United States Patent 9,328,346 (POLYCOMB-ASSOCIATED NON-CODING RNAS) - sequence listing, part 160

SEQ ID NO: 192969 - RNA, 306721 nt, Homo sapiens
cuccgggcagagcgcguguggcggccgagcacaugggcccgcgggccgggcgggcucggggcggccgggacgaggaggggcgacgacgagcugcgagcaaagaugugccccgggacccccggcaccuuccaguggauuuccuugcggaaaggauguuggcggucccugugaccuguggagacacggccagaucugcccuccaguaaguuccaauuuuguccccugcguuucuggaaacucucgagacuuggcccugaguagggaugcgcugugaguagucggacggaggaaaggggcuuucggaauccaauaugugugugcuaggcgugcacuguccucaucaccagccucaagacugguggcgaguuugggcguuuggggagggugaggggagggggaugacaccgaauggccggugcauagaggcaauucuggauuuaugaacuugaucaaaggcauauuaacuaauuucuaaaaauagaccccucugcagucagaacagauuuggagccaugaugugguuuggaggccccucuggcgaaacuagaggucugugaaugugugauccucccuccauccuuugaccaucacuccccgcuuccucucacacccccucagggcugggcgaaggugauuuccaaaaacucaguaacuccguguuuugagacuuucucaguuuuugcaucgcaugugaggguuuguugggugcuccuaaacccucaucauggucauucuucuuggcugggcuguugauuuaauuagguuugccuucucuugcuaacgugcucuuauuuaugccaguguuugugguucuggguguagacuuucaggaagcacagccaugaagcugcaugcgucuguguguggaugccucaugccuuuuccuggugguuugcaggcauggaagauucuucuguucaucuaagcuccugacuuuaggcccuucuagaacauuagagaggagaagaaaucacgugcaaggauuuagggacaagaggaugagguuuugguguuuccuuucugguauuagguuuuccagagagaggcuguuagccugucucucgcccacuccaccacugugaauccuggcuacuggggcuaguuccuugcuaggaaaaaaaaacucuagagaaauguguuuguguguggugggugggcgggggcccugaggaugcagggacugugucugcuguguugucuguuauaagauguuucagaccuauuuugcauacuggcagcgacaaguugagacuuguucaacuugacacaguccuguggucauagcgaaucuuucuaaagcucugaucagucaagaaggggguuguaucaauccucagaacccugaguggaacuuucuacaggauuuauuaggagaaaaaccuucccggaagcugcagaaggacaaauacagaauccgugucugggagaaaccucguggccuggucuccauuauuugagaugaguuacaucuuggaggugaggacgugccucguggucuaaagcuucggcacaagggcccaacuggaauuccacuuacggguaugacugugggguauaugcuguacccauugaauucccagagggauuuguuaagugguuguguugcuguuuugccugguuaagaguggcuuauucuuguugccucaucuaucuugagugcagaauuuuugcauaaacggcuucucuugaaaaauagaaguccguuuuuguuuuguuuuguuuuuuuucugauuaacuuuccuuuuccucugucuuaaacaccuucccccgccccucgccaccuccaugcuguguuucuguggcuggagcuuuucugcacuggaaaggaggaguucuccccucuguucugacauaucugauccccacuaguuuauaugauugcuggucugaaaaccuggugaauucucacugcccacaucaaaucaauucccuguucuuuaguuguuuuuuuuuuccgccuccugagcgguaggcaggcacucuggcuggauucuggagccuguguuugccaugccugggccuucugccugcccaagauggacacguuucucuggcagcuuugucaagagaucuccuggacuauaagacacccuguucuuuccuccuguuugugugaguggcccugcauuugggcagaguauuggcagaauaucugggggaaguggaagacuuuggauaguugccgguccaggucgucuggagaggcaguggcaggccugcugauggcugccccuuugcuauuuguuuuauaucagguggcccuucuggauguguggccuuuuuauuuugcauuuccuuucauaguuggcugcagacauaagauucuucuuuuucucuuguuuugcuuuuuuuuuuuuuuuuuugagacagaguuucacucuuguugcccaggcuggaguaaaauggcuggauuucagcucacugcaacuuccgccucccagguucaagcgauucuccugccucagccucccaaguagcuaggauuacaggcaugcaucaccacacccagcuaauuuuguauuuuuaguagagacggaguuucuccagauuggucaggcuggucuugaacucccagccucaggugauccgcccgccuuggccucccaaaaugcugggaggccucccaaguugcugggauuacaggcauggaccaccaugccuggcuaauuuuguauuuuuaguagagacggaguuucuccagauuggucaagcuggucucgaacaucugaccucaggugaucugcccuccucggccucccaaaguacugggauuacaggugccacaguacccggccuuguuuugcuuuuuauuguuuccugaugcagguuugugaucucuuugagggaucaggaccacaccccccaccccaauuuauauucccaguguccauggugggacccugacugaggaugggaacagagcaacaaucuggaaucauuuggaccauugaguccuguggacagucacuucaauaucaucccuagagagucucagaaauucaaggccuuuuggaaugcugccaaaauggguccuuuggcaggagcccccuuugucucuucuguuuucugaccucaaauaaucuaaggaacuaauaacgguaauaaauaacaauuaauaauaagaacaauaauagugcauguauaacauggacauuguuuaucacgcaaagcauguucuucaccuucuacucccuacaacuccaugaggcauuuauaaugaaaugucuagcaaugguagacuucuuguuguggggcaggguugguucuaacacuucaaauuauaugaucucauuuaacuuuccuauaaaauaggaugauuauuguugugguuuugcagaugaggaacccacagcccagagagguuaaaaauauccucccaggucacacagcuugggagaggcagagcuguagagauuuggaccacagucuucgacuucuuagugugacucucagaaguuagaggauaaugagguuaagaacaagcaaagggccgggcgcgguggcucacaccuguaaucccagcacuuugggaggcugaggcagguggaucaccugaggucaggaguucgagaccagccuggccaacauggugaaacccggucucuacuacaaauacaaaaaauuagccgggcaugguggcgcacacuuguaauuccagcuacuugggagucugaggcaggagaauugcuugaacccgggaggcggagguugccgggagccgagaucgcaccauuguauuccagccugggcaacaagagcaaaacucagucucaaaaaaaaaacaacaagaaaaggguauaccccuuggccuugagcaggagaacacagugugucccccacccucaccgugcaccuuaggcacaaacagaaagcugaacaucuugcaugaagauaccucaugcucugccugccgaccuuuucugcagccacggagcagucagagacaaaggggccaagaggccuuaggugagggcugccaugcuggaaaguuugggcugugggugugggcaggagucauggguagaggucagaacccuuagucuuggcugggugcaguagcucacacccguaaucccagcacuuugggaggcugaggccgguagauuaccugaggucaggaguucaagaccagccuggccagcauggugaaacccugucucuacuaaaaauacaaaaaaaaaaaaaaaaaaaaaauuagcccggcgugguggcacacgccuguaguccuagcuacucgggaggcugagguaggaagaucucuugaacccgggagacggaguuugcagugagcugagauugccagugcacuccugccugggagauagaguaagacuuugucucaaaaaacaaacaaccgccucggucuuugugcaaaaucuauaaucauuugcaagaggcugcaaucagguauagcacuggauuuugugaccaaaacuagguuucaggauuuaauuaaaaacaaaaacaaugucaggucauaaaacacaagacauauacaugauguggaaauggucuuauucauuuuuuaauugcgaaauuccgaacuaucuguuuuuuuuuuccuuuaucuuuuccuuuuuguguguguguggaguuagguggggggggagguauggcauauuguuuuguuuaucugccucuuuauuaucacugacugugaaauucuugagaacaggggcgucuaagugcccaacacagcccugguacuuuguugaaucagguggcugucaagagcugcugcuucagcccggcaugguggcuuaugccuauaauuuuugcacuuugagaggcugaggcaggaggauugcuugagcugagaaguuugagaccagccugggcagcagagugagacucugucucuguaaaaaauaauaaaauaaaaauuaaaaaauaaagaaagaacugcuuugucuucaaggaaacaagauacacagucaacagucauuaucuuuuuagauaugagacagcuugacaugguguggaaguggggggcuugccuguagggaaaguaugcugaugaaaaagaaggaaaacagacaguagcaggaggcaguggggaugugucagggagcugaggaguguagaucugguuacuuuugggcaaguuacuucucuaagcuucaguuuccucaucuauaaaaugguuugcugugaugacgaaagagaugaugaacagaaugugucuggcagaggaccugggcucauaagugagcacacaguaaaagguagcuaauaucauuacuguuccaauuauugagcuuuauuacuuccuguggcugcaugaaguagugguuucugaauagaaaggcaacauucuaguugccuagaucuuaagauggcagugacuucacuguaguucucugcaagcaucagaaacaagcccuggcuuauguaaguuagaaacagaugagaaaguaaauaaagcugcagaagugggucucaggaaggacaggaaucaaagggcugucccucggaugucagacugccuuugcaaguuacuucaggucacugugccuccauuuccucagcugcugagcaggggaggagaaucacuucucccucccugggauggugcagagcacuuagcagagcacuuagcacagaggaauaagcccuucaguaaaacauuugaguaaagcaauuauuauuuauuauucuucagggcucuuuuuuuuucuggugcauuagcccuaacauugacuacuugguucaagagugauggaugcauucauuuccugagcaguugcuguaugccuggcaccguuuuagcugcuggcgauccagcagggagcagaagagacaaaaaucccugcccuccugaagcuucuguccuaguggaugucacacaguaguggggcaggcugguccccagagacagcugggggacagauggaggcagugcaggcaaaagcuaacuccugugcaaagucuccccggccccacuguguuaacaguaaagugcuuagcagaggcucccacacauaguaguuacuauguagugguaguugcuauguuuauuauuauuauauuauucuccucccucauaaaauggcagccucccuuucuuccauuccccuuccugaguuauuuuuucucgauagggcuuaucuuccuaguauaccauaugucucucuucucccacuaaauuguaacccauucauuuuuccaggauauauuuguugggugucuacucugugccuggcauugcuguagauguuggggaugcagaaaggaagaaaaaggacagauuuccaugcuagagcuuagguuacagcuggguuagacagauaaggaacagcagacauaauaaagaaggacaugaauuguguauucaagauuaugaagugcugugggaacaggccuagcagggucagugucuggagggcuggggcguggugcugugugguuaaguuguccggucagagucagggcaggcuccauggaggagcugacguuaaccuccaccugaaguaggggaaggacaggcguuucaggcucugggaagagcuaggacagagguggaggcagaagugagccugugggggugaggagcagccaggagaagcgugagaugagaauggcgugagcaagggagguaggagaacccgagcagcaugcagugugcagccucacagagagccugcagggcauuccaaagauucugucuuuuacucuguaaaauggggagcccuugcgguguuuuuuguuuuuguuuuuuguuuguuaugaggcagagucuugcucuguugcccaggcuggagugcaguggggagaucuugguucacugcaaccucugccuccuggguuuaagcaauccuuacaccucagccuccugaguagcugggauuacaggugcgugccaccacgccuggcuaauguuuuuauuuuuguagagaugggguuucaccauguuggccaggcaggucucaaacuccugaacucaagugauccacccaccucagccucccaaaguguugggauuacaggugugaaccacugugacuggcuuccuugcaguguucuaaaaaggaaaguaauuugaucugacuuggcuuuugaaacggucagucuggcugcuguguugagaagaaacuaaaucagggucaggagcuagagcaccaggacaaacaugcacagagcguuaagugccagguccaggcuggcagugguggauggggccacaggaauggacuucuaggcuguucacuguuguauccccagcaucuuaaacugugcucuccauaugguagcugugagcccuauguggguauugagcacuugaaaggaaauugauauguacuguguguuaaacacacauuggauuucagagacuuagugagaagaguaagauaucucauuauuuauuuauuuauuuauuuauuuauuuauuuauuuauuuacugagacagagucucaccuguugcccagccuggagugcaguggcaugaucucggcucauugcaacuuccgccucccggguucaagcgauucuccugccucagccucccaaguagcugggauuacaggugcccaccaccacaccuggcuaauuuuguauuuuuaguagauaugggguuucacuauguuggccaggcuggucuugaacuucugaccucaggugauccaucccacucagcuuuccaaagugcuggaauuacaggugugagccacugcaccaggccuauuuguuuauuuauaugagacacggucucacucugucacccaggcuggaaugcagugauguguucauagaucauuauagccucgaccucccaggcucaggugauccucccaccucagccuccugggcagcugggaccacaggucugugucaccacgcccagcuaauuuuuuuguauuuuugguaaagcuggggucucccuguguugcccaggcuggucuugagcuccugggcuccagcaaucugccuuccucagccuccuauaguucuaggguuacaggcgugagccacugcacccugccaaguuaucucaugaaccaauucuuugauguuaauuacauauugaacugauaauguuuuggauauauuggguuaaauuauuaaaauuaauuucaucuguuuuuucuaacuuuauggcuacuagaaaaucuaaaauuacauguggguugaaucauauuuucgcuggauggaacaaugccuuggacgaggucagcauuuagugaaucaaaugugugggugaggcacagguguucugccgugaaugagaaaccguugccaucuucgggaaguuuccagugugggagggaggcacacugcagauguaacugcuaggagagaaagaaggcagguugaaaugggaccacagccaaccaggccugcuguagcccagaagcuggaagagacucgcccaggagggaaggaagacacugggguguugggucucagucugggucuuggugacagcagugggcuggcagugcagagguucaaggccuuggacugcaaguccacuaagguggcuggugguguggguggagguggaaaaggcagguggggcgagggugaggggcaggacauccuggagagccugaauaaccagguauaagugauuucuuuuucuuucuuucuuucuuuuuuuuuuuuuuuuuuuuuaagacggagucuccuucugucgcccaggcuggagugcaguggcgagaucucggcucacugcaagcuccgccucccggguucacgccauucuccugccucagccucccgaguagcugggacuacaggcacccgcccaccacgcccggcuaaguuuuuguauuuuuaguagagacgagguuucaccauguuagccaggaugguuucgaucuccugaccucgugauccgcccgccuuggccucccaaagugcugggauuacaggcgugagccgccgcgcccagccccaggcggaaauuauuucaacuggguccugagaacugggcacuuuucaaggauugucagcaaggagcaacuucccaaauauacaucuaaaaagaugacaaacucauguggaauguggauuuaaggaggaagguacuugacuuaagaauuccaggauuuugguggaagaaggaaauaugggccaggcacuguggcuuaugccuguaaucccaucacuuugggagauagaggugggaggauuaguugagcccaucugagaccagccugggcaacauagugagauccugucucuacaguuuuuuuuuuuuuuugagacggaaucuugcucugucaucaaggcuggagugcaguggugagaucucagcucacugcaaccuccgccuccuggguucaagcgauucuccugccucagccuuccgaguagcuggaguuacagccuugugccaccaugcuuggcuaauuuuuguauuuuuagcagagacgggguuucaccauguuggucaggcugaucucgaacuccugaccuugugaucugccugccucggccucccaaagugcugggauuacaggcaugagccacugcaccuggccucaaaaauucuuauuuuuaauuaacugggcuugguggcauguaccuguaguuccaucuuugguggcacgcaccuguauucccaucuacuugggaggcugaggcaggaagcuugcucgaacccagaaguuugaggcugcagugaguuaugauuacaccacuguacuccagucugggugacagaaugagacccugucucuaaaauaaauaaauaaauuuuuaaaagcugggaggugggguugguaaauucauaaaaaauaauauuucuugaguugaauacaaacaauacaaucacuguuuuuucuuugccuuguuuuauuuuuacuuauuuauuuauuuuugcagacauugggccucacuccuaggcuggucuuuaacucccggcuucaagugacccucccacuuuggccucccaaaguguugagauuacaggugugagccacugugcccaggcugugguuuuuuauuuuuuaauuuuuuauuuuuuuguauuauaaucauaguguauauguugcauccugauuuuuuuuuuuuuuuuuuuugagacagcaucucauucuguuauccaggcuggagugcaguggcacaaucucagcucacugcaaccucuaccucccagguucaagcgauucuucugccuuggccuccgaguagcugggaugccaccgugcccggcuaaauuuuuuuucuuucuuucuuuuucuuuuuuuuuuuguauuuuuaguucagacaggguuucaccauguuggccaggcuggucuugaacuccugaccucaagugaucccaccucggcuucccaaagugcugggauuacagcgugagccaccacaucuggacacauccugauuuuuuucuuaguugcuauuaggacacaggcauuuuugaauauuauaugcacuuuguccaugucuuuuuuuuuuuuuuuuuuuugagacggaguuucacucuuguugcccaggcuggagggcaauggcgcgaucucggcucacugcaaccucugccucccggguucaagugauucuccugccucagccuccuggguagcuggcauuacaggcgcucaccaccacgcccggcuaauuuuguguuuuuaguagagacgggguuucuccacguuggucaggcuggucucgaacuccugaccucaggugauccacccgccuuggccucccaaagugcugggauuacaggagugagccacugugcccagccguccaugucauuuuuauuggguagauauuucuguucagugacuguuucguugcuuacuuuaucauuccuuugauuuggaugcuuagcuucauaacagccuguuuauauagauuauguuuucuauuuuucaguuaauuaaaaaaaaaacaaauucucaguccuaggauuauugugcauaaugucugaauuuuuuagaauuucagguaaauauugugguucaugagauuugcacagaagcugaauuugcugcuuucuggugaggcacgugauguuuuuugcuguccgugaugcacuaacaugucauuaacauguauguacaguguuauaugcucgcacauguuuaugugcagccuaugcaccuguauuggauuuuucuucacucucauuuauuggcagguauuuguggaaugccuguggugugccaaguucugcuugaggccuuggguauucaguagugaucaaaguagaucaacuaguaccaguucuuaagaggcuuauuguuaagugggggaaacaagcaaauagacaaagaaaaaauaacauuauuguaaggaauaugaaauaauauguacuagaauaauaugaagggaugguuauugugagguaaggggguucauacugaaauacugucugaggaaucaggauuugagugagacacgaagacucaguagaaguuaaccagaagaacaaaguguuagcagaaaagacaagauugaucaauaugacuacauauuaaagaaaaaggcacaucuaagcaacaaaaacugcaaugguauuaaaagccaaauacaagacuuagaagauauuugcaauauuuauaacacauuacaaaacacuaauaucuagaauguaugcagaauucccaaaagucaacaacaaaaagacaaacagccuuauagcaaagugggugaaagauaggaccaugcagugcucauagaaagcaaaguagauggcugggcaccguggcucaugccuauaaucccagcacuuuggaaggcugaggcgggcggaucacaaggucaggcguucgagaccauccuggccaacaugguaaaaccucauuucuacuaaaaauacaaaaauuagcugggugugguggcgugugccuguagucccagcuacuugggaggcugaggcaggagaaucgcuugaaccugggaggcauagguugcagugaacccagaucuugccacugcaugccagccuggacacagagaacgacuccgucuaaaaaauuaaaaaaaaaagcaaaguggaugauaaaugugaaaagauucugaauuuugcuaacaaagucagguuuuggagaucuaauuucuagucaguaaaauucauccuuucuaggauacaaugcuaagaguuuugauaaaugcauagaacuguguuacacuguuguguaauuaccacaaucauggcuuagaacauuuccaucguucacccagauucccuccugucccuucacagccagucuccuucuccacccccagcuuuaaccaaccccugaguuguuugcugaccuuacaguguugccuuuuucagaguguccuauaaauggauucauacaguguguagucucucggauuugucuucuuucaccuggcauaaugcauucgggacccuuccauguuguucuaugcaucagggguuugguaguuuuuauugcugacugggacucuguuguauggauauaccacuguuuguuuaucuguucuccauuugaagagcaucuggguguuuccacaagauacauguuucaugcuuuacaacgugccagaaauaggaugucugacucaaguguugacaaggcacaggguguucagcagcuccgcuagugagugugugaggucacuuuagagaccaccuugccagcagguagugaaauuggaaacaugugcagccccguuccuagguaagauugagaauucacaguucgugcuguauguuacuuaaggauauuuagagaugaaagugaagguuuaaaaaaugggcuggaaagaucuauaucaaacucacugucaucaucuggggagagaaggggagugggcugauugugaaggucaaagccuacuuuaacuuugccuuuauugcuuuuuuuaaauucaauuaauuaauuuacuuguggggacagaaucucacucugucaagguugcuggagugugaguggugugaucguggcucacugcagccucuacuuuccaggcucaagugauucuccugccucagccuccggaguagcugggacuacaggugugagccaccaugccuguauuuuuuguagagaugagaucucacuauauugcccaggcuggucuugaacuccuggccucaagccauccuccugcccaguucucccaaagugcugggauuacagggaggacccagugucuggccuaucuuuaaugcuuuuuuugaaaagaagguggauaccuacacauaucacuuacacaguuugaaaauauguagaaaagaaaaaaaguuugaaaauacauaugacaagauguucaugguugucaauucuagguucuuugaauuuuucuuuuuuucuuuuuuuuuuugagacggagucucgcucugucacccaggcugggagugcaguggcgccaucucggcucaccgcaagcuccgccucccagguucacgccauucuccugccucagccucccgaguagcugggacuacagaugccugcuaccacgcccgguuaauuguuuuguauuuuuaguagagacgggguuucacuguguuagccaggauggucucgaucuccugaccucaugagccacccgccucagccucccacaguguuaggauuacagacgugagccaccgggcccggcugagacagucuugcucugucacccaggcuggaauguagugaagcaaucucgguucacugcaaccuccaccuccuggguucaagcaauucugguuccucagccucccgaguauuugggacuucaggcacaacccccgucuggcuaauuuuuguauuuuuuuuaguagagacaggguuucaccauguuggccaggcuggucucaaacuccugaccucuggugaucuaccugccucagccucccaaagugcugggauuacaggcgugagccacggcguccagccuguucuuuaaauuucuuucaaaacaguuuagggaagggauauccuagguaaagauaauagcaugugugaaggcccugaggcugcaaaacuuuugguguguucagagugucaaaagauucguguggcuggaaaggagugaacguccaggguccagaugaacagguguuuggucauggagggccuuaagugcuuuuuuaagucuuuggggguggcuaagcugggugguuccugauuugauugaccuuuuuguuggguagaugguggaucaacggaagcagguggcccauuuggggacugaauuacagcaauccaagagagagcuggacucggcucuagcaguggagaggaagagaagaggaugaguuugguauuuauuuuggagacagaaaggacuucuugggaccaggcgugguggcucaugccuguaaucccagcacuuuggcaggcugaggcgggcagaucacuugaggucaggaguucaggaccagccuggccaacauggugaaaccccaucucuacuaaaaauacaaaaauuagccaggagugguggcaggugccuguaauccgagcuacuugggaagcugaggcaggaaaauagcuugaacccgggaggcggagguugcagugagcugagauugagccauuguauuccagccugggcaacaaagugagauuccaucucaaaaaaaaaaaaaaaaaaaaaaaaaagaaagaaaaaaaagaaaaagaaaaggacuucuuggagggcaaaguuugagggaagaguuagcuagcuagagaccuuccaaacugugcucaggcauuuggauuuuacccugugggugauagggaacuauugaaaguuuucauuuuuuucuuuuuggagacagagucuugcucuguugcuucaggcaggagugcagugagccauaguggcucauugcagccuggacccccugugcucaagcaauccucccaccucagccuccagaguagcugggacuacaggugcauggcaccacccccagcuaauguuuuguuuuuaauuuuuuauaaagauagggucucacuuuguuguccaggcuuaaaacuccuggcuuuaagcgauccucccaucuugaccucccaaaguguuggaauuacaggaaugagccaucaugcucggcucuauggaagguuuugagguggggcagggaugagauuagagugaugugccuuugccagagagauuuguccagaggaagggugaccagccuggagucucuuuggaauguucuagguaauguagcagagauugugucaguuacccucuggugggaugcuuggcuuuucccauuuuuucaaaaggaaaugggaaaaggaaaagguccucuguauggaaaguccccaggaauuuauaggagaguggcuaacgaagacagaguucccuuccggcauuuauugugacugaguuuguuccauaguuuuagucccacuuaggucaugauucaucccacugggccagcagcagcauugggaucacgucagccaaucuucgcacuuagagauuuugaagagagauaucuccuauccaugugguacauugcuuuucacaaaacaaaagaguucauuuugucggugaaaagcccuggccagacccagccgguggagaccaguagcuuccucuggcaggcugggcuuccuauggucauugcagucccuccccauuuauaaggcugccuucccugagaacaccugggacagaugccccccagaagcaugcccucuggaaagggagaggagcaggagggggcuucaggcaugcugggccuggggggccacccccuggccuuugcuaaguuccuggcuggucugagcccucuucuuuccucuccccaggccuugcaaaggccauaucucuuccuuuucaugacucuggaaauuccauacauacuuucugcauuaggaagacauucucugcaugcugaucucguuaaaaaggaaaagccaaggagcauccugcaccucccuccuguaagcgagcuuugcaaaugguaaacuagauccugaaaggcaaccacuuaaaagcuuuuaauggcuucccauuauuagcuugagugccuggugcgucagaggcucucagugagcguguauugaauugcugaaugcaugguggcccugggcgaggaaucuggcccucacugucccaaggcugagugccuuugcccuguggaggaaagcacugccuuggggucagaaauaaggauuggcaggauugccugggguuagaaauagugaucaugggaucagaggcagcaggugaauguggggugugaauauuuuugaaggcuuggaaugaaaugauucuuccagacuuuagaggauuugugucugcagauucuucucuaagguuugugucucacauagugagagaaucagccagccagggaaaugggacaggauuuugucucuuuccccauuuccucuucuaaugaacuccuaccuaugcuuuaugacugcauuaaggggucaccuccuccaggaagcauucccucaucuccuuacgcugguucugagugugucguuccugcuugauccccucccagcaccaugugugugaguucucacagcucacaccccauaguauuacuauguuguuucuacaguggguuccugucagggguuccaaacuuagcuguuuaggaggaugaguagauuguacaaccacaccaggcgggccugaucaaauacaguaagaaguguccggauuggcaaaccagcgggucccucuucuagauguuaucagagagauacuguuagagagagguugcuagauguuaauagaggcugcuguuagauuccagcucccuccuccccuggucccuuuucucuccucaugccaaaagauagacccaguguugccagagcuuccacuuuuaaaagagaagccuuuuaaaauauaaacucuccugauuuuuaaauguuuucaguuaaguuuuuaaaggaacauucauaggccaaaccaaauaccugugggccguauguggcccccggggccagcaguuugcagcuccuugguuauaggugccucuaacccauugcacaagcucccucaggcauuucaugucuuuccuuuccauucccccugggccuagcagggagcuggcaugucacagugggugcucccuaauuauugguuauugacuugaaugcuagacugagcaagcaccucccugcucacaggguguuaacauuuuucccucagaacuguuuguauguaaugcuauucugaauugcuucaguuccuuacauacuuuagugauagucuguaugugccuggaaaagucaucauuccuuagauucuagacaacucuguucuucuguucuuuuccuuuuuccuuucucucuccguccccucaacauauguuuuuguuuuuuguuuuuugccaguucuuuuguaucuggccgguuaacacagggcuucauaacauggggucggcuguuauuaagcaacagugguuuccgguagcucacugacuuugcccucucugcugguaagccauugcugauuuccaucaggguaacaagcaugauuuucagauuuaccuucauuugcagugaacaauuauagcaaaauugcuuaaagaaaugaaccuucagguguggcggcucgugccuguaaucccagcacuuugggaggccgaggcgggaggaucacuugagcccaggaggucucuaggcugcaguaagcuguaguugcaccacugcacuccagccugggugacagggugagacaucgucucaaaagaaaagaaaggaaaagaaaagaaaagaaaaggaggggaggagaggggaggggaggggaagagggagagagggagggagggagggacggaggaaggaggaaaggcaggaaggcaggaaggcaggaaggaaggaaggcaggaaggcaggaaggcaggaaggaaggaaggaaggaaggaagagaaugaaaggcugggcgugguagcucuugccuguuguaguccuggcacuuugggaggcugagaugggaggaauuggaaaccagccugggcaacauaaugagacuucaucucuacaaaacaaauuuuuuuuuaauuagccaguggcaugcaccuguggucccaggaggccaaagcuggaggauugcuugaggaugggaaguugaggcugcagugaccuauguucccaccacuguacuccagccagagucacagaacaagaccuugucaaaaaaagaaaagaaagaaaaggagagagggagggaaggaaggaagaaaaaaaagaaggaaagggagagaggaaggaaggaaggaagggaagggaagggaaggaagggagggaagggaggaagguaggaaaauggaaggaagggagggaaggagggaagaaaagaaagaaggaaggaaaaaaccggucggcuaucuugacgaaaaaagucucaguccacuccauuuugugcagcauuucccgucuuguuaucuuucuggaaaaacucaguaagucucuggcugggaauuauagaagcuuaauaugcacuuguaacugugucaggcucucacagggaacaaacaagaggaacuauagauuuuuauagucugcaagagcccaguccaugcauuuaggaggcacagagugagagaaagagcauugacaaugauaauauagcauuaauauagguacaaucuggaguaauguuaucuaguacuacuaauagcgauauuaaaauggcauuauauagauauuaagcccugacuucgugccgguuugaacuuuuccuguauuaauucaugugaaucaauuuugagacucugucucaaaaaaaauauauguauauaauauauacaaauauauauaauauauacaaauauauauaauauacaaauauauauauauaauauauacaaauauauaauauacaaauauauauaauauauacaaauauauauauauaauauauagaugucauggugaugggaagacugggggaggagaggagcaguuuaaucccaggaucccauggagaggaaacuuguaggucucuuacccagugucuucuccugcucucuggcucugauuucugaacuaagaaaagugugcaaacaucaucugcucuccugguuguauuuguaaaugccuccccuagacccagcucuacuuuaggccacgugagugacagugaccacaucagucagggauucuccuacugucccugacccauguccgcuuuugucuccucccacucuaauaacagaccguguggcuugaaccucagcccugcugccaaguagcugugugagcuucagagccuggugccucaguucccucaucuguaaaaugggaauacaaauggucccuguguguuuggguauucaagaaaauuaagugaguugcugcacaccucaccucuggcuccuucaacaaaaacauggucacccucaaaccaaacgugaacaggaggguggugacgcaaaccacauggaaacgagaggcagacccaggcuggagugcaauugcacgaucucggcucacugcacccucugccuuccagguucaagcaauucuucugccucagccuucugaguagcugggauuacaggcaccugcugccaagucuggcuaauuuuuguauuuuuaauagagacgggguuucgcuauguuggccaggcuggucucgaacuccugaucucaggugauccacccgccuugaccucccaaagugcugggauuacaggcaugaaccaccgcccccggccgcagaugggaaauuauuuuugcacuuucaguuguccuaaaucuagaguuuuccuuuauccagacagcuggugaaaguggacgugagaauagagagauuuccugguggggaagaccuccauccuccuucuccagccccuuccucauuauucccaagaaaagagcuucuggguuucugggagaggcugagcagguggagacaccugggccauaucugggucucuccagaauccaggagccugccugacgcgucagccggggaggguuucugugugaagucggcuugagugagccagccuuucaugcauccuugucuuuauuucuuccccagcucaggaggggcugaguugugucuuaaugagcaguuccagcugcacgcugggcaucuccuaauuuacucucauuuauuuagcuccugcugcaugcugggcaaugcucuaagugcucugcagguuuuggcuaauuuaaucucccuagcaaacccuuugaggggacugacaggaugaccauccucauuuuacagauguugggauugaggcacagacaguuuauuuuuaauuuuuauguguaaaauguuuuuacugugguaaaauuuacauaauaaaauuugccauuguaaccauuucuaacuguacaauucaguggcauuaaggccauugguauuguuguguaaccaucaccgcuaaucuaaccaucuccggaacauuuuucaucauuccaaacugaaacucugcacucauuaaacacuuacucuccucucccccuccccucauccccugguauccacaguuucuaugaaucuaacuacccuaagcauccguauagguggaaucauaguauucauccuuuugugacuggcucauuacacuugguguaaacuuuuuuuuauuuuuuauuuuuuuuugagacagaaucuuguucuguugcccaggcuggagugcaguggcacaauuucagcucaccacaaccucugccucccaauucaagagauucuccugccucagccucccuaguagcugggauuauagucgugcaccaccacgcguggcuaauuuuuguauuuuuuaguagagacggggcuucgccauguuggccaggcuggucucaaacuccugaccucaggugauccacccuccucggccucccuaagugcugggauuacaggcaugagccaccgugccccaccuuaguguaaucuuucaaagguauaucuccguuguagccugugucacaauuuuaugcccuuuuaagacugaaugaguuuuuaaauucauucccauuuaacucuuuguuuuguugccugugcuuuuggugugaggcacagacauuuuaagaaacuuagccaaggccauucaaccagaaguggcagagccuggaucuugaccacauggcuuugcugcucccagagucuugacccugugcuggggcugacuucugcuuuuacaugaguucuugucagugcuuucggcagcuugaucagguagaugcugcuuuuccacuuugcaaauauggaagggagcacccagcucucuugggcauggcagaaauucaucaggggcggaggaggcacaggguacccacccaaaaaaucccaacauauugaaucaccuuccaauaaucuauagcaucauuuauguuaugcugcccacaacauaaauggcuagcaaauaauuuggaugcgacagaauuggugaaugaauuuaauguagcuucaaccugaagaccauuauacacuauuaauaccuacaaaauuauagauguaaggcugggugugguggcucaugccuguaauuccagcacuuugggaggccaaggugggcagauaaugaguucaggaguucgagaccagccuggccaacauagugaaaccccgucucuacuaaaaauacaaaaauuagcugggcuugguggcacaugccuguagucccagcuacucagcaggcugagggaggagaaucucuugaacccgggaggcggagguuauggugagcugagaucacgccacugcacuccagccuaggcaacagagugagacuccgucucaacacaaacaaaauuauagaugucaccuacaggccaguugggaggcauauugguaaguaaauacccaugaccucuccacccugccuaggauccaaacuaugaacacugaugguugacucuaacuccauauucuuuucaguuuucucccaugccuacccccugcccccgagcauucucccucauugguggcccugauuuucuuuuuguugagauaggaucucacuauguugcccaggcuggucccaaacuccugggcucgagagauccucuuaucucggccucucaaaguguugagauuacaggcgugagccgcuaugccaggccaacucuuaucuugaauguugauguuuaucaugucauggaugaaaaaaaaaaaacccaugcguauucuuuuuuuuuucuuuuuuuuuugagaugguguuucgcucuugucacccaggauggggauggagugcaauagcaugaucucggcuaacuguaaccuccaccuccuggguucaagcgauucuccugccucagucuccugaguagcugggauuacgggcacucgccaccaugccuggcuaauuuuuguauuuuuaguagagaugagguuucaccauguuggccaggcuggucuugaacaccugaccucaggugauccacccgccucggccucccguuuguauucuuaaauaguguauuguuuccuuuacuuccuuuagagcuuuacagaaauuccaugcugccuucagcuuccuuugccgcucugcaucauguugguaagucucugcugaugccugcugcuguagcuuauuuuucacugugauaaucuguuccauugugugaacugaccacaguugauugaucuguucuccaaggacaugugaguuguucgcagguguccccccacccccucccgauacaaacagugcugcuguggacauuucauacaucugguugccuaugucagaauuuccaggguauacagcuaggacgcaguacugcuguuggauuuuccugggauuguagacucucaaauuuggaauggacuucuauggccaaguaguucaccuucagcaaucaucucaaaagaaaugcucuuggugugaugguugagagcgcuguucuggaauaggagagacacagaccugcugggccuuugccucauuuuauuacuuaguucauuaugcaaugaacuuaacaucugucuaccucaguaguuucccugucugugaauugagucuguuacauauauauauaucuauuuaaauauauauaucuauuuaauauauauuaaauaauauauauuuaaauagauauauauauauuacagacucaauuuaacccuuagggaaauauauauauauauauguguguguguguguguauauacauauauauuuaaauagauauaucuauuuaaauauauauauauauauauacacacacacacacauauauauauauauuucccuaaggguuaaauaagauagagaccugguaugguggcucaugccuguaauuccagcacuuugggaggcugaggcaggagagucacuugagcucaggagugggaaaccagccugggcaacauaguuggacccugucucuacaaaaaugaaaaauaaaaaaaaaaaaauuagcugggugugguggcaugugccugcagucccagcuacuagaggcugagaugggagaauugcuugagccugggaggucgaugcugcagugagcugcaacagagugacaccuugucucagaaaaaauagagagagaaagauccggcauguguagagauuaacucggagccuggaaauaauaaacacagaguaagugcucccugcuguucgccuuguuccuguugguguuuaaagaucacuuacacuugcagaggcagaacugaugcccaggagaggggcaguaacuagcagaagggaaacagcccggguccaguuuacuuccccucaacgugggccaaggacgccaggcaggaucauaguccggcuggauuguggcuuuccucaaggugaucuugacuugcccaggugggauuucacccccacuuccuuccaggcuucccauuuuagacuugaaauguaggccuguuggggccuccuccaguagaugugugcccuugagcuuggauaccccccugccaagauacgccuuucaaaaacagauaaacuuaucgcaacugaauagaaggggcucccaaggggucccacccugcuccggaagucucagugaggaaucaauagcuguuaauuccugugcugcccccugccugacauuccauccacacuugaggcccagauuguaagaagggagagcaggcaggucucucuuccaggagagggacccgguucaucagcaggauuuauucauucauguauuacgucaggcucagcgccugggcuuuuuauaaaugagggcucugcuggcguucuguguuauucagauauucggugagagaccaccagaagccacaaaaaauugcugacaucuguuggaaggcaaucaugcauaauggauaagggugcacucugcaguuccagcagcauugauuugaauucccccucugccgcuucaaaacucugagaucucagcgaguugcuuacccucuagagccuccacguccucaucuauaaaacuagaaaauaagugguacucacuagauccuuaccuuguugugagaguagaaugacgugcauguagagcuuucccagagcuggcaugugguaggugcucaauaaacgcugguuauucucucucucucucucacucuguugccuaggcuggagugcaguggcgugaucauagcucacaacagccucugucugccaggcucaagggauacuccugccucagccuccugaguagcugggacuugcaggcaagugcuaccgcuccuagcuaauuuguuuuauucuuaguacagauggggucuugcuauguggucccugcuggagugcugguugcucucuaacuggcugcgagccccgggguaggcacacugguacuggggcuauagcaaaauccgugcucgguaaaucaucauugaaggagcaagggugcuuuacaguuguagaaucucauaguacacguuacuuugguuuuucucuucccagcucuggaguccugggauccaagugugagccccaugucugcaaaaugaggcuagucacuugaauccucuuggaucuugcuuuccucaucuguuagugagcuuguagauagcucugacugucaccaggcuuugcucugagcacucugcaucuguauucaaccuguauacuuaaucuucacaacaguugaggugguugauccauaguaauuucucguuguacaaacggagaaacugaggcagagagauaagugucuucccaagguuaacagcuaaccaguagcagggcacgcugggauuugaaagacucucuauguguccuaacugguaugcucuccugucuagaggugaucucuuccuccaggguuccagguagauugguugagaugugcaaugcggaagagccucgggauaagucggcuaaugacacccucaggcuacccagcccucgggagcucacagcagagcaguuggggaugccuugcaagguuaccugugccagaguuccugggguacauauuaaauagguaggacccaauacuacuuugcauuuuccuggaauccuagacucuuaacauuggaaaggauuucuuugccaaguaauucgcccucaucauuaaccucuaagaaaugcagagguggaauuagaaggugcgugucucuuucuuuugcaccacagauucuaucgagucucaucuggcagcuucaaggaucauccgcauucuuucaucuucauggaaugucacuagauugagaugauucuaagggugaggucaagcauuuggaguuuggaacucugccuuuuguagagaugcucccgugggacuugcccugcacccaguucagcuugcuugggaugcaucugcugagccuggaagagaaguauggguucaaggccagcgguccagcacucccacagaccugaucuguaauagggaaggguugccucuguguggguugggaguuuaaucagcaagaguggauuagcagcaggcucauucuguuuacuccaguaggucacggggccaagggcaaacauacaccccucccagcccagaaacugauagcugcaaaguugcacacccuucuccccaaauugacaaauaugguuuucauuguuggaguaauaaauuaugcuuuuuaaggauaaaaauguugcccagcuguugagugguuuaaacuuccagauguuccucugcucaguaaucagagcaggaugcaugaugggaucucuuuaaaaguugaugaacagaaugguucauuaaauuucaacaaugugccuggaaugccaaggggagguguagcaucucccucgagggaaggagguacacauuuccuagggugcuugggugaagaauuagcaagcaguaacugaagaccaguuacuggucaggcagggaagcccaaguucuggccccugcugacugugugacuuugggcugagcaguuggccucucugagucuuagguuuuguuuuuuuuuuuucuuuuguguuuuugagauagagucucgcuuugucgcccaggcuggaaugcaguggcgcgaucuuggcucacugcaaccucugccucccagguucaagugguucucaugcuucagccucccgaguagcuggauuacagacaugcaccaccaugccuaacuaauuuuuguauuuuuaguagaguugggguuuuaccauguuggccaggcuggucuuaaaguccuggccucaagugauccgcccgccuuggucucccaaaguguugggauuacagacaugagccacugcgccgagccugagccucaguuucugauacuugcaacugggagcauguuuugagagcuagagaaaguauuguugucuuguguaacaugaaaaaagcugugcggauacuagcuaagaucaaugaaagguuaucaaacucaaucugauggugaaagaagauacagagaucaagcccguccgcauuuuuaacguggggacacugaggcccaggaaacuuggggcuucuucaaguaguagcuaggccugugcugucccauaugguagccgcuagccacuagccgcauguggcuauugagcagucgaaaugugcgaaaauucaaauuaaaauauguuguauauguaaauugcacaauggauuauaagacucaguuuaaaaaaaagaaaaaauucauaacaacuuuugaaauauugauuacauguugagaugauaagauuucgauauacuaaguuaaauaaaacauuaaaaaugaauuucaccuuugguuucugcuuaguauuuuuuaauguagcaacuagaaaauuaaaaauuacugccgggugcgguggcucacgccuguaaucccagcacuuugggaggcugaggugggcugaucacgaggucagaagaucgagaccauccuggcuaacacggugaaaccucaucucuacuaaaaauacacaaaaaauuagcugggcaugguggugggcgccuguagucccagcuacuggggaggcugaggcaggagaauggcgugaauccgggaggcggagcuugcagugagcugagaucgcaccacugaacuccagccugggcgacagagggucucugucucaaaaaaaaaaaagaaagaaaauuaacaauuacauguguaguuugcauuauauuuccacugggcagugcuaugcuaaacugugacacaaacgguggacuuuagaguugugcaggguacaaucugcacggccauauguggcaggccuaccagguguggaugaggcugucuggguucgaauccuggcucuaccaguaaucaguugugugguauugacuaaauuguuuaaacucucagagcuucaguuguucuaucuguaaaaugaguauugcaauagugcaugcuucauagagcuguuguaaggauuaaaugaauuagugcauauaaagugccuagaauagugucuggcccguuuuaagagcucagugagucuugguuguuguaguuguuacuuuagugguuguuuuuuagaaccugaggacacaaggauggaaagacucagucugucuguggcaaaccacgaaaggaaagauuaaacaauucaaugcaggcugggugcagugggucacacuuguaaucccagcacuuugggaggccaagacgagcggauaguugagaucagaaguucuugaccagccuggccagcauggugaaaucccauaucuacuaaaaauacaaaaauuagccagacguaguggcgagugccuguagucccagcuacucgggagacugaggcacaagaauugcuugaaccugggagguggagguugcagugagcugagaucacgcuacugcacuccagccugggcgacagagcaggacucugucucagaaaagaaagaaagaaaaaauaaauucaaugcagugauuauuagagggguaaguccaucgggacaaaucagggggcauucccacugaggcaggacuugagaugaaucucggaagcagaaaugcugagcuuguugggcuggccagagauaagaaggacauugugggcgggagaaacagcaccuacagggcugagauggaugaaagcucaguucagucugggaacugcagaaacucaguuugccugagcaaacugcaauguggcaagugggaaaugaacccaagcuaaaagaggacagcagcuggguguaaauuuuguccuguaacccauggagagccaagaaggauuuugagccagggagugacaugauuggauuucaugaucagaucauucuaacugcuuugaggagguugucuuggaaggaaagcaagagucuuuggcaagaagaucaagagaagaaagauugcuauuuccaaagcucaaguaguguauuuuucauuguuguuguuaaaguucaaaagucuuuauauugaaaguggcacguaugcuaugaucucacaccuguaaucccuucccaguuuaucugcaugagaaaagcgcuuggaauggugcauaucuaaaggugguuucugcucaauggggauguggauucuugugucagguuguuggggaggcuuuaggcuguggcugccagcccaucccacugacagccaacuucauauggaugcagagcuuuuuaaccauaucaaagagaaggauaggagcuuaaaauaugaaacuccugcuuuugauaugcuuaaauucugggucugauaucuuuuugaaagaauuagguuuuuaauugaaauagcacaugcauauauuuaacaucaaauggguaaggcuuuuauggaaaauccagauuccccugcccuuuuucugccuguccuuagcccuguuucccagagugaaucagggacaggucaguaccucuaaagaauaagcucauguugcuccuugucuguugacuuagacuucuggacccucagcaaugucccgggacucacacugggggaggcagggagaccagcaugcccccucuugccacuuguacuucccauuuucccccuggcaagguguggaacauuuauacucccacgcccacacuuaagacuccugugcuuuaucugcaagguuaauuccaacaauugauaaauggaugaacaguguuuacauuaagaggcuugucaauggccuucacugcccgucgaagcagucggcuuugaucacauguccuuuguguucagcucucucuuugcccucagcuuucuaaucgcccuuuaaggggcuaucugaggcugggugagguggcucacgccuguaaucccagcaguucaggaggcugaggcgggaggaucucuugagcccaggaguucaacacuaaccugggcaacaaagcgagagccugucucuacaaaacauuaaaaaauuagccauacaugguggagugcgccugugguccuagcugaggugagaggauugcucgagcccaggaguuugaggcugcagugagcuguaauugcaccacugcauuccagccugggugacagagugagacccuaucucaaaaaaaaggaacuaucuggcuucauccuaagaguaguugcauuuuaaacucucagucagcuucuuuuacuguaaaaugggaauaauaauuaacagucuaaauuccuaaagugauuaugaaggcugaacaggugaugccuguuccucaggccccucccuuggggccccuucagccccaugugucccaggcuaaucucaaacuccugggcucaagugaucugccuacuuuggccucccgaaguguugggauuacagacacgagccaccacucccagccagguugcuauuaaauuuuaccuuuuuauccaggagcgugggucaucauuucuuucaaauaaugcuucuauuuaugagauuuuucuuuguagaaaaugugggaaauguuaagaguauaaggaagaaaauaagucguguuaacgcaauugcugcauuuuucuuuuuuucuuugcauauuucuuuuaaacuugagaucauguaaugucaacaaguuuauuggauuuuucuccuaauguaguauuaguauuuccauguguuguaaagagcaagcuuuuagguaucauuuuuaaugcaauauaauguuguaacauccuauugcaaugacagcuugucuuucucccaauuuuaucugcacuauuagguauuaagaauauuuaauguggccgggcaugaaggcuccugccuguaaucccagcacuuugggaggccgagguggguggaacacuugaggucaggaguucgagaccagcuugggcaacauggugaaaccgcaucuccacucaaaauacaaaaauuagcuggguguggugaugcaugccucuaaucccagcuacucggaaggcuaaggcuggaaaaucauuugaacccaggagguggagguugcagugagucgagaucaugcacugcacuucagccuggguaacagagccaaacacuagcuaaaaaaaaaaaaaaaaaaaaaaagaacauuguguauuuuccucuuuuaaauaauguugagaugaguguuuugguguauaugucugugcaugugugcacauaugugugcagaaaccuauaggauagauuucugcaagaauuaucaagucaaagguucuagacauuuuuaaggcucucaaugcauguuguucaguuguuuccccauuugguuacaccaaguuacagucacaaaauuacaccaaauauuuuuuccuccauggaguugcuuucucaugaaauuggguuucugaggccaggaagacuugggucuuguugaggugaaggggauaauucuucagcauuugucacuauuuuucacuaucauuuugaguuugauuuaaauagcacaguuugcugcguggaaaaugagaguagcuuugaaggggcacagcuuugaagggcacacaguagaugaugacaucuacuucagaacucuggcugcuacgugggguacgaccauguugcauuuucaggaugcuuuaguggaaaucaaaagcaugggaugcgaaugcaaaaccaaagggcuuagguucugcaucugacauauguggcuagcuguauguuccuagccgcgucacucaaccuugcucaguacauaccuucuucauauggcgugcaucucuuccucagcuauauggguguccucgaaaaugcugagcauaagaaaagugcauuuguauccucuuuauuuauuuauuauuuauuuauuuuuugagauggggucuuacucuguugcccaagcuggagugcagucgcacaaucaugguucauugcagccucaaauuccugggcucaauggauucucuugucuuagccuccucaguugcugggacuacaggagugugccaccaugcccagcuuuuuuuuuuuuuuuuuuuuuugauaguagagaugaggucuuguuauguugcccaggccaguuucgaacuccuuggcucaaacaauucccccuccucugccucccaaagugcugggauuauaggcaugagcuaccgcuacacccagccuauccuguuuaccuacaacuugccaguaaccuugggcaaauugcuuggccucaggaucuugguuuuguuuucuguaaaaugggaauaauaauaauaauaauagucccuaauuccuaaggggauugggaagguugaacaaagugcuuccgcuagauugcuugaccuggugccuaauccuggugauuucucguaaaaaucaguuguucucacuaguggaguccaccagaccugaugauuccccagcguugaguucagccaaccugcacuuuaguucuucaggcugguuguauauggcuggcuagauucaucguuuggaaucuucagagucagaagggacccauccaaguuugucacucaauggaugacaaaguaaggcuccagauggugagugucuauuuuggaauuucauaacuguuuccauuuguguguaaaggaggauaacacacacagacuuacauauacacacaagcauauuugcauaggcuggauuuggaagggugcacaaagaaaauggucauaguggcuguugcuaagaggccacccgggagcuuucuggggccaggagagaaacuuagccuugacuguaugacuuuuuuacaguccuguuggaaaauuuuaccauguguaucuuuuaguucuucaauuaauaagcaaugaguucuuaaaauucaccagguaguaaaagaucuuugaaagccaauccugcuucuuaaugcaaggaaagaaucccugggaguaugcaaaaucucuguugguuuuguagcugucuaucugaacucacgugcccuggauccuggccacagggcuuucuuuuucuuucuuucuuuuucucuuuuuuuuuuuuuuuuuugagauggaguuuugcucuuguugcccaggcuggagugcaguggcaccaucuuggcucaccguaaucuccgccuccuggguucgagcgauucuccugccucagucucccaaguagcugggauuauaggcaugugccaccaugcccagcuaauuuuguguuuuuaguagggacgggguuucuccauguuggucaggcuggucucgaacccccgaccucaggugaucugccugccucaagccuccaaaagugcugggauuacaggcgugagccaccacacccgaccuagccccagggcuuucuaacacucacauggacugucugcugucucuugcuggccucccagucugucuccagaauauguuagacugaguccuagacacuuagccucugguccccuggcagccaacugcuccucugguucacccccuggggcucccuguauaggggagccaucagccugacugagcagcccugaggcuggaguuuuuggcuuccuccuaaccagcccccuucacgguccaggagccucccagcacagaagggagaaucugugcagcuuguuccuuauccuccuuugaaccaaggccuguuccaagaacuccagggccucucugcuugcacgucaggguugagcugcucccccaggccccaugcacggaguuggcagcucccuggaaaaauuuccuucccccuuucuuucuggcaaauacgauggauucccugcauggccccagaccaugagucuugaguugaguucugcaggagcaucuugcuggguggcuucagcaggggcagggguggaaagccugaaguccuccucuguccugaaagccuuugaucuucauucuggcccgaagccccugugccguauuucccucagcaccguuguaacaucuggugagccaggcuguuagggccaagugccugcucuuuggagggcaucuaguucaaugugagcauuuuuuucuacccagcgaccaauucuggaaacaucaaaguguuuaugagccuacuuuuuguuucuccauucaaaaugaaaauagcuuuauugaucccauggugaggggugggcaggguguguaucuucuugcugcugggauguucuacuuuguuggacagaaggcuaugugcuuucuggcagguuacaccuggguacauuucagucaagccgagcuggcucucuccucauuucauucucaaaguagaucucuugcuaagggcuucuuacugagugucuaguuccuuguuguacaggugagggaaacugaggcccagaguggaugugacguuuccgaaggagaggcucuguaaaguucugaguaggugagacuuauuauuagcugcaaauaacaacaacaauaauuagaagaagaagcaucuucugcccuaaaucauggggcuuuuauuuuucagcuggauggugaagcuuaguggccucuccuuuucucuucuuggaagcacaagcccuguguuguuuauauuucucuuuggccagagauguauuuugaaauuuaaaugauaaagcaaacaaguccuguuuucacugacgcuuuagaaaacuugcaugaaaccucuucacggugguuuugggagccaagcgaggccagguuuuucuauaaacguggggagagggauguugaggacaguccauccucagagagugaaugauugcauucaucuugauuaaacucagugaauccgugaaaggauggugcagguccgcccccccagacucauccuuccauguguguccucguggccaauuugucuuugcacgggauggaaagcugacgagauggacuauuuuuuuccccuuaaaaauaauuacaugccagaugcucguuccaaguucugugccuccaccaguuaaagauuuuuggaucuuuugcugagaaugcuuguucagagguaaacuuguuagcaucugagacaagcauaauaauaaugauucaggucaggagcuacaaaggacucugugaugagcaaaaaauaaugauugagccuggcgcgguggcucacgucuguaaucccagcacuuugggaagcugaggucaggaguucgagaccagccuggccaacauagugaaaugcuguuucuacuaaaaauacaaaaaauuagcuggacgugguggcaggugccuguaaucccagcuacuagggaggucgaggcaggagaaucacuugaaccugggaggcagagguugcagugagccaagaucacgccauugcacuccagccugggcaauaagagugagacuccaucucaggggaaaaaaaaugcauauugcauaaaauaaaaccuuauauauauucacacacauguguauauaugagauggggugguccuguacaugacagcuaugguuuuaaggccccagugccuuuaaguuuguucuugaaaugguugguagccaguucuucucuccuuggcuucccagaaauccuuuccaacccaagagcgucagagguacuuuaaguaagcaagacuuucagguguugcuucucuggccucccucuuucacaucuauucuauaaaaagaggguggcugcucagcccaauguaaagaaagcgcuuucugaaguugaaugaguuuuacauuucagcucugccaguguggcaguaugaacuugagaaagagacauccccucucugacacuuaauuucccaucuguaaagugagauccacaauuuuaccuuugcggguuggcacauggacuggagacaauauugguaagaugcuguguucauuuccuagggcucacauuacaaauuagcaaugggcuccuuucaacaacagauauuuauucucuugcaguucuggaggcuagaaauccaaauucagggugucaggagggccaugcuccacaugaaggcuccgaaaaauaaucucuucuugccuccucuugguuuuggugguugcuggcaaucucuggcuuguggcugcagcaaucugccuccaucuuuacauagccuucuucccucugugugucucugaauucucucuucuuguaauaaugccagucauuagauccagggcccacccugauccagcagaaccucuucuuuacuuaacuaauuaccugcaaagacccuauuuccaaauaaggcuacauucugagguucugaauagacaugaauucuugggagcaaucaacccaguacagaugucuggcauuuuauugcagacaacaucugggcagaugacagcaucugguauuuuuaugauugucacuuaccagagguauggauagacauuucuugaagaagauaggagcaagccugauuauuugaggaacacgagggccagauagcagaaguggagggagaggugugguuggcuuggcagguggagaggggcagggauggaagcaaggagcuugcuaugugggggugugggagugggguuggggaaaccauauugcuuuauuucaggagagagugauguggccugugucuuggugguagcaaagaaagcggagagaaaaacguagauuuuacauuuaucugggcaauugugccaauaggacuugcacacggauuggauauggaggugagaaaauaagggaaucaagaaugacuccuacgagucaggcugggugguucaugccuacuauaguccuagcacguugcggggcugugaugguuaauacugagugucaacuugauuggauugaaggaugcaaaguguuguuuccaggugugucugugaggguguugccaaaggagauuaacauuugagucagugggcuggggaaggcagacccacccuuaagcuggugggcacaaucuaaucagcugccagugaauauaaagcaggcagaaaaacaugaaaaugcaagacuggccuagccucuuagccuacaucuuucucccauacuggaugcuuccugcccucagacaucggacuccaaguucuucaguuuugaggcuuggacuggcucuccuugccccucaaacuugcagacagacuauugugggaccuugugaucguauaaguuaauauuuaauaaacuccucuuuauauacauacguguguguguguguguguguguauauauauauagauaaaacuccucuuuauauacauacguguguguguguauguauauaucuauaucuauaucuaucucucucucucucucuauauauauauauaucuccuauuaguucugucccuccagggaacccugacuaauacagaggcugaggcaggagggccguuugaggucaggaguucaagaccagucuggacaacuuagagagaccuugucucuacaaaaaauuaaaaaaaaaaaagaaugacuccuagguuuuuggcaucagcaaccuggcagaugcuggugucuucaauggacacggggaagaugggcaguagauugugggcgcagagaguucugugcaggcauguuaaauugcagaugcccauuaauggccacaggagaugccaacuagguacuuggcaaagugagucugggaauugagaccaucaugguaggagauagcauuuggaagauuuuggcagaggugggauccaaauccaugggaguggaguauagauagaaaaguggacauaggacuagacauggccacuagugguagggguagaaguuggggagcuggaaaaggugauuacaaggagccacuggugaggcagaaaaacaugccgggagccuagagaaggaagaccuucuuaaggaaggaggagagucaucacuugcaauguugcuaagaggucggguagaaugagucacacagaagugacuguuagauuuggcaucaaggagguuguugacuaacuuggcaagagcgccucaugggagcaaucaagaggaagccagugaccaaugaaggugacugcucuugcguucugcucucucuucauugccuuuugcucuuugcuuaggcaaaucagugucuucaguagguuccuugaaggcuaaugucaccauuaguauuuaccuacccauuagcucauuugauucucaaaacaacaucuuugcagaaaaggcugggcagggcaggcagguauuauucccauuuuacagaugagaaagccacaacuuaaaaacgucaaguguuuuuuuuucaggcuguuucuuaaaaguaagaguuaugugucaggcaccccuccuccacccccaucucggcauacaucccaguguuuugugguuugcuacauuucuugguuuucuuagcuagauugugaacccagugaagggaggaucugaaugacaucucuauauucccacgcagagauagcaaaugcuugccacacuuguuacuuucucuuggguacccauggcaggcaucacuagcugaucaugaccuucucuuccuuugagcccagacucagcuuagaauucuacccagcauuccagauagccugucaaccugcugacagauaagguaucaucaacaggcauuuuuacuguaguacuuaaugucaugccugguucagcaagugguuuugugacugauuuagcaaauaagcauucucugaaaacacagugagugaguucuaugucacuagagguaaucaagaagagaucaaauucaugcacauggccgggugugguggcucacgccuguaaucccagcacuuugggaggccaaggcgggcggaucacgaggucaggagauagagaccauccuggcuaacauggugaaaccccaucucuacuaaaaauacaaaaaauuagccgggcgugguggcgggugccuguagucccagcuacuugggaggcugaggcaggagaauggugugaacccgggaggcggagcuugcagugagcugagaucgcaccacuccacuccagccugggcgacagagugagacucuguuucaaaagaaaaaaaaaaaauucuugcacaauuggauaagguaaauagaauucagguauuggguaaaagguuauccaacucugagauuaucugauauucauggaguuauuuaaugaacaguaguaucucuuaccauucuggaacaaaacaagaaaccuuugagaggaaucuccccccaccuccccagauauauaggaggggacagugggcaacacuauuauggcuccuuucuuguugucuuggccacuuggggcucuggucucagccuuucuggauugccauaaucuguugggcccuauggagccaaagggaguaaacagaauaguacuguucuggguuguugagggauucggugagauucccuagguagguuuuggucaacaagcaggcauuucauaauccucucuaccuccugcccugcccuggggauugugaggauugucugcauuccucuguggaacuggaauguggcugcagugauggugucugcagagauguugaagcugcuccucucuccugcccucuaucuuggccucgcccgguccuagccgggguaagugaacaucaaucccauggacagagucuucucugaaaacugcuuuauggauuuuuuuuuuuuucccagacagggucuugcucugucgcccaggcuggagugcaguggcacaaucucacugcaaccucagcuuccugggcuuaaguaauccucccaccucagccacccgaguaguugggacuacaggugcaugcuaugaugcccagcuaauuuuuguaucuuuaguagagacaagguuucaccauguugcccaggcuggucuugaacuccuggacucaagcgaucuaccugccucagccucccaaagugcugggauuacaagccugccuuauggaucuuaaugucuuggcccgagggcauuggcucugccuggcuccagagggauaugaagccauuccugggggacaccauuguuuucuaguuaauauuaucaguccuguaguccagugauuuucaaauuuuaguguagucagaaucaccagaagggcuuguugaaacccagacagcuggaccccucccuagagacuuaggaugaggccugagaauuggaucuaacaagcucacaggugacacugaaguugacgaccuuguaucucacuuuaagcaaagucuucccauaggaaccauuguuccucccugcccauagguaauaucuucuacuugggcccucugcuuccacuguggccugcuuacaaccucaccuacacuuauuaacuagcagaguucacugagucugcuuaaaaccuuaaacuucaaacuauaccacaaggcuacaguagccaaaacagcaugauacuaguaccaaaacagagauauagaccaauggaacagaauggaggccucagaaauaauaccacacaucuacaaccaucugaacuuugacaaaccugacaaaaacaagcaauggggaaagaauucccuauuuaauaauggugucaggaaaaccggcuagccauauguagaaaacugaaacuggaccccuuccuuauaccuuauacaaaaauuaacucaagauggauuaaaggcuuaaacauaagaccuaaaaccauaaaaacccuagaugaaaaccuaggcaacaccauucaggacauaggcaugggcaaagacuucaugacuaaaacaccaaaagcaauggcaacaaaagccagaauugacaaaugggaucuaauuaaacuaaagggcuucugcacagcaaaagaaacuacuaucagagucaacaaggaaccuacagaaugggagaaaauuuuugcaaucuauccaucugaccaauggcuaauauucagaaucuacaaagaacuuaaauuuacaggggaaaaaacaaacaaacaaacaaacaaaaaccccaucaaaaagugggcaaaggaugugaacagacacuucucaaaagaagacauuuauauggccaacaaacaaaugaaaaacagaaaacaaaaaacaacucaucauuacuggucauuagagaaaugcaaucaaaaccacaaugagauaccaucucaugccaguuagaauggugaucauuaaaaagucagggaacaacagaugcuggagaggauguggagaaauagggacgcuuuuacacuguuggugggaauguaaauuaguucaaccauuguggaagacaguggggugauuccucaaggaucuagaaccagaaauaccauuugacccagcaauccaauuacuggguauauacccaaaagauuauaaaucauucuacuauaaagacacaugcacauauauguuuauagcagcacuuuuuacaauagcaaagaccuggaaccaacccaaaugcccaucacugauagacuggauaaagaaaauguggcacauauacaccauggaauacuaugcagccauaaaaaagaaugcauucauguccuuugcagggacuuggaugaagcuggaaaccaucauucucagcaaauuaacacaggaacgaaaaaccaaacacagcauguucucauucagaagugggaguugaacaaugagaacauauggacacagggaggggaacaucacacacuggggccuguugggggauggggggcaaggggagggauggcauuaggagaaauacccagugcaugcggggcuuaaaaccuagaagauggguugaugggugcagcaaaccaccauggcacacgcauaucuauguaacaaaccugcguguucuguacauguaucccagaacuuaaaguacaaacaaacaaacaaaaaaccuccacaaaaacccuaucuccaggcuucccauuguaucuccugacuuuuuugaaauccugagcagccuguuccuguugaucgagugaaugagcauucucugaaauugcagugagugaguucuccaucacuagagguagucaagaagagguuggaaucacacacaauuggaugagguaaauagaauucauuuguuagauagacuaugcaggccuaagauuguuuaguauucacggaguuauuuugugaacacuagugucuuccagccucaucaaguggucccucccucuguagccccacauccuggucuuugaucaguucccugacacccuucccugggcaccacaggaccuuugcacuugcuggucccagauccuagaaugcuuuuuccccagcuuguugaaaagcugauucucauccuaacuucaauaucaccuccucagaccaccccuucuaauagacucauucccuaaccuccauuucucaucacuggaugcugcugaauuucacuguggcaccagucauagucuguaaaaaaaauuuauuaaauuauuuggcucuuugauuuuggugugacuccuccccuagagaaaagaaacugacuuuguccuugaacucuguguugucugacacucagugggugguucauacauauucuuuuuuuaaaauuaauuuuaauuuuuauuuuacauuccgagguacaugugcaggaugugcagauuuguugcauagguaaacgugugccauggugguuugcugcaccuaucaacccaucaccuaguuauuaagcccagcaugcauuagcuauuuuuucuaugaaaggugagcaaaugcuuguauacaggcugcagaggguuaggucaaggcugaaccauguagucuaaauuuuggagugacugcagugaagccccuccaugguggaagaaaauggaauguccuuguuggagcuggccagaacugggcagauccagaggcuggagguaauggcaauaacucugacugcuaauaauaaaauaagaacguaaaagagugcuuacaguguguuacaggcacugcuuuaagugcauuacgucauuuaguuuccacaguugucuccauguuacagaggagaggacugaggcacagaguauuacaauaagaaacuuggcccacagucagcgagcaagaaagccuagauucauaccugggcauauggcuucagaguccacacgcuuggcgccugcacugcaccgagaggggcugcugggccgggagucccccaccugcucucuguuuucaaacuccccauuucacacccaugccaggugugaugaaauccucuaggugaugggcaguggacaugagugguucugguuacaguuggacuucacuggccugucccacaccugaggauauggauucuagcccaugggaccauaagccaggcccccugagggucuguuauuugucugggaaguggcagcgcucuuuggaaucuuguucaugacugacaaacacccccacgccccuucagccauaauuaucaccuaguccccagagaagggccaugggugggcugacuguagagauagacgcuugggucucuggcugggaacaccacaugcaagagaagaggccaugggcucgccuuccauccagcugaagucuuucuggccgggcugcaggcuucaugcaacaccuuucaaccuguaaaaggaaaaaagaaggccgggggugggccucagcugcugccacuggcauuguaucacugaagcguuuuuuguuguuguuuuuuuuuuuuugaauaccggaaauuaaggggaaauucggaaaccucauaauggcuucaugaaccauugcacuuggaaaauguacuuuugaaaaauucccuugauuuauuguuuuucggaggcuguagauaacauuagaguauauuauuccuauauaauuuccugaguuuucuaugucaauuacuuuguuuuauuaaagagaaaaaaggaacuaauauugauugaggcccuccugugugccaggcuaaauggucaucccuuucaguuguuaguuacaaagugacccuaugaagcagagaagaugaguauuguuuagcgauggggaaacggagccaggggaggaacuugccccagcucauggcuaggauuuggaauucugucccaguguucauacucuuuuguguugucagguaugaucagccuauguacugcuuccuugacuuagauuuuugugggguagagaauaucaguuguagcucuaaaggggugugauuauuuaugauuuuuuuuuuuuuuuugaggcggaguuucacucuuguugcccaggccggagugcaguggugcaaucucggcucacugcaaccuccaccuccuggguucaagugauucuccugccucagccuccugaauagcugggauuacaggcaugcgccaccaugcccggcuaauuuuguauuuuuaguagggaugggguuucucuguguuagucaggcuggucucgaacucccaaccucaggugauccacccaccucggccucccaaagugcuggaauuacaggcaugaaccacugcaccuggucucauuuaugaauuuuaaaaauauauguguauauguaauaucugauuauauaucacaucacaauuugcugcagagugagguuguccuuccuaaaguacuugucuugcaaggcuauggacagauacugguaauggaaccugugcucagaauuguugggaaucuguaguuuaaagguuugucauuuggaggaauaucaaguaaacccuauggggucaaaaacaaggucuagccaggugcggugguucaugccuguaauuccagcauuuugggaggcugaggcgaguggauuaccugaggucaggaguucaagaccagccuggccaacauggugaaaccccguuucuacuaaaaauacaaaacuuagcugggugugcuggcaggcaccuguaaucccagcuacucaggaagcugaaacaggagaaucacuugaacucgggagguggaaguuucagugagucgagauggugccacuggacuccaaccuggucaacagagugagccugacucugaugauaguaauaaauaauaaugguagcuucuauuuauuguuuacuacuaugugccagacacuauucuaggugcuuuucaucaauuagcucauuucaucuucguuauaacccuauguucuaaguacagucauguaccacauaaugauguguggaucagcaauggaccguauauacaacgguggcccuaugagauuauaauacaguauuuuuacuguacuucuucuauguuuagauaugauuagauacacaaaugcucaccauuguauuaaguugacuccgauguucaguacaguaacaugccauucaggacugcagccuagaagcaguaggcuguaccauauaguccagauguguagugaguaggcugucaucuaguuuuguacaaacucccucuguaauguucgcacaacgaaauugccuaacgccgcauuucucagaauguaucucuacccuuaagcaacgugugacuguccuauuaucaucaccccauuuuacagaugaaggagcuguggcaagaaauugacuaacuuggcccaaggucacccauauaauaaaaggcgggcugggugcaguggcucgugccuguaauuccagcacuuugggaguccaaggggaauaggaucacuucaggagaggaguuugagaccagccugggcaacagagggagacccuaccucuaccaaaauuauaaaaaaauuagccgggcaugguggcauagacuuguggucccagcugcccagaaggcugaaguggaaggauggcuugagccugggaggucaagccugcagugagccgugauugugccacugcacuccagccugggugagagagugagauccuaucucaaaaauaaaaaauaaaaaaaaaaugaaaaaaaaaauaaaaaaaaauaaauaaaauaauuaaaaaaagagcugggacuugaagccagauaauaaggcaggcagagggcauacgaaacacccagaugggucaugagcccgugcaucagucagggucuaauggcucagcugaggaagggagguuuaaggaagagacuguggacagagguguuagggaaggugucagagaagguuaaggagccaacauggaucaugggggugguacaguguugccagggcuggggaggauuggcugcagugugggguacccagccgcugccauguggagagggaccugucacuccugcugugaacucucccuucuucugcccucugaccuccugcuggugccucccauuggcuaaacacaguugauggccagugcacuggggagcuguucuuggagcccacaggcaucugcuucuuggcacagagcagacaauggauugagucgggagggaggggaacuagagaauacccaagucccaauggcuggagaggagugagcagguaaaggggguagaaggugaagucagagaggccgggguccacacuacacagggccuuuggcuuucuucggaaggagcaggaagccaguggaggguuugagcagaugugugcaucacggccacugccaucaggagaacgucuuucucuaugcuaggugugaacagucaccccuuccucucccuuucucaggaugagugcugaggaggaaaaggcccuuuccuccaaugucuucagaggagacgucugcccaguccagacuacgugccucaugccagccagccuguaaaugacaggaaagagaaaggagcagugucucaaaagaggauauucuggaacguuugauaaucagagcccauuguaaagucauguuuugaguuacagcauuuaaaucuuuguuccaguggaaaacuuuuacaggccguccugggcaaggcuugaauccuguuuggaucuccaaaggccuuaaaauagugugggaugccgggagacuggcuccaaaagggaggagaccugugcuggcagcccuggccacaccuuggugggaccggcuccuggccuuggggacccugccacucuccuagcugugcuuccgcagagcuggacacacaaaagcuuucuugucuggauuuguuccccuaagaggguggcaccgaacugguccugcccaugcaggaagcugguccuguccaaccagggaaugaaaaguuggccaguaucuucucaggccacgcuacagccaagucucuuuuaaugagcugguucucuuaggaugcccaggggagggagaacacacuugagugggauggcgaaugaagaaggaagcggcuguucagacagcuuccaguucugucagguucugcugcugugaccaaggcaccaagucaucuggaaacccacugcaggcagcaaccucuuuuucaccuuugugugccccaaagcuugcuccgggaaucgaugguuugggaaacaaugcuugcugucuuugaguccucaguccuguaaaauggggaaaguauacaucagagggcauuugagaguaaggcaagaagcgcuuggcaugugccuggcacauaguaccuguucagcagauucccuuucagcucaggguuagaucuucauccaccucuuguuggccugaaggaaggggagguagguacuauuagccccauuuauuuuauuuuauuuuuuuauuuuucuugagacagucuugcucuaucacccaggcuggagugcaguagugccaucuuggcucacugcaaccuucaccucccagguucaagugaucuucccgccucagccucucaaguagcugggauuacaggcaugcaccaccacgcuuggcuaauuuuuguauuuuuaguagagaggggguuuugccauguuggccagucuggucuugaacuccugaccucaagugaucugcccacuucagcgagauuauaggcgugagccaccacauguggcuuauuagcuccauuuuauaggaggugaaauuagacagcaagaggcuaaaugccauggcugagguaagaucugugguagcauccaagucuugaccccagacuugguguacuucucaucacagaugcaauuuugugccucaucaucugacccaggagcuacacaucugcuuuuuuuuuucuucuuucugagacagucucacucugucacccaggcuggagugcaguggcacaaucuuggcucacugcaaccucugccucccagguucaagugauucucaugccucagccucccaaguagcugggaccacaggugugcgccacuacccccagcuaauuucugucuuuuuaguagagacgggguuucaccguguuggccaggcuggucuugaacuccugaccuugugauccacccuccucggccucccaaagugcuuggauuacaggcgugagccacugcgccuggcuaaaguuguuauuuuaaaauuauuauuuauuuauauuuguuauuauauuuuuuauuuauauauauuuuguuaucuuauuuuuaaaaguuguauggcccauuuaaacuuuugcagaaauaguuuuuugaauccauggauuuaaugcuuuccucuuuaaauuuuuuuuaagucaauuuagaguuuuuaagacaaaaacuggaaaacggcuuugcucuuuuguggaacugcucuggauuuuuuuuuuuuuuuuaagaaagaauuuugcuccaucacccaggcuggagugcagaaguacaaucauaucucacugcagguuucaacuccugggauccagugauccucuugccucagcuuccugaauagcugggaauacaggugugcgcuaccgcaccaggcuauuuuuuuuuuaauuuaaauuuuuuuuguagagauagggucucucuuuguugcucaggcuggucuugaacuccuggcuucaagcaauccuaccaccucagccucccagcgaguugagauuaaaggugugagccacugugcauggccuguguugaauuuuuugucuccccauucccaaguagcaacucuggacuccacagaaaggccgagucucuccaagacccagccgucuuggagggucaucuguccacuccuccaaagagggugagacagggccaauaaugaagugaucacugugcaccaacccucccucuugcuucagaagagaccuuuucaucccugagccaauuaaucaauuucaagagauagcaucugagugagaugggucaccaagucacagaggcccucagcuccugugccggcucucaaaggggguugaaugagguggccuuaacagauugccuaguacccaacuuccuagaguucguauaguagagagcaaguagcauagggcuagaaggccaggucacaauacccucucuggagucuucugaauguaugaccaauaggcaagagccccaguuuccuggucuacagaagugacagaugggacccuaccuaccacacagguucugaggauaaaaauagugauaugggcugggcacgguggcucgugccuguaaucucagcacuuugggaggcugaggcggguggaucacuugaggucaggaguucgagaccaaccugggcaacauggcaaaaccccauuucuacuaaaaauacaaaaauuagcugagugugauggugcaugccuguaaucccagcuacucaggagggaacugcuugaacccgggagguggagguugcggugagcugggaucaugccacugcacuccagcuugcgcaacagagcgagacucugucucaaaaaacaaacaaacaacaaaacagguaauaugguuggaagagguuuauccuugccaaguuuuuguaaaucaaacagcucuugagagaugccuguuuggcuguuuuuauuuuuuuagagauggagucuugcucaguugcccaggcuggagugcaguggcgcggucucggcucacuguaagcuccgcuucccggguucacgccauucuccugccucagccucuugaguagcugggacuacaggcgcccgccaccacgaccggcuaauuuuuuuuuguauuuuuaguggagacgcgguuucaccauguuagccaggagggucucgaucuccugaccuugugauccacccucuccggccucccaaagugcugggauuacaggcgugagccaccacgccuggccuguuuggcuguuuuuuuaauaggaggugggaaucccuugucuuccugggcagacuagaugugauguguucacagggagcuuuguacagauugcuugagagaagcaccuuucuuuccagaguggcugcuuggacgaugccuuccaaagcugcuaaguccuguggcaggggauuguugauauucuucaugguuucucuggggagccuccuagccucugaauuauugaugcaugucuacauuauuauuauuuuuuuuuugagacggagucuugcucugucacccaggcuguagugcaguggcgcaaucucggcucacugcaagcucugccucccggguucaugccguucuccugccucagccuccugaguagcugggacuacaggcgcccaccaccaugcccggcuaauuuuuuuuguauuuuuaguagaguugggguuucaccguguuagccaggauggucuugaucuccuggcaugucuacauuauuaaaagggucucuuugcaugaguuagcagaauguagugcccucucgugaaugagaaaagccgcccaguccugauugcagccucauaaugggucugaaaugacaagugugaagcagugggcagagccaagaccaccuuuauuugugcauccgugcucuuggguggguauguuucacacaguuuguuguccuucugucccuugcccaugaggccuuagaaacucagcuugucuccacccauuccucuacaacccacacaacaacuuguaaccuuuuaaucuucuuugcuuccuaaagaugcaacucaugccaccucccccaggaaguucucccugacuuccaaucuuuagaauaggcugccagagaucccuguguuaacugugaacagagcccuuuucauccucuugcaucagaauuccugucucauccacucgacugaacuucuuggguaggaauggagguguguuuuuuuuuuguuuuguuuuuguuuuuuuguuuguuuuuaagauggagucucacucuguugcccaggcuggagugcaguggcacgaucucggcucacugcaagcuccgccuccuggguucaugccauucuccugccucagccucccgaguagcuggaacuacaggcgcccaccaccacgccugguuaauuuucuguauuuuuaguagagacgggguuucacuguguuagccaggauggucucgaucuccugaccucgugauccaccugccucggccucccaaagugcugggauuacaggcgugagcuaccacgcccggccggagguguguuuuacaugcaucucacugccugggacagcgccuggaaccuagcagguguuuuaugugugggggguguugguuguaguaguggggaaagguuucuuaaaugagguguguuuagaauuuagcccuuugcaggguauaaaaucugagaaauaagguguguguugugacgagggauggcacugggggccugccuaaagcacuggcuucauugugggggcugagguggcuuguuuccuuggagcuaauggucagagugaggagcuggggacugagcuuggaucuagauuauuguugcaugaauggccuaaaugaagaguguuuucucaagucccuauagaagagggagauccucauggcuuucaaggagucaugcccaagauacaggaauggcucucugguggacuggcugggacagaggggagagggugaaaguggggaggaggaggaaguuuaacaguauuugaagcauuugaaagccuagacccaucguacgcugaaacagagaagaauggcuagccaaaaauacugugugagucuaggaacuuaagaaugcuaguccuugaccccaaacauacuuauauagcagacucaacauuauugucuuccaccuaccggaugggauuaugcaagugauaugacccagagcauucuggaagccggcaggggcauaaauaauacauuagauaugcagaugaacugcccagggugucucuggucuugggaagaauucuuaguagaccugagauaauugcagaacagaguguccuguuuucccauccacagccuccaggccuggcgaggauuuuguguucaaaagagauuuccaagguggacaucucucugacacuggcgauuuuucucucucacuugaacaaaacucggcggaaaggucacuccuauuugucuuagcuucucugucacaucccacccacacuuugaaaggucuguucuuagcggggucccaggaaggcugugcuggcccugucagcccugagcugggugguaguccuuuaucagagauacccaugagaaucacucacccuggagccuuucccaagcacacaucguggaccccuccagggcugcacaugugcuuuguaagggcucuucaggugacuggagcuuuaagagcuacugaacuaagugguaauaaaagugaacaaaguaaccagucuggaaaugucaguagaauggaaagaaagaacaggugggagaguucuccauuuuuucacgguaagacccgguuacuuggcuuuuguugagucccugguggguguccauggugucuuuggccuuaucucccuacuaaacaggauuaccuguguggggcaccuuuccuggucuccucucucuccaaggagcagguaguacuuggaggccgugguuaaucacauuuccuaagugagcuuuuccuuucuagaaugauccuugcucuuacccuugcauuccuacugcauguucccucaggcugaagccuuccuuuacaugugagcauucuccuggaucaacucccugaugacuggagccugugccguguguuuccaaguugcacccaccacccacggagacuagcucauggccgaguggcagcugguguagcugauagcugugugggaaaugggucugcacaauauaaagacagcucacaggaaaggggccccaaaugguacucucuuuuuuuuugagauguugcccaggcuggagugcaguggcgcaaucucggcucacugcaaccucugccuuccggauucaagcgauucuccugccucacccucccaaguagcugggauuacaggugccugccaccacacccagcaaauuuuuuuuuuuuuuguauuuuugguagagaugggguuucgccauuugggacaggcuggucuugaacuccuguccucaggugauccgcccaccucggccucccaaagugcugggauuacaagcgugagccauugcacauggccuuuuuuuuuuuuuuuuuuuuuuguuguuguuguuguuguugagauggaguauugcuuuguugcccaggcuggagugcaguggugagaucucagcucacugcaaccuccgcuucccagguucaagcaauucuccugccucagccucuggaguggcuaggauuauaggcgcccaccaccacaccuggcuaauuuuuguacuuuuaguagagacaggguuucaccauguuggccaggauagucgaacucuuggccccaaaugacacuuugauaaguugcucuacccaauccuaaaaaaggaaauacagauaaaaaauaccaacguuguauaauacacauguuguugaugcgcucuguuguuggcaaaagcuguguugcuggacggaaugcaaguggauguggcccuuugggaagaauuauggccuuuuggcauucucuauccaaacuacaaaagcaugugcccuuugaccuggccaucucauguugggacauugggauauuuccccuacagagauaaccuauagauauuuguaggaaaagaacagugcccaagguuauucauggaacauuuuuauaaaagcaaaagacugggaguaacucaaacaucugugaguugaagacuggcaaaugaugacacauugugcuaggcaagaugcggaaaggaauaaggaagugcugugugcacaaacacggggagaucucaggauguauuguugacacaaaaagcacaauguggagcggggaguauggcaugccaucuuuucuguaaaaaaaaagcauggguguagaggggauguaaaaaugugucuuugcacaaacucuguuaggaugcacaggaaaccaacacaagugguggccugugcguggugggaggagggagaugcagggaggggagacuggguuagggaggaagaugcaugaagaagauuuuuuuuuucuuuucagagauaagguuucacucuguggcccaggcuggagugcaguggugugaucauagcuugcugcaaccucagacuaugaaggagacucuugauugcguaucuuuggguaucauuugaauuuugaagcaugaauauauugaaaucgggagcagcucaaacauugaguauauuaucuaucauacauuuaauuuaaaaaguuuauaaccuugucaugauuaggcugggguuaugcauuuuuaggagggagaccccagagguaaaacgucaguucuuaucacaugucaagguuauguucuauucacgcgacugauauaaaucccgguugcauaucccuauaauacaccugaccaaagccaggugugguggcaugugccuguagucucagcuacuggggaggcugaggcaggggguugcuugagcccaggaauucgaggccagccugggcaacauagcaagaccucaucucuccaaaaccacaaauuuggcugggcgcaguggcucacgccuguaaucccagcacuuugggaggcugaggugggcggaucaccugaggucgggaguucaagaccagccugaccaacauggagaaaccccaucccuacuaaaaauacaaaauuagccgggcgugguggcacaugccuguaaucccagcuacuugggaggcugaggcaggagaaucgcuugaacccgggaggcagagguugcagugagcugagaucgcgccauugcacuccagccugggcaacaagaccgaaacuccgucucagauaaaaaacaaacaaacaaacaaaaaaggccaacaaauuugaccaauacuccucaaaacuggaaaagcuggugaccaccaccccuagugcuccaauaaagggcugugggaacaguugugcucagggugguacugguacagccuggcagaggacaugaugcuugcauaguguggaaaggcccucugagauauugcugggccuuaggggaggagguccaggccuagagaggacugaagcccuccccagggcaugguguggaccacgcugaagggaggugggguuggagacacagcugggagucagaucccaggggcucuccugugugaugcugaauugcugggaaggggaugccagcuagucucuuucucugugccaacccugauugguuggguggcugcugagagccuuauggugcccuggcucaguaggaagaguguguguucauuuagugaguuugccaaagacaagggaaggggguuagagaguagguggcagauaaugccggccuggggauccuggagguuuuaggcuggcagacccuggcugaggcuguuuucuguucuuuuccuuaggccuugggagaccuuuaccuuuucagugccucuaagacagggucagagcaguuuggugacaaaguggaaguaaaccaugggugaaaaacagcucuggggacccucauaggcuuccacuuauugaggauuaggcagaacuugcagcuuggcccagcuuucgaaacaagguguucccaggagguggaaagacugguuuucaaucagauaaagguaggauccuaugaaaaacuccuagggccuugccguuccuaugaagugguagcuaucauucacacuccuaguuaugccaucgagguaaaaagagguggaauaagaaucagggacacuugaaaauaagaaaagagaaagacugcgugcaugugcaugggugcacagccuguacauaugugugugugugccccugcgugcacgugcaugggugcacagccuguacauaugugugugugugccccugcgugcacgugcgugggugcacagccuguacauaugugugugugugccccugcgugcacgugcgugggugcacagccuguacauaugugugugugugccccugcgugcacgugcgugggugcacagccuguacauaugugugugugugcuccugcgugcacgugcgugggugcacagccuguacauaugugugugugugcuccugcgugcacgugcgugggugcacagccuguacauaugugugugugugcuccugcgugcacgugcgugggugcacagccuguacauauguguauuugugcuccugugugcacgugcaugggugcacagccuguacauauguguaugugugcuccugcuugcauaugcauggguacacagccuguaacuacaugugugugagccuguggguaugugaggggagugagggacccugagggacuagaaacuuccuuaaaggccauuugagagagugcugcuuucuauaccacccacccuagggcaguuaggcaaaggugugccucccuuuaagaggaccuagcggucggucugguuuacaacauagguuaucagggaguaguacuuuggccuggaaaaggaaccuuuauuuuggaaaagauuuguaaucucuguggcuuguuugauacacauuggaaaccugacuggaaacucaggccaccagcaucuguugggggcacauguuugcacuuuugguuaugaugccacggcccugguucagguauccuaaagaagauaauuaaugaugaaaaugauugguguagauuucauaccacagagcacugugguuuguauaguaagacacagugaugguguggacccaugcacagccagcuuugcagauguuaagaauagcgacuuugccugacauaauuggugucugcacaugggauuaaacaaguaagauugaugugaauuuuauucuuucauuuuuuauguagacucacugauuggguaacuguggaaauaaugucacagugccuuuuuaaguuaagaacauguaguugugaucaggagcgguggcucacgccuguaaucccagcaguuugggaggcugaaguggguggaucaccugaggucaggaguucaagaccagccuggccaacauggcaaaaccccgccucuacuaaaaauacaaaaaguaggugggcgccuguaauuccagcuacuggggaggcugaggcaggagaaucacuugaacccaggagcuggagauugcaaugagccaagaucgugccauagcacuccacuuugggugauagagggagacucugucucaaaaaaaaaaauuaaaaaaaaauaaaaaaagauaaaauguaguuaugaaaagauuucuaagcauuuuuaagcauuuuauauuaaaacaggaauucagaacaaaucaaaacgaaacaauaaaacuggggaugaaggaaacucaauuuuaaauauaaacuuuggcagguggguggugaauccggguguugugagucauuugcuggcuuguuugucacauggccugcucuauaagugucacccuaauugauguauucguuuggagugggugcucuucugagguuuuuguuucccccuuucuuuggggugcacugugugugcaugguaagaacaagggccauggaauuagagaaucuugaguuucuaaugcaaauucaguuccaagcagugugaccugguuguuuaacuccuuugagccacccccgcccauggcccucaucuguacccugaggauaauagugugggcuuugcaggcuuuuggugagcaagugagaugauguagcaaaacacccagcccagagccuagcaccaauuggucuguaauccaugcugcacggacacagccauucucuggauguggccucuucugccuccacugugaggucagagacugagucacugcaggaguaaccucuccuuggcaagcagcgggagucauuucaucccagccuuucaggagggugaaucugcaccugggguccagagucucagagaugagacgugagccaggcgcugauucaucaugaugcaggcuguggagacucuagccaugguuucuccaugcaggagugagguugggauaaggggucuuucugggggcucugugcucuguggccccugcugcuccggacugguucauuggagaaaccugucacauucucuagaccgguugccacgccaugcucacagucucuguucuugccuuccuaggugggaagugagugaugacccugaagugaggacucaucucuagaucuccaagggcugcagcucagccagcacuuuacaagggugaucuggagccaaacuggccuguuggcugaccauaggugacucuggguagcccauacccaggcucagcagcaguuggggagcugccucgauuucugguuacagaauuccuggaacugagucacugcaguaauugcugugaugaauuguguuuacuuugugugggauuccaaacuguagcagcagugacuacagcuggaagacagcaugaucagcagcuuccaaggcagagccuggcgucagaaagcugcauugcgcuaaugcugaagccugugggagccuguuggagagacacuuggauguuuagcgagcuggugacucuccuugucaugaguaagcuuaggaccuugggcaagucauccaaacucuucugggcaagucauucuccugcuuggaugccuugaggcagagaggcagugaggugaaguggucagugcgucgacucugccucuagccugcugggguuugaauccaccugugugauguuguaugauauugaccuuucuggcucucagcauccucuugugugaaauaggagauuuuaacaguaucuauuucguaggguugguguuugaaugaguuaacauauguaaagugaaugguacagugccuggcuuccuggcaagauugcuaucaggauuaaggcagguuaagcccuuggcacacacuaagagcucaauaaaugugagcugauguuauugguccuuuauuacuauucaagaagccugcccagcccuccucccucuccauccacacagcagccugguacccgcuguucucuagguucuggacacacguuaugacauguucugaugaucuggcuuagacaguggggcccucgagguaggcccagaggacuugguccucacugccucuguggcgccuugcacuggguccagcugacguggagagagacucaggaaacaguggcugagugugacuuuggcuggcauagugguugcugagagaacagacaagguucucucucacgacauacagauuucagaucagggaaagucccagcuggcauaaguuuaucgagcaucucccauggacaagaucagcuguggguggagccuugaaguacaugguagaaggacagcgagucuucccaggccagggcuucaagugaggagacaagauauagccucccagagaauuccuauaaugcaaucgugaaagaaccauacccagcaggaggccggggaaagugacuccugcaacucuaggaaggcuuccuggaagagguggaacgugagcagcauaggauuuugagagaagaaauggaaugggcugagggagauucugcugguggagguucagguugaccuaagggcuggcagcaguggaggccccccacgagugaguuugaggggccucuuuagcucaguccaguugaggcagcagagccuuuccauagggguguggugugaccugaauguugggcacguggucguaacugagcuuuaaaagugaaugagaggagccaugcgugauggcucgagccuguaaucccagcacuuugggagaucaaagcugggggaucaccugaggucaggaguucgagaccaaccugggcaacauggugaaacccugucuguacuaaaaauacaaaaaucaguugggugugguggugggugccuguaaucccagcuacucaggaggcugaggcaggagaaucgcuccaaccugggaggcagagacuguaaugagccaagauugugcugcucuacucuagccugucucaaaacaaaaaacaagaaacaaaaacaaaacaaaacaaaaaaacacugucucaaaaaaaaaaagugaauaaagagagaagaaaggcggggcacgaugcuuuuuaagucuacgagcaucuuauagcauuguuuacaucccagcuuuucacugacccuuccuuuacccccgcccccaucccguggcccuugcucuguccugcccuuucuguacggcguuuucucuucccggcuccucugcccccagccccacgugccaacuuguuucagccuggcaaggaggccugcugguaucccagccauuuccugccccaaggccgcccacccuccuccgaucuagcauggccuugcccuccguaggcaggccucaccccugcggcagccgggaagcagggcuccuguuuugccuguuuacccuggcgcagggacagguagaucauguagcacugcugggaugccagcugcguaagucuccggcagugggcacaggcggagggcagggggcauuccucugggcugacucgagcccggccugccuggcacaagacccccugcuccuggaggcagcucaggggcuugcucauggcugcccuggcucugcgcugggccgcugagucaucgcucagcagugaggccucugagucacagugcagcccuggacuggacagugagugccuugugggacccuccugggcuuuccugucccucagagcauuuaaaggggucccaaauugucaugugacccucucugaugccagagagacacucuaggucuuucgcgcccuggucauuuuacagaacuguggcuggaugccaggcauucagagauacauuccucaaucucgguccgccuuacaggauccagcaucgaagaguucaguucaagucagcagccgaguuacaggaaagcagccagggcaaugauucagcaaguccaggcaggagugaaccaggcaagauuucgggaggagagggcugggucgcguguccuggcagggccacaggaagagcauacacaucuccugcgucuucguauuuugugagugucuugaaaugaccuugagaaucuacgcaauaccaugaagaagcaggagcaggaauaccauuuauccauuggcacaggguagcaugcucagugugcacugagguugugaauucuuguccugacccaaagaugcugaugcuguccuuauacccauuucacgguugaagaaacugaagguguaguaggagaagauacugacucagaggcacagaguuagaaagcagcaugucugggauuugaccccagaccugucugacucaguuuacuauuuuaaacuacccgauucaaguuaaguuucucuccucucucucugucucucuuucucccacguggcugcuggaaucuucccuaaggaccauagcugucugcagugcaggaagccaacuauuaaggggaaacaaaaguguucuuaggaguccugcugucacuguggauugagccggugaagcccugagggauuucaucgcugagguggauggagaagcagcugggggccuuggcuguaaggaccccuaaggguuagugucuggagcuugggggaugggaaugggucccggugugcggaaauuggauggcucgcugaccccaaggggaaacccuuguugacgcuguaaagugucuucuggccuuagagaaacccucuaggguucagguuccagcuucacccuccuuuagucagguggcuuugggggggacauuucugcuggcccuggcagacacuggacuagagcaguguuucuaaaguguagccccuucucucucccgggaagggagacaagugggugaggggauuggaaucugcauucauaacacacuccccaggagagacuggagagcaccuuucccggugaacucccgucaugucaggccucagcagacugagcgggaacccccaccagcgagguugcucaggacagcguuucucuugggccuguguuuggaacaaguauccuuugaacuaaucacuaaccugugaaaauggauagaccucgugugaaaaugaaaaugucuggcuucccuucugaggagcggaggcaugaaagguguggccgguaggggugggggccccacaccugugcagccgcccuggccagagcccacaagcagcguccccuggucaugccccacucccuucuccauaaucucgccccucccugaccaggccaccugacguugccauuuauauucaaguucauuccguuguuauucuuuuagaaaagagagaugagaaauauuucuugugccuacaucuuuaucaaaaguagagcaagaaacuugaggacucuguuucuagaaaaaugagagugggcaucccucuucucugaaaggaagaauuuccauaccugcccucuacccaauguguagacgaaaggaugaguguccuuuugguguguggagagcuuugauggggcaugugauguguagggcuuaggggguaugcugggguggcugggaaaggugguuggguguccugggaaggcuuuuauagacacugcguggcaggccuaggacucuaagugcuuccagccagcuguacauacguauauauuuuuuuuucuuuuuuuuuuuugagacggagucuugcucuggagugcaauggcaugaacuuggcucacuguaaccuccgccucccagguucaagugauucuccugucucagccucccaaguagcugggauuacaggcaccugccaccacgcccagcuaauuuuguauuuuugauagagacgggguuucuccauguuggucaggcuggucucgaacucccgaccucaggugauccuccugccucggccuuccaaagugcugggauuacaggcgugagcuaccacgcccagccccagccagcuauauuaacucaauggaauucuuguugaggacuaaaauggaguuuuuguugaagacuaaauaaguaaaugacaguggaguauugucauuauccccauucaauagauaaggaaauuaagguuuagagagucacaguaacugguccuggcuacacagccagucaggagcaaggcuaacauuuaggccuagagugcucuccuaaccgcuaugccuggggugaggagggaaaccuuccauccuugugucaucccauuugauauauuaguuacugaagcugaagcuaaaauaauccgagggcugggcgagguggcucaugccuguaauuccagcacuuugggaggccgaggcagguggauugcuugaggucagaaguucgagaccagccuggccaacauggcgaaacccugucucugcuaaaaaugcaaaaauuagcugagcgugguggcaggcaccuguaaucccagcuacucgagaugcugaggcaggagaauugcuugaacaugggaggaagaaguugcagugagccaacauugugccacuguacuccacccugggauacggagcaggacucugccuaaaaaauaauaauaauaguaauauaauaauaauccgagagugcuuaccaugugccuacauuguucugggauacugagaugaauaagaccucuuuugggcucuugaugacuugguuauaagaagaggcagcucgguucccccagggacucucaacaguuagggacaggcuggggcaugguggcuccugccuguaaucccagcacuuuuagaggcugaggcaggaggauggaguauguccaggaguuugagacuagccuggacagcauagugaggucccaucucuacaaaaaauaaaaaauuagcugggcaugguggugugugccuauagucccagcuacucaguaggugaaagaggaggagaugggagaauugguugagcucuggaguuggaagcugcagugugcagugaucacaccacugcacucagucuaggccacagagugagacugccucaaaaaacaaaacaaaacaaagcaaaaacaauuagguacagaaagggaggagcauccacauuuucugacauuguuuauugcuuuuuuacccucauguucuccccucuccuggcauugccuggcacuugggagaaguuucauaaauauuggucgaaugaaugaauggauauuaaaucauuuguguuuucuuuugugaguugaaaccgucuucaaaugagucuucaaagugcucugauucguaugguggagugugaugaaguuaaacucuggguugagaagagaggaaaugugaguuaaggaaauaaagagaauggaguugaauguucagaaucuuuggagugcugucagggauccaugauucugaauucaguuaucaucuuuggugugagaaauccccaaagauucaaacuugucaccagaaagguggucuuaggcugggugugguggcucaugccuauaaucacggcacuuugggaggccaaggcggcuggaucauuugaggucaggaguuuaagaccagccgguccaacauggugaaauacaacaugguguauuuugugucucuauuggaaauacaaaaauuagccgggcaugguggcgggugccuguaaucccagcuaccagggaggcugaggcaggagaaucacuugaaccugggaggcggagguugcagugagcggauauugugccauugcacuccagccugggugacagagugagacucugucucaaaauaaauaaauaaauaaauaaauaaauaaauaaauaaauaaaagauggucuugagguuucgguuugggcauagguuaccuucugcagaaugcaugugagugauauggagacaaguuuuaacaugggcacuuuuugaaaacagacaucuuaaauauuggccaaaaggccagaugucaaaguggacuuucuauuuuugauggaaaauuucaagccuguuuucuguaaaggaaugauuauuguacaaggauuucuggaacugcaacuggcccauagaugguggccauuauaguaguuuccuaugaaaucuacuaauguacagcaagcaguucugugacuuucagucaccacuugguuucuuuuuuuuucuuuuucucuuguggacuacacuugaagauucuuuuuuuuuuuuuuuuuuuuuuuuuuuugagacagggucuugcuuaggccggagagcaguggugcuaucauagcucauuguaaccuugagcuucuggguucaaaugauucuccugccucagccuccugaauagcugggacuuugggugugugccaccacgcuugacuaauuuguuuacuuuuuguagagacagggucuugcuauguugcccaggcuggucuucaacuccagagcucgagugauucucccgucuuagcuucccaaagugcugggauuaccagcauaagccaccacaccuggccugaaggcucguuuguaauggcacucuuaagugagauaaauugaguauuuucuuccucacaaccuucuuaugcuugucuguaguuggcugucucauuuuggacaauuuugauugucggcuuggcucuucaacugccuguguuguuguauucuuagaacacacagaacaaccaggucugggcuucuuaucuugcgaggcaggugaagaaagacuaggaacaauguauuugggugcccaccucauaccggccaugaccuucuauugaggaacagcagguagaugaagcagcuuucucauauuacgccguggcugacuccaaacuugaacucuggucucuguuuuuggagcuugcuuccuuccuacgacccuagacugcuccuccuaaauaauuaaguggcaaacauggcacagacaguaaccucacauaagaagcuaugagguuaggacagaaauauccacugcuggccugcgaacuauucacacaggucugacuccccgccagaguccuggcugcccugguccuguggaaucccgucauggcuucugucuaaacggagcaggcucagggccaugcugaacuuggagaaaucugugcaggagucagauuugggcuuuagagucaccugggguugaaucucgggccugcuauuuauugaaccuguccuagccucaaucgccuuaucuguaccauggggaugauaccaucuaggucgaagguaguugcaggagauucucaugcacggaggcccuuggccgucauuuguuucuuugucucuacaagcagagaggcugagucauacagauccugaggggagaucacuuucucuucccuccuuucgugugucaucuccaccuggguguggugagccccaggaauaaugcugugacaucaagccccgugaacaccuccuuucacacggaccccgugacuggcugcggcugccagcggugaugagaacugaugacacuccagggcuaccaggaacggugugugugccucugggcagggccacuuccuagaaccauggggcugcucugugaagagaaccggcucccagugagcuccaggagacgaggagcagguccugguggcggaggugcuggcgcaggaggccggcuccuggcagaaucggcuuccagcucugggcacuggggugcggugugggaccagcaacaggcugcuccucugccaggaaccgccagaaccaaagucuucucgaaggcaucuucagaaggcaagcacagggcugagcacuccggagaggagccuuugggggaaaacuuuuucucggagcuucggagcucagggaguacuaugggggagauucacuagguugaugcuuugcugauaggcagcccuguagagaagacaaggcagcugggcaugguggcucaggccuguaaucccagcacuucgggaggccaaggugggcggaucacaaggucaggaguucaagacuagccuggucaacauggugaaaccccgucucuacuaaaaauacaaaaaaauuagcugggcgugguggcacgugccuguaaucccagcuacucggaaggcugaggcagaagaauugcuugaacccaggagguggagguuguaguaagucgagaucacgccacugcacuccagccugggugacagagcaagacccaaucucaaaaaaaaaaaaaaaaaaaaggagaagacaaggcgacaacugugagcuuucugucuccuguggaguuuagcacuuggucagguggccauuucucucccuccuacucggugaccuucucaagggcaaggggcuccuugaagagugucuuucacauugaaacaugcacagaaugguggcuuaugacccaugguagaggcgugaacuugggaugccacuguggacguguccccagccucccuccucauugguguacugauaucguguugccuuggaccuauuaccucaccucuuccuggugauuucaccucaauauccccuuucuccuaugcuucuguuuuuccuucuacccuuccauguuuuuuucucccaaccauucuucuguauuuuauuccacccagccacccuuucaucuaaccagccuuccaccuagcuaggcuuccaacuaacuauccuuuuuuauugagacagaguuucaaguggcacaguugggccacuuguuucugaugggagccacuucucaaacaggucgaugacuaggacuuuggacaaaagcaugggugcaggcugggcgccguggcucacaccuguaaucccagcacuuugggaggccaaggcggguggaucaccugaggucaggaguuugagaccagccuggccaacauggcaaaacccugccucuacuaaaaauugaucaaauauagaucacccguaauuaucacccaucauucugacacuuagcaauagucacccuuaacaucuuguugucuugcuuucagaugguuuuguuuuugacauguuuuuuuuuuuaacuuauauuaugaccaucuccucuaugucuuuuaaaguuuuaaaaacuuguuuugaauaucuuuuccauauuucauuaugcaccuguacaggaaagguacuccauaaguagguuuuucuucucuguaaaauggggaaaauaagaaccccuucuacaugggguuguugcgaggaugaggugaagaaaguugucaaagccccucgcuaguaccaggcacagagcagguacugggcgcauguugccugcuacugguauuauugucauugucauugcuaaucaucagccaagucaguccugcggggcuuucagauuuccucugcuuuuaccuguugcaagguauaaaccuuuucaugugucucugauuguuuucuuggcagagccacccacaccccaggaauuuaauagggucuugaugcauucccagcuugcuguugaggaguauuuaaccagucaccacuccacaggcaauauuagggguugcugaggcagccuccaauagugugagcauucuaauuacugcagcaaacucuuuuaaaaaaauuuuaacuuuucuggcugggcgcguuggcucacgccuguaaucccagcacuuugggaggucgagguggguggaucacuugaggucaggaguucgagaccagccuggccaacauggugaaaccccaucuuuauuaaauauacaaagauuagccaggcgugguggcaggugccuauaaucccagcuauucaggaggcugagacaggagaauugcuugaacccaggaggcagagguugcaguaagcugagaucauaccacugcacuccagccugaaagacagagugagacuccaucucaaaaaaaaaaaauuaacuuuuaauuuuuauuuuuuagagacagggucucgcuuuuucacccaggcuggauugcaaugauacguucauagcucaguucauaguucauagcuuagaccucccaagcucaagagauucuuccaccucagccucccacaggugcacaccacuaugcccagcuaauuuuaaaauauuuuuuguacacaugaggucucacuauguuaccaggcuggucucaaacuccuggccucgggcaauccuggacuccccagaugcuggaauuauggguugagccauagccugcagcaaacucuuaaaacaugaggggaacuaucuuguuauaaaguugcuuuucuuugacuacuggugugguuggccagcuuuucauguuuauggcuuauuuguguuuguuaacuggucauuuccuuugggguguuagcaauuuuuuucucauugauuuguaagaucugucuugauuaacuugugaauuuugcagaugguggaaccggggugccccacaguaaguccccuuuguuaggcauccugucccuggauucgacaccuccauuucuaugggggacauuucuuuacaaaucugcaucugauugugauaccaaaccaugcuuugcaagugaauacaaggaucuaccccauuaaucugggcaguugcuaguuuuauuuauuuauuuauuuauuuauuuauuuauuuauuuauuuauuuuuccgagaccgugucuugcucugucacccaggcuggagugcaguggcaugaucucggcucacugcaaccuccgccucuuggguucaagcaauuauccugcuucagccucccgaguugcugggauuacagguguccgccacugcgccagcuaauuuuuugcauuuuuaguagagaugggguuucacuauguuggccaggcuggucucgaacuccugaucucaugaucuuucugccucagccucccaaaaugcugggaugacaggcaugagccaccgugccuggccaguugccaguuuuuaauguucucaggugaguggcauuugccaaggaacuucucucuucccuucugucuucauaaacaaaaaauccuacuaacuucaggugucaguuuaaaagucaucucuucugggagccccaccuuaaaccccuaaaucagcuguuggcgucggggguggacuucuccuuuguugcaccaauugcaauuucuuacuuaggugugugcuugugggaacauuuuuguaauaucagcuucucugcuaaggacagcgaucaugucucuuuuaucauuugguauguguugcugcagcacuuagcacagugcuuagcuuggaagccaaagcccagagggguagaaugacuugcuugaggccccucagcuuggaccuggcagaucugggacccggugucugggcccaccuucaagcuggaucccucaggacccuguguaccuguggccagggcuuugcuuuggugccuggaugagagugguaagaguugcugaggugccaggccuuugcccccaugcccgcuggcaucacugauuccagguuauuuuggcucagcgcggauggagcgagauguaggggaaagguugggaccggcuuccaggugauuggcacaucccugcccuaaacccugcauggcuuuccugggccugccauccaaggggaaagaagccucuuuccucacaagcugaagcuugaaaccaaucaagcuccaggccagagaagcugcagguggggugugguuugcaguggggguggggcaggaaagaaagguuacguggggugaaggggucaggucaauucaguguggguuggaaugcugggguccugggugagcagggaugaaggacaccuggggaggggagagagccugccggcuggaacuggggcccugccagucccccgcugcaugagucugggcaugcuuccaaucucugggagccucagccuccugucuguaaaauggagcuaaugaggccugccgucaggguuugugggcaagauucaguaacuggaugccugcuccuggcccuuggcaagcauucaauaaauguugauuucucucccaccccucgcuccuucucuuauucuuuuccuguugcuuuucacacggacauguguugaauguggcaggauauuucuuucuuuuuuuuuugagacagagucuugcucugucacccaggcuggagugcaguggcgcgaucucggcucacugccagcuccgccucccggguucacgccauucuccugccucagcccccugaguagcugggacuacaggcgcccaccaccacgcccggcuauuuuuuuuguauuuuuaguacauaugggguuucaccauguuagccaggauggucucgaucuccugaccucgugauccgcccgccucagccucccaaagugcugggauuccaggcaugagucacugcgcccagccaggauauuucuaacacagagaaauucucaguggaggccgcgggaacuagagauagagguccucuugccuaccaaagcaccagauggaggugacagaggccaucuuguccuagagggaccuggcuaagaggaucuaagaccagaacuagucugagugcuugggauucauauggggcuguagacggcaggccugcuugaacaccaguguuccaaucccacaucucauucuuagagcuguguggcccugggcgagucucuugccacuauuucuucauccugaagugggcaccacauuacugcaccucaauuuggacgaggauucucaggauggggaggugguugaaaucauccaggggucacuggaaucaggaugguccuggcuuuuucagaaggacaaggugguaggugccaaucugggggcuuugcagauauugaacggcagccugaggauggggauaaaccuggguguggcagacagaauuaugcuucccccaaagagguucacauccugaucucuggaacauggggaugucauaugccauacagagaagggaaauuaaagucacagguggaauuaaagcugaccuuaaaagagggagauccuuuuagauuauccagagggcccagucucaucacagaguccuuacaagugggcgagagaggcagaagaaggguucagaaacaugugaggugacaaguaacauugcuggcuuugaggauggaggaaggagccaugagacaaggaauaaccgucccuagaaguuggaaaaggcaaggaaauaggaacucccccagagccuccaggaaggaacacaguccugcuaacacucagugagacccacuuugaacuuuguauguucagaacuguaucauaauaaauguggguggauuuaagccucugaguuuguacuaguuuguuccggcagcccuaggaagugaaugcaaugggcgcagcauuugauggccagccuggcauccagccuguggggagugggagcugagggcaguccaagggaaauguccuuugaguguggcaccggcaggcaaacccuuguuugggugugaucaucagugaguugggccacugaagcugccuggugaccuggcagggauggcuuaaguaggcaggguuugcagaucagcgagauaaaggggcuugcauaaauucacaugcccauggcuucucccucugacagcgcagcccugccuccggcugccuggccaggauggcguguuggugcauuagggaccccuuccucuccugcccugcuguuuaaauuguuggucuguuggcguucucaggagcccuuuaccaguacccuuaggccccagacgaccuacuccucaagcugaucauaucugcuggcugugucccugcucugggcccagcacccucaugguuuuccauaacacguaucccaacuccugcugaugggacccucgugagcugucuguguagggagcauggcugccccugggucugcuuuccugccccugacccacaggaauaggauguggcagagugggggccagaugacagagaugcuggugcucucugagcugaggcccacugcugaccugcugguggcuuguccugcucuuggaucauaggcacugggacauccugccuuccuucaguguccccucccacucccucuccuucagcaucagaggaaugaaggaggccuggaggaguagccccuaucuaauagagacaggagugggcugggugagcaugggguggucgcagggggaaggggauaggagauggagagaggaaccugcuaucugguggguuccaggauggugacagacaguggcagaagcagugcagagaccuuaguuugugcuggagguucaguuaaucacuggugaaggcagacaucacugcaggagaccagacuguuauguauugucugugcauucauauuaguacacagggaagaucuugggcuccgagaccuaggcagaucuugccucccaucugccgacccuccgcagaugcuacacauuaugccagguaaacacauuaucaaggagccuugggccguguuagaggaaggcuccuugugccugugaggaguuugcacuaaugcuauguguguuuguguguaaggcuugcauucacugauucacuguagaggaugacuugaaacccaagucaucagcugggcagugcaugggcugcucgccugaauggugaagcucuaccaagugguuuccaccuagggccuggcuuagcuggccucagaugcccuucucaguucugcucaagaccugccugcggccuuccucgggcuugcuugcccagaaugcuaggaauggccagggauacugccugggcauguguuuggccucagccaaggucaggcugucaggaaggaagaagggggaggggcacacuugccugggaggguggaggaggagggguccaagccgccacagccuggcaguccuuuuuugugcaaaggagacccaucagcuccucugccuggaacacccccauuuacuccuccgcaguuagaggggugggaggugaggaauuuugugaggggaauuaucucugaucuugaugugcacauuccucggcaguaucccgggcuuggccagcuugcugacaccuggcuggaauaacaaugagcgaugcuucuggaggaugcuccgcuggggagggcucugcugaaccagcacuuacucccugcuuuucgauccucacucugccuuccugucugacaaaggccgggcuguugggaugguaaugcccucugggcuggccuugauugaagguaaaaaaugaacuucgaggauagccccuguggcugugcagucucauuuuuuaugcagauauguugggggaugcagagacaugguggcgggugggguggggagaaggggacugggaaaucugagaccugaagcuaagaucugagaugucauccuuuauggagcaucuccggaugaaaaugucccagaggcccuaggucacucacccucugcccccuaauaaaaucacuguugcugccuccugcugaaucugaaguaugccuucacugagggcaggacguccaucucaacuauuaucaaaggaaaacauaacaagaggcaacagcacagcccccggggcaugaggcuccuuccucugugaucccucuguccuugucugccaguguuuuuuuccuugacuuuuaaaauaaucuuuuucuuauuaugaaauagauauuuauuuugcuuaacaaagaauucuguaguccuucuagaagcuagguaacucuucuaaguccuuugcaaauauuaagucauuuaauuuaauccuagagcaguucugcgagguggugggaagaccuagagagguuaggguccaccuuagcacuagcucucugagcuauaaggccucagggucuguggcauucccuacucacugaaaagaagggaauuuaaaacaugaguuccaccacccagaaaugaaacaguguucauuuccagaauccaggcauaugguugauuuuaccaauuuccugucacuugaaucacaguuuuuuuuguuuguuuguuuuuguuugagauggagucucacucuauugcccagguuggaguacaaugguaugaacuuggcucacuacaaccccgaccuccuggguucaagcaauuuucgugccucggcuuccagaguagcugggguuacgggugcaugccaccacacccagcuaauuuuuuuguauuuuuaguagagauggguuuucgccauguuggccaggcuggucuccaacuccugaccucagguuauccacccucagauuauccacccuccuacaccucccacagugcugggauuacaggugugagucacugcaccuggcccacagguuuuuuuuaauaguccuguguguauaauuuugcauccuauuauuucuccuuccuuuuaacauauauauauauauauauauauacauauauauguacauauauauauauauguauguauuaucucuuuacuuuuuaaaaguuucucagacuuuaagaauuacuuaaaauuucccaaaacaaacccacaggcacugcugugaucuucaggcacacuuugguauucaggaguugcuucugcuggaccaaagucaauaacaaguagcuuaagaagcuguagauggcagagauaauauugacuggaggcuuaggggucugguucaggguggacucaacaauuuugcaaguucuauauuguuaaaauuacaaugaauuauuuauaagcaguuguuaguaaaucaugaaguuggcauuauuauucuuuauuuauuuauuuauuuugagauggagucucgcucuguugcccaggcugaagcgcaauggcaugaguucggcucacugcaaccuccaccucccagguuccagugauucuccugccucagccuccugaguagcugggauuacaggcaugcaccaccacacccggcuaauuuuuguauuuuuaguagagauggaguuucaucauguugcccaggcuggucucgaacuccugaccucaggugaugcacccaccuccuccucucaaagugcugggauuacaggugugagccaccacgcuuggccuauuuuuuauuauuaaaaaacaaaaugaugcugaugcuuucaaauauguauugcagucuuauuacuuaguauugagcuuugcaguguuggacuaauaucacaagucgaagggacaaagaagaugguagacaauaccaacuguuucccauuaggcucuuucccuccucuuguuuuucugagaccuuaagggccugguuguuucuacuguucccugcuacuucauaaccugcaagcuugagaauguuugucauuuacaaauuuuaccuuauaguagaagaacauaguaaauaauuguaccagauugaguaguguccccccaaaauucaugccuguaugaacuucagaacauggcauuauuuggacauaggguuuuuguuuuuguuuuuguuuugagauggagucucgcucugucacucaggaaggagugcaguggcgugaucucggcuuacugcaaccucugccuccuggguucaagcuauucuccugccucagccguccgaguagcugagauuacaggcacccgccaccaggcuuggcuauuuuuuguacuuuuaguagagacagggugucaccauguuggccaggcuggucucgaacuccugaccuucagugauccuccugucucggcuucccaaaguguugggguuacaggcacgagccacugugccugguggacauugggucuuuuuagaugucauuacuuaagaugauaucauauuggauuagggugggggcuaaagccaaugacccauguccucagaggagaagagagggacauaggaaagaaggauuuguagagauacagggagaaggccaugugaccacagaggcagagauuagagugacacagcuacaagccaaggagcuccaaggauugcaggaagccaccagaugccagaaagaggcaaggaaggaucuuucauggagccuucagagggagcacagucccgcugacaccuugaucuuggacaucuaguccccagaacugugagagagugcaucugcugauguaagccacccaguuuguagcaauuuguuauggcugcccucagaaacuaagacaguagccaacacagaaccaaauacccuuuggggauugagggaaguggagcgggagaaugagcggcacucccucccuuuacauaggacuacuugguaaauauuuacugaaugaaggaaagcugaaguaucuguagaacuggccauuucauucugcauuuagagcucugggagcucuugaaaugucuagacaaacauccucuucagcuagaggaagcuccuucucccacuuacuagcuaugagaucuugggcagauggcuuaacauuucugggccucagugaccuuacuugcaaaguugucugggucaaggcaaugauuaaaugcgaugaugcauguaaagccccagcaugcagccugaaaaugugagcccuuauuauuuauacuguuugccaaaguggugaguaguguugcugaauaugccguguguccuauuaacucugugacggccacagucacgucuccuuucugccuccuccuccuccuccucucuguccagugacuagggagggcaggaaguucagagggugaaaugcugaauuaauuccuguccuccuggucuauauuccagaucacccuguggguggguugaaaaccaugcccugucuaccuccucugcaaggaaaaaauaaagacagagagcaaaucuaaaacacgcaaugcagaggaaugguuacugccugcugugugccucuccagggagcaccaggaggggcugugugggacagggacacugcguauaagugacacuccuccacauuuuggccuggaguuagcacauacaacugccuuuuugcugacgcgaugcccaggagcccucucaggggauggcaaaucucagaauaaauguguuuuuuacucauggaaugcaggggaauggauaugaaaacuuuuguaucaaauagacauuagcgaggagagggaugcuucacauccuagguuugugugaugucggcacagcugaugaggucuuugcaaauuuugcugcugaggaagggaugcgcuggacucccaguguccaggggcccucugcuugucuguccuuaggcagaguccaccagaaucggguaaaguaugugacugccucuuaguguagggcaugacgucaacugugaggagaagagaucaagauacagcucuuuggugguguuuuuugacccauauccaggaacuguucccacacccagagaggaauaucugcaaguucuggugccagauguugauucaaaaacaaaacccagcgaagcaucuguacuuuuuuuucugauuguauuagaaguacaguccacaauaauauauuguacauuuaaaaauaacuggcugagcgcaguggcucacgccuguaaucccagcauuuugggaggccaaggcaggcggauccccugaggucaggaguuggagaccaaccuggccaacauggcaaaaccccgucuccacuaaaaauacaaaaaaaauuagccagacguggugaugggcaccuguaaucccagcuauucuggaggcugaggcaggagaaucacuugaagccgggaggcggagguugcagugagcugagaucaugccauugcacuccagccugggggacaagagugagacuccgucucaaaaaaacaaaaacaaaagaacccucaaaaaacuaaaagaggccgggugugguggcucaugccuguaaucccagcacuuggagaggccgaggcaggcagaucacugaggucaggaguucaagaccagccuggguaacauggugaaaccuuaucuccacuaaaaauacaaaaauagccgggcuugguggugggugccugugacccaagcuacucuggaggcugaggugggagaaucgcuugaacccaggagguggagauugcagugagcugagauugcgccacugcacuccagccuggguggcagagagaguauccgucucaaauaaauaaauaaguaaauaagaguuuaauuggauuguucguaacacaaagaaaggguaaauguuugaggugauggaugccccauuuacccugaagggauuauuaugcauugugugccucuaucaaaauaucucauguacccuauaaauauauaugccuguguacccacaaaaauuaaaaauuaaauaaaaaguucauuaaaaauaacuucaaacacuacagaaauguuaaaaguagaagugaccuuuccguagaaugucaugccuguacuuuggcagagaauuucaauggaagcauccagaaaacccuggcucggaaucugagcuugauuauuucaguguuucaggucucacaugggggacagucuugccacugucaaaggccaucaugagaguuacagcagacuuuugaugaaauuauguccacaguggucccugguccuuugugguuugagauauauucuuuguccccacgccugccccuugcuucagaucuucuaggaauccagauacauuaaagcaaagugacgggacagcccuguccauuuccugaucuguugcugacuguaccacugagcugcucucuccuacugagccccgcaugguuccuccuguuuuccugcccucucacuugcugguguuggccugcucuggcuguucugcuugggguuaggugaggauauggggcagaaggcuuccagccuggagcgccuauggugucccaagacaagggccugccucuggccucuggguguguccuccugcgaguuuuagagaaaucugggcaggcucagacugaaugccugcuucuccuugcagccuucugaagauucccaugacacacaccugauuuaccuucagcucuuuuacuugcuggguaagcacagcccuggauuacuuggcaucuggaauuaacugaaggguaacacuuucuuaaccuuauuuggaaaaugaauaggaaggagaccccuucuaacuucuggaagcacaaaaguguguuuauccuucaggagcauucuuggcugcugaaaaaucaucauggcuagcuuucacuuucacguauugagcuaguaggugguaucaauaguagcuaauaucuauuucauguuuuuuuguguaggagggacccggcgugcaauuugcauggauugucucauuuuauccucccagcagguaaaagagcugggagggaguaaagggaguuguuaauuucugagaaggaaggugaaacuuaggaauguuaaauaccccucuugguguacacaguaugcaauggaggcagggugcaaaugugcuauggagauuucagagccugggcuucccagaggaggccuuugccccacagaaucuuugcuccauuucuccacuuugcugccucuaugaaucaaugauucuguguuguccauuuuuccuuugcaaucuuuugccaucucuucauuaaaaauggucuccaucauucuggccaagcacagugacuaacauacaauaggugugcaguaaaugucuaguggaugaauacccagugugaacauuaauugagcaccacuagcugccaagcagccaagcacccuauaucugggagauguagaauuuaaggcuguguagucacuguccucaagcugcucacagcuuuguguaagacacucaagggaacaugcaaagcucagggcagcucaauuuggggcgaggguuauggagaaaauacagucugcaugcuuuuaguacaugcaguucugcaucuuggggugcagugcuagagugaaugacacaguagaggugacaggcuuaggauuuaaauuugauaaugucaugaugccaugggagcacuggagaaggggcagcaguggauucagcugagagucgcaagggguuaaugagaagauugggaaaggcugcacagaggaggagaagggcuuuguaggaugaguagagguucaccaaggguggguaacaguuagaggaacagcagguacagaagcccagaggagaaucagugaaugacacauccaccauguccagagaucagggaugguugcagcugaagcuaaaaguguaagagcuuggacuguggaucuucaaucccaguucaucuuauucccacccauauggcuggugcuaugguuuugucaccuguaacacaaguaugagacugguaccuuccuaggagggguguugagagucugagccacacucaaauucuuggugugcagugucucugaucugaaaugugcaccgugaauguuagcaguggguauuaccuuuggccugauugugaagcggguuugagacagaagugaagcaguucaauuuguugugugaucuucuucuuccccaaaagaagguuuucauccuccuuaaggcuuuugcccacccuucccuuccuucacaucccugguggguacccuucccaccugcaggaagccuacugaucuuugaguuuuggccugccaccuggcccuucccucgcucugcagucuugguuggccuccagguguguguguguguguguguguguguguguguggguguguggcccugggcugcacugugccugcuggagcaggugcaguugcccuuucaccaugcgugcuucuuuggaugugaccccuugggugccuguguauuuagaguggaggaacguccuccacuauaaugaugagaagugucauugcuaguugcacucaguuuucuaugguguuugggggagaaauuggggugcuggauuuugguuuuaacucuuucccaccuuaaccagugacuguggaaaguugcacaucguccccuuccucacagcuggggucuguucuuccuccggguguuacgguuugugagagccaggaggguacacagagguggccugauuucuggagccauagcaagaagggagagguguguguccucucugucucugucucugucucugucucugacucugucugucucugucucugucucucucucucucucucucuucuuucucccucucccuuuuucacauguuguuuucugauuauaagaggaauacuucaucauuagacauauuucgagccuccguuccucaucuaugaaauaagcauaguaaaggacugaaggauuuaaagggauguggccaagugugcaaagucauaugugcucaauaauuuauuuuccuuguuuucuuuuccauuuccuucuucuccucuaaggcgcuccacaucuccgugauauagcguguacuccuuuccucauuuucuuuucucugagacaaagggaaguuccuaguucugcuauuuccuaguucagugaccuuggacaaggcacccuggggagccuuagcugcucauaugcacaagcuucuagcaacugcuuccaagggaaggguggggaggaagggagacccugaguguuuggaccccgccugugcucagcacagaauggagcucaguaagggcaggucgugggcuccuucuucucccuuucagcaaccaucacucguauucuuuuuuaucuccaaggccucaugcuggaaagagauugauugcucucugagcaguaaguccucugaaacaggguuucucuggggaguucuguggcaccccugccuuaccugggggaccuggcaaagaggcacccuccacccccccucacccucagccagguuuacugaacagaguuacgggguugggccuccggaucugcauuggagcaaguccacagguggugcuuaggcacacucagguuugagagccacugaccuagaggggaagacugggagaagccuuuuaagagaccaguacugugacuugcaccauggagacaccuggaaaacauacagugauucacacacacgccccaaacagcaguguguguguguguguguguguguguguguaugugugguuucacacuugguuugcuaugaaugcuguaaugccacccaguucccacagagcucuggggacucagguuccccaagucaggguucuuuucuggagugcuauucugacagguuuuuauuuuuauuuuuuuaauuauuuuauuuuauuuuuauuuuauuaguauuauuauaucugacagguuuuuaauacagugaauuuguaugucuccuguguauuuauuuuagcugcucccuucuuuccccuucucucccuuuccucucaucuccucccgcuuucguccuuuaccuuucccuggaugauauuagcauuacccguacacucuucccaucuccuggccccuccaguucugaagggauggggacuaagugggaucuguccucuaagcaggcggaggagggaaccaugucagcuccuaggugcccccagagcaccugcugccaguuuuccacaacuccuguccuccguggcgcuugggugacagcagagcagagccgaugugccugcuccuggucaugggcuguucgugcugucaucgcuuucauuugccccauccccccaauuuggacuuacccagaauccuugggcaagcuagauggcugccaaaguuuacuuagcgagaugugccugcgugacuugaguagagaccugcuucugagaaagucagaagugcauuccaaagucaggagcgugaccuccccggaagcccagcuaauccagguuuuaaagaggaguuggaacaaagguggugcuuaugggauguauggagcugugggaugugggagaggacagguuuagcagaguggcgugguggaaaguuuccucucgccgaggaggacaacuccccagcgccugagacagcgggagcucagagcgccuagaaugugcccagauucuaaagugaagcaggcuguggugugaugauggcccccgaggggacuugcagucuuauggaccuggguucaaggccacccucuucagccacacaaacugggcaaggggcccgcccuuuucacgcugcuguuucuguaacuuucagauaugagaccugucugugggguugugaggauacauggggauuaagugggaaauuaaaaggguuuucuuugugacuggugacugauaaaugccauuuccuuucauccuccuuauuuugacauuagccccaaccucuaccccgagggucucucucucucucuucccaacuuagauuccucucaggggacacauagacaacccagaaaagcagcucugaucucucguggagcuucccugaacuccacaccgcacaucuacuacuguuuaggauaacauuuugacuuaguccuuaaacggacuauuucucauaguccuguuuuguaaaugagauuuuaagcucuuugcagacagggaccaguauaaacucuugagucucugucaaacuuagugaacuuucuuuccagccugggcaacaugaugaaaaccucucucuacaaaaaaaauacaaaaauuagcagggcaugguggcucgcacccguagucccagcuacucuggaggcugaggugggagaauugcuugagccugggaguuugaggcugcagugagccaugaucacgccacugcacuccagccugggugacagaaccggacucugucucaaaaaaacaacaaccccccucccccacaaaaaaccuuacugaacuuucuuggagaacaugcacacuguagaaccuucuguauuuggaaucuucaagugcagguccugcuguucuguaaagaacugucaccuugagucauuguuugacggcucagguccuuggcacuuuaccccuuuguucaugauugauugacauuuggaccuuugcugaccuuucccugagggauuuugugggcauagucaaacaaaaggaaauugaaaaaaaaaaccccacaaauuuugaaggucugucacuuggagaagaacaguguucaugacucuucuucgucauuucagcaucuuaaucaucuugagccuaaagaugaaggagaguggaggugagccugauuaaaugggagcuuuuccuauauugaggaucuacuaggugcaaggaccucacuuggguuaucucuagccuucccccaacucugcaaggcauuucacagauauggaugcagguucaaagaacugaagcuuaaagcuucgcagauuuggaagccucagagcuagaauucucccccuagccuguuugucucugaagcguugguuauugcuugacauugcaucccucccucuuuuuucccucucuuccucuuucccuucccugccacugucugccugucuuccugucugccucucuuucugucuuaaaauuacuguugcuauuccuuacuggucuggucuggucuaguuaauuaaaaagaaggcuaucgugagguaacccugggauccuuauuggcacagucauauucccauaacuuuuaggugccugaguccuaauggaucuguaagacagugcccaucagcgagaaauacccacagccucccuggaugcugcccacaggcaucuugcagaugaggguguuugccuucucaccugcaaggggguggggagaaguggccaggggugggcuguucuggggacgccugccuccccacucccugagccuagggggaaugauauuauggcuucaggccacaacuagacacauuaucuacucugacagggagccagucuggagaaggaugucauggaugacgugaagaaauuacugagggaaaaagagcaaggcgugagcccuauuggggcuguuuuggucaacuccuggcaguagaugauauugaugcuuuggaaaucucuauuuuccuugcauuucccagcaaagugccauucccaucucuuucuuuuagaagcuucuuauccuauggcucugccuccagucuuucucaucacauaauucuucaaaggcaaggcagacuagugguuaagaacaaagacccagggcugggcgugguggcuccugccuguaaucccagcacuucgggaggccaaggccgggguaucaguugaggucaggaguuggaggccagcuuugccaacauggugaaacccugucucugcuaaaaauacaaaaauuagccgggcgugguggcaggugccuguaauccuagcuacuugggaggcugaggcaggagaaucacuugaacccaggagguggagguuguagugagcugagaucacgccacugcacuccagccugggugacagagcaagacucuaucucaauuaaacaaaacaaaacaaaacaaacaaacaaaaaagaacaaagucuccggaggcagugccugggcucguauccuagcucugucucuugcugacuccugcauggcuugggcauacuugggcuuugcugugcaccaguguucucguuucuuagugaguucguaucucacagcauuguuggagauuacaggaacacaaccaaugcucucagaaccagcacucaggaagugugguaauuacaugcucuucugggcuucuggucaugccaccuucgacggacaaugcgccagcacccaccaguuuaaggaccaguuccuccucuaggcauugugcccagcgcacccuucucauggagauuugcuucucacucugcaucugcaggucuucgcugggugaucuugggcaagucacuuuacuucuccaggccuuacuucucagcucuucagugaggacauugaacgagauuauuuccaagguuucuugugugcugacguacuggggccucucacauucuaugugguccaaccuuuccuccuguuccucagcuucugccagcccgccagggcaaccugguuaucaacaaauguccucgcuuauggacauguccugcuucucuggaaaucuuaguacagccugaaagcuccaugaagucaggauugugucuuucauguuugauaugauuucuggcuucuagcacugugcuaggagcuagcacgugaacacugucuguguagcuggaauuaaucacccacuauuccagucaacaauuccuuuuuucuuugagacggagucuugcucugucccccaggcuggagugcaguggcaugaucuuggcucacugcaaccuccacuuccggguucacgccauucuccugccucagccuccugaguagcugggacuacaggcgcucgccaccacgcccggcuaauuuuuuuuuuuuuguauuuuuaguagaggugggguuucacuguguuagccaggauggucucgaucuccugaccucaugauccgccugucucggucucccaaagugcugggauuauaggcaugagccaucgcccccggcccuuuuuuuuuuuuuuuuuuuuccgagauggagucucacucugucucccaggcuggagugcaguggcaugaucacugcucauugcaacuuccgccugcuggguucaagcaauuauccugccuuagccucccgaguagcugcgacuauaggcgugcaccaccaugacuggcuaauuuuuuguacuuuaguagagacgggguuuugccaugcuggccaggcuggucuugaacuccugaccucgugauccacacgccucagccucccaacgugcugggauuacaggcgugagccacugcgcucagcuuuccagucauuucuuaagcgauguugaguucccaagcacugugccggacacgcauggguugcuggaggcuggcagaacccgaaugucaguauuccugaagaauggcucuaagcaauguaccuugcagagcucaagcagggcucugcugcaucaugcccaugaaggugccugcugguagaaggcugguucuauacuggcugcuugccuccuccuuguggagacccacauugugucuggcaaagugcagaaggaaaucaagcccuuaauaacauuagggaacuggacuggguucgguuugcaucucccgagucugacucgugggaguaaccaccauaauagcagcgcugugcuguugagggugacuuugacuaucugcuuguguugugagcccacugugugccggagcacucucuauacauucagucuuguccgcagaugaacuccaguggacacauguuucuauuccuuauuauuauuauuaucauuuguuuuucugagauaauaauaauaauauuauuauuaauauuauuguuauuauauuauuauuauuauuauuauuauuauuauuucagauggaguuucacucuugucgcccagguuggagugcaguggcacaaucacaaucucagcucacugcaaccuccgccuucuggguucaagugauucuccugccucagccucccgaguagcugagauuacaggugcccgccaccacacucagcuaauuuuuguauuuuugguagcgauggaguuucaacauguuaguuaggccggucucgaacuucugaccuuaggugauccacuugccuuggccucccaaagugcugggaucacaggugugagccaccacacccggccuauuauuauuauuuuuugagacagggucuuacuuugucaccuaggcuguuggcucacugcaaccuccacugacuuccuggacucaaggaauccucuuaccucagccuccugaguagcugggacuacaggugcgccaccacugccagcuaauuuuuguauuuuuuguagagauaugguuucaccauguuguccaggcuggucucaaacuccuggguucaagugaucugcccgccuccaccuuccaaagugcuaggauuacaggcaugagccgcugugcccggcuuauucuuuguuuuauugaacagaugaggaaacacuuucaaugagcuuaagggaugugcccaaggccacacgguugugaccacagcaugaggauucacaccuugguuccuguggcucccauccccccuccccugaaugaggaaucgggugagugugacgggagcaggcacucgaaggcuugggaauuccaaagcagcugauccaugucaucccagcacacguuagggaggaagugaaacgaagcaaaaauagagccugucagcggggggacagcugccgcuuucucugggaacagaucuccccgauuuaucuuccagguuaggaaagccccagcuccugggguaccacagagaaauaaugugagcacagccagagaaauugccaccucucccuuccucagaagaagauaaaggagacaucgucuuuuuggcaucaguuuugaagaaaucuuuuuuuuuuuuugagauggagucucgcuccuguugcccagccuggagugcaauggcacaaucucggcucacugcaaccuccgccucccagguucaagcgauucuccugacucagccucccagguagcugggauuacaggugcccgccaccacgcccagcuaauuuuuguauuuuuaguagagaggggguuucgccauguuggccagucuggucucgaacucaugaccucaggugauccaccuccucggccucccaaagugcugggauuacaggcgugagccaccacacccagccaguuuugaagaaaucuuacuucacaauccugagagaaagagaaauugaggcacacuuagcaugugagacugauuucucacuucugcugcuacaacugcugccccauugaccgggucucagagguguuauaauuaacauccucugacucuugcugguacuaaaauuaacaacaugacuggucccuucugcaagagagggaaagagauacacacaugugcacauacacgcacacacaugccugcacacacacacuugcacgcacacaugcaugcacacacaucacacacacacacacacacacacagacacaugcggaguccagaaggcucagagacagagagagagagaggaaggcacagccacacacacacugggagacacuuauuauggcucccccugcaaacggugcuccccucaaagcuuuaggaccagggacgccuucccucacuuucuguguucuguaccucauaccccauuuaccagccugugccaacccuguauacuuuaagucuucaguuaccaaagcauccaucugcccguccuauauugagggggaguggaugcgcagagguggucuguugguguuggguagggaauagacgcagccuguuuuucguuuuucuuccaaaugucuucggcagggccucagcuaguggaaauaccugguggggagggucaagaaggaaaugacaguggggggaauggggagggauagcauuaggagauauaccuaauguuaaaugacgaguuaauggguguagcacacaagcauggcacauguauacauauguaacaaaccugcacguugugcacauguacccuaaaacuuaaaguauaauaaaaaaaaauaaaauuaaaaaaauaaaauaaaaaaagaauuccuauuuuaacuuuggaaaaaaagaaaaaaagaaggaaaugacagauuugguccugacagccugggaggcagagaggagagagauggagccaagagaauggggcuggggccacguuuucuuguggggcaauuccgugucacugggccagagcaugcuuauugugaagacuuccccucaguguccucuggggaagggucagcugugaggcaguggggcgugagaauacgaugaaacagggaaaccuggaagcugccgauucccaggccuugaagggguguucugaugucuuugacauuccagcaaacauauuuucacaggaaaacucaaaaaauauaaacucccuuuuuauagaaauaaugugcauggagaaaagugcacaugucauauguguaucgauagcuugacgaauguucucaaacugaaccugaguguggagccagcaccuggaucaauagaacauuuccagcauuuuggaagcccccucccagucagucacucaggagaacuuuguccugacuucuaaccacacagauuaguuuaaccuguuuauguacuuaaucuaaauaacaucaucacacacuccccugugucuugcuucuuucacucaaaauuauguuugugggauauauucaugugguacgugcauuuucagaucauucucacuggucgcuagauugugugcauauuuuaaaaaauccauucuacuguugaugggcauuugaguaguuuccaguguuuggcuguuaugaauagagcugcugugauauccuuagacuugucuucuggugaacauaugcacacauaucugugcauugauaccacggaguggagcugcagggucauaggguuuggguauauucagcauuaguaaauagugcagaacaguuucccaaagugguuguuuauccuuuuucagagugucuguucaccagcacguaugaauuccaguuccacaucaaagccaauuauuggcauugugugguuuuuaaauuuuagccaacccauuacagaaagagcaaaugaaaggaaucuaacagcaaguaaucaggagagaaaagaaaaugcucccugagaaagcauuaugauuucaugauacgggaaaucccgguguacaaugccacacauuguguacuuuugcaggcggagggcgaggugcagccaccuucuugugagcaucagggcaguccuugccauuggucagggaccaccacuugacugcaguaauacccaacagaccaugucauaauucuuccucaggugacagagcuuuaauggauccgaccccaacagaacaaacuuggcuucagacuugccugugggccucaguaaauauucaacagacuguguccccuguucacuccccugucauuagcugaggcugguaccauaaaucacagcuccccuuccuguuguaaguggccccucucagcugacgguacuccaguccugacauucaggagcagugccucuccugggcugcuucccagggcuggcaggucuugguggucacuuguaggagccgaggagugagugugugcaguccuggagucacugcuguggggugacuugcaggagccucuuccauuugaugugagaaugauagauccgucaagcucuuaauaugugcccagcaacaugcuaaguccuuuauguuguuuauugcaaccugucacaguccauucaggcugguauaacaaaccaccuuagacugguagcuuguaaacaacagaacuuuauuugucaugguucuggagguggggaaguccaagauuaaggcucagacauauuuggugucuggugagggccuguuuccugguuuagcaaugaugccuucuuguugggucuuuauauggugaaaggaucaaauaagguauuuuauaccucuuuuauaagggcacuaagcccuccagccucaugaccgaaucacuuuucaaaggccuccccuuuugagaucaucaccuuggcaguuaagaguucaacguaugaauuuaggggucggggguguagguaacaaacauucaaaacaucauacaaccucacaguaguucuaugaaaugaguagauguuguuuaccaccauuuucagaugaggaaauuaaggguuaaaaacauuuccccagaguaagaaacguaguaaauuugggagucuaacuucaaacuguaauuuuuaauuacuguacuuccuucuucuuuucucuuaggggcuguuuagauacuugagcuuccuuuugaagccaucuuccucuugggucuaaaagcuuucagguagauuuaaaugggacaagaaggccagaugcaguggcuaacaccucuaaucccagcuauuugggaggcugaggcaggagaaucacuugaaccugggagguggaaguugcagugagcugagauggcaccauugcacuccagccugggcaacagagcaagacucugucucaaggaaaaaauaaauaaaauaaauaaauaaauaaaugggacaagaggaagugaccugcagagcacauauuggguucagauguaauuaucugcuuuuucaaugauuuuaagaaauuagaaccacuguuuuucucuggcucuuuucaugacuuuuuucaaauguugguuuucagcaguucaacuauuauauacuuaggugugauuuaaaaaaauauauauccugcaugggauuugcugauauucuuauaucuauaaauuaaugucuuucacugaauuuagaacacuuucaucccuucccacccccgauauugaucuugcuccauucucuucucuccuuuugggacuaaaauuacaugucuguuaggcuuuuugauauuguccuacaggucucugaggcucucuucaauuuuucaaauuuuuuucuguuauucagauuaaauaauuucuauuggccucuccucaaauuguacugacucuugguuccucuucagucugccguuaaauggauccaauugauuguuucagauuuuuuuuuuaauuguagaauuuccauuuggcucuuucuuugcuaagcuuucuuaucuuuuuauuuacuaagaauacauuuuccuuugagucuuugagcauaguuauaauagcugcuuaaaaaacccuugucugcuaauuccagaaacugggucaucucaggaucauggggacgguccccauaacuaucuuuuuucuuaagaauggauuacauuuccuguuuuuguuuucuuuuuaguuguuuguuauauugagcuauuauaaauuauaucacagacauugugagugauacuugguaaggacugauucuguuuuguuccuccaaagaguagugcuuuuuuguuucaguagguaguuaauucaguaaucuaagacuucaaauucugacucccuaguauugggcagcaauauaaauugcuguuuaguucuuuuggcuuuaacugggcuacuccauacaaacuuggcucaggagucacuuagugacuuagggaacauuuguacacagaauuugaacuccccuuuuuggaaacucucuuuuuaccaggauuucuucuuucacuuucaccuauuguguugccuugaucucuguccugauguuucagugcagcaacaccaucugaguguuagccacucacauguugcagaaccgggccuacucucagacuaaaauugaccaaaagcaggaacucacuggcuugcugaauguccaggucuugaucacacuccagaauguccuacuuuuggucaucaggugccuagauuuuuuagaaaucuuuguucuaauuuuuagaaauauuuguucagaguuuauaguugcuaucuaccagggaacugcuucaauaggaacuacucaaccauugccagaaccuucuugaacuuucuagaaacacugucuuauuuauuuuauuuuauuuuuuagacaaaaucuuacucugugcucugccacccaggcuggggugcagugguguaaucuugguucacugcaaccuccaccucccgaguucaagugauucucguuccucagccucccagguagcugggauuacaggcaccugccaccacaccuggcuaauuguuuguauuuuuaguagagacgggguuucaccacguuggccagucuggucucaaacuccugacuucaggcgauccacccaucucagccucccaaagugcugggauuuacaggcaugagccaccacgcuuggccuagaaacacugucuuauuuaaauaagaaagagugucucucagaauggaaagaaaacagcuuuggagucaaacccaacuuggaugcagaaucucacucuaucuuguuuuuuuuuuuuuuuuuuuuuuuuuuugagacugaaucucacucugucaccuaggcuagagugcaguggcaugaucuuggcucacuacaaccucggccuccuggguucaagccauucuucugccuuagccuccugaguagcugugauuacaggugugugccaccacgccuggcugauuuuuuguaauuuuaguagagacgggguuucaccguguuagccaggaugaucucgaucuccugaccucgugauccacccgccucggccucccaaagugcugggauuacaggcgugagccaccgcacugggcuggauauguuuuuuaagaagaaaacguaccuuacuguuuccuucgugauuucuucacuagccgcugcaaguguguguggcucugugcauugugggcagggugaggcagcuagcuugauuuccauuuugggaaugaguggugccuccucauggaagacuucuuaaaacaggagaugggugcccucuguuauucuuguauggcaggcagaauaacgucccccuaaauguccacauccgaaucccuagaaccugcgaauauguugcaugucaaaagggacuuugcagaugcuaguaaggcuaaggacccugagguggacggaugauuuuggaucaucugggugagcccaauauaaucacaugcguccuuaggaguggaagagggaggcagagaguuauucagagacagagauauggccacagaagcagagucagagaugccuugguguuguauuugaagauggaggaagaagccacagccaaggccuaugaagcagccuuuagaagcuuggaaaagcaaggaaacacauucccucucagccaccagaaagaaaugcagcccucccaacagccugauuuuagcucagugagacccaugucagacuuccagaaauguaagaucauaagugugugcuguuuuauuuuuuauuucuuuuucuguuuuaaaccacuacguuuguaaacauuucuuuggcaguaaucguugcuuuugauggaaguuggagcaguggucaagcucgugggcuuuggagccagucugccaguccgccuuguuucaaaccccuuuuccuuucucucuuucuuucuuccuuccuuccuuccuuccuuccuuccuuccuuccuuccuuccuuccuuccuuccuucccuccuuccuucccucucucucuuucuuucuuucuucuuuuuuuuuuugagauagagucucauucuguggcccaggcuggaaugcaguggugugaucuuggcucacugcaaccuccgucuccuugguuuaagcgauucucauuccucggccucccaaauagcuggaauuacaggcaugcaccaccacacccagcuaauuuuuguauuuuuaguagagacaggguuucaccauguuggccaggcuggucuugaauuccuggccucaagggauccaccagccucggcaucacaaagugcuaggauuacaggcgugagccaccgcgcccagccucaaacccuuuuccugugauuuuuuuuuuuuuuuuuuaaagcugugugaccuuguggaaguugcuucacuucucugggccucaaauuucucaucucuaaagucgguuaacaauaaucuacaacucauaguuuuuugugaggaugaaaugaggguuucauacaugcagaaagccuggaaguaaguuuuagcuguggccauucugggcaggaaucccucacuagguaacuuagagcggcggaucagggcacagacuugggagacagacugucuagcuucagauuuaggcuucuuacuagucugaaguagaaugguuguuuguuccuccacugcuucaucuggaaaacaggggcaggcaucccaggguguuugagagaucauaucagauggagaggccagaguuuuuagccgauacaucauagacauuccccaaaggacaguuauuguuaucauuggguggauggggaauauugagccuccagcccuaggcauuguggaucaauuuguucuucaguuaucuuuggaauaauuuaaauacacuggauugggaagacaaagcuaucacccuccugaugggagagugcuggguaccuagcaggugcucaguaguuagugaaugaaugaguaagaacagaacagguccuaggcccugcccugaagaggcucacagugcaggacaaggccuggagucaggccaggguuuugugguugucuuuaaaaagaaacaaaacaaagaacuacuuccuaccagcugacccuaaaccccucagcucccugcagggaccucucagcccugcaggggagcccaggcuaugugccaggccuggccuugcugucagcuuucuaagccagucacaaacauucuccucucaacuuuauaauggaugccccccagccuccucuccccucucagggugcuccugaggcuaugagcagcuggcaguucccugucugagagguccuucguaccgcaggagaggcagcucucaccugaaggccucccuggacaccggucucaacuuuguguguuaccaguuauggagaauuauuuuuagugaguuacacucuguuagggccaaacacaaggaggaaagagugacugaauacugcucugagucagugacugugacaagacuguuuuuuucuucuucccuguugcaggccugaucuuuuggccagaaggagauuaaaaagaugccccucaagauggcugugccugucagcugcauggagcuucguucaaguauuuucugagccugauggauuuacagugaucuucaguggucuggggaauaacgcugguggaaccaugcacuggaaugacacacgcccggcacauuucaggauacuaaaagugguuuuaagggaggcuguggcugaaugccucauggauucuuacagcuuggauguccaugggggacgaaggacugcagcuggcugagaggguugagaucucuguuuacuuagaucucugccaacuuccuuugggucucccuauggaauguaagaccccgacucuuccuggugaagcaucugaugcacguuccauccggcgcucagcugggcuugaggugaggcuguccuggcuggucacggaggguucacugggauguggcugguguucucaacgagguggcauuuaaugagcacccucugugugguuggcgugaugcugggugccugggggagacagauggaacuaaagagguccuuccuggaagccguuacuguucccugcccugacguguguuauuguaccugucaccauuuucugauguucccaguuuacguaucugucaccaucuaccucccuauaaagugccucugcuguugguucuguguccuuaagacauuguguggcauuuggcacagucucucaugcugcagaaaggguaaauuaagacaggauuguuaaugaaugaagacaugggagauucaauggaaagauaugcauggggggauaauuucuuggcucugugcucagagcuaggaacaacauaaggccauauggcuggugcugugaggguuguaugugggcagaugcauguggaggcagacaggccuggguaugacucuuuaacacauacacacugcaugccuccaggcagacugauggauuccuuucccugcagugaaggguuaaguauuaucacacgucacaggacuggaauugaagaucgccaaguagacauugaaaugcugaccacaugacagacacucagcauguggugggugauguuggcuggggguagcuuuuggggaugguggacauuucuuggcccugaucuuucugagcagagccagggaggcagugcuggacucugaccugggcacagcugguuggcguggacaguugauuaaaggucacaguuucccugcagcccaugggaaggcagagugacaagucaguggcagaugaggaaauggagucucaugccagcuggagggagggagcagcuggguuggccacaaaggccuguugcaguucugcagcugacaaguggaaggacuggccucucagguccaggccugguggccugggaggcugcuagcucugagcgaugaguggugccaaggugccugaaggagaguugcagcucaaacagcaagugguccagcucucagaccacuugaggccaccuggcauguggcggccaagaccacaguuggggcggggccuugagucugauuuugauuggauuccuaguucggcucaugccugacagcacuuucucagacaggcuucccugaccuccuaagguaaauaaugucccucuggguguuacaugcuguucucacccauagcucuuagauguguucuaauuguauauucauaugugcaauuuacuggguuuccugucuuucucucacacuagaaaguaaucuuucugaguugaggaaaugcauuugccuugcacacaggcuagacacauacauaguaggcauuuuauuuguugcaucacaguugccuugaucaaauauggugacucuccgugguuuucucuugguuucuuugaaaaggucagacagaagggaaacacucuuuucuugaguauauauaugacuuagcccagcaaucccacuaggagagcaaugguuuauccauuauacaguugagcgccuggaggcucugaggggccauguaccuuccccaagguuauuuauccaggagaagacagagccagaagcugagaacugccucguguuuuauaccaaacaaggccccuucagcugaagacuuuuccuugcggucuugggaagggugugugugacggugagcugcagcaggugcugggcugugcuugacuguggucacguaggggcaggcagaggagccauuucggggggcugcugagggucuggagagaggcucacaguggugagcaaagagguucugggaugggaggggaucaguugggaaagacagaggcagauacuccccacuccuuugugccuucccaguccucucucaccccuuccugcccucuccccacacccuaucgugguggcagcugugccucacuuaucacaugguccauagcucuguuuuuuccccuuuuaucaguuacugccuagaacaacccaauugugguggucuggguuaucucccacucuucacaguagggccagagugggcucagacaccaaaggacacagaaugguuauggcaaugaauaagauuccuucucugugucagcaaggaugcugauguaguaauaaucuccauuuauuaagccaugcugucuacagggcacauagcacauguuuuuccauucaaaccucaaaacagagcuaugagaugcgcaccauuaugaugauuaucuguuuuacuguuuuuuguuuuguuuuguuuuuguuguuuuuuuugagacugagucuuacucuaucauccaggcuggagugcaguggcgcaaucucggcucacugcaaccuccaccuccuugguucaagugauucuugugcgucagccucccaaguagcugggacuacaggcgugcgccaccaugccuggcuaauuuuuguuggccaggcuggucuugaacuccugacuucaagugaucugccugccucggccuccuaaagagcugcgauuacaagcgugacccaccuugcccggucuguuuuacuguugaaguaacuggagcacccagagggaaaucaagugucccuagagaauacaagcagcauuuggacagcccugucugacuccaaagccacugcacaacauugccuggagcugagagaugcacauucucccuucuuggccacuggugacugugaccuugggcaaacuaccucugcuuuuugggccuuaguacauucauucauagagaagcuggcuaauuucucuucucagccuggagacuugagagugaaaggggcacuguaucacuuacucugggaugacagguguauacgaggauguagcugggcaagccaggccuaguggcucgcacacucaucaguuagauggugggugcuggugcugcuggugcaucaugcauacaaggcuggcucucccaguuuucccuggacuuuugccugaacaguuugcauuucuacucguggugcaggagcuugcuguucugauuucaugucacaagccugcuuucagccacuuagaagagcccuguuaucccugacugccgcuacagcagucccaaccuguguuguuuucacuugaugggcuccuggaauuauugacagcacacucucuagucguacgggcugcccugccaccuacacugacauccuggccagguuccuggagauggccuggcaucuuggaccuguuccccacggggugccuggagccucugauggucuacccaggguggcaaugagggaaaggcugugacuugaucaucuccagggguucuucggugaacagcccaagguugcuuaacagcugguguguaugaauaccuggaaugugccaguucaccuucuaaucuggcaaggagaaugugucuccuccuuaugcauaugaacaaacugagguucagugagauccagaaagcugccacgguuacugauggagagagcagagaagcugguguuugcagucccaucugucagccuugacaccccuacuccuguccagccaguguuuuccaaagcgugcugaugagcaaugcaagaugauuucauguuauagauaagaauaaaaaaauuguuuuguguuuaacucaaauuagaaaaaggcaacaauugguaugugcgaccugugguuuugcagaugauacugcuuaggauguugguacuuaagaaaaggucaacuuuucaaaaauacuauuagugacauguggaccuaguccuccugaagaggacuacauuggggcaccgguaauuguuucuauuugcgguacucuggcuguguggcucuggccacgccacuggaggcagugucugagccugugacuugaguaguagcucugugucaugucugcugauucuccccaaauccugaagauucaugaugaagugacuggccggcuuggucugaagcuagauugaaaacaauaaggaucccagaacgauagcacuuuacaauccuauaauuuggcucaaauugccugcaguuacuaucucagcccugccuguuauguucauugagcacccaaaguuuuucagucaauuccugaguuaauuauucucugggauugaauuaugaaauaguaaauauuuccacuaugcaaucaauuggugacuuauucauguauucauuucauucauuuagucucaauaaauugaagauaagggcugagcacaguggcucacacauguaaucccagcacuuugggaggccgaggugggcagaucaccugaggucaggaguucaagaccagccuaaccaacauagcgaaaccccaucacuacuaaaaauagaaaaauuagcugggugugguggcaugcgccuguaaucccagcuacucaggaggcugaggcaggagaaucauuugaaucugggaggcggagguugcagugagccgagauugcaccacugcacuccagccugcgugacaaacugagacuccaucucccaaauaaauaaauaaauaaauaaaagauaauauuaccuaccccaugaguuuauuaugagaauuaaauaagagaacauauuaaaagguuucauucagugccaggcauauaauauguacucagggaauacuaguuuuuuuuaaauaaaauuuuaaaaugggauuagaaggucaaagcauauaggcauaaagguauaaaaaauauugaagaugagugaguuacuaaaauuuaacauuacguuuagcucugagcuuccuaauuagcacaacaugcuaaguagguuauauuuguaucuaaaguaaagauuggcaaacuuuuuauaucaaggguuaggugacaaauguuuucagcuuugcaggccacacagcucuguacugcuugucaguucugccuuuguaucuggaaaguagccauagauaauauguaaaugaguggguguggcugugugccaauaaaacuuuauuuacaagaacuggcaauaggccuuuaggcuguaguuuguccuuggccuaaauaaaggaaacauguuugucuuucaaaggcagaaacuccuccuggaucauaaacauugaaaaaaaaauuguuacaagaugcaauauuucugugagacuuguuaagcaguauaugcgcagugcuuucauuaggauuuuacagaaaacuuagaagauggccuucacauggcuaguuuccuuacuguucauucagcagacauuuacugagggcuuacuauguccuaggcucugauauccauacaugguaaaacguaaaggcaugugcauuuuggcagggggugcugcauugacaaggaguggucucggugacaguuuugggaagucaguuuagaacaguauuggacacacuguuccaucccugaauuacacacaggccucaaugcuaacuugagugggcuuuugguccagcaggccugggcuccaggggcagucacucagcguccugccucaagagugguugugucaugaaaucuuggcccucuuugacugauagcuacaauuauuugaagagugugguuuuuagaacaaaacuaaaucuguuuugaagcucugcuguuuuauaccugcugugugaucuugcucaaguuuuuauuuuuauuuuuuucuguauaagggauuuuauuuuauuuuuauuauguauguauuuauuuuauuuuaaguucugggguacaugugcaggaugugcagguuuguuacaugguagacgugugccaugugauuugcugcaucuaucaccccaucaccuagauauuaagcccagcaugcauuagcuauuuuuccugaugccuuuccuccccccccccgcccccgacccacaggccccaaugugcucaaguguuuuaaucucucugagccucacuuucuucaucugcaaaccauaacaccucugaaucuauuuguuacucuaaugcuagcuaucuaguguuugcucucuaaauguuaguuccuccaccugggggcugggcgggcgguggcugaccucaccccaugaagcugucuccuggcuuucccagcuagagccuguggguaugaagauugcagcccccuccuccugggggaguauucaguguaacaagccuugagaaaacacuggccuguggaauuccaaaguuaaugaagggaacagauuccaagagggucucuguuugaccuuccacucuuuccccaaccccguuaccccugagcgaguuugggggcaagcauagguuuguaggcacugcaaagaagaacucucacgcuguggugcaggaccguggccuuggccucuggauaucugggccaggugggugcauuugggccucuucccuacagcgccuggucagacugcaagagacauaggaagcagccagggcaggcuaucuuaagaggagggagcauauuugauaaaguuagaaaaugauucucagcuguccauaggaagagcagaguaaggggcuaugugagaaguuuggaagauggcccaguuccaaaaaugaagaaagaaaguaagaaagaaagagagaaagagagaaagaaaggaaggaaggaaggaaggaaggaaagaaagaggaaagaaagaaagaggaaagaaagaaggaaagaaagaaggaaggaaagaaagaaagaagagagggagaggaaggaaggaagaaaggaaagaaagaaagaaagacagacaaagaaagaaagacaggaaggaaggaagaaaggaaagaaagaaagaaaaaggaaggaaggaaagaaggaaggaggggaagaaggaagaaagaaggaaagaaagauucauuauucuguccucugaaccugagugaagaaaaauacccuguccuuuguaccugcgugaagagagaaaagaaaagaaaagaaaagaaagaaagaaagaaagaaaagaaagacaggaaggaagaaaggaaagaaagaaagaaagaaagaaagaaagaaaaaaagacagacaggaaggaagaaaggaaagaaagaaagaaaagggaaggaaggaaggaaagaaggaaggaaggaagaaagaaggaaagaaagaagauucauuauucuguccucugaaccugagugaagaaauauacucuguccuuuguaccugcgugaagaaagaaaagaaaagaaagaaaagggaaggaaggaaggaaagaaggaaggaaggaagaaagaaggaaagaaagaagauucauuauucuguccucugaaccugagugaagaaauauacucuguccuuuguaccugcgugaagaaagaagagaaaagaaagaaaagaaagaaagaaagaaagaaacgaaggaaggaagaaagaaagaguguaaagaaauaaaaggcuguaaagaaauaaaauaauguaaagaaagaaaauaauguaaagaaagaaaagaaaggaaagaaagauucauuacuauccuuuggaccugagugguguuuucaguuaaaaugaguggaguagaacccagagaucaggcuuuugaggacgguaaagccucaagauacauucuguuucuggcucagggaaccuucagggaaaaggcuuuggagaccaagcuaggcagggaagcgccuuugcuuaucaugcuggagaccagacugaggcagugaagucaccauaauugaugggccacacuagacuggagccaaccauggcccauugcugagacucugggccucaggguggccuuggcuggaaccuguauuccaguggcccugguggcucucuucccucucaccuucccaggaggcagauuauuucccuguggugggggugaggcgguggcgugggggcuucuucccucucucucugucuuguagccuuguuaaaauaguggccacacgcugauagcuggauuuccagugcaguugcuggggaugggggucuuucccucucaucugucugucacccuuuaucacuccacaagggguggggguacuggacagaaagagugugucccaccugauuacugggaagugcaauggacacccccaccccccguugacuuaucuggcuccaaccgaagaacagcuguugguggucaggucucugagucacucaguagcuugggacuggguucagugggagaugauggcauaaacaaauaaacacuggcuggcccccagcucucagcuuucugcucacuggggggccccagaagcuuccuguugcgucugcagggaaaauaaggauacccauaaugaaaauaguuuuccugauggagaaaugcucuggggagguuguugaggcauguuagaaaaucccugaggcuuucuggcucugugagcuaagggaggacacuuggccucucugggcuuucgcuugcuccuuugggaagccuguuauugugaaagugagaugaucugggagguaaaacuggccaguuguccaucuccccucucugaacaugaugcauaguaagcccugaaucucauuuaaauuuggaagucagacugacuuugugacuguccuaguuuccggcuguugagucagcucaggcaguucuugggacuucugugagucucuggcuccccgucucucaauggggugacaguccucgucuugugccccucacgcgcuuguugagaugacagaugagucaccucugggaaacugccugagagcuggaugacaccacucugugggauugcauuucauccacagagacaucuggaaaaggaggcagagcagagccugacuuuugauuauuuggggagggagccuggagcugguggaagugagggcauagagcacauuccuuucaggccaggcagugcuuggcugcugaggcaccgguggagaccucaugaucuggugguccgccucccucuugugcugugugugccuggagcucucuggcuuccuuggcuuuccacugucuuucccaaagccuccauguauucuagaaucugcuauggaguuucagggggaucucuguauagugugaauaucuagcucugaaacacaaaagagaaagcuacaaagggcaacguaacaaaagccguauucccacccaaggauuagcacaugcucaugagguggcaugcuuugcuuuggaucauugucuuuauuuuauuuuauuuuguuuauuuauuuauuuauuauuuauuuuuugagaugcagucucgcucuguugcccaggcuggaaugcaguggugcaaucucagcucacugcagccucugccucccagguucaagcgauucuccugccucagccuccugaguagcugggacugcaggcgcguaccaccacaccuggcuaauuuuuuauauauuuaguagagaugggguuucacuguguuagccaggauggucuugaucuucugaccucaugauccccccaccucggccucccaaagugcugggauuacaggcaugagccaccacacccagccuggaucauugucuuuaaagaaauuuaaaaaaaaaaauagauaaaugggaagucuaugagccuugucucccauuccccauccuucucuucauacaaguaccucuccugaacuugggguauaacaggucaugcucuuacaauuucauuacaaaucuauuugaagaucacugguagcaccauuuuguguguuuuuaaauucuuagguaggugacauaacguauaagaugucugcacuuuccucuuuucucccggcgcuaugcugggcagaugaugcuacuaugcuuguucauucauucccugggccacagagucuuggguuguuuccagaauuuugcuuuuguaaacaaugcugucaugagcauccuagcacagggcugcaggugcaugucugggugugucccaggaguacagggcacagagcaugcacauuugcagccugacuggagguugccacaucacucuccaguuggcacuauuuccuagguuccuucccugagagccugggaacuucuggaaggcaggagugggugguguucaccacuauauaccucugccagucagcaugccccacaccauguaccagcucaugacacgccugaauggggugaauucuggaaggggacaaggcaagugccagggcagguccagagucuggguguggaaggagcaacauaaugggggccccuugcagaagcagcagaaagaacaaagaaauaggggccuggagugggggugugaaugaagacauugcuguugagaagauacuugugaagaagccaacagcguugucugggccuggcuggauaucaugaggcuggacauggaggucccaggcaccauugcugugggcuuuuggggaguuggaugcacaguggagagcugaggaggaaguugggcuugcugcagagggcugcuggaggggcuggcuggagucuggcucuggcccucacucacugaggguuauccaagugacccauugcaggaagaggggugggggacccagaguuacuguaaccacuuuaugagucugucucagccaggaucuggggcuucuagcaaagcccacagcacaggcacauuuuaggaaaggcaagauugagaugcccucgguggcccagaaggacacuucagggcagcagggcuguaaaggucaggagggggaaacuucuggaaggaaguugaauguugugggaaaaagcugacauaaaugaacaaggaaugauuuuuuucuuuucuuuuuuuuauuuuucuuuuuagagagacagucuugauauguugccuaggcuggucucaaacuuuugaacuugagugauccucccaccuuggccucccaaagugcuggaauuauaggcaugaaccaccauuguacagccacaagggaagauuaaacauagacaguuugagaagaguuuuuuuuuuuuuaaauuucuaauuuuauauuuaauagagauggagucucacuauguugcucaggcuagucuuaaaguccugagcucaagcgauccuccugccuuguucucccaaagugcugggauuacaggcuugagccacugcaccuggccaaggguacuuuuuuuuuuuuuuaagaaaaauaucguuagaaauagaaaauuuggauuugguaauggauagugcauacuaugaaauaaccuuuuuacuucuucaacacuucccaugauaauaacacuaauacaagaucuuuggugaaaacuuagaaugcguagaaauguguuggugguugaaagagagccccauaacccuccacugaggaguaaccucuguuugaccuuagaaauaauaccugugaacagaauggccaacuuguccugguuugccagagacuuuccugguuuuggcacggaaaguccaacacucugggaaccuccucaguccugugcaaacugggauggucguucacccuaccugugaauugaaugauaccacugagcaucaagcacuuugacaguucacaagucauuucuagugcugucauuguguauacuugguuccggcugugugcaaggcauugugcgaggcugcauguucuggagcuacaccagagcuccagagcugaaguucuauuuucuuuuuuuuuuuuuuucacuuuuuauuuuagaaucaagagaugcauaugcagguuuguuacagagguauaugggaugcgguugaaguuuggaguaugauugaacucaucacgcagguacugagcauaguauccaguaguuuuucaauccuugucccccucuuuuccuccccuuucuaguagcccucagcaucuauuguucccaucuuuaugcccauguguacccaauguuuaguucccacuuauaagugagaacaugcgguauuuuguuuucuguuucagcauuaguuugcuuaugauaauggccuccagcugcauccauguugcugcagagagcgugauuccauucuuuuauaugguugcauaguauuucuugguguauaugugccacauuuucuuuauccaguccaccacugacgggcauuuauguugauuccaugucuuugcuauugugaauagugcugccaugaacacaugggugcguguguacuuuugguagaacaauuuauuuuccuuugaguauacacccagguaugagauugguggguuaaaugguaguucaacuuggaguuuucugagaaaucucuaaacugcuccucacaguggcuggacuaauuuacauucccaccaacagugugucagugucuccuuuucuacacaggcccaccaacaucuguuauuuuuugacuuuuuaaugaaaaccauucugauuggcaugaaauguaucucauugugguuuugauuugaauuuuuccaaugacuagugauguugugcauuuuuucauguuugguggcugcaugaaugucuucuuuugagcaguguccguccuugugcuuugcccacuuuuuaaugggauuauuugcuucuuugcuuuuugauuuaaguuccuuaucgauucuggauauuggaacuuugucaaaugcauacuuugugaauauuuucucccauucuguagcuugucuguguacucccuugauaguuucuuuugcucugcagaaacucuuuaguuuaauuaggccccaauugucaauuuuuguuuuuguugcaguuguuuuugaggacuuagccauaaauuccugucaaggccuauauugagagggguauuuccucgguuuucuucuaggauuuuuauaguuugaagucuuaagucuuuaauccauguugaguuauuuuuuguguggugauaaauagggauucuguuucauuuucuucugcauauggauagccauuuaucccagcaccauuuauugaauaggaagucuuuuccccauugccucuuuuugucaaguuuguugaagaucagaugguuguagauaaguggcuuuauuucuggauucucuauucuguuccguuggucuguguauuuguuuuugcaccaguaccaugcuguuuggguuacuguagccuuguaguauaauuugaagucagguaaugugaggucucuagcuuuguucuuauuucuuagaauugcuuuggucauucaggcucuuuuuugguuccaugugaauuuuagaauaguuuuuucuacuucugugaaaaaugauguugauaguuugaaagaaauaacauugaaucuauaaauugcuuuggacaguauggccauuuuaaugauuuugauucuuccaaucaaugagcaugaaauguuuuuccauuuauuugugucaugucugauuucuuucaacaauguuuuguaguccuuguagagaucuuucaccuccuugguuagaaaguauuacuagauauuuuauuuauguguguaugaagcccuguuuucuauccuuaaggagcuuacaacuugucuuugguaugcaguaggggcauuucacuugugagagugggggucuuacuguagccugggcaauacccucuuuuauuauuggguacuaaggauuuaaggauauuuuuguucugguggguuauccaguuuugcagguugguaccaaugcugaauuugacugccccuggcccugcugugcagcacuuucagaccccuaaaugaugugacccauucuggggccagcucaguguuuuacagugaugaagaugauguugaugaugaugaugaugaugucaacauccaucauucugaggugugugucuaucucuggccucguuauaccugcagaacauucaugugguagccaauaccugggaaaauaaucccacuugccaggcagcaaaccguggcccuccguuagggggauggcaucucacacucaugaaguguugaguguaugggucccuggccagcuuuggcaacugugaggcaggcauuaugcuuccauuuuaccacugacagacugaggccggugauggggagcaccugggccuguuggcuugucugugguaggccaggcuggcuacauaauauguggggcucagugcaaaaugaaauaugggcucucuuguguaaaaauuaggaagaauuucuagaugcugacagcagagcuuuaaaccaagcucgggccccucugagccaggagcccugugugccugcacaggcuguauguccaaggagcugguccuagggcaggacuaagguucaggcuucguauugacuuccaugaccaagcauccuggguccaggcuguguuuugugugucugcagagcucuggucuaucugcugauaagucccuguggugcucaaagguaccuggcuuccuuggagaaaaguuucucucuccccugcccuuccccagccucaaaauacacaaaugcucagaugaauacuuaagaauccaacuggaccagcuucugucugugacuugaugacuuaaugugauuuugggggaugcaacauugggggugaugcuuuagcaugccuucucucucccacucaggaacaugggcaaaugccaugggcugggagcucucaccugcucuuuugugcugagcuucacuaucucuucugggcacagauugguuacagggauauagaccaccuguguggugcccuggggguuauguccacggggagccucacaugaagaagagaauuuccuuugggauguguauuucuuguggucuuagcaugcuggcaauucuuauuuuuggcaucauuuaauccuuacaacaacuuuguaagguuuucacauccauuggucauuucugaguugagcaccucaacucaggugaauguguuuguaugaauguuuguugagcaccuacuaugugcagggcaguguaguaaaaaauugaggaccuguggguuuuuuuuugaguauauauaauuguguucuucugucauuuuacaugacuuucaccucauuucauugcuguagcaacacugugagguuguugcugucacccccauuucucaggcgaggaaauagagguugagucaaucucccaucuuggauuuaccugacaucacagucugagucuuuuguggcaugugcaagagugcacuggcuuucggggccugagcuggcuggccuggauugaauccuggcuuugccauuugcagcuguggucugaggcaaguuauuuaacuucucuugaccucgguuuccccaucuguaaaauggggcuauacuaguugcucuguguaggaagggucugagguuucaguaagauacauuuugcacaaaccccacacacaccaaguauccaugaagccugguuauccuuauaaccucagagcgguuuggagaggguuaggaacuugcagauggucacauaaucgguguauggcagaucuugggcagagcuggacuggucuuccuaaugagagcuccuuuccccacucugcuuucauggacagacccuaaugaccaccuggguuauguuuuugucccugucaauuccuuuguccuugcugauaaccuaagggaaccuugagagccagaacgagacaggaagaaaaugccuggcugcugcuugcgggguuaauuaaaccauuccugggguuucauuugcucucuaguuagcaccaaaauaaauccuccaaauggcuuugagccuuccaguugacauugcauuuugaauucugacagcaccagcauuuuacaucuuccugaggaugauaaauguuuagauagcaccgaagauaaugguaaaaggagaaacuggggguaguucaggcuguggcugagcagauuguaacucuuuggugugacgaaugggugagaaguugcuuaaaggacacaucugauguccccugcuccuagggguugagagggggaugggggguggacucuguuuugccauccggagaauccauugccuucccgaugcuucuggggucucaugcuugagucuuguuuccaugcguucugucagauguuaaggucuugugcauaaugguugaggugucaaugugcaggcguuaaugucaccauucuuauguaauuguuacccuuuauugagugccuacuaugugccaggauuuaaauauuucucucagcaacccaaagauguaaaugucauaucaccuucauuuuacagaugugaaaacaggcucggagaggcugagacacccagccauuaaggacucagcugggauucccagccuucccuggcacucucucuuuuuuuuuuuuuuuuuucuguuuugagacagagucuugcucugucagccaggcuggagugcaguggcacaauaucagcucacuucaaccucccucucccgggcucaagcaauucuccugucucagccucccgaguagcuggauuugcaggcaugugccaccgcacccggcuaauuuuuauuuuuaauuuuuuuugguagagacgggguuucaccauguuggccaggcuagucuugaacuccugaccucagguaaucugccagccucggccucccaaagugcugggauuacaggugugagccaccaugcccggccuucccuggcacucuugagcauguuuccagaccgccugcuuccuaccccagacaugucaaaaugcggugcuguaaaugacagggcucuggucccagauggacagcccgggcccuuugaagacacucuggccuucaggagucuggaucuuuaugccugauggaacugacacgggccugcuauguuuacagugccuguucuccugcagggucuccggaagucaucagccgugcuggccagcacuccggaggaugacaggaaauucugcugcagcucugugggcuggcuggggugcaugcuggacagggagcgggcggacagggcugguagggaggaaaacaccacugaaauaguucagaccguauugucagugaauuccuggauuaguaugcagugcugccaaugaucagauuugggucaggaagcccagauggcagaaagauuguguuaaaucuuuauauuuuuccacgaaauccucaccguuucagacccuguuuucuaagcuaucacccuaauaauuguggauuuuggauuuccaaggcacguuuuauagugguuguaaggaggggaugguuggguuggggauugggaugggagggggguagcugaagaaauaagaaagugcugcagaaaggagcacauuccacacccagcuucuuccugauuguguuucccuccaagcagcgaacaagaggcugauucaaguggcucaguggccucccugccuggaguuggguuccuaugccuuccagugacuaaggaggaaauuccauuucaguuaaucuguggccgcgcaucacccauggcauucucuaucuuaauuuuauggcugccucaucuuuuuggaauucgccuucuuuuuguguguugggugauaagucaaggagacauauggcacagcuccacaaaauacaaccacauuuuaguauuccguacacaguccuuucugggcaucccaggcuuuguauuuucacguuggucggccgugaggaggguggaucuucauuaucugugcaugcaugugcaucccuucaucccuuccucuucaguuucuuuucuuuuuuuuucuuuuuucuuucuuucuuuuuuuuuuugagauggaaucuugcucugucacccaggcuggaguacaguggcgugauauugacucgcugcaaccuccgccuccuggguucaagcgauucuccugccucagccuccugaguagcugggauuacaggguugugccaccacgcccggcuaauuuuuguauuuuuaguaaagacgggguuucaccauauugaccaggcuggucucaaacuccugaccuugugauccgcccaccucagccucccaaaguguugggauuacaggcgugagccaccacauccagccuccuguucaguuucuuaacccuugaugggacucccggcuaaacacccccauugucugggaccuugagauuagaugcaguagcacugcugguuucaugguggacuuugagucggauggaggaacuccuuggagugcgggaggaagggcugcggaaggugucugaacuaucguagcaguagggucccugccacagggaggugaggcagccaucaucaccaguccuaagagguacggucacccuccgccucugucucccucuccaguccccauccaauuucagcuuugaacccagcugccgggucuucaaagccuguucugacuuacccagcagaguugguugcucuguccucuuagcuuauagacgcugcccguuuuuuccccacguggccccugccauuuagguccaugucucucgugauccuguguguauuuccaguggaaggacaagguuuggcccacuguauauuugaaggcccucaauauggcguuaguucguauuuacugauggaugaagaacucugaggagaucugguugaaagagacuuuuaaaaauuaaagggaaaugggucacgcaggccgcguuuuuguccuugccuauuggcuacuuuugcuauucagaucaucugugaauguaagugacugucugcuguguucgcagugugguuacugggaaaacagagcucucucuccccaaaucaggugaaacuacaggaaaacaguaggcaagagucuucaaagugaugcaucucgagagagagagggccugggucugaaucauggcuuugugccuuaccagccugugauucuagucacuuuaccuucugagccuuguuuuucccagcugcaaaaugagugugauaauagcgcuugcuucaggggauuguuucaaggaucaguugaaauagugcacaccgaauguuuggcauaugugcggagcucuuugggggugacucaugggcaacuguuuuucauuuaagaacugaguggauuggaccuuuaagaacugcuuuggucccacugucaugggagguuagugcugucuggagcaggcauggggauguggugguacaggguaggguguagggguccccagaauugggggccuccguguuggaaagggacagugggcagaguccaugcaggcgcucuggggcugacagggaccugggacuucuuucugagaggcagugaccagccaacuggaguggaggguuguggggaaaauguuuggccaaaggauuuaggaaccagagagaagcaggcacaugaugcuccuuuucuuggugggguguucaucaggccuguagcugccacagucaucacuguggcugagauucauaccuguagcaccagagugggaggcaauuuuuccaacauggggcagaggcuggguguguggggauugguugcaaggugcugggaguggggugcagggaagggccucugcacaccacguccguccucauccugcuaugaggucagcucuguacaugugcuggaagagcaauuagcggggugccuaagcaguguccaucauggacgugggucucugcuggccacgcaaggggaagaugggacuggugggaagauuggggagauggaagcgggggcaguugugugcgaaagguacagggucguggaaacaugcacaagaaagugacauuuuagaaggugguuuuuguuccauaauaaauuuauuagcuuuggaaucugacucuauugccuuggcuucuccaaacuuugguguccucaucugcaaacuggggaucacaaucucaguuuugcagggaaugugaaauccugaccugaaaugaucacauguguaggaagcugacaaagaaugcuaauuuucuuccuucuuuucuuuauggccuuuccuugguaaaucucugugugauugauaacucaugaagaaccuaccagucaaaucaguuaaauuaaaugacuuccuaaugauaauaauuagauuaguaacuaauaaucauagcugacauuuaucuagugcuuauuaacuucugggcagugcgaauuuggucucaucuguuaaauaauuuaauuccuguaauaauccuaggaggauggugcuauaauuagccccauuuuacaaacaagaaaacuggaggaucagagaggcuaaguauaaugucuaaugucacacugcugaaaguggcuugcugguguuccagccccaacagucuggcuccagaguuugugcuauuaaccauuauaucagucugcuguguguguguguguuugugugugugugugugugugagagagagagagagagagauugugcauuguacggugaagagcaauagaaaucauuauaaggcauuccugugcuacagucuuggugggucaggcuuacuuauagaagcugugagaaggauggggcuaugggcuuuaacucaguucugacaaucugucacucccagaaccugaggcaggcuggaccuauagacuuccaccuccucuuccuccugcccugaaccguccagggacucagaggaggucagacaggugggacucccagaauagugaccuccucugccacuugcagccuaugucgggcuccucuuauagagccacccccuugcuuaugcuguaguguuccuuuguucuggccauaguuuuccugggccugugucaguugagugcguccagaugcagcuggguugagacucaaagcccugaagauaccgcaaggggagugcuccugugugcaguugcucugaccugcacagcaggucggaguggccgccgguccccggcugccagcuguuuaccuggccggccuugcaaaggcucuucagggccaggccccagccggugaaucacugaaacugauccccguggccacugugaaguacgggacuggaggucuccggaggagauggcagcucuaauaaaaacaggcugccaaaccgcagaaacuguauaagccucuguuucucauccucgcuaccaccccugcguagucccuguuuuacaguugaggaaaccguggcccagggaaggucgggaacuuguccaaaggcacagucauagaacuagggcuuacaccagcugugucuaauagcaugcgugcccccucugcugugcuuuuauuugcuucuuggagugcuguuuagagaaauugaugguucuuuuguugugacuagggguccgcacuaugggugaccucccugcucccuuuggccucaggcccuuaucuuaggcgauggccaaaagaacagcuuuacauucaguaaacuguuuuaacugaaccucaccacagguuuacggguggugcucguuucauaauggauaaagaauggguguggcucaguguggggaaguugguggauggggagagggcagcagaguaaccagcuuuuaguggagaccuggauuugagugcccugaguuaggugagccuuuguaccuguuucuucacuucuuggagcagaacauuaguuucuccagaucccacaugugauaaaguucugugauccugcaguuugaacauccuggcauucagcucagcccacugugcagaaaucuauacuaaacauguagacaguuuaggaagagggauuguuuauuguguugaauguuauagaauaauagcuacuuaaauuuuggagcacuugccauucaucuuccaagugauuucuacguguugacucauguaacacaggcaaccacccuauaauaaguacuauguuuacacacccacucuacagaugaggaaacugaggcucagaggaauuaaguaaucugccaaagaucccuuggcaaguaaguggcuaaggggggauuggaacccagggagagagcauaauccuaggaggagauucugccaagguacagcccuccacgauggaagggcagcagccuccugugagcugacucacuugaguuauuccacaccaucccaguggagaaguuggauuaucccuauugugauagaggaagaaaggugaaggaauuugccagaaauuauaaauggugacauucgcauugaacacauguccacugaccccaaauacugggucauuuuauaucuuucccucccuucuuuuuuuuuuuuuuagacuagucucacucugucacccaggcuggagugccauggcacgaucuuggcucacugcaaccuccaccucccggguucaagcaauucuucugccucagccuuccaaguagcugggauuacagacaccugccaccaggccagacgaauuuuuuggauuuuuaguagaaaugggguuucaccauguuggccaggcuggucuugaacuccugaccucagguaauccaccugccuucaccucccaaaguguugggauuacaggcgugagccacgcccacccacccccuucacaccccaccuuguuuuuuucuuuuuaguagagaugggguuuuaccguguuggccaggcuggucuugaacuccugaucucaagugauccgcuugccucggccucccaaagugcugggauuacuggugugagccaccacgcuuggccucuucccucccuucuugcuaacuuugaagcucagcuccuuguccaagagccuuucuguccagguguuuucauggugccugugccuucugcugguuuggagugagcgguuuccacagcauccucccaucagccaugcauuccucagggucaggcgcaacaugcucuucauaucugcucccuggcacuuggccuucaaaccaggaauucacugcaccuagccugauccauugaccugggcccaguauaggcccucccauguugggaggccaugggguguuaagguuaaugcugggccacacaugacugugaugagucccuuucucucugcugaagaacguguuuccaugggggacaggggcaguuaagccuggguucuguugggcgcugcugcuuggguggguccagucugccccauguggggucugcauucuaugccaaguguuggcagguucugccagguagagcucuucaguauggaagcacuucccugugcucagccucuccccgacugugcacauuuccuucucuucugcuggggaaauggaaaacagcugaccacugauuccuugaaaucaccuacucagacacuccagggucugugugggauuaagucguccgcagucuuucccucccuuaaucucuucuaaccuuccucgaaagugccguuucccaccccauuuuaaucaugcccuuugcucucgccuggacaucuccaggggcuccagugccucucuaagugaaggguuuggggccacacacauggcugucuguucucuccaggcccacaugcagaauccagcagcccccuggccucacaccugcuuuucaguaguggcugggacugccagaugaauaggcuugaggcagcauacgaguuugcuauacacuugcucaaaacauuaguggacucaaaaccaaaaagacaacccaguuucagaaugggcagaagacuugaacacacauuucuccagagaaguuauauaaauggccaauaaacacaugaaaagaugcucaguagccaugguuguuagggagaugcaaauuaaaaccaugagauaccccuucauaccuacuaggauggcuguaauuaaacaccaccaccaccaacagcaaaaaaaaaaaaaaaaaaaaaaaaaaaaaaaaaaaaaaaaggcagaaaauagcaaguguuggugaggauguagagaaauuggaacccuuguacauugcugguaggaauguaagaugauacagucucuguggaagacaguuuggugguuccucaaaaagucaaguauagaauuacauaugacccagcaauuccacuccuagguguauauccaagagaguugaaggcguauguccacaaaaagcuuuuacaggcaugugcacuacucacaacagccagaaggugggaacaacccagauguccaaugucuguccgcggaagaauagcaaacaguauucaacuguaaaauggaaugagacauugauacauguuacaacauggaugaaccucaaaaaugcuguucuaggugacagaagcuaggcacaaaaagucacauauugucugauuccauuuuuaugaauuuucaagaauaagcaaaauuauauagacagaaagcagauuaaugguugcugggggccauggggaguagcugcuuaauggguacaaaguuguuguugguuuuuuuuuuuuuuuuuuugagaccgaguuucccucuuguuucccaggcuggagugcuggagugcaguggugcaaucucagcucacugcaaccuccaccuccuguguucaagugauucuccugccucagccuccugagcgguuaggguuacagucaugugccaucacacccggcuaauuuuguauuuuugguagagaugggguuucaccauguuggccaggcuggucucaaacuccugacuucaggugauccacccaccucggccucccaaaguguugggauuacaggugugagccaccacaccuggccaaugaguacaaaguuuuauuugagggugaugaaaauguuuuggaaccagauagacauggugauuauaccacauugugaauguacuagacaaacgucacugauuuuguacacuuuaaaaugguuaauauuacuuuaugcagauuuuaccuccauuaaaacaguuaugacaucacagaucccaucagguuaaaagaggacaugugggccaggcucaguggcucacaccuguaaucccagcacuuugggaggccgaggcgggcggcagaucaccugaagucgggaguuugagaccagccugaccaacauggagaaauccuuucccuacuaaaaauacgaaauuagccaggcgugguggcacgugccuguaaucccagcuacuugggaggcugaggcaggagaauugcuugaaucugggaggcagagguuguggugagccgagauugcaucauugcauuucagccugggcaacaagagcgaaacuccaucucaaaaaaaaaaaaaaaaaaaaaaagaggauauguggacacuaugucuggcacuuaaacugguggauucuauagagaugggauggguucauuagccccauucuacagaugagaaaguagaggcuccauuagagcacacaguguagaaguggaaccaggauuggucugacucuagaaugcugcuuuugaucacuuuucuauguuccucuuccucuacaguggacagguuuuguuuuguuucgcuuugcuucagauucuuggcucaugccaagugcugugugccauggguacaucaccugacccugaagagcccagaucuaugucuuuucaugcaaccuugcccugugcuuuccacauauucacauccuucacagucaaucccacccuggccacuaggccaauagggacuccccacaucccacuuacaggggggcaaauauuuauagccaaaagaaaacagaagauguggguuugagucacaguuccacuauguggucauggaugagugccuucaacccucaguaccucaguuucccuaaaugugcagugggagagcaugagaacacuuaucugaugucuucccugggguuuugugaggauuaaacacaccauguaggggcaagugcuuugagaauggaaaagcacugugcagacaugagugaugugcaugaugguuauuguuagauguucucuccuggaaucaaguucaagcuucuugcauacucagcagagaacagacccaaacucccgaaucuagugcuguggcaugugguuggugcucaauaaugauuuguugugugaacaagugcaugaaugaguaguaggucaaugaccucaaugugggccuggucaggauuuagauuucuugucuuugugugugcucagcccaggacugaaugcacagcaggcugucaggaaguagucauggauugauguguccguauucgccauaaccaagcaggagauagaugauuucguucuggucucuggauuuuggcugcauuuucucucauaguaggaauuauucccggaagauccaaaugcucagcuuuguccuccucucauccuggugaggcgugugauccaggugagaagcagggagaacuggccuuccuggugggaaguugugggccaucaccuuaagcuuggcuuguaguggugggagaccuguguuccuuccuuccugagccccacuuccucuugauuuuauuguauuuuuagcagcacugagcugaagcuuucuggguugcauguuagaggcagcacuucuugcacaagcuaggggagcgugaguaucguuucgguucugauagcaggauggauuguuauguauccuuucugauggaggcuaccaaaagcuuuagauguuaggauggauuaucucaccuugcacaagacagugagugcuagaguuuaaguuuucuccucugcaaaauaaggaguggcagugagacuuagagcaucucucaagcccacuuuggcccaaaaguuccaugacuguggcagucuagaguaaauguguuugauagccccuaguuacaacucucuucugucucuuccccuuucugccugcgcuaccaucuaauccauccacgcaaccacccauccacccacccacauuuccuagccagcucucuggaccaggccuuguguuaaguccugaagacacagaaaaggcuaaaacagccccuggucuuaaggacucacagaucaugaggaggcgauagauacuggaauagaaggcaaaagucaaaugucaugagugcugggauucagaaaggugcaggcugcucugguagcaauaaaggaaaccagcucucccuugagaucccuuucaugaggguuauagccuggauccugugaugacccaggacagacuggucuugauccaggggaaccauaucagugaccucaagaggccccuuuuagccacaguaaucuaugauguggaguucucaauugcuggcuuugcuggagaaagagagaaggaagaaauagaggggccggucagcccuccuguacauuuaguuugcggucucaaaccucuguuuccuggagcugcaggcuguaugugugggaggugcacagcaguggcuuggccgccccaacgcgccuacagcccgcucuggggacagccgucuuuuggcagagucugccucugcagugguggcagcuggcccaggcagaccuccucucuguccgguuagucagcgucugguggccaagggcagaguggagccuguguuuccgacaggccagcugccccucagagugaggcagcgccgugauucugagggugaugcuggcguucgccccucaacccugucccccacaaggagauuacggacaaggcagcauuucuaauaagcagccucugcuugccccguagcagaugaaagacugcguguaagaguggguaauuuuggguuuuccugaugaaaguaguugacauuugugcugagaccucaugcgcucugcagcgcugccuuucaucucugcucucaaagcccugcucaucucugccaugacucgggggcggccugcgccaccggaauucaguugggccaguggugaaauauagaggaaaugguggaaugaccccugaaggcaguggaugggggaguggagacaaguccugacuuuccugguggaggggauguuccuggggguguggaacuguguaucggcccaugcagcacagccagggaaagaguguggaucuuggagcuugguauggcuggcuagauuggaaaggcagcuccuccacggacuugcucggugaauggagggcauccuuucucuucccugaucuguguccucauuugucagugggaauaauagaauaacauuacuaccaacgacgauggcuuucacaacuggaaccacuaggcccucaggaauguuuacuggcuucuagucucauugauaaacugaagccauugugccauagcucuagagaacuggcacuaggggcuugcaugauucaucugaguuccccagacaaugcuggcacauaguaggcccuccauaaaguaagaagggacacuuugcuccugacauccauacagcuccucuagcuuugcagagaaagcccuagagagaaagaaugugaaggaacaaagggucagguuagguugugcaaccuuucugauaugcauuuguaaugcagugagcaaaugcacaagccuugagucgcugcauucuuuucuaaccacccaagagauaaguugaacccccacucguagcaaccuggccacuugucuguuuagucagcccuggaauaccuccacugacggggcacucacuaccacugaaagauggugugcagaauucuaauguucuuccucucgcggggucgugggggcuuucuuccaguucucuggguucugaucguuggggcuguccugacacccuucuucagaugaccgcugucagguuggugaaggcagugcgcguugggccuucccucccuagagaugugauugcacgucggguaccaggagccuggccagcccucagcuucugcuaaccagggagcagugaagcccgguuuacuuuuguuggcuuguuuauuuucuaaugucaccugccucugcacuuuaaguaguauuugggcuguuauggagugugcacauucuaacacagcaccuugucagcuggcugagaagcugaaaauucucggcauuccuccuugaugucaauuacuucaaggagcaggaaggugacuucuuuuaacaaguggaaaggauucagguaacaaagccauuuccucuucuuaacccucuacuguggaaaguuauugacuuagcgacacagucuguuuaucugggcuucaggagcagggcuuuggagacugaaggcuucuccccacuuuugugcaauguuauauauuuuuucucacucuucauccagucugaguggggucugcccccuccccugagcagucaccauccugcuacccacuccggcucuauuggcgacuguggcauagggugguggaaaggacgcuggacugagagcccagagaucagaugucugaccuucccucugccuggaagagcugccuggccucugaucagggucccuaccuucguuuucuggccucacucacuguggcccaccauccagcagugcagguguccuggggacucggggaaggucagaaguggaaggaaagccuccaagcccucgcaugcaggcccaccauuccacugucagguuuucuucccuuuccuucugcucuacauuuugugccagcaguuugggggucuccugaaucuuaucccuucgcagcgguaggcaggugcaauuucuggccagucacugaacaugaagaagcaucuauaggcggaguuaaauccaaaacacuuggccugacacaccuggccuugaagucucccccagccucuccucuuguccccaacagugguucauguucuagccacacagaaauugaggggguccuguguuaucuguguuccugcagacagagcuugccuaggacagcaaaagucauccuaacauaaaaauaugcaugaauaaacucacugccaacauucagcccacccacauccaaugauaaucagucauuuacugauggccagacguuguaaacaucugucaguccacugcaagaacagcagaaacucguagcugaccuccauuuggccuacucacugaauuaagugauguuacucauucgcuuuguaaaagcaaacugagugaggccccaggcucauugaagacucuguggguuacccagaagcccaacuuuccagauucaauauuuuuucuauuucuuagcuguguuaccuugggcaaguuaauuaaccucucugugccugcauguugcaucuguaaaugagacuaauacuaguacccaccuucuaaagugauuaugagcauuaaaugaauuaguacguuuaaaggcuuagaacaguguuuuaugauacgauaaacacucaauaaauguuagcuauugauauuggugugcccagaaggcuuguuacuacuaguugauuuaugugcuugccaaaaguuguuguguugguaauuaaguacgacauaaacuaaugaaaauugaguuuauaaagaguuguuuuaugaaaaguuuaguacuuuggauagaauggauaauauugauuugcuaaaaaaaaauugucaccaaauaacuuaaaggcaaaacagcuguaaaaaauuguaaaaccauaguuuguauuccauaugcuuuacaggugauuaacuuuggcacugcuuuaaagaaacugaaaccaggaauuguagauguugacuugugaguguguauuuugcauggaagaugauuugcaucucuagucagcgugccaaaaaaagauccuacccuuugauugguuaauaaauaugcaacuauaauaaaauauuuaaguguugguccuuaaugauugccuacauuuucaaugaaaugacaguggcagaacugaggaacagggguuuuucucuccaaggcagaucagcugccagaaauugcacguuuuguaccagcugcaggguuuccuggaaucagcaaaggccugugagaggcugcaugaaccacacacgcuuacugacaccuccugugugccgagcgcugaguagugcugaggauauagcaauuggggagcacuagcagaaucaggguuguuaaccguggagaagagaaaggaaagaugaugucucucuaugcaaaucaagggaaagugauuuaaaaauguuaaaaaaaaaaaguuaagagaggucuucgaaagguguuuugcaaaaugauuccuuggauuaaugaugaaggaguggagugaaggaaguuuauauuuugugagaaaacgugugcuaaggaaggccucgacauuagauucauucuguacacaacucagcaaauuagaucauaguuuaaaaugauaauuucaggggccgggcacaguggcuccugccuguaaucccaacacuuugggaggccgaggagggaggaucauuugaggccaggaguuugagaccagucuggccaacauaucgaaaccccaucucuauuaaaaaauacagaaaauuagcugggcuuuguggugcaugccuaucuuccugucuacuugggaggcugugcaugagaaucacuugaacucaggaggcagagguugcagugagccaacaucacgucacugcacuccagccugggugagacugcgagacucugucuggaaaauaaauaaauuuaaaaaaauuauaauuuuugguucauguuuuuuuuuuuuuuuuuuuuuuuugaggcagagucuugcucuaucaucuaggcuggagugcaguggcgugaucuuagcucacugcaaccucugccuccuggguucaagcaauuuaccugccucugccucccgaguagcuaggacuacaagcaugugccaccacgcccgguuaauuuuuguauuuuuaguagagacgguguuucaccauauuggucagacuggucuugaacucuugaccucgugaucugcccgccuuggccucccaaaaugcagggauuacaggugugagccacugcaccuggccaguucagguuucaaaguauaagaucaaucuuauuuuauguauaguuuauguguaauuauaaauuguauacuaauaaagucauuuuuauaauucuuuauuucuuuuuccaagauacccacccccccccccaccaaggagggcuaggacaagugacaaaagucaccccagaucacagccaaauggguagagcuaggaauccgaaguaggugaugaagcuugauuuuucaagaugcugcaaccccucucccccauaugcuacauuaaauaucuggaccuauuuuaaguggguucuuuucugggguaaugagguucucuucugccucaguuuuccauggcugcagagcuccugcuguuccuucugccuaguucacucuucuuugccuugacugcaccucucugagcuaccuuccuaccuccauccuugcauucauuagggguuucuuuauguguccagcucacugugggacccaggacuccuugaagagggagaucuugcucauccaucugugucccccacucuacugccaacacagugguaggaagggaaggcggcaggcuuaggcgagguccugcaggcuggacaggaucugucaccauuacuuagcccaggcccaucucuuuacuuccagaccaacuggugucaccauaaugccuucuggcaauuugaagauucuggcaaccucuuaccggaugcagcuggcaggauaaucccugugcauuagccacuuucagagguaucugggcccccaaaagagucacgggagucccagacaugaaggagcauuaguggccaucuccccaccuugcuguaucagcaaaacugcuaagcccugacccauauuuugggcagugcucacccuaucucauuuuaucuuacuguauaucucguuuguaucauuuuauuagguaucuuauuuuaucucauuauaugguaaucucauuugcuggguagaccagugaggagggcugggacaagugacuggaauugcccaaggucacagacaagugagguuuagaguuaggacuccgaagcagguggcggagucaccguugaguucaucauagcgaugcuggcugccucaaaguacuguuuuaguuaaugcucacaagcaacucugcgaagcagacgggccauucauuugugcuucacagugugggaaacugagucagagcagguucaugucacacagcugauaaaugacaaagccagaugugaagccugugaguuggauuccaacauucaucuuugaugaagcguucagguuggggccuggugugggacaugcucagaggaggacgaggaggaugauuugggggaggccucagaaggcguuccuggucugagugugcugcugucacugccuugguuuggguccccgcuucugagcaggaucuucuauuggcagaggguucaaugcagugggugccaugaaggaagaugucuccccaacagcaucacagucucagggacuguucacaucacauuaaaagcgcugagacucuggcuuuuggugaaaacggcuauuuugucuuguuccacgggagcugggaagaggagacuaaacacaggagccucccccuaacccaggggcacauggagaaggaggaaggcagcccaugcuggggagcaaaagggagagaaggcgagggccagagcccugggaagugucagauccuggugugccgcgcuucucccagguuguauaaucagcugucacuucagcauuucccugcaucagccuucccaaguacagauugaacauuaaacaaacagugacggcuuuauaaauauuuaacucccacuguuuaggaauugcucggggcaggagacaaaauaagaguuccuggcugucugcuccaugcccccucuggcaugguguuggaggccgggggucagagauuuggggaguggugggcagcagcuauucucuucuuccuuuccagggggauguguuuggggacacaugucuguguguucauggagcuguuagggccucuucuagaagccaccaguuugcguuuucauacaguggcugggauccaucauugcugguguuauuccuucacaucagagcaaacuucuuccuuucuuuuuuauauauagcagcuuuauugagauauaauucacauauaauucaccugaaacucacccauuuaagguauacaacacaauuuuuuuuguuuguuuguuucuuugagacagagucuugcucugugacccaggcuggagugcaguggugccaucuuggcucacugcaaccuccgccucccggguucaggcuauucugcuucagccucccgaguagcugagacuacaggcacacaccaccaugucuggcuaacuuuuguauuuuuuuuuuuuuuuuuuuuugagacagagucucacucuguugcccaggcuggagugcaguggcucgaugucggcucacuguaagcuccgccucccguguucaugccauucuccugccucagccuccugaguagcugggacuacaggcgcccaccaccacgcccgacuaauuuuuuguauuuuuaguggagaugggguuucgccguguuagccaggauggucuugaucuccugaccucgugauccgcccaccucggccucccaaagugcugggauuacaggugugaaccaccgcaccagaccccaacuuuuguauuuuuaguagagaugggguuuugccacguugcccagacuggucuugaacuccuggccuuaagcgauccacccaccucggccucccuuagugcugggauuauaggcaggagccacggugcucggccaacacaauuguucuuaauauauucauggaguugugcaaccaucaccacaaucaauuugagagcauuuugaucaccccaaaaagaaaucguuuuuauuagcagucaccucuuuauucccacaauucucugcgugcuaagaaauuguugagcuacuuguacuacaaauauaccuauccuggaauggucuuuugugccuggcuucuuucacuugguguaauguuuucaagguuuaucuguguuguagcauagaucagcaugucauuucuccuuagggcugaauacuguucccuagcacaaguauauugcauuuuuaaaaaucuacucaucuguugaugaacauuuggggacagcaaagcucuaguugaaaaaucaagaugaaaaaucaaaaaaauauaguugaaaaaaucaaaaaaaucuaguugaaaaauccagcaucaugugauuaaggccaaacucaacuucacaaaagagagccucuacuauuuugggaaagaucuagaagguuaucuguaagcauaugguggauguuacaauguguucaguggacacgccauucagcuuuuauucagcacuuaccauauggugggcacuaugguaggauucauuaauuaauuuauugaaaauaauuauugagauuauauagucuugugaaaagauuuaucagaggcuguucugugaauuuuagagguuuuuuguuuuuguuuuuuuuuugaaauggaguuuuacuuuuguugcccaggcuggagugcaguggugccaucucggcucaccgcaaccucugccuccuggguucaagcgauucuccugccucagccucccaaguagcugggacuauaggcauacaccaccaugccuggcuaauuuuguauuuuuaguagagaugggguuucaccauguuggccgggcugcucucgaacuccugaccucaggugagccacccaccucgggcucccaaagugcugggauuacaggcaugagccaccgugcccaggugaguuuuagacuuuuuugggguguaagaaugggagcaugaguuuguguucucagcucguuucauuugauuucagaugucagcucucuuuaggagagaggcguggagaaaaggugggacucucugcaguccuguucuuguucugcccacuucccuccagucauggucucuggccggcucucuucuccccagagugguucuuuuccugccccuggugucccucuaagacccagauguuuccagcacccauuugagaggcugauucagcccaggcagugucuggccuagggaaggugacugcaggaaauguuaaaaaaugggggcuguuaucaugccugagcaucgcacagucccuccguugugacuaauuguagugguuguuguugaagggcugccccaggucccccucccuggaccgguacacucaccccagcugccgagacggcggcugcuaauguccacugcugcuaauguccacagcaccacuucucuggagauuagccuuccuccaacuggagcugcuucauccgggaaguugcucacccugcaccagcccuggcugacucaggggugcaaagggcugcuccuccuuguuuccaugugggguaaacuccauggugcgguucauguuccagggcauccuguggauggccugaguugguccccagccgagaccaccuccuucccuugccuggcucugccaccuucccuuccuuucuccugagguugcucccuguuaaaucacacagacagacauucccuccucaggaucuguccccgggugcccacccucagacacuauccggcaacacguucccuuuccugaguccccucugaugauguaucugacuuggagauccuuggccugcuggcucucuuuucaguucuguucuggagaauagaagcuuccugggcuggccuguugaguguuuuguuugguugguuuugauuuccaagucuuuucaggcuaaucggacacgaggaaaggucugcauugaaucacagccuuggcacuguuccccccuuccuucccuccuccguucauucccccgaacauccuuuucugugccgacaaugaccucagcagaaaggggaaaaggacgugggaaggcugcaugggaaacucauggaacuugguagcaaacagcucuggguucaaguccgggcccuguugcucaggagccaggcacucaguugugguggcuucucuaaccgggaacuucuucuaugaaaaugggacuauucgucucuacuccuugcauuauuguggggaucggaaauaaucugggucaaugauguggugcagugacuagcaucgaggggacacccucuccacacaggcuggaaagacauccagaaggaguccugggcucccucaccacgcaggggcucagccucgccagauaguugucaucacccauccaggcccguuucuggucucauugcuuuuguucauguacuuuccuccuggguugcucuuccuuuucucucugaccugucaaaaagccccauuguaagcaacauuuaaaugcuaccucuuccaugaagcccuuuuggaugccucuuagggggaugaguucuuuccauccuagcacugcuugcugcaugguccaggaucuguggggccugucuucuuuaccacuuugcucacuucaugaauguggggguguaugaagaguaugaugaaauuagaggcuauguucuggagucagacugaucaguacugggauucuggccauacccccuccuuagcugggugacuuuaggcaacugacuguaccauccugaaagucaucuguaagccgugcugaccccccaaccacaggacacuugugcccgcugcaggugcucugucagcagugacuucucacuaccuggcauccucugaauucacgagcaguuugaagaaugagcaaauacugagcaaagcucauaggauuaaauacacacagaccuguguaaguuaacaccaagcuaaggguuaaauacuuuacaaaaauucucagugcgguuggugggugagaagggcugucguccccucuggcugccuugccaagcugguagaggggccaucucccacuaccuacugacaaagauucuuugcuugacccaauuacccaauuuaaucagacacuuaagucuuuuccuaggcccaucuguguacuuccuguaaaaucuaguuuuagcaaaaaacucugcugagucaguuugguaaggaccaccggccgucaauaucuuccauaucugauagauaggguuccucaucuucuaccacccuccagaugaugucuggucacccuggccugccuuuagcaagaaucuugauagguugauuuaaccagaaucccccuuacuccugauguugccuguuaguaauuuucuauccucugacccccacccugcuucuuggcugugaauuuccacuugcucaggcuguauugaguugagcccuaucuuucuccuacacugcaaauucccauugccguggucccuauaccuaucaggaugguccugaauugucuucuuuaucaucugcucugcucugccagagcuuaagcccaggcagcugaguuaaaagugugaccaaauggaccaucuugucccugaaaauugggaccuaagcucgauuccgagauuuaaucauggcagaggaguuuacucugcuaaccaccaucaccccacccuaucccccagaggggugcggugaguaaggggguggcaacugguuguuuccaaucucccaucucucucuggcccuccucugucucuggccucccuucucccuuugaaagggacacagugcugcucacagccuguccugcugcgguggcugcagagaggggcugagaauaagccuguguccgaggcagcccuccaaauacagcagggcuggguugaccuuuaaauagaugggcucugggccacucaguuccuggaaguuugaagaaagucagccuuucaagugaugcgacuuccaaccucaggaaagaucgcuguguuuguaaaggguauaauuuacuguugcuuuugcacuucaugauaugcggcugcacagccagugggagccagcaugccagaauuaggaggggaaaauccucaaguauuuuaauauaccccuacuuagaagcaagauaaacauauguauuguacuuugggacagaagcaagggggguuuagcgggugggaaagggagaguccuggcauugcaugaaaggucuuuuuaagcugaacucugaggguuuucaguuuuucauuuuucuguuuuuuuuuuuuuuuuuuauuuguaagcaaagcuggcaugagcaaaugaugccaggaucuacuuggcuguguaaaagcuguagucccuccucagacaggcagacugcuagaacccucccuaagccauaaacuaguacaccguuuugccucgcccaauuaaaaaugauuggguguggguugucaucacaguugacuuagaugauuuacuuucuuccaggaaaucuuccucccaacucuugcuuugcaauuaggcaaaagaaaaauaaauguuaauauguucugugcucccagggaaaauuuuuuuaaaaagaaaauaaaacacuuugggaggccgaggcaggcggaucacgaggucaggagaucgagaccauccuggcuaacacggugaaaccccgucucuacuaaaaauacaaaaaaaauuagccgggcaugguggcgggcgccuguagucccagcuacucgggaggcugaggcaggagaauggcgugaacccgggaggcggagcuugcagugagccgagaucgcaccacuggacuccagccugggugacagagcgagacuccgucucaaaaaaaaaaaagaagugucaaggucaugagugucagggaaagacugagaaaugguuccagacugaaagagacuaaagagaugugagaauuaaaugcaaagcuugauucuggacaauugucaaaccuuggauggcugggagcguuagauguuaguuacguaucugugucagcuuccugaucuuccuauagaacaugguccuaagggagaaugucuuugcuuuagaaaaauacacauggaaguacucuguagugauagggcuucagguccacuacucccucucacaugcuguaggggaaaaggauuugcuguguguucccagcacguuugugauuauuucacaaauaacaauaauuaaaaaaaaccaaccucugguggggcggugcggaauuauuauuauuuuuuuuugggacagagucucacucuguugcucagguuggagggcaguggcaugaucuuagcucacuacaacccucaacuccugaguucaagcgauucuugugccucagccucccaauuagcugggauuacaggcaugcgccaccaggucuggcuaauuuuuuugcauuuuuaguagagacgaaguuuugccauguuggccaggcuggucucaaacuccugaccucaggugauccaaccaccucggccucccaaagugcugagauuagaggcgugagucaucaugccuggcaguaaucuuuucaguggagaauaaaauaaacccggguuugaauucugacccuuuaaauuuacucaggguuugacuucagccagggaacauaaccuuucugugccucaguuuccucauuuuucaaaacaaagauggugugugugugcaucuccaucuaugaguuguugugaauaggaauguaggggccccagcaggguguguaaagguaccaguuccuggggcgucaaagguuuuucuuucccuucguacccccucacugacaugcccaggucugucuguguagagcaguggguggauuuacagacuccgcugagaacccccuuauagcauauuuucagguucgugaugauaucaugggcugugacccugggaguuuaauuggaaugaauuucaagguuuuguuaaacuuggcuagaaucuuccuauaucuccagcaagauauugaugggguuuuuguuguugcuguuguuuuugagacagggucuugcucugucacccaggcuggaguucaguggugccgucacugcagccucaaccucccaggcucaagggauccuccccuucagcgucccuaguagcugggacuacaggugcgcuccaccacacccagcuaguuuuugaauuuuuuuguagugaugggguuucacuauguugcccacgcuggucucaaacuccugggcucaagccaucugccuaccuuagccucauaaagugcuggaauugcaggugugagccacugcaccuggccaagaacuugguguuucuuauuuccaagcuuaucuccucuguuauuugcucccagggagaccccuuuuccauuuauguuuccagggugcuggggggaagugauugcccucaucucuuuugcccagccaccaaacccagugcagacucugcugaaugcaggccccaucucuguauuuuacuuauuccauuuccugucuugaaggugggggcacuauguuuaucucuaggacccugacuggcucaucauugaaagcuuauuuugugcaaagcauuguucugagcacuguguguguaugauucuacuucauccucuguaacccuagcaguccggucaaauaguaucauuuuauagacaaggcaacugaggcacagagcagcucagcagcuugcccagaucacacagcuggaaagugguagagcuggaaucuggaugggugcuggcagccuggccucagagucggugcuaaccacugagcggcacugccacccaacggaugggagccugcaggaugaggccaugggaauugauuucacucagcgcgagccaagcagaacucccguccagaccucuguccaccacccuaauaaagccaguguuuacacaggcuggaggugcucaucagauguuuuugccaauccccaaauacggccagggccagaaagugagaggggugccuauuauguaaggcccugcggcugguccccagacaaugccacuuccucgcuuggcgcugugugacugcauaacaacggguuacucauuuccucuggaaaacuucacagggccucuuugccccauuuccuccucccaccccauccucaggcuuccucuguugaauuuucuccagauuccugggaacaccaccauggagggccuggccuuuggcgguggacagucuguggcugggugggaacgucaggaguggggccugccucuuugcugggaaugccgugcacucccagcccacuugccccaugccagcacucgaggcaggugaggcccagccauggguauaaggugcucccagggcgggauuagccucaaggaggcaggggguccauguuucugcuccucucccauuacuaacgggugucugcuuuagguuugaucucccucccuucugccccucuccugguaaagggaugaauaaugaaggccuuccuugggaagucugagauggauuaccccaaggaggcucgaacaugggaggacaugcgagaacuauugucacaugaguuuucuuucuauccugucugcaggacuucgcaggugagcaguaacggaaaucagccccguuuauuccucccagcaccugccuuauccaacuccccacgcuguggcugagucccagccugcuauggaagcaucacuggacucccauugaacucugugcagauucgcuguucguagacaugguaccugauggacaccaagcuacguacagcuucaaggccccuucuuucuuugcuaauaaaaaauaaaaaauaaaaacauaauacacguuauauuucuaucuuauaauacacauuucuuauuuuuaucucaauaagcugauauauaguagauauacacaucucugacuguacauacauacacaaacacacacacacguacaugcauguauaugcguaucuaucuccaaugcauguggaguguugugccaggucauccucacauuuaauuuuucuguucuauuuaucauucuuaaggauugucaggcauuagggauuuaucuauagcaauuuggaucuuagcaguucuuuucauggguuaucuuauuuuuuccuuccaacaaccuuggaggcuauaaaagggcauauuauugcccuuuuauagaugggaauuaauuuauuagcaaacucaguuucaugauuuuuuuuuucuuuugagauggaguuucgcucuuguugcccaagcuggagugcaauggcacgaucucggcucacugcaaccucugccucccggguucaagcgauucuccugccucagccacuggaguagcugggauuacaggcaugcgccaccauaucuggcuaauuuuauauguuuaguagagaugggguuucuccauguuggucaggcuggucucgaacucccaaccucaggugauccaccugccuuggccucccaaagugcugggguuacaggcgcgagccauugugccuggccaguaucauggauauuuuuaaagugcuuguuguguguugggcacuacuauguccugcauuuagaaauagaacucauuccuauucucugcuuucccauggagagaggcacaaaccugcggguauagguggguauaguuucuuaaugugcacaccaucguaaaguggagacccugugcgugagaugugugcuguguacagggugggcaggagagagacuggugaggggaugaugcccuuaugcuggaaggggcaagaugaagccucucuggguuuggugggaccuuggagacaucugccuaguguguggucacccagaggccaaggaugugcuguuucuacuugcuugcugcuuucucugggaguggccauuucuuccaaggcaguguaagagccugggcauaggagccaggcagaacuguguggggauguugccuccauagcuuucuagaugagcaaccuuaggaaaguuugaacaguuucucuacauccuggguucuucauccaugaaaugggaauuauuguuugagccucuaaagugagacagucaaaugagaugggcauuugaagccuucagcaggguuccagccucacagcuaacucucaacuagcugugaugguuacagagcuguagguugcucauaagucaacauuguaguugcuggagccaucaacucagcuauaggauacaacacugagcccuuuucacuauccuuugaugggucuccuuuucccuaguaugggccaucggcuaaggugauugaaaaagggccuuucauguuuucaaaggggcaaagaaacuucaguaguugguugggcauuuuauugaguagaggugacuccaugcaguucuuuuugggggaaggaugcugcacauuccaggguuuaacaaaaauuuauugaaugcuuacuuugccccagguaccugucuugguaaaggugauaaauaagacagccucauccucaucuucaucaagccaccagucuggugguggugacugggguggggacugcugaggcauugggccccuugaagccuucccucugggugucuuccuccccaggauggucugggcucucucgggaugggaggaaguuggucugaaagugccucagugaucgcugaaauagguuugccaaagauagaggggaaagaguuggccagccuuuguuuagggacucccagaauggucuuaggucaggaaagagugaauggguacauuucucccaauuucugggcuggagauuccaaacugacuccuucauggcaggcuuccuuaucucugcaacauuuguuuacauguucccuucauagauuucuaacaggaugaagacuuuguuccuugggguaagggucuaccuccagguguguggggaaaaguugagaagcugcuaaauucuuggcuuugacuuaucaaugguuuuucggagggccuggagcugggcugggacugaucaaauuugguaauugcuuaggcagccuccacuuuuguugcuccuggggccagauggcguugggcuagaaacaauaucggggaguucuguuugguuuuaacugcuguaccugggugcucuguuauccaaccaggcccucuccuaaguucucuucuuuuuuuuugagacagaguuucacucuuguugcccaggcuggaguguaauggcgcuaucucacagcaaccucugccucccagguucaagccauucuccugccucagccgccguaguagcugggauuacaggcaugcaccaccacacccagcuaauuuuguauuuuuaguagagacgggguuucuccauguuggucaggcuggucucgagcuccggaccucaggugaucugcccgccucggccucccaaagugcugggauuacaggcgugagcccuguaaucccggugcccagccaguucucuucuuuuuuuaagccucuuccuuuagaaggaagaaaacauaaucuauaugcuggcuggcucuacacagcagcaggcaucacaagggguuuuugucugcuuuugcuucugaaggugaacccacuaucuauuuagagaggccaggucagggugugugugugugugugugucuuuuucccuaggguggguauuuucauucaggaagguguuguuaugauccccuguuguagaagaagcagugaaguuuuagggagaugaagugcuuugucugaugucacacaacugauagaugacagaaucacauauguauucaggggucugguccaaagccuagaagaaggugagccaugcguggcccgauggcacagagcaugagcucugguugcacaaucgugggagguuacuuaaucuugagaaaccucaguuuucuuaucuguaaaaugggacaguauguaucccaaagggccauuuugaccauuuaucaaagucaguuucuccuccguauggagcggagaacaguguccagcaugcaguacgugcucugaugaucuuggcuguaaugaccauccugguuaggguggauuuggccaaaagcuggaguaacugguagcuuccugaucugagaggugucagugggugguguggcccaaagauugagaaucuugucagggguggccacgugaggguggaagugguuugaaugaggaauggucuugagguaagaguuggacaaacagugucuucucucucucucucuuuuuuuuuuuuuuuuuuuuuuuuacuuuuuuuugagauggaguuuugcucuuuuugcccaggccagagugcaauggcgcgaucuuggcucaccacaaccuccgcgucccagguucaagugauucucuugccucagccucccgaguagcugggauuacagacaugcaccacccacgcccggcuaauuuuguauuuuuaggagagaugggguuucuccauguuggucgggcuggucuccaacucccgaccucagguguucugccugccuuggccucccaaagugcugggauuauaggcgugagccaccccaccuggucgacagugucuucucuaagcagaacuguagcccugaagcgcccaggcuagaacucucuauugaaugaggaucacuccauugugccagcugcucucauauugcuuugauggccuuucucagaaaggagaaagguggugcuggguguggcuuuggcuuccuauggccgccccaaugcuggucugacacuuucugaaucugguuugugguuggaucugugcauccuaccgcuccacuccauguccuggccuuggagaaaucauuucccucccgccgugauuguucaccuucaaaggucaacaaaggcaguaggcacugcugagcucuugcagccuucagggcugagcugcuuccucuccugcuuccagugagggguugcuugagggugccuuuaggaaggaaccucaccccuaauguaacuugagcaggucuuugcucuaaacucuucgcugggaacauacccucccgugggacuuggcauggcacccaccucugcagagccaccugugccacagaauaaccucuucucccuagacacacuguguguccuugguuggauucucuagaugggagggaccggcugaagcauaacuguguauguucacauaugugccuuggaagaguuuuauacaggaaaggauuuguaaaucagaaaaaugaaugcugguaucuaauuuccuguccccguuuuaaguccagaccaagucaccuaaccccucgggcuugcagcccgcaucauccacugggugauuaccuugaguuaucugguucagucccuuugcugugggcacccucuuuaccucuacaaguaaacugcaauuaaucugacagcaggggcaagggaacugacgagucuugggugcaaaucuugagaugcuuuggcacauuaucuaauucauuguuuuucuuuucuuuuuucuuuucuuuucuuuuuuuuuuagacaggcuggagugcaguggcacgaucuuggcucacugcaaccucugccuccuggguucaagugauuuuugugccucuagccuccugaguagcugggauuccaggugugugccaucacgcccagcuaauuuuuguauuuuuaguagagacaggguuuugccauguaggucaggcuagucuagaagucuggccuuaagugauccacccuccuugggcagggugccaccugccugaaagaaaaugcccacccuagggaaaaagacacacacacacacacacacacacacacacacagagagagagagagagagagagagagagaccaacguggccucucuaaauagguaguggguuaaccuucagaagcaaaggcagacaaaaaccacuugugauaccugcugcugcguagagccagccagcauauagauuaugcuuucuuccuucugaaggaagacucuaggauuacaggagugagccuggccccaauucaauucaaucuuuaugggcaucgaacaagggcauuauuuauuacccaugguuuacagaagucaaacccaagucucagagagggaagacauuuuuuagucucacugcgaaaguaacagagcuagaauuuagucucugucacgcuaaaucgugcuacaugcuccgucuaguucagagccuguguggaggucgacacuggagucccucaguuuuccucaucaggcuccuggucugauucuuccaagaucagucucuuucccucagcggaagccagcugggaaucacuggccuuguaaccucuucaggcgaccuccuugggauguucacaaggagcauagccaucuggagaaugauacuguuuuuuccuagggcugggaugggggugguaucccucacaucauuccagaaacagcgccagcccugcuuuuaucagcgggggccacaaagaggcgacaagcccugaucaaaugugagcgagauugacaaucucagcacuuuccagggaaaggaugccgucccacauggcuucaggccuccgaggaagccccauccugagacagagagaccccaaaucacaguguguuuccuuuuggccagagaugaggcuuacucaucucagacagcuguguccacggcauguuccucaaggacagcugcuccagaugaaaagaagagaugcucccagagccuugaggggcugcugauaggaacccaaggccucacccuggggcuguauccuguggcuucaaaaauauauguauuugaaagcuucuagcaaaacagauuacacaagaacgcaaauguaagaucccuuugggauucuaacuuuuuuucuuaagguguuuaaagaaaaaugacacccuuaaaaagaaaugccauuuguuuucaaagcugcagcaccagaggacauggaagagaaaggcugaagugucccugaaaaugagugaagauuccagucuguuuuuacuaauguccaaaaucuuagguuuauugccuuugcguuccucugccccagggucucuguguggcaggcgagugggucucguucgauggugcagucaucguguggcggaaugcaugcucacacagggaaguugguugagcgucuccuuugagcaguccuuccucuggugaggugcacaggcgggcaucaugcccauuucauagaugaggaaacugaggcugagagggaugcugcaauuuaggacuucugggugauaucacagaagccucauucucuuuuguggcauguaccuucucuauuugggaaguuaaauuggacuauggggauuggaccaaggggucuucuugcuuccgcuuucucuaggccaaggcuuugcaguuauggaggaagaaagagcuggggucugucuuggcaacccugugacucuucuccccuauccucaccugccuucucacuugaccaacauauuuuaagggcuccauguacaaagguggggcuguggcccuuucccaaccagcaccuuggcccuguacccugauaugggaugguuaaggcacacaggcuucauggaugggggccuacgaccgcagauggagcagagguggacaggguaugguccggcagguggaggugcuggagaaaagccgcguuaggcagcacgggagccaggugcggggucucucaaagccucgagucccuggcagugcugugcucugugaggacugcuuuugacugcagggcacugacacucauaccuuuugcuucugcagcugaccauacucccuggagccuucucccgaggugcgcgggugaccuuggcacauacagccaucaugaugguacuuuaaguggaggcugaaucaucuccccuuugagcugcuuggcacguggcucccuugguguuccccuuuuacugccaggacacugagauuuggagagguaaguggcuuaccugaggccaugugcuaacagagaagaugaagagaugauugaaacaggccuaagaccagaccuaagggucuguacauuuuccacauacuuuccauaucuuuagaggccugaccaaagcagaucuuuuccuuucuucuagguaaguccaaaggcaccugccugcugggcccacuguuuucuaacuuuccuaacuuucugaucccuuggaggugauaaucaaauauucuagucugaggcauugggauacauggugcuagguucugagacucugcgucaggccugaacccugcauuuuguggaggugggugggagaauguuccccuggggaacaugccuagacacgggggacaacaguugcccucauggggagguaccuguuuacucgcuguuaugggaccgcuuucacaaaaccacugcaggugagugaguuccugcugaauaucaggccuggugucucuagacucauuauuucccccacccaaccccuauguuaguucaucucgagccacauuuuuauugccauaauccaggccuggacaggccaagaucuuuuaacaauuuuaauuacugaaaauaauaacugcauuuuuuuuaaagcccaacuuuugguagagucagcccaaaauacagucuuuguguugccaucugggaacuggauuuggaauuguucuuccaugagacugcagagcagaacggcagggccagaggucccacgagcuggucagacccgguucugcuccuugcuggcugagugaccuugggcauugugauucauauucucaucugccuucaagugugguuacgaaugcuuuuuauccugcuuaucaauuucuaugauugccauaaaauauuaacacaaauuuagcauuuauauaacauaauauauuaaugcauaguuuuuuugugggggggggcgguggaggggcaguguugagacagagucuugcucugucacccaggcuggagugcauggugugauccuggcccacugaaccuugaccuccagggcucaagggguccucccaccucagccuccagaguagcugggacuucaggcaugagcuaccacaccuggcuaauuuuuuguauuuuuuguagagacgaggucucacuaucuugcccaggcaggccuggaacuccuggacucaagcgauccucccaccucggccuucuaaagugcugugauuacaggugugagccacuauguccggcucacguccaguuaucuagggcagaggucagacauggaucucuccaggcuaacaucaaggaaccuguaggcugccuuccauucuggagacugcaggggagagucuguuccuugcucauucuggauguuggcagaauuuguuuccuugagguuguagggcugagaucccguuuucuugcuggcuguccagaugcauugagcuucuggaagccuccucgcuaggcuuguggccuccucucuccauuuucaaguccagcaaugguggguccaguuccuuuuaggauuuaaaucuuuucucccucuuucuuuucaccucugugaucucagcuagaaaagauuaucuaauuuuaaggauucaugugauuggacuggggccacccugauaauccagaauaaucccuacuucaagguccuuagguuuaaucacaucuaggaaguucuauugccaugggaggcaacauauucacagguuccaggaaauuccgacaugggcaucucuuugauuggaaugagggguggcagguauucugacacaguaccucagaaggguugcugugaugaugaagugaauggagacacguaaagcgcuuaaaauauuauguagagccaugugaauuuggcagcauugaauuguugaccuauaaaaggucaacuuaauaguaucuggucuauaguaaaucuucaguaaauguuugcugucauuacucuagugguagaaaugucaugcuuuauuuagccaguuugcuauuguugggcauuacuuuuuaaagaguuauuauuuuguuauuauaguauauaugugaacaccgugaucaucaugccuuugcaaauuuuauucugauuuagggcaaugcaugucuuuccaggccacacucagucuccugcucuggugccagugucucuguggccugaggggccccucuuucuugcagagccccucauccagcaccagcucagcucugggccauguguguggggugggacuuuucucuuuugggaagugggccaugccucuccuuccugagaccauccccuuuggcuuccucggggcccuuggcucuuugaaccagccugcagggcaccacaccugugggcccauuuuugucaggaaacgacucccuucccaagggcacccugagucccagguccccaggcccacagauguugggcccucagagugugaucccauguccccagcucuguaacucccugcauguggcucuuaagacucacaagcccauguuugccuuggccagacacuuucgccugucaguucugccaguugggaagugucauccccacugugugaauguggaagggauaaugaagaauuuccacggcuugccuagggucguugagcaauguggaagggaucauggagaauuuccauggcuugccuaaggucaucaagcuggcaucucaacccagguucaucugccugugaugacaggaaagaaaucaggugugauucuguucuuguugacccauagccaccucucucauuaaggcuucuccugcaggcaacuacacagccaguggugggaaagcaccuaauuuacaucuucaugcauugaaacugaugucacucaccucucccccuugaccuggaagagccccugaaggcugccauaggggaaaugauaacccauucuacagcugcugaaacugaggcccagggaguguccagagcuuucugagguccaccauguacuguugaccaggaugagugauagccaccuggugacaauguugaagguucucauucaguagagcuggguucaauucugacuugccugaccagcuggugccucauuuugcucuaaguauuggagccuccagcuuuauuuucuuucagugggaaagacugugagauucagucccuccuugaagcugcgcaucgacucuccuguccuggguacucuuuagguaguggcuguucugaaguggcuuuggaaacccuggaaugaaacugucauguccaaugcugagauuuguauaaacugucauuuuaacugugauuauuauuccuuaggauuugagaaauaaaaucugaggagggagcaggaccugccucagggccuccucuccaaguugagugacccaucuucccaggucuccuuuuguucugucuugagccucucuccugagguccugaaagaagagaaugugcuguuguagggggccuggaaaugucccauggaccaucucgugacucaguaagaugauguguguccucuggggacagaaggagguccugcacagaguguuccugcccguugaugcccuccccagauccuaacgcgaagucugacacauaguagccucccgguaaucuuaauaagcaaaaggacacauuucucaagugaucuuagcaccauuucaugcaaucaauuccagcccagcccuuuauucuggccagcccugguggguccauuagcugcaaaaauuagucgugcucaguuuuaaugcaaaugacuaaguauuacuuuauugaauugauuaauaaagaagcucucuuuguaugauaucaagaccaugaagaaauugcaaagacauagguagggucuacagcagaguuucucagccuuggcgcuguucauauuuugggucagaugauuuguugugggggcuguccuauguauuguaggauguugcucggcaucucuggccucuacccacuggaugccaguagcucugucagucgcaaccccagcuuccaguugggacaaccuaaaguguuuccagacauugccacauguucuuuuguggugguguuggugguggugcguacauauguguguguaaaaaucucccuuuguugagaaccacuaaucuagagaccaccuaauuagggcugacgugggcucuuccacagagccuucuccuuaaagacagauagguugauggacaguuggauuuagggaaaagaaaacugaguugaggguuuaaagugaauuucauccccaauguggaagaugagcguuccguuccuggcuguaggauguggagcauguuacuccacaugugggagaaaaaaaucaucccaucuacuucaggacuuuugugugauuaaagaggcaagauagucuagugcuuuucauuccaugcgcacucaauaaaaaauagggguuauauuuaugaauaguaacaaaaagccucuuaaggaaaauuauuuugggcccuuguucaagguucaguugaccauuuauuuuuaaagagauggggguggcccaggcuggaguagaguggugccauccuaguucacugcauccucaaacuccugggcucaaucgauccuccugcuucaacaucccaaagugcuaguauuauaggcaugagccauuacaccuggcccauuugacuauuuuuucugcuugauuguagagaagggaauguaagucaugaagaucuaaacuauaaaaccugcguggcuuagaggcugagcauggauugugauuuaaggaagccccagguucaauuucugguucugccacuugcuagccauggugagaccuugcccagcuuucauacuuucagguucuuugucuguaaaaugggaacaauaagaguacugaccucaccgggcuguugugcuacuggcugugcugccugaaugggcccuccuuuauuugaaucccucugccacaguugucccauuuuuuuuuuuuuuaaauggugacccaaguuccauuauggacgaucaggcauucaggggaaggagggauccaaagcagagacaaaagcagccagccagcucauccccucugcagcugauaccgaggaggaggaugccagugggaagaagcguggccauauggcuggcaggaugccucacugguaacagucagcccggccccuuugaagugguuuuaagaccaauuugguaacuugauuuggaaagugguaucgaugacuccgagggcgcaggcugcucauuagcugcugucugggcccggcaaauugguuuaaguggaaugaaauugguuccuucccuccccgugcucauggcugagguccaggcccgauuguaaugggaaccucuccugggcaaaggacauagaaaagcuuuccggggagucugacccucuuuuuucauaugugaauucuacuuuccccugggggucaaggcaauaggcugauaaaacauaaaaaugaaccugaaguggguggggugagugugugugugggaaguuggaucagaggagaaugaacaaugaacaguggccgaguguuuuucaagggccaguuaaccauuccccuguugagacacugugcuugaugcauuuuuuuucuuuucuuucuuucuuuuuuauucucccauauuacaaacacugcugggaggaacauccgcacaugcuuucuuggucacuuaugugagagcucauccaggauuuauacccugaggcgacuucacugccguggaggcuaaggaacauuuucuguuucauaagacgcgaucacauugcccuccagaacaaucaugccaguuuacacucccacugacuguacacaagagcccuguuuucccccaucuggucacccacauuugauaggucagaauuuugcuuuuugccagucucaugggggugaugccauuucugguaguuccccugauugccagggggaugagcagccugcccucaacugccccaugcugaaggcccuccaaaggcagcaugaauccucacaguucccagccugugcccugacaaccuaggaggacacgcuggucugguccauugcuuaucugaaacgauucccuuucccuguuccuuuuguugccuugagugucaguuuuggaccucccacugagcaguuuuuucugucacguagccauagacaggacugaguucuuuggaaaauaaucacaucccacuguuguucccauucguucauuuuuuccuucaacuaaccaacauuauucagcacuuuacucagcacaggauguggaaccgaaggccuggcuuuugggacacucaccguccccagucagcucuguguccuagggagagacccaugagcucucugggccuccuuuuguuucucuguaauaaaggacuaaagcuaccagccucgcugcggguuggaaaaaagaaagaguuaguguaacacaugugaauguguacgaagggguuuagagacagacaaaacauugcaccaaggcagggcucgcuggagugcagacccaggaaaaacacugcaggccaaauugcuucuggucugucaggguaccagccacacauccaaggcagggaacuuagggcgauuggccuuucugcucaugcuuacucucccaagcuuguuggguuauuaucaugcacaagccauucaaucgauuguauugggugccuaauauaucagacacucuuaggugcuagggauguaagagcaagcaaaacagacaugguucugcccuugugggcuguauagucuaguggaggaagggggaagagguuaaguauuuguaggaaggugaaccccauguuaagaaagcaucuuccaucuuucaaauguuuccaaguagcugguuauucaugauagcgaggaaaugguggucaucuccauugcucugguaacuaguuugugucugagaaagugcugauuuccaagaaaaggaaagagaccacggaugaaugauagcaagacuauuaaacaggaauacaaagaagagcucacauuuauugagcaccuacuauaugugcuggacccucuuguaagagcuucauacaaauuaggcagacaggcaauauuauuauccccauuugaucuacaaggaaacugaguacaaagugauagcuuuucugcagagcuugugcacaggggccaaaguuugggaacaaugccuuucuuuaauuugaaaguaucuguuguuggugucacuuguuggaauuccuagaaucccagaaaaguaaguuuaaguuuucuucugccagcaucggucagccuaccuuugacccaaggucacgacucccucccuccucccuucccuucccugcucugacauucuuaccuuguuuuugaguuccuuauucccuagcuuccuccaagcagcaggcucugggaacagucccguucauuuauauaacaaauauuuauugaaaugcagacuuguuguuuucauaauaccuguguacaaguuaaacccguggucacuuguucaugugccucuuguuuaugacaagagguggucccuuguugaaagccugucacauggcagguacucagucuuuucuuuccuucuaauaaguaggugaguauuuuccuugguuugcacacgaggaaauggaggcucagagagcuuagguagcuuacucaaagccacacagcuggguuaaauggguucagcaccaugaaaaucugaccuuuaaugucugcacucuuauucucuggcuuauugggaaagaauuggacagggaugguaaauggaguugauggaggcaaagagauaauuacuguugcucaaagguggaucgagagaguuugggcaaaaacggaaccacgaacaagccguugaaaguccccucauccuggaccuguggucuguccuuuguaacugcucuuuuuuuggcauucccucugucuccucugcccaucccaaugccaggcacacugagccuguagggauuuacaaggugggccucagguuucuccccucccaggugggcauaggaaucacugcuuagcuuagauuuggcagaaugaaagagucaggcagagucucacccggcccuguuucuuagcugcuuugacaccuggggcagguuuuuggaccucucuggacauggccagcuguguugugacugcccaccagaggcugggucugugaauggaagacugaagaaaaggcgaugaucacaguccagggacaagguuucugaaucuugugaaauaguuacaaauacuaugaaacaggaauacaaagaaaagcucacauuuauuaagcacuuacuuugugcuauacccucuuguaagagccuuguacaaauuaggcagacagacaauauuauuauccccauuuuaccuauaaggaaacugagugcaaagugacagcuuuucugcagagccugugcacaggggucaaaguuugggaacacauugccuuucuuuaaucugaaacuaucugcuguuggucucauuuguugaaauuccuagaaucccagagaaguaaguuuuagcuuucuucugccagccccggucagccugccuuugacccaaggccauaguaaguuccagagugacuucccgucuguuuuauuaucccugacaaagggauacaguauugugcgguggcuguggauggcguguaguaguguuuuccuucucuugaaaagcagcugcugagugguggagcacagagguauucccugagccccagcuugugcccaugguagguccagggcguuugggggaaggagaccgacucuagguggucccgucugguuucucaggggagaaaauucauagauccaucuccuagcugucauccaauucuguguagaaggggaaagccaagguugcccucagauuuugaucuugguucacucugauuucucuaugccagacuaguagagcuucagggaagcuuggugacuaugacuggaugaauucugucccccuuaaaaccauagguugaaguccuacucacccauaccucagaacgugacuguguucggaaauagggucucuagagagguacaguuaacugagcucacguggcggggcuccaauauggucagacugguggguguccuuaucagaagaagagauuaagaugacaaaggaggagugaagaccacguguagacacagggaggagguggccaucuacaagcccaggagagaggccucagaagaaacaacucugaccacaccuugauccuggacuucuggcuuucagaauugugaggaaauaaaccucuguugucugagcaacccagccugugaaaauuuguuguagcagcccuggcggaucaauacagugaccaugagcaagucacucacccucucugaacccccuuggucucagcucuaaaaagaagccugagaauuucugccucacaggcugugguaagaggcaucagaaauagccgacuuucaucggaggcucacugcgagccagggccuguuuaagccuuuuccaugucugaacacacuucaucuucauguguagccuuuggcuggggaggggagauacuauuguucccauuuuacaggugaggagaguggagcacagagcuguuaauuaaccugucccauguuagucagcaaggaaggggcugguccauauguggaacuucguaguuguacucuggugcccacacaccagaucacuaugccgucccagcuguuguuacaauaagacuauguaggugaagggcccacccaguagugccuggccuaugggacacauugaagaccagcccccugugaccagaaccucccauuugcugcauugaguuuggaauguuugaacuccaggagcuguguguguguguguguguguguguguguguguguguguguguguaucugucugucucccucucucuccucucuccccuaccuuccuuuucuucccuccuguuuuugggagggagcucagccucccuucacugccacugcccaucagcauccucucccuauucagccacccccaccccccaucccugguauuaauugacuuuggcuccuguccuggagcucagccuggcacccagaccugccgugcuauacuaacaccucucacaugguuaaaccaauggggguggcauuuagcagaugacgcugaaacccgugaaucugcccuuucucacugggcccucacugcucuagaguccccgccucuuuuacgaagcggcugucaugguugaugggugagugucaggccccacccagggacagggaggcccagugccggcuguggaguuacccagaccuuacgguaaaaacgcaucacccugaaugggggccaggccaggcaucggcccaagccggcccugcccagcggcuggauucugacucgcugugccuuagucacaggccagagacucuucugcuuccagcugaggcuguccccugccuucccuggcggcccggguuccuggaaaagcugugugccagaggacgggaguuucccuccaacuuaagccauuagaaagcucauuuauugagcacuuacuaagugucagagacugugcuaggcacuuuacaugaaucuucucauuuaauccuuuuaauaaacuuccggggcacaugcucuucuaaucucccuuuuacugaugaugcaggcuugacagugggaaugcuaaccgcagaaagcagcucaccucacuugggugcuacugugugccaaguccugggguuagcacccaauagccccguggcggcaugcuguuauuacucucccugcauaggagugggaggcugagaccuggguguuucugggugucccagcuccuguaugccaucugccuguccagcccuuagccacaaagcuguugugccauguggggagaugcggccaguuucccaggugaggcugguccugcuucaagcgugggagcuccaaccacugcuccacgcugccuccacuccugaaccugaagguggaggaguuucccacugucucaaauaagcaccggggcccaggggucaccaggcucagauggaauuugcuuaaaggacucuugggagaaaagcugauugggggaugggaagagacagcuggcagucacuuaggagacagaugugucaccagaacuaaagacugaccugggaggacugacuuucacccaaaagggccugggcugggaauucuccuuuaugucuccuucccucacacucaagauucaggugcucacaaggagcaccuucgagugaggagguguaggagggaggauggcuaacagcucagucugcucagcacuuuuacaguuuauaagccauuucacagacauuaucucacuccauugggcaaucauaugggaaugcaagccacugucuuuucuuuucuuuuuuccaaauggaguccugcuguguggcccaggcuggagugcagugguaugaucuuggcucacugcaaccuccgccucccggauucaagcaauuauccugccucagccucccaaguagcugagauuacaggcaugugccaccaugccuggguaauuuuuguauucuuaguagagaugggguuucaccauguuggccagacuggucucgaacucuugaccucaugauccaccugccucagccucccaaagugcugggauuacaggcgugagccaccauacccugugccccugucuuacugaagagggaaccgaggcuuccuuagagagggagaggacccuccugggaaacuuucaucccaccugcuccuucuaccccagugcacugcuggagcucaauauuccugaggcaaagcucccugcacagcaguguccacagccguguuguugucauacccgugcacuagcagagagcucagggguagggcccuggguaggaaacccagggcaaggccaguggguagaguugaugcaggccucaggcugaucaaaaggaagacagcgucacagcauggaucugacaucugagggacgucagaucacagaaaggucuugagauuagagcugaaugaauaccccuaggagaaacuaaaaggcguguaacaaaggaguacaauaucaacagcaagccucccccggucauuacaugccuagacugugccugaaccucacauuugucauugcacugguccuuggcacuguccuucaagggaagaacuguuugcccuauuuugcagacuaagaaacacauccaggaagcagcugagcugggaauuaagcccaggguugaucccaaagccucccuucuuuccaugcugcucugcuccuuacaaaaacaaaaacagaauuccuuuuuuuuuuuuuuuaagauggagucucacucuguugcccaggcuggagugcaguggcaugaucucggcuuacugcaaccuccaacuccuggguucaagcgauucuccugccucagccucccgaguagcugggauuacagguauaugccaccacgcucgacuaauguuuguguuuuuaguagagacgagguuuuaccacauuggccaggcugcucucgaacuccugaccucgugaucugccugccuuggccucccaaagugcugagauuacagacgugagccaccgcgccuggccaaaaaacagaauucuuucaauguugcucuaggaaauuuauuuuuaaaaaaugaauuuccuucugcaaugccuggcucacgaccgauuguagaucaagaaacagaucuugggccuuugccacccaagcagguucagaaagacugcccuggccuccaugugcccagggaggccagaggagcccacaguuucacugucucagcagagcuggaggaaccuguuaaacugucuaagaagcuaauaaaaaaaucccagugagaucaugucuguuaaagcccuuugagcucccugagcucugaggcugucuuaacacucacugucucauugcuuacucagcacaaauuuccccagggcugcaaagccccuucccuguuuccagaccccugguuuccucacucauuucauuugaugcuuccuuuacaucuugaagaucugccauuuuuuucuuuaaacacccuauucuagaaagaacuggcauguuuuggguaccuauuuugugcuaagucuuuuuucuccauuggcuuuauagucauacuuugaaacaaaauguaauaugugcccucauuuuccgaugaggcaacagaggcacagucuggggagcucagcaaggucucauguuuuagaaucacaagcugugucugcaccuagguugugccugcauuuuuuuuuuuugagacggagucucgcucuguggcccaggcuggagugcaaaggcgcgaucucagcucacugcaaccuccaccucccagguucacgccauucuccugccucagccucccaaguagcugggacuacaggcgcccgccaccacgccuggcuaauuuuuuauguuuuuaguagagacgggguuucaccauguuggccaggauggucucgaucuccugcccucgugauccgcccgccuuggccuccgaaagugcugggauuacaggcgugagccaccgcguccggcccgugccugcauuuuucaggucauucucuccaguaggcagaagcuucucuguccuuccucaaugggagaacaaggaccugucuggaauuuggcucugaacugaugguuauggcacauuacuuauucuugcuuugaaggucaggcugggcaaucucuguccuuuugaauuguccuggaguaucuuggccccgaucugcugggagaucacccuacugcaaccucccugugcaggaaugcuuuuacuggacucugcauaaaaugaaugaacagauagaucuugauguuggagauaucagccuguagauugccugagaaccugacucaaaccccacucuugucuccaucugcaaaaaucaggcucuuuggaauaccuuuaucaggggauggccauaaagauuguuagaaaaauaaauuauaauagcuaacauuuauuuaguauuuaguauuauaguaacguuuauuuaguauuuaguaucagaaaccauucuaaaguuugcucugguagcaacagcacuauccacaccccucccaaauuaaccaugagauaaauugaacggguaauuugcuuccauuuuacagauaaaaaagcugagacugaaacucuaacuugcagaauugggcugaaacccagaucuccugagauuagggaagacauucccuucucccuacuccaagaaaucuguugugagcucauuucuauguggacuuccuagaugacuggaacauuuuuuuucuucuuuucuuuccuuuccucuucuuuucuuuuguuuccuuuucuuuucuuuugcuacagcucacguaggugccucguucauaauuucuccuucccaguagaaucccaacuacagaagauacauacauaaaugcaaagcauggucuaggcagguuggcuccaggacuuuggagaaaacgugcacaaaacuugaaauacugaucaucuugaauaucucuuaauuacuagcaguaaggcacaaccauaugcaaaaagaaaccaaaaccauggacuuuugccacugcuugacauugcuccaagaaaaaacuugccuuugagggugaaguugaccuccguuacucuuaaguuuccuuaugugccucagaauguuauuugagaaucauucugagggaugacagaggccugcaauaccuaugucuuaacuagaacagaugcuuugugaugaaauugucuuguugugguugugugacugcugugacugagacucaacaaguacccacuuuuuuuuuuuuuuuuuuuugagacagucucacucugucaccaggcuagagugcaguggcgccaucucgguucacugcaaccucugcuucccagguucaagcgauuuuccggccucagccuccccaguagcugggacuacaggcacgcaccaccacccccagcuaauuuuuguauuuuuaguagagaugggguuucacuauguuggccaggauggucucgaucucuugaccuugugauccacccgccucggccucccaacgugcugggauuacaggcaugagccacugcgccaggccaacaaguacucacuucuaccugugggugugguucagcgcccccagugccucucccaggugggaguugccugccuugagcaggugaacaaacugaggcccagggaguggcuuccccaaagucauacaguguagaagaaggauucgggccucugaguucguggauuccuccaugaagcaaugacugagcugcugcucugcaacuggugcucggcuugguccugggggucugugagcucuguaccaugggccagcgcuuucugugugcugccacauuuauccuuugcaccacccuacaagccuguccuccagguccuccauccuuuauucaaaacauuuaggaugaauuauguuugggaguuuauccuguuuugagauuuuagaaacgcaauacaguacgcauaucauacuauguguuaugggcugaauugugucucugcaaauucacauguugaaguccuagugccaaggaccucagaauaugacuggauuugaagguagggccuuuaaagagguaauuaaguuagaauuaggcuauuagggugggcccuaagccaacugggcuagagucccuguaagaagaggaaauuuggacagagacaccaggaugcgcacacacagagggaaggccauguguggacacagugaaaagacagccaucugcaagccaaagagaggccucaggagacacccaacugccaacaccuucaacuugaucuucuggccuccagaauuaugagaaaauaaauuucuguuguuaaagccacccagucuauacuccuuuuuuauggcagcccuagcagaccaauauaccgugugucuggggcagugccucuaaccaagcccaaaauuucuacagggaaauauauuaauuuucauaguaagugggauaaauaaaauccauaaauagcuucaugguaguucaggucaagauacuaaguuuccaacacacaguauaagaguuaugcccaagagucuguaauccccuccccuccccugcccuccccuccccuucccgagacagucucugucgcccaggcuggagugcaguggugcaaucucggcccacuacaaccgccaccucccaaguucgagugauucucaugucucagccucccgaguagcugggauuacaggcacguuccaccauacccugcuaauuuuuuuuuauuuucaguaggaaugggauuuuuucauguugcccaggcuggucucaaacuccuagccucaagugaucugcccgccucggccucccaaagugcuggguuacaggcgugaaccaccacacccggcuguaauaucauuucuauucugcaaauaaaaagccaagcuccaagaggcuuaguaauuugcccaagaugcccaauuaguuucugcaagggcuaaauuuguagcuggguaguuggccucuaggccuuugaauuugccugucauacuguaccaccucuuugacagagauagccuggguuagugcccucucagagcuuggggagguagacagguacaucuacaacuauaguaugucacaauggagugugagaagggcaucugggacccaagcucaaggggaagagccuuggcuuuggccccagcacucagcuguuccagguugagccuuagugcuuguuccacaggaaggauggugcagagccaggcuggcagggcuggggcuggagcugaggcugagaggggccugccccucauccauccagcaccaucaaaggccuuuccuuggcuggcaagaagggagcucugaacagucugcucugucuuuccauacuguguagggacagauagggagcuguugcaggagaaagaacugccaccucuuuuccagguuccguggugaagggaagacacagcucugcaguuuaauuuuuuguuguuguuguguuuuuucuguuuuuguuuuuugagacgaagucucgcucuguugccaggcuggagugcaguggcgugaucucggcucacuguaaccucugccuccugaguucaagcgauucuccugccucagccucccgaguagcugaaacuacaggcacgcgccaccacgcccagcuaacuuuuguauuuuuaguagagauggaauuucaccauguugggcaggauggucuggaucucuugaccucgugauccgccuaccuuggccucccaaaguguugggauuacaggcgugagccacugcgcccugccaguuuaauuuuuuuguaagucucauguuucucugcaaaacuugaaaacagggucugcuucacacuugagcuagagcccuccuuuuagcagaagcuuguucuuauuuuuucauuuuuauuuuaucuuaagaauggccugucauaggccucauuauuaugguaggcacuauuauuacuauuauuaucaucaucacuaucauuaucacuuuuuauucucucuagugauuaaccagucaucacuggccuagcuugcauggugguuuaaugcuuuucaaacaacuuuucaaccaccauuuaccucuacuuuagcuacuaguaccaucccuauuuugcacauguggaaguguagguucagagaugccaagucacuugccccagguugcacagcuuggggauggcaggauccacacucugcucccgagcacuaggaaaagcaccaugauagccugugacaugaagcccucuacagacucaaguuucaggggugguuuuaaacaugucuucuggcuggacacgguggcucaugccuguaauuccagcacuaugcgagaccgaggugggcagaucacgaggucaagagaucaagaccauccuggccaacauggugaaaccccaucucuauuaaaaacacaaaaauuagcugagugugguggugcaagccuguaccgugcagcuacucaggaggcugaggcaggagaaucacuugaacccaggagguggagguugcagugagccgagauugcgccacugcacuccagccuggugacagagcgagacuccgucucaaaaaaaaaaaaaaaaaaaagaaaagaaaagaaaaaaaagucuucugcaggccaugggggacauggucuucauuuuauaggugaacagacugagauacaggaggagucacuugccuagggccaaacagcucguuccucuucaggccuucccgguccugggagcgaguguuucucuuugccuugggaggcuuugcagcuugugcugcgcagcugauagcacugcaaccccugaacaugcacacacacacaaggugcacacaggcaugcgcauggcggggaggugugggugcacuuuccagcuucccugccgugccucguucugcagggcaaggccgagaaacagcgggcagccugugugauauggggacagacauguucucagaucuuggccaugguuucuaauucccuggcaccagaagcccugcugggugaucaaagcugagugccccuaacagaaagcagagaggcacaugggaaugacagguggugaggugaagggaacacgggcguggcaucaaacaggauggacagagugguugguuggcugaucuaaguguggaggagguuguaaacuauucauuuaaaugaauauauuuauucagcaccuacuauaccaaccuuagaaaacuucauacuuucuguuuuuuucucuucuuuuuuuguuuuucuuuucuuuucuuucuuuuuuuuugagacagagucuggcugugucgcccaggcaggagugcaguggcgcgauauccacucacugcaaccuccgccuccuggguucaagugauuguccugccucagccccccgaguaggugagacuacaggugcacaccgccaugcccaguuaauuuuuuguauuuuauuggagcugggguuucaccguguugcccaggcuggucucgaacuccugagcucaggcauccgccugcuuuggccucccaaagugcugggauuacaggcaugagccaccaugcccggcccaugcuuucuguuuuauuugauccccuuuuuggggaagacagggcagguugaaaggucugcuuuccaggggaggaaacugaggcucagagaggagaaagucaggcgccagagguagaugagagccaggauuugacccagugauuuaggauuccaaguccaaggcucaaagugugacuugacagcugcaaucugggaucuggaugugugccuucuguggcucggugacuccagaauuuuuccaacaucugguuguacggaauaacaauaguagcacgaaugaucccauagcugacagccacgggagccaugugccaggccugguucuaagcacaugucauauuugaacucacagaguccuccuagcucacugugaaguggauacuaucgaaggggagucuuaaggguuucagucaguugucacggucacagcaccaagaugggaacccagcagguggccuggguccucaugguuugcugcuguucugugcugccccuuagcggggugggguggggugggguaggugggcucaggccugcagagcuucuguguggcucuaagggagaaagagcagaagggagauuugggaugucuucugagugcuagccacgugagugcauuuuaccaagcgaacugaugacuaucaguccccugauugcuuccugucuuauguuuuuaucuuauccacgcauuuagugggcauuuauaaaggaauucugguauucuaaauauucuacacucuggggauauaaaaguuaaaagacccaggcugggcgcgguggcucacgccuguaaucccaacacuuugggaggccaaggcgggcggauuacgaggucaagagaucgagaucagccuggccaacauggugaaaacccaucucuacuaaaaauacaaaaauuagcugcacgugguggcacgugccuauagucccagcuacucgguaggcuaaggcaagagaaucgcuugaacccgggaggcagagguugcaguuagccgagauggcgccacucuacuccagccuggcaacagcgcgagacucugucucaggaaaaaaaaaaaaaaaaaaaaaaaagacccagugccuacccuuaaaggagcucuucuuauugaaacucuuuaaggaaaggaggcaggaaacagacaucuuuaaugggccagaggcugauuuaggcuguucagacauuguuaagcugcucagcaucugaaguucaaagaggcugagaacaaaccgguuaggaaauggcagaaggggguugggaccuaggugagcagcccgucaggagccccuggguggcuugcacuccuagccccaagugcaauauacaggugaggcgccugcagaauuuucauuaggcugaguucauuucuggaagcagggaauuggcauccacuuaaccaucccuaaugccugccuuuucauguaugucugcacuuacuucuggccuuccccggaugcaguaugugauuccuggaaggggucuccuguacgucguaguuuugucaucuucaggcaacccaggaugacaugauuucuggaaauuucccugauuucuuucugcuucacucucccucuuuugcuagaagggaucggcuuaggcagccauugugguguucauucaacauguccaguacagccuguuacugcaguuuccaaguuggaggguccgugagucuacucccuuuuuugaacagagggguacauggggaagcugagccucugaugaauggguugauuugucccaggucacacagcuugaggguggcagaagccagaucucaggucacagaguggcucuccuccauuugccucccuggucuugccuccuggaggccuguagauaggagacacccuuccuggaaagacaacagcuuggggacauuacagauaaggcugggcgggugugccuagcuagcccagaauaaaaggaucaccgagagaaguuaggaaucgaccuuccuugagguggguucugcagauaaagaugcuuuugaaguucaguuggugggagauaggaucuuuguggccuucuggauggaugcaccacgauagggaaaucagcaagcugaagauagggaaagugaacacuuaucacugaaggccucugcaggguuugcuuugagguacuuccuuccugucaacccuguucuggagucugucuccauuuuucagacacaaaaacugaggcauagauaacuguuuucuguuuuuuguggggagagaguauuauuguuucaauuuccuggacacuucaaaacauaggguauuucucauuaugcaauaguuuaauugagcacauacugcaggccaggcauggugcugcaugcauucuggaaguacaggaaugaguuggaagugcucuuuuuccuuagagauuuuuuguucucuuguguguguguuuggggguggggggggcgggcgggcacgaauaggggaggaauuuagaugagaaaucagauaaucacagccaaggugccugccuggggacacagggugccauaggcacacagaagggcccaggguguggacuuaggguggucaggggaaggaaggaguuugcccagagaagaggcaggagggagacaggaaagguaagcagaggccagauccuagaaagaccauuuugacuuugugcugagggcgauggucucaugaugcagauuuuaagcagaggugagagagggagagauuagcauuucagaaagcauggccucugccauaggaagacaagaucagagggagguccaagcugguggccaguggugacggggccugagcuggaggagacagggaugcacuggagacccaagagagaagucccugaacgcggugcacgaagagccucugggguuacaggaaggaagggguaaaauguucuuuucuguguccagcuuaggccacugaauagauucggugcuguguguuguacuaggaaaugcggaggugauggggauuguuugggcuggagucuggaggggcugugccccaccccaagcugggugagcaucuaagguaagugagggcugugcccaagacugcaugagcaaauccagguucuccuaccagcaagcugccuugaagacucugaggcuggaaauguauaaccuuguccguaccacugagcaccuguuacccauacacauuacuguucuccaaaccacggaacaacuugaaggauuguuuugccagacuaaaaagugaagaaagcacugguuuccuuccaugguguuccucuuuaaaccacaccuucucaaccuuguuuagggaguggggauggccuucaggagcuccagaggcccccccugcccgagucugacuccugguuucuggcuucaacaaugacuaaccuguaacuucacauuuuggucuauaaaguggguagaaauguagcaccucugcauucuccagguuuguugugaggacgaaggagauaaugaauguagaauuuuuuuuuuugagacggagucucgcucugucgccuaggcuggagugcaguggcgcgaucucgccucacugcaaccuccgccucugggguucaagcgauucuccugccucagccucccaaguagcugggccugcaggggcacucccagcuaauuuuuauauuuucaguacagacgggguuucaccauguuggccaggauggucucaaucucuugaucucgugauccaccugccuuggccucccaaagugcugggauuacaggcgugagccaccgcucccggccaugaauguagaauucugagcccagggcuggcucacugggagugggccacacauuuaggggguuguuguuguacacaugaucaucgguggcacugcuuugcagccuaaugguuuuugacacauguguuccuucuuaauccuuaagccagcaccuugaguugggugugaucaacucauugaauuuuuuaacuucagcugugacauuauagaucaucuagcucugcugugaccuuauuuuguagaugacagggcuagggguuaccaucccucuuaaggccuagggccuggguguucucacacccagguugcgguuuuuguccuugucuucuggagguucgucugcauuuuauuuuuuuuuguugacgauuuguugacgaggcuggagugcgggggugcuaucucggcucacugcagccucugccuccuggguucaagugauucugcugucucagccucccgaguagcugggauuacaggggcacaccacugcaccuggcuaauuuuuguauuuuuaguagagacgggguuucaccguguuggccaggcuggucucaaacaccugaccucaggugaucgcccaccucggccucccaaagugcugggauuacaggcaugagccuccaugccuggccucaucugcauuuuagggucccuguuuuacaaaggagcagucccuauuuuacuugcagaugggcaguagugucagauccucacugggguggucagggaagaggagguguuuggaagagggccccaauggaccucuggccugcgggauugagaucgggcuggccagcucuccucucuuuccucaacagagucugggucucacccugcccagcagcuuucucuucuuccuagaagugcccaagacaggaucuuuucaguucugagaucuuccaccccucgcacggcagccuuccugccccugcccaggcugacuucacaccaugcucuguuaucccagguccuaggcucgcaucggccacuugccaccauguuggugacugccugcccucuaccuuggauggugcgguccacggggcaggacugggguuugccauuugugugucccuggugcuucucucagugucugacaccuggugagauuugccaccuguuuggugcaugggugagugugguuguuuacacuagcguuguuauuggaaaucacucaauucuuguucucacccacuccugccuccucugagaaaaaguguggcagaaaaguucccugaacuacuaacacagggggauuuagcacucuuagauauuuuuaacuuuuccauagaaaggcagcaccccccaccccccuccacccuuuuuuugaagcagcagcauuuacaaauauugaaaccaacuuuguacaucuccacucugacuucugggccuauuuaauaaauauucacucaaacauguacuaugugucaggcaugauuuuuggcacuugggaaacaucagggaaugauguuuggggaggaagcugaucuagcuggggcccaggugggguuggaauggaggaauggaguccugcccuaaauccagcauggccuuuguccugcgugccuugggaccugguccuggugguucccuccacuucucugauucuugguuugaauauauauugacugaagaguuggaauagaaauaucuucguauucuguuuucaguucuaggaucguuuauucguccaguaacguuugucagggguugaaugucgaguggagaauggcugaauuugcacugugagggaacucacagcuggagggagauccccacagggacugcgaaggcuuauugcagaugaaggagugccaugacgacgaugacccccaggagcguccuuccaggacaagcagauggguucagggaaggcugggcaaagaggggcaagucagccaugccuggagaggagcagcaucugcugggaguccuguuuugacaguugucauucccagauguucggugguguguucccugcagcaggccugcaugcaccuggaugucagagugggaggccauuagcucacugguucagaaauaguuccugguuaugccugucuugugguggcccauucucagcuuggcggauacagcagcgaccaaccgaagccaccagugggagcagaacuggaggauggagguccucggaaggguucuagccacacugggcuucagacccuccagagucaaagccuggcuuccuucuccugcuggaggcaaaggcccuuauuguuuuuuuguggcugcaguaacaaauuucgacagauuugguagcuuaaaacaacagaaauuuauugucuuacaguucuggaggccagaagucugaaaucaaggugucagcgagguugacacccucugaggugcuaagggacacccuuuccuugccucuuccagcugcuuguggcacuggauguugcucggcuuguggcagaaucauuccaaucucugcucuugucuccacguaccuucucuauguccgucucuccucauguuuuagggccuccaaugaucucaucucaagauuauuauuuuuaaacaacuuuauuuaauuuuauuauuauuuuauugauuuauuuuaagaaugggguuuuaccauguuccccuugcagcucuccuacucuugagcucaagccauuguacugccucagccucccacagcaugggauuacaggcgugagcccccacuccuauccaagauucuuaacuucauuacaucagcaaaagcccuuuucccaaauaaggucauaggcaccagauucuaagggcaauaucuuuuuucggugggugaagacagcauucaacccacacuaguaggccccagcacuucuggggaaagccaagguuuagaccucauauccagaugcucuuuucugugguuuugucacuuuuucuuaucuuauaugagaaauauauacauauuuuaaaaagguaauuaaaauuuuguugauauaauuucacuuucacauugaguaaaagcugcaagaagaguacaaagaacucccucauauacuuuacccaaguucaccaaugaaaaaauguugcccccuaaguggguauaauguacacauuuucucacagccaguuggcagauucaucagagccucaggcucccccuaccccucacagcgucagacagagaguuuaccauggggcuggacaguuaugauugguuucucaggcagcugcucacucuaaggcuugcuguaggcucuggcguuacaucugucacugggaauguggcaucguccuggcacagucacagagaggccaaagacacagcucuguucaccccccauuuaaagccaaauggccauccuggguccugggggacccuuccuuguucucuccacucugcccuuggaugugucaguugcaggcacuucagaugcaguagaguuauuuagagaaggcggcucccugcaccgccugcugccuuuugguccauuuugagcuggguguccgagccucugcccuacaucuaggaacuaacagagucagguguugggugcagaacagagauuggcaggagaugagcaggcuguucagaguccgccaggagcucugugcuugaagcucugaagagcuuccauccuaccuuccugaugaugcagacuuuaggugagggggagaggcaaggagguuacaggauuuaccuuuuggaaagacuacuuugauaugaaugcagaaucagggauggaaaaccagugaaagagaaugucacaauaaauaguauaauugaaaguccaguuuuagagguuuugccagaggcacauggaggggguagcuugcuugguuugcauuaaauuaaauugcauuacuuagagucccuauaaaugcugguggaucaauguagcugaugguuucauaacaaaacaagaaugauaauaacagcgucuaagagaaugcaaacguuaauaguacaguguuguuuuugauccugccacuguaugguauugaauuuaccuggguuauggagucucauaauuguaccaaaagcuguggaaagagucagggagaguauuuuugcccccauuguggggaugaggaagcuagaggugaccugaauugcugagguucaugcaccuaguaaguaacagagcugcacuuggacccugagucuuagaaaaaaccccacacuaguucuuuugcugauuucugagcuaugcccauuucucucacuauggaauuguuuuccacuauaccucuaggaagcuaaacugggacauaacuggggcacaagaugggggauggagcuugccccucuucucagcagccagauaaggccuugggagcagugaagagcuuucuguaaccugaacugccugacauccuugcccuuagccacguggggcuguugaacacuugaccuggggcuguagcagcugagggacugcaauuuuugugugaauuaauuucaacagacuuaaauuuaaauagcccucccuauguagccaguggccaccccauuggacagcauaugucagcgcuguaaaagucaagugugagccacaaugggacauaggaaggacuuuucaggaaaccauuugacuguugggauucuccuuucaucuuuuagggguaugguggggaguaccugcugacggggauauuagaaugccuuucuuuuuuucuucccuugaugugccgagacuccaugcccccugucacggguaucccagagcuauggcuaguggguuugcuggcugagauggguccugagcccuaggccccuuugccccagaaaggaaaaucccgaggaggcagcugaugcuagcccuggaagacuuuaauucgaggguggcacaccugacaacgccuuggguaaugaguguuuguuucuggaggcucaugggacacccaccccagggcugauugcagguuggaugcuguuuggugagaauggaugcauacccacccgcugaugacaaagggacaggucagaaggacagggccuuucuuugaauggaaaaccugacccgggaucucuccuggaagaugaagaaugaacugggcagugaaguggggagaaggagagguuaacuucuggggggcuuagagaagaggggggaaggaggagaggagccugggauuagucccacgaaggcugcgcucuuguuugcccaagucuccuccugugugggacacaaagugggcuuguaauacaauacuggcucaaaggaagaaaaacggcagaggcuagcacuggggccacccugagcaagugguguguucaucugugcauguucuggacaguaccacgaggucaguaaaugcuucugccuggcaucuaccacaaagcucauuccagagggugcucuguggcccugccaagaauaaggccucgucaggaaaggcucacccuguauuuucccagccuacuuugagccaucuccugaauaaaggacagcuugccugggcaguaccgcuccugccacaaagacggaaaggaaaaguauggcaagugcuuuaagacuccuuuuaaugucagcuuucuacauccagauaaggagaagagcucacgaugguccuguaacuugccagacaucucacaggagauucauugcugagucucugagcacacacaggcucccuuuacagacuggaaaagucuuucuggucaguuugccuccacugacauuuauugagcgccuguaguaugugcuuggaugcugccuugagagggcgcuuuggguuugaaggcuccggaaacguaugacuuuggagcacucauuccuauucggugcugaccuuuguucacauuugugcucagccaacaauccuguguaggagaguggagccugacaaauguuuauggaaggucugccuggcugacuccauacacagauugcauaggguuuuccaaauggcagcuggggagaaguucuggaucugucagaacugauugggagaaccugcaaaacaggcagggguguauacgucccuuuuccaaagugacccuccugccuggcuuuugggaacaggaucuguccucgauggucccucacuaacugccuggcuuccuaacuguugcaggucuggggaugucuguuguuaagacaccaugcaucuggaugccuguugaguguagagugcuggcucagcuguaggguggggugggauggggggugguuugaaaccucuuucaaaaauaccauuagggagacaccaagacagcacugacguggaugcagaacguaagugcucuuggagaugaggucagcacaugaagcuucucugauuuuacaguugccaccagggacgcaggauuauguuccuguuaacugaagacacaaugagaggccuggcuuaggcaaaagcuggccaguaggguguaucagggaggcccuaaaaggguuaguacagugggugaauuguauccccuaaauagauauguucagguccuaaccccugugcccuugaacgugaccuuaguuggaaggaucuuugagggcguaauaaaguuauggugaggucaucuugggguauggugagcucuuaauccaaugaaggauguuuuucuaagagaaaggacacguggauacagacacacucugggaggaaggccaugugaugauggagguggagauuagagggauacagcaccaagucaagggaggccauggauuccuggcagccaccagaagccaggagaggcaaggaaggguuuccccucagaggcuucacagacagcacggcccugcuguccccuugauuuuggacuugcagccuccagaacagugagagaaaacauuucuguuguuucaagccaccuauuuugcgaccauuuguacccugagaaucuaauacagaagggaaucucauccuaucuugaggugauggcuuuccuagacuccauuuagagcaaggaauugcauguuuauaagcgaacuuugacacuugccucugcugauauggcugggaauccucucuuucauucuucauuauuaauggguauuuauuaugucauaggacuugucauuaaaucugcugaaaucugguaauccaagccuccaacccauaguuugcaucaaccagguggcgacccccaggcucugcugguuuccauuccuuuaucuugauuccauuccuuuaucuugauucucccuggccgagagcuuuucugacccaccuaaaaucuguucauuucagaccccggccuuuccaggaugccuuuuggagccccugcuggccaccacauaucauguucugaaguucuacagcccucugaguuggacacugaccaucugggggcucgagucauccucagauugguaugcagccauucaaacauuccuguuuguuuccugugagucagcauugugcugggcuuccaaggaaucugcaguccucuucacugccucuuccugaguacucacuguguuccaggcuucucucagcccuuccuggguacagugcuaggaaguaaagagucauauccacuccaguaaaugauugcugaguggaugaauauagcuauuuucaccaccaagauaaagaugggaaagugagacucagaaauaagaaacuugccuaaggucuacacaguuuaccagugcaagugcugggauugaacccuggccugucugacauagaggccacuauuggcccaggacaaaagcuugucugcagaggacagagcaggagcagcgcuguccauccagucugggcgauauucuuugcagugggcccaggggugauaggaacuuguugcauggaugaaguggaacuuuucuucccagaaaagaagacaagaagacagggcucugacacccauggucuccagcagcccuuuuugccuggagcaaguaugcccaaccccccuuuggcucuugaauaagaaggaaaggccuuaccauaugagcaggaauugugcauccaggcauguggcuuacucaccuuuccugcuaugccuaaccuucucuucuccuuucucugucuccucagacccucagggggcacacauuucagcauaagcuacagaguuuuguccgcauucacauuccucuccaucugccaugauuuguuuuuuuuuuuuuuuuuuuuuuuuuugagauagagucuuacucugucacccaggcuggagugcaguggcgcaaucucagcucacugcaagcucugccucccaggcucacgccauucaccugccucagccucccgaguagcugggacuacaggcgcccgccaccaugccuggcuaauuuuuuuuguauuuuuaauagagauaggguuucaccguguuagccaggauggucuugaucuucuggccucgugauccgcccgccucggccucccaaaaugcugggauuacaggcaugagcaaccacgcccagccgacuuguuuuuuuacuagccgucaaucuccaacccucugucacagccuaacaggugccagggggaagacuuaggacuggggucucaucguugguuaugggcacuuuaggguuaaauaaagcuauguaagacaccuccccaaaaaauaaaaacaaaaacuaaagaccaccaaagaaaguaggaaaccucaaaaaacugagaaucacuauuaccuuaaagcccaagugcucuaggaggaggcaaaagaaaaugaaaacagagcagguuaugacucagcuaacugaugucauggcuguuacaugucccaucucaugucaucuaaaucaggggccagcaaacugacaggcuaucaguuuuuguaaauaaaauuguauuggcacauagccaugucaauucuucuaugugcuaucagugcugcuuagguaccauuauaacagcagagucugguccugacagagacccuguggccugcaaaaagccuaaaauaguuucugucuaacccuuaaagaaaaagauugccagccccgguucuaaacugcacuucugauuucuaacuagucggagcuauuuuuuuauggagggcagacaguuucucauuugcucugcauagcaggccuuggcagccgagggccagggaggagcuugcccagaucaugcagccagucccuacacagcuggcauucaccuccaggucugccugacccugaagccugcacccugauccccugcuccucugccuccauccccugcugggccucugcaggagacgguccaggcccacacugcuuagagagguuuccaagaguacaugaucuguuagggauuguuugugacaguuagcuuucaggugagagcucuugagaagaccgccuauaucucuucccaugcaauagcuccagcccccugcccugcacuggcauagagcaggggcccaauaauauuuuuugauuaaaggaaggaaucaaugaagagggcagcccucaagccagggcacugcaguguagcauagagcagcccagccucuggaacccaugccaggccacgaguuccagucugcuaugaccuuggacaagguagacuaccucucugggccucgcuuuucucauccguaaaauggggauaaggacagcaucaaccccaaaugcccacugugagguuacaggagcuacugcagguugugugcauggaacauucuuagcauaucugucaccaccgggacagaaacgggcuguuauuaucgaggcuucaggcuguuuacugaggauucuuuagaaauggagaaaggaagaguagaaugcuggucuucggacaguccggccaagugagacugucaggcagaugacuguggugaagauggcccagcaagccccuccucuacucagaucgcccuuggaaaagccagucugagaauugcuguccuggucucuucacuggggcugggaaaggcaaggcaucuggccucagccucccuggacaccugcuccugaggagccugcagauuccucaggaacuacugcugcacuccaguguugggauggcagcagcaagaccuucaagcugcaugcuggggcgaaguucugccccaggggcuuguguucaccccaagacugucagugcgccacccauauuggucaggugcuucccaguggccuccguggggcaggccacuccagccggccagcuuucuugcuuugcagaaagucacugggcugagcagcaggcagggaguuggggagccccuugccauuuauuugcuggucacucacaggguguucgaugguuucaauuggagcuguugaacuguggccuaagucaauuaucacuggguugcuccugcuugaguuagaugugccccaacccaguggcacaguggaaucagcuuuaaaaauagcugugcguugggagaccgagguggucggaucacaaggucaggaguucaagaccagccugaccaacauggugcaacccugucucuacuaaaaauacaaaauauuagcugggugugguggcaggcaccuguaaucccagcuacucaagaggcuaaggcaggaggaucacuugaacccaggaggcagagguugcaguaagccgagaucccgcuauugcacucuacccugggcaacagugcaagacucugucucaaaaaaaauaauaauaaauaaauagaaauagcuuugccaggguuccgcucccagagaagcugaugacauaauugcucugggaaggacuggggcaucugugcuucuugaagcucccaggugauccuaaugucagccaaguuugagcuguauauuaaaaaaaauuuuugauuaaaacaaauuuuuagagagagagucucauucugucacacagguuggagugcagugauguaaucauagcucacuauaaccucgaacuacuggcuucaagcaauccucccgaguagcuaggacuacagguucaugccacaauguccaguuaaguuuuuauauauguauauauuuuuuguagagauggaguuuugcuauguugcccaggcuggucuugaacuccaagcaauccuccugccuugaccucccaaagugccaggauuacaggugugggccaccaugccuggcuguucagcugcauuuagucauuuaccugugugcccucccuugccaugugugcacaccugguaccugaagaccugggagacgaaucaaugacagggguacauaggaaauaagaauaauggagagagccaccaguuagugagccgcgacuacugccaggagcuacacuaaguacucaccaugcugcuaggaggaaaguucugaaauguccccauuuuauggaugugaauacugaggucauggggguaaaauaacaugcccaaaggcacagagcugguacuguuggagucagaacuagacuuagguccccugugauuccaaagugcuaccuuugccuuggccaccccugcuuggacuuucagugaggacaacuguguguugggauugugguccacacuggaaaucccaacuaggucccaccugauggaaaacuaaaguuccucauuacuucuagugccaguguagaagcugacccaaguugccuuuuugaaaaaaaaaaaaagaaggccaaacacgguggcucacaccuguaaucccagcacuuugggagucugagguggguggaucaacgaggucaggagaucgagaccauccuggcuaacauggugaaaccccaucucuacuaaaaauacaaaaaaauuagccgggcguggugguggaugccuguagucccagcuacucgggaggcugaggcaggagaauggcgugaacccgggaggaggagcuugcagugagccgagaucgcaccacugcacuccagccuggggacagagcgagacuccgucucagaaaaaaaaaaaaagaagacauaguuuaggaaauucaguauuuauuucuuggccucucagcagggcuuuauauuuucgaagggugggcacuuaaauuacacagauuggguuuuucuguuccucuuugaacacugggcugugugaggaggaggaggaagaagacugaaucuuacagagcugagaugaucagauacugccggaugugccauggggccuggagagcugacguugcuaauauaucaccccauuggugccuacaguuuccauucucugauuagagaucauauuucuuugacuugaugcucaaaugccucugaguuugauccuuucucauauccugaauucuauuuccaguuccccagaguuuuauccuaauuuuauccauuauugaaguuuucccaaaaaaagucagcaucaucaucaucaucaucaucauuauuauuaauuuuucuuuugagauggagucucacucucacccaggcuggagggcaguggcacaaucuugauucacugcaaccucuuucucucggguucaagcaauucaccugcuucagccaccugaguagcugggacuacaggugcgcacugcuacacggcucuaacuuuuguauuuuuuaguagagaugggguuuuaccguguuggccaggcuagucucaaauucaugaccucaaaugauccaccugccucggccucccaaagugcugggauuacaggugcgagccacugcacccagcccaucaucauuauugaugucauuuauuacacagcauuguauuuccaaagaauagauacgggugagaaaacaaaaucaguaacucuuccuugacuaaucagauuguuuucagauaucugauauguuuugucuuuacauuaauuaaugauuuuauauagucauagguguagggaauaguuuguagucacuuuuuuuuaauccuaaagcggaaacauuuuuauuauaauauauccuaaacauuugauguacccuaaauauuuuuucauuuuauuaaagcagcuuacaaaugaucauuuuuagagaguauauaaugcuucaucaaguggacaagucauauucuaaaucaguucucuguuguuaaaaauuaaagugccuaguaguuugccguuacacuucuaagggugccaugagcaucuucgugcauauaaccuuuuucuucuuggaaaaucuuuuggacagauucucagcaggauuauugagucaaagggcacaguuuuaugacucuugucccacauugccaaauuacuuucaaauaagguuguuuaugcugcuuccaucaacauguggacaugccaguuucaccacaaccucaucaacacuggguauuauuagcuuaaaaaaauuaucauucaauggaugcagaaugaucucuuguuagauuuauauauuuuuuuauccuuagugaggccaauuuucuuuuuugccucuguguguuuaccaacucucuuugggaaugcugacauuggcugcuccuccagccaaguucguuacuuuccauguggaugccuucaaguugagccaguugcaacgcagccuugacuuaaaaugagcgagcuucaacauugagccuuuguaugaaauucagcuuagcacacuggccccugaguuugaaggcugagauugcaacacccugcucuucacgucgugggguucugcaugaaaucacugaacuggccuuauggucuuuaugacuucaaacuuaacaguugucccccuagauuugucuuaugagcuaggcaggguuuuucuucagaaagcuuugagauacagcuccuucaacuauuuuucgguuuccuagcuugaaaaacgaagagaagaaaagucccuguguguucauguugucucuuuauuuguggggcuguuguguuucuagaugguuuuuucugguuuucucuugcugcuucacucaccacauccuguggagcuggaggcuucucuagcccuguuugucucugccugucugacauugagugccuggagcccucccuagcucuccagcuggaaccuuccucuguaggaaggcugaggcuagcagggagaagccaggauggauuuuaaagagccuuguugucucuaaggaagaguggagcuuacaucuuuggguuugcagaaaugcccacauucaacucagggggaauaaaaggaugggaguuagaauuucaacuugcaguugcagaaucucagaguuaaaagaaaccucagaggucaucucuuccaacccuucuccagagcagcuuuaauugccugugugggagauucagggccagcagcugcagcuucccuuucccugccucugacuugccaggugaguuuagaugaguuccuugcuuucuugaguguuuauuauuauuacuaauaaacaagaggaugaauauuugaaguucuucugcugucuuaaagcccucaaacuccacuggcuacugaaaucuuauaugcaagcuuuauaccuguaacuuguuaaaggagagcugcuuugauaaaaauaggguuauaguccuccugcugaaccucccaucuccaccuggcccccagaagucacucaggaggcucucuugacccccuagggauuuguggaguacaguuggaaaggguggcacugugaccuaugguuauaauaacaccggcaccuacuuauugaacauuaaccaggcaucaggggcuuggcacaggucauguucaguucugacagacacuuugggggcucuguauccuuauccccauaucauauaucaggucugagccucagggaggugcucguugcucugccacacagaggucacacaggaaggaagugguggagacucaguuccagcccagguagcucagcagcaaggccugucugcuucagcucugagcuuuacugccucuuugugacuugugaccuucaaccugacacacagcaucccagccuucccuggaguuugguuuuuugaguugucaucccaccugccaucucugacagccccaguauuuaguguuuuaggugcucccagauccacgauguguaguaauaggcuaaaggcaucaguguucucuagaauacuucguaccacuuagcaaauagccucugugacgccacugguuuugugauuuucccaagcaaacuuuacuaucccuuucuuauuguccucaucacuuacucuuguuugcacaaagcccaggcucuaauuuauuccccuuguccuuaauccucucaucucuuucuccagguaucacccucagaaauaaggaugugcaguaggucuggugggcaucugaaugaggauggcccccaggguguguacauuuccuggggggaaacugaagcuggagucugggcuucucaaguguggguucugccccugaagcuguuuucucacaauggaggcuccagguacuuccuaagcccccaucugcugcaggagauaccugaagaaacuguggacaguucaaagguuggauuauuuaagaaaucuuggcugggcauggugguucacaccuguaaucccagcacuuuugggaggcugaggugggcggaucacuugagaucaggaguucgagaccagccuggccaacauggugaaaccccaucucuacuaaaaauacaaaaaaguuagccuggcaugguggcacaugccuguaaccccagcuacucgggaggcugaggcuggagaauuucuuggacccaggagguggagguuucagugagccgagaucaugccuccacacuccagccucggcaacgaagccagacucugugucaaaaaaaagauaccuuguaucaguucugacacuugcauuacuagcugucacccaacaccuuaguuccauaagcuugaaggcuucuuaucacuauaggauuaagucuguaaaccgcaguuguaaguucggugccuucugucaacuguucaucuccccugguugcaggcauguucucacccacguccguggugauggguguuaggugacagcaugcuuccccaugcauugcugggcuauccuagugacaguguuauauuuaccccagcaucugaugagcagagcagagucagggcuuaugugcuaaugucuuguugcucuucucuucucuugcaugcuuacuuccacacugucacuucuuucaagcugcugaucacaaguuacgucuuacaggaaguucuccaugaguagcuuacuucucuuucucuuuuuuuuuaagagauagggucuugcucugucacccaggcuggagugcaguggugcaaucauaguuuacugcagccucaaauuccugggcucaagcaauccuucugccucagccucccugaguagcugggauuauagguguguaccaccauaccuggcuaauuuaaaaaaaaauuuuuuuuuguagagacaguaucucacuauguugcccaggcugaucucaaauuccuggcuucaagugguccuccugcuuuggccucccaaugcacauuccugagccaccacauccagccuuaguugucauguuuuuguuuauuauuauuauuuauuauuauuauuauuaaacggagucucgcucuguugcccaggcuggagugcagaggcggcacaauuucggcucacuacaacuucugccuccuggguuccagugauucuccugccucagccucuugaguagcugggauuacaggcacgugccaccacaccuggcuaauuuuuuugugguuuuaguagagaugagguuucaccauauuguccaggcuggucuagaacucgugaaaacaggugauuugcccuccuuagccucccaaagugcugggauuacaggugugaaucaccgcacccggaccauuauuauuauaauuuuuuuuggagacaagguuuugcuuuguugccuaggcuggaaugcaguggcagaaacauaacucaguguauucuugaacuccuagacuuaagcugccuugcuaauguauuuacgugugugucuguguuuguaggucucacuauguugcccaggcugaucucaaacuccuggccucaagugacccuuccgccuuggcgguugccauuuuuagcauuauuguuauuuggacauugugauuaauacuuuacacaaaugacacaauuuaaccuguaccaaauaaucaucuuucauuuauugucuaacaauaaacucaaccaaauguguaaguucaucuaucuauuuguccaucuggucaucaucuaaucacccaacagaaguuuuaccaaacuccuuuuuuauauuaggugcuaggugaacaaaguugaagaaaaugggucucuaacucaaugagcugggauucauccacgcauucaaacgaucacaaguguuugcacacugcucacuacccuugcuuguugaugccagccuugaguccaggcuuuccauccuugucagcaagguguucccacaaaguagcucccauuugcuaugauauguuugcccuucugguccuggaaccuucaucuuggugacacaaggccugagcaucugucauauaaaccuuugcgaugcaggcuguguucucuaggaaacagacgcuaagauguagauuagcaaguaggauguuuauuaugggauuccuuugggaucaacagcugugaaacugaaggagaagaaaccauaguugggcagagggagaaguggagcuguaacaaugucccaacaaaggccaaugccagaggagccugggagcuagacugauccuucagaauuguccugaauugaggugaggguugaucagucauuucaugugcccccgaccccaccacccaaaggaugccuaaucuugaacaaggugauuguauucggccaaggcaguucccagagagggcugauagcugauggucaucugccagcacuuuaguaacugcuuuagaagaagccuggauggagaaacaucugcuuuguuuuuuuguugugguggugguuuguuuucagugaaagggucuugcucugucacccagguuggaguguauuggcaugaucauagcccacuacagccuugaucuccugggcucaggcgauccuuccaccucagccucccaaguaguuagaccuacagguccauaccacagcauccggcuaauuuuuaaaauauuuuuguagagauggggucucacugugcuccccaggcuggucuugagcuccuggcauuaagcgaucuuccugccucgaccuccugaagcgcugggauuauaggugugaaccacugugccuggccaaauaucugcuuugcuuaccauuuuauccccaguaucuaguacauaaaagcacacaguauuggggggaauggaauuaccuaagcuuuacggaagcacugugaguaauucauuuagcaaauauguauaucuauuauguuccuaugacaugucagucacgauuacuacccuuacggagguuauagucuaggggguuugggcugagcgguggcucaacacugacuuccuggaagaggcaaccugcauacugggggcgugacuuccuggacgaugggcucugggccagcguugggcucaguguuuccuggguucccuagaagguggcuuauugagcuggagacuugaauggauaugggauguuuucucagggagggggcucucuguugcagcccaccucugggcgcaccuguccaccauaggaaauucccugcuucacuuaccuucauugacguuugaacucccaggagccuggaacuuccccaggugccccauuggcuuggugacuuuacaucauuacaucaguugaguaauugaagaauggaggaaccauucuuuugagcuaaguggaaaaauauauuuucuccucugugagucaccaaaaacuacagcuucuuuuuuuuuuuuuuuuuuuuguuugagacagagucucgcucuguugcccaggauauagugcaguggugcaaucuugguucacugcaauuuucacccccuggguucaagugauuccuugccucagccucuugaguaggugggauuacgggcauccaccacaacacccagcuaauuuuuguauuuuuaguagagaugggguuucaccauguuggccaggcuggucuugaacuucagaccucaagagauccacugccuuguccucucaaagugcugggauuauagacgugagcuaccgcgcccaggcuuagagcccagcuuauacccaguuacuuagcuucuguguguguguguguuuguaaaugaacuauuauauuucaggaaguuccuagcagggaggaugagauggaaucagugaauuuuagaucucaaggagaacuagagauugcuugguccaaccucuuuccucugcaagagggcccuuguggggaagggacuggccaaggcuacccaaagagcuuggagagaggugcagggcaugugaccaugugcaaagcauuugccaguagaguucggcauuuuuuccuggcgcguucaccuccugacagggcaccaggaaggugcugcacagccuggcauguggugggugguguuuaucugcacaagucacccaagugaucagaacgcuuuuacggaaaacaauggcuuugauguucugggugacaagaccaaagcaugcuggcgggaagggagguuuuugggguuagagaaaugaaaacuauuuacauuuagggcugacuuaauaacuuaacaccucugaagugggaggauguuuuugagggaaaguugaauguaaguguaguacaaaaaggaaaguuugagguagaagacuaggaguggaaauacuucuaauggcucagggaaaacguccugguaagguugaacuuccagaugccuccuuucuucccacacccccacugcauccucuguuucuacggugagauuugcauggcacuuuacaguuuccaaagcauuuccucacauauuaucuucuucaguccucccaggagguggugccaccaaaggcugucugaccacaccugcggcuuuuggagggagcuuggcuuggaacccaggguucucugagucaaaauccuuuuuuccugggacaguggugguccucacauucccuucaagacuauagacuuuagaagcccagucucuggcgcuagacuuccuuccuucaccuaccaggcuucucccucugcagaggucuugggcgccuuuugugaccauucugugacgugguuucuugaaauguaagauggggauaaugugagcaccuacccaccuucuuggguuguuguagggaugaaaacaucuucacaguuccuggcaccuauuggaguuggauaacgauguuaggauuacuugaggcuggcuuuccuaccuuguuuuaacagcagcucuagaguuucagaaacauaaggacuggacuuuuggugaucaaaucuaaacacucuccaguaaaaucagugaugcugcugacucugagucuuuaaucauucuagucucuucacccucugaaaacaagaggauguguagcauagugagcaacagcugugugccggggacucagcauuaaguagcaugggauuacucaugacuucgcacucauggcagccucacagguaacuuugucaauuucuuuuuuuccuuuuauauuaaaaaaacaaaauggcuggguucaguggcucaugccugugaucucagcacuuugggaggcaggggagggaggauggcuugagcucaagaguuccagaccagccugggcaacacagugagacucugccucuacaaaaauaauuaauuaauuaauuaauuaauuaauaaaauaaaugaaucaauuaaaagaauuaagaaaaacaaaacaaaacuuuuugaaucaguaaagcauuuacaagacacaaaauccaaaagguauacaaaguuuuccaaugaagacugccaacccucauguccccagaccccuguuucuccucccugggacacaguuguugcagguuucuugcuccuucuuccugaaagagucugugcauuauugaaaagaagauguguguccaugaguacaucuacagacgaguguugagcaccuguugugcacaguggugggggcagugugaugggaguacacagggcagggagacacgggucugggcuccccugaaguuugcagccguauuaagggcucggccuuacagugcguggggccucggcuucagaggaagggcugaucuuggggcuggcugcugcuugacuuggaguaccugccucccucuggccuccuguugaggcagccuggggucaaaucccagcucaccuaugugccaggcugcuggauggcucggauguggccuaauuauuuccugauggcccugccagccuggccaugggcuguaggaacaguaguagccauccauuuuucuuucuucuucuuggacggagguggugguucaaaugaaauuucagccuuacccuuuguaguuuucuacguaauaaauccuaacaucugugauuaaggugacauagguuuuuuugagaaaggcuuugauuucuugcuugcauggaugguuaauacuccaggcucuucagggugauucucgcccucuuguucuguagcuugugguccuuauuuauuuuaauauaauuuaaaacuugcagaaaaaaauuaugaacauaugaagaacuacugcacacccagaucaucaguuguuaacucacacuccaccccaccaccaaauacgcuauuuuuuccugauccauuugaguaaguuguagacaugcccuuucaucccuaaauauucagugugugcuccccaaggauaacgacauucuuuuacauaacgacuguauaauuaucaaacucaggaaauuuagcauugcugcaauuguauuauccaauccucaggccacacacaauuugaucaguagucccaauaaugucccuuuugacuauuuuuucccaauuauggaucauuauugcauuuaguggcugugucucauguuccccagucauacuugacuuugauuuuuuuuuuuuuuuuuuuugauauagagucucacucugugguccaggcugaaguacaguggcaugaucccaggucacugcaacccccaccucccggguucaagugauccuccugccucagccucccgaguagcugguauuacaggcgugugccacaaagccuggcuaaguuuuguauuuuuaguagagacgggguuucaccauguuggccagguuggucucgaacuccugaccucaagugauccacucacuuuggccuuucaacgugcugggauuacaggcgagagucaccgcacccggacgacucugacauuuuugaagaguccagguaaguuguuuuauagaaacacuccucaguuuggguugagacuguuauuuuugaaagcucauacugcaccacuugcuuuaauucuguaauccucaaugguccccuauggcugcugaucacguccgcgucucuguagauaagaaaacggagccaucgggaaguagagugguuugucaauagucacauucccagcaaguggcagagcuaggauucaaauccagacuaucuguccugaaaccuaauuugccuaccaggcaacaggaauaaggacaacaauuagacccugagaauaacaaaguguuuaucaagcacccacucugagccagagguuguguugagcacucugcagacacugcaguacaauacucccauccaucccaccccaguccaggagcagcuguuuuauguuguuguuguuuugagacagaguuuugcucugucgcccaggcuggagugcugugguacaaucucagcucacugcaaccucugccucccagguucaaacaauucuccugccucagccacccaagcaguugggauuacaggcauacgccaccaugcccagcuaauuuuuguauuuuuaguggagacaggggucucgccauguuggccaggcugguuucuuucuuuucuuuucuuucuuucuuucuuucuuucuuucuuucuuucuuucuuucuuucuuucuuucuuucuuucuuucuuucuuucuuucuuucucuuucucuuucuuucuuucuuuccccuuccuuccuuccuuccucccuccuuccuuccuuucuuucuuucucuuuccuuccuuccuuccuuccuuccuuccuuccuuccuuccuuuccuucuuuuuuuuuuugacagauucucacucugucgccgaggcuggaguguaguggcgugaucucggcucacuguaaccucugcugccuagcuucaagugauucuccugccucaacuccccgaguagcugggauuacaggugccugccacugccccuggcuaauuuuuguaguuuuagcagagacaggguuucaccaucuuggccaggcugguuuugaacuccugaccucaugauccuccccucucggccucccaaaguguugggauuacaggcgugagccaccgcgcccagccuuccaggcugguuucaaucuucuggccucaaacgaucuuccugccuaagccucccaaagagcugggauuacaggugugagccacugugcccggcugaguagcugcuuuuuuuuuuuuuuuaauccucgauuuacagaugaagaccagagaagcuaggcugacuucccauguugacacagcaacuaacugguggggaucagcucagagcugggcagacuaugcacuucccacccugcccugcaccccaugcucggcuugcuggauuugauagaaucuagcaagcgugggggccaggcucugcugacucccugugagaagcagugucuguuucuguguccuuuucuggggccuucuccagagggaaggaacauaucccaaagcuggagcuugcacucaggagcuucccaggggaaacugcuccacucucugccaucuacagcucuugcagguaccauagucuaccuccaugaucuauuugcagugggcgaugguguuuugaugauuuccacaucaugaacccaagugcuguugcugauuucgaagcuuguucacugucuccugccaaguggccaagggcuccuacccuagcccuugguggcugcuccuggcugccaucugcccacccaguuggccccacugccugggccacguucugguggcauccaagaacugguagcagagauggugauuagucaauguguguuauacccugggucucuccaucuuuccaacagagaccugccuuacauguaggacugccuccccuuguucagguuaccuagcccuugugcaauucaccuucugauuggagaaggaagacaauacggcccugccucucggccuguagagaggaauggaugaugugaaacuguggcaugcuugauauucugcuggcagagaggagaacagauguuaacacagagcacaccucugccccgaaccuccugggagccuuggagguccugagucagccuguccuuggcacucaggcucuucagacgucaaagcacagcguugggcccagcaugaccuucugcggucccaggagacaucagggaaguguugucaguguccuuagaaagcccauggcuugcucggccacaucaggugcagggaccucagucaaccacacagcagguagauauccuugagaacugugucaggugggaggauagccagagggucugggggcagccaccugacccuucagucccaggaucuagcaccucccaucagaccuuccucuucacucccuguuucucccaccaauuauuggcauuggcauauuucugagcaaguucucuccuuguggccugucacucugugggugggaagugacccccugcugagcagguucaguguuuugagguggggcuaugaccuucugcuuugcaccgggcucuaaacacccuggccugcccaggauucuuugcagcuccugggagaagcuuagaaauuuuaauuuccuuaauuuccauggaacauugcuuuguguguguggcuaaaaacauuaauuaaaaacauuaaucaguuuggcugccuuggaaagagguucuuuuuucugcaggagccaacgugcuggguuauugcaaccccaucuccccagccccuuacaaggaggaggggacaggacaucagcuugcaaaccaacacuucagcccuguauuuguggauuugucucuuggugucaggcagacuccuuagcuccucugaacuuuaguuuccacaucuguaaaaugggaagaaagguuaugugucuccugauuucuuggggacucuguguguguucagugaggugccaggaggacaguccuuagugaaauguccucuacagaauuugcuaguaaaggcgcuguuguuauaauuagcuggauuucccugguaguuuacagacugccucuucugcgcacugucucauuuaauccugucagcgcaccuggcagacggguaguguuugaauccacucuuuuucacagaugaguacacuggaaagggaggguuacagccaggccuggagcugagaaccuuugauggaagccccaggcuuuggcccaaucucauugccuucauuugcucccuuggccccaugugcugagucccuacacuaaguuacaguggugagauagaaagaggggaggccuuuucauuuccuccugggaggagaggaagaaguuaagucucuagcauuugccuaaguagugcuaauaaaagcugacauuucuaugggcuuauaauauccagagacaagugcuaaacucugcaaagauucucacuuaacaccaggaacaagccucuaagaugagaaacugaggcucagagagcucaaguuugaguacuuguucaggguccuaaaaagccucuuuaaguaguagaacugggacaccaacccaggaagccugagaagagcccaccgucaaccaagaggcugugccucugcccuuuuuggguaacgaagcaaauucauuuugacaauaaggcuaaaagugcuuuccuggucacaaugccugaggcgugugggaggcugcucacuggggagcccagaggcgcugaggacagcaucuuucugcgugccuagcuagucaaggggacuuuucagaguaagggggaauucacucugugcugcugggaacuggacucugagugcaggaugcguuaagccugcacugaaugggaggaggcgaggacucugaggcuugcagaaccacugcagaucuguccgugauaccaacacaucuaaggaaggaauaugacaaccagagugccucagagaagacaauuauggccaaguuguuccuuggggagagaugaggaaaucaaaguggggaauacaagccaccugcccgccguucuugccuguggggcaaggauguuucaccagcuauuccagaguugagagcaaauuccccuucagaacuuuucagcguucuuuauucugaguuugugcugacuaagcuucaugucauucaugauuuggcugccagugaggauggugggggggccugaaaagggaaaagggcaccguacuguaaauguaugaaugggguuuucugugggggccacaccggagcaucacaguucuuugaaggacaggagagaaggucagugccuggauccccaggcuaaguaccaggcgcugcuuuaggauagccuagaaggguggccccugggccucauucuccacacugucccaccccuuuugaccaccucaucuagccaucuugaugaucaguuaagauaagaaucucuagugaggcuacauuuuuuuguuuccugaauaaugcaugauguccacugaacacauguuacuagaugacaguguugggcucagauaaaacuuacaacaaaauuaaucugaugcagccuccauggcucacaugauccccaccauguaugaaaugggcugggcacccagggacaggcuauucucagaaugggguuauuggguguguuucuuauuccucucuaccuaguauucuuggaagaaggugaaugaaaaugcucuaguaggggagggaaacaugauuaaugggugggggcuuaugagucagaaagacccaaccaucacuucugcccugacugccugugugacuucagaaaugggggauaucaaagccuaucucauaggauuaaacaguuuaauguguauaaaaugccuaacacagugcuugccacauaagcauugcucauuaaaugucuucucuucuugugcuccucauucaguguauaguaaaugugcaguccuuaucuuuuaaaugaaugaaacaucucauuaccaaaucuauucaagguaaacauugauauuaauauguauccuuuuuguguguuucuagaauccuguuacaccugggauuuaggcacuuucaaucugaaaaaauacauauccuuucagcacucuggacggacuugagaacuguccuuacgugaccuaaagcuggaguauuuugagauuggagaauuaagguaagcgacuuuaucuuccugauccuugugaaaccaaaaauagcuuuuggaguugacgaccuccugcagcacagcuuggguugugguucuugaccucucggugugucuuccugugccgcuccaauguguucgggaagcuggcuccccauaaccucuccccgaccugguucucagagucuaguccacuuauucauugugccuaggaagcucucccucugucccuaguggagggaggagcccaccaucuccuagugaaugcgccacuuguagcagaaggugcaggaugcuccagcugucuugugaaaacauguggagacagccuuggggaaaagaggaaaaggugaggugaggguuauauaaucagauugaaacaccuuugggacauccagaacaugagcucuuccuccuuucccagccaauccgugcuuccuccuuucaccuccuugaauucuaugcuccuuccacacuaaggcugagggugcaggagguaaaggguuagagguuaagacugagugcuucagguagacuuggguuuucuugguuuugcuacuugccucauuuuggacaagucacucagccucucaaagccuuggucuccucauuaguaaaauagggaugguauuagugccugccucaugaagauguuguuuguguugagugagauauuggagcaaaacagcuuagcaggcugccuugcacugaggaagaaaugcuccaaaagggaagagaguuuuugcaaauuauuccucaauuaugccauuuagaauuccuuccauguaucaggcuauuuugaagucuuucauuugcuguccccccagccuuucaccuaucaccaagucagccugggaaacagcugagaaucaccuucccaguugugcccagccccuuacccaaagcagaguugauuccccccuccccuggacggcagcgggcuagugaaggcaugucuccacuauaccauggcuacugcacuggguugaaaugucccuugccccuuccccugcccauucccccuauugcuggugaaauugcuuagagcaaggacugucuuacacaucacaggaucuggcauagugccugaccgagggugaaacaacaaaugaaugaguaauugaaaggagagagaaaaagagauagagaaguaaccaaaagaagaaaguuuuuaaagguucagaggaaagaaugaggucaguugcaauuuuuuuuaaguaagauguuggaaagaauaaaugacaugaugaaaaggaaacugacaugauuccuaucaugaauuugaaagcuaugcaaggguggaaaggugggugagaagcuguggacuggugagaagacagagaagucagaacugagagcauagcagagaacuguacuucuguugugcuacauaugucaucuucaucuuuuguauugugccuuaaauuuucaaaagcgcauuugcguuucaaaucugcugugauagucagcauuccuguggcaugcagaggugaagagcaugaggccuugcccuucagucaagguggggauacuggcacacauaggauacuacauacucccuaggugucugugaggaugguggaggggauuuucuccaugccgggaggcuuccuggagcaggugcugccucucgugacucuugaaagaugcuugugaauaaagcauacugggagcugagcugcuguuuaguaauuaaaaauccuuuccauuguuuagagcucagcaccuuugugcauucauauuacgcauucauuuucguaucauuguugaauuucucacuucugcuacugcaauguaugucuacagcugacaagucuuccuugggagcccuacguagcucuuuuuuuucuuuucuuucuuuuuuuuuuuuuuuuuuuugagacggaaucuugcucugucacccaggcuggagugcaguggcgcaaucucggcucacuguaagcuccaccucccggguucacgccauucuccugccucagccucuugaguagcugggacuacaggugcccaccaccacgccuggcuacuuuuuuuuguauuuuuauuagagacgggguuucacuguguuagccaggauagucuugaucuccugaccuugugaucugcccgccuuggccucguagcucuuuuugacccucagggacagucacugaauuaugucuugggagcccaugcuucugaggcaggcuuagggagcaggagagcauacagguguagcagccuuuccagcugauccccaugcccugcugcaccuggagggcuggaacaagcuauucucauauuggggaaaagggcugaugggaccucagucauguggcagagaaucugaaagccagaagcuuggcaggucugucucgggguggggugacggagagacauuucccuagaauucagcugcugggagcagaaagacagagcaggggcaagugcuggguuucugaggcccgcaguccugagcauggccucaggcagucuguucuaugacagaaccugaagaaaggcccaggcauuugcaucuaugugugcaguucuacuuguccuaaaggcacuucucacacugggagccugccugucuguaccugucuagaaaucagccuggcugggacgcacaccaauaggagggcauccucaccuuucccacccaugagucgggacuguugccugcugugcagcaaaggcaccaggaacacggagucagacacuuagggucuaccccaggcuccacuucccacugccuauuugacucugggcaagucuuuuacagcuuuucaaacuucucucuuucuuaaaacaaaaaaaaaaaaaaaggaaaaaaauuucuugccaggcacaguggcucacgccuguaauuccagcauuuugggaggcugaggugggcuaaucacuugaggccaggaguucgagaccagccuggccaacauggugaaacccugucucuauuaaaaauacaaagauuagccaggcaugguggcacacgccuguaauccuagcuacuugggaggcuuaggcacaagagucacuugaaacugggaggcagaguuguaguuagccaagauugugccacugcacuccagccugggcaacagagcaagacucugucucaaaacacacguacaaauuuuuuucuuuuauuuuuuuaaagacagggucuuagcuauguggcccaggcuggccuccaaucccugggcuuaagcaauccucccaccucagucuccugaguagcuaguacuauaggcacacaccacacacccagccagacuucaauuuucccagccacaucauggaccagaagccacuuggucugguugugaggaugacggaaccuugcccgaggaaaugggcaaugaacaggagccuguuuguuucuccuuccagcuccugaccugucuagcuccugacccucucagugucauucuugcucaccccuggcccugcucccuggauaugcagacaggaugggcuucuucccuuuagaccuucacuuugcucuuuuggacuccucuucuggccuugccuuccccuggugucaucugcuggcucccugccugauacugccacacuggucaugcuggccuccuggccuuuggugacaccgcaucagcaggcuccugcuucccugucaagggauacaagccagcaccggucuuucgccacaagguauguguguaaagauugcuuccuguacuugguguccacaggauuuuaaagaacuccuggcccacucggaacucuacgcuugaaacagaaacaucuucucaaaacaccucugguauuggcccauuucucuauuacuguuucuugugguuucauacugagguuuuuggugcauugcaauugcccuggaguuuauuuuuaguaauaaagacagaguucaauuaaugucaaaacaugaggguaauugcagaggaaggauuaguaagucuaggggaaaaugugcccaacuuuuuuucuucugauaacaucuuucacugaucauacaccgucacacccacagacacggagcuuccuccgugaugucugcaaugcacuaggcccagucggggagcaguggcugcgccaccaccugaaaacgaaagcauuucugagucucuuucaguccagcucaucuagcagccagccacacaggugaccacccaccguagcugucacuaugggugaugauuaucauuaugguuuugaggaaaggcugggcuuuagaauagucaauucuuauccucucuccggggggauuuauucugucuccagaagcagcauuucacuuuccugaacaucagcucuucuccccuggauugcagggucuaggucuuguucucugucugcuuccagcuuuuggcauuuugacagcacauaggacaugcuuggagaacguuuucuugaguuaacugaauucaggacacugacuuggggcuggaaaggcaaagugaggaagaaaguauuccccuuucagaagcuccccagucugccuuaagaaacaaaggcagcccugucaucugcccaggacuuuacaguuuauaaagugauuucucauccuuucuccuuucuuguauugcacaaauaucgaacgagaaccugcagugugccacugugcagggugccuagaauaaaggagaaaagccacugugcuuucucugaaggaaucacagggagugaagcuagcuucauggaugccagaauuucacagaugaagggacuggaggcuuggagcaauugcauugcuugagauccccccugcucauggaugguggcucccaaaucaggacaugagucuucugaaucccuuaaaccugcccugugccugccuguucucccagcacauucucuguacucucuugugcugcuccucacccccucuccaacugucucuccuucuccaccauuguccucugcccacuccuagucccuucuuucagcucuguuucuucugaaaaugaggaucuuucucucuacagugccucuugugggacggguucugcugaugggggcuguguuugggaucucgccuggaaacacgaucucuccaacuuucccugggagcagagccuugggucucacugaacccaccuccccagcaccuuguguggugacuggcaggagguagccauucccuccuguccucucugcccuuguccacuuuccuguuaugagucaguugcugagauaggcuaugaggaguuaacagaguggauaaaaaagagcuuuguccuucuuuaaagccuucaaaauauacagauguauuagucagggcuuuccagagaaacaggaccaauagaacaugaagauagaugcguauccaugucuauaucaauaucuaccuugauauuuauaucuauaucuaggagauuuauuuauuauaagguauuggcucaugcaauuauggacccagagggguccugugauuugccaccugcaggcuggagaccuaggaaacagcugucgugucacaaagggcagagggcuggagaaccuguaguguagauuccaguccagauucgaaggccugaggaccaggaaugccaagggcaggagaagaucgaugucccagaacaagcaaucaggcagagaugaaauucaaccuuccugugccuuucuguucuauucaggccuucaguggguugaaugaggcccaacccacauugaagaggaccaucugcuuuacucagucuccugguugaagugauaaucucaucuggacauacucagaaaugcuguuuaaccagcucucuggaaauccuguggcccagucaaguugacacacaaaauuaaccaucacacugcagagacacagucuaucccaauaccuguauuuacuggguaacgugcaucucagcucaccaggcugguuugauugacuuggcccaaagcugcccuuugaguguugagccccagcugaccccuuugauccuucacagccccaucauuaaaacaaggacccugaaucaagugacuguaagagccacucuuguccuguucugucuguauccuggcuuugaguguuuaucuaagcuaagcccaauugacuguugucauucuuugucucuuccuugcucagacaucaguuagguauuuauugaacacuccuguguucacagcauccggcuccugggauuagagacagcucuugacuccugguuuugcucuuugaaaccuauuggacugcuuuucuuuuaagauacaccccccacauuauaggaaucuauccauuucuuuguucauuucuuuaauugugcauuauaucaguccgucagucaguuuuccuccugaaauaugcuaaguauugagaauuauaauagauucuauuaagcaccgcuaauaaaguacuauccuuauaguaguaguaguguuugcggugauggucguguuaguacuaguaguaaucaagauggccaugaagagacugcuuuuaaucuaccaguaaucaugguaaaaauaguaauagcucaaauguauuauucaugguguuucaagcacuuuacauuauaugaugucauuuacucuucacaaccugccaggaaauggaaaugauuacguaauauacuccaguuugcaaaugaaggaaucuuccugcggaacguaugugaagcgcauauuggugcucugggcuuuugcauaauuucaaauguccuuuuuuuuuuuaaacuuaaggcuaauguuuagaagcuuuugcuaaugagaggaccauuugcuaaaucgguauaagugcuacacauuuggguaucuccaucccaacauaccucuuauugccauuccccaaagcagacaccuucuccucccucccucaaggaccucugagcuugcacuccaauuccucucccacacucaccuuucuccuuucuguuccucuugggauccagguuuauuugaggagauaggaaaagcuccugauccagcagguuuuauucuuaaauuuguaacaaaguaaaucacagaaccuccacccagcauccaggccucugguucucucccuccuucccagguauaggccggcuuucagaaacccugcaccacauagacccugggccugaauugcugugaguaauaaugacucugcugguaauuuguguccuucugcuuggaacuguuuccuuuuuaguuuggucacccucccagagcugguuucaaugggggcauacccauuaugggaugcagggcauccugcauccugaggaauuuuuuuuccuccaaaaaugaaaccuugaaaugaggacauuguccuguccacggacugcacaacaacacugagccucaaggacucauacuggcauuuuucuucuuuugcagagugugggcacccuggcuucaagcucacgagaaaccaggucgggauuuaaacaauguuggguuaaagcaaaguuucauaaagacagaaucaagaaaaaaagaaagagaaaccaaucuaagugccauccucccugaguugcaucuuaccugagucuucagccgccgcccccugcugcugugggaggaaacgggaaagugacuggccauggggacaggggucgggggugugaggguuagugguagcagggagguagcacuucugugaagccggaaaggagaccugaaccuggcucucugcuuugcugcuugccagcccucuggcugggaagaaggcucuuggcucuugugagccucgguuuccucugcagaguggccuguucugaggacaggcugacauugcuguccaucagucuuccaggacccugaggauuucagcucuacccaugggcacugaacuggaacauucacuggucauuugcuuucguuuuuuuuuuuuguuuguuuguuuuuugauacagaguuucacucuuguugccuaggguggaguacaauggcgugaucucagcucaccacaagcucugccucccggggucaagcgauucuccccaguagcugagauuacaggcaugcgccaccacguccggcuaauuuuguauuuuuaguagugaugggguuucuccguguuggucaggcuggucucgaacuccugaccucaggugauccgucugccucagccucccaaagugcugggauuacaggagugagccaccgagccuggccgcuuccggucuuuggauuugauuuuccucaaguguaauugaaagcaggggccuggauggccgccauagucccucccagcuucgacauuacacauuccugccaauccauuuuucaggcugauaacauuguucagaguuuaaugggagcaggguaagauagucaccguguggagcaaaaauugaaggaaauauuccagaugucaugauuuuuuaccuguagccccucugcugccacacccuugugcacauccuccagacacuuuuaaagaauaaacucuauuuucagaagaguuuuagauuuacaggagaauugugaaaacaguucaaaaaguucucauauacccugcucccaguuuucccuguuacuaacgcuuugcauuaguguggcacauuugccacaauuaauggaccaauauugauacauuauuauuuacugaaguugaaacauuacuuuaguuuuuaccugguccaggaucccaucugggaucccacaucacauuuagugaucaugucuucuuagauugcccugggcugugccgcuuucucagacucuccugguuugugaugacauugacagucuugaguuuugaugaccaguuuugacuggucagguauuucauagaacguaccucugugaggguugucugauucuucuucuuauuagauugggauuauggaggaaggccacagagguaaaguuccgcuuuuaugaaaucaaggguaggcaccaucagcaugaccuaucacugauguugacuuugauuaccuggcugcuguagugguugucagguuuguccacuuuaaagauacuuuuguguuuuuguucuuucuuaacucccuuuuuauauuaaacucuucagaaggaagucacugugcauagccauccccuaagaagagggcauuccugcucuuccuucuccauggcuagaggaucuacaugaacuauuuagauuuuuucuaccugggagauuuaacuccucucuccuauuuauuuauuuauauaucagcauggacuugcagguauuuauuugauaauuuuuaauuuauuugaguuauaauccaauaauaugguuuuauuuuguugcucaugguuuuucuuccuuggcuauugggaacucuucaguuacuuccugugcccauuugacauacuuucuuauuaugggucuuucuuucuuccuuuucuuuccuucuuucuuucucucucucucucucucucucuuccuuccuucccuuccucccucccucuuuucuuuucuuuuuucuuuucuuuccuuccuuccucccucccucacucccuccuuccuuccuuuuucuuccuuuuuuccuuccuuccuucccucccuuccucuuuucuuucuucuuucuuucuuucuuuccuuccuuucuccuuccuuccuuccuuuucuuccuuucuuuuccuaccuuccuuuuccuuccuuccuuucuuccuuccuuuccuccuuccucuucuccuccuccccuuccuuccuuccuuccuuccuuccuucccucccucccucucucucucucucucucuuuuuuuggugcauccauacuuucuggcacuauaagaugcuuagggcuuaucuuguauauuuccagccccaguuauagaaucagccauuucuucaaggauccccugucauuuuacuggagaaaggacuuagaauccaagaucugggugcuagaugugcuugagguguuguuuccuccagaucuucucaacugacagagcagugaaauauauguguguagggaggauggggagaacaauuuuuuuaacacauaugaauacuuaccuggcaggggagauaccaugaucacaaaggugguuuccccagggugaggcuuauccauugcacucccgaugugcugaccccugugauucccccaaaugugggagacuugacugcauaauuugugguaaugggggacugcauuuacacuuuucccuguaaaaauuuuuaaaaauaaauaaauacauaaauaaauaaauguguguauaugaauccaugugcaugcacguauguguaaauauuucuccagguauccaucuuaucuauguuaagcuaacuaugaguuuauacugcugucuccaacucuaauucauuaccacauuucacccauuuuuuuuuuuuuugaaauggauucucacacuuucgcccaagcuggagugcaguggugugaucucgucucacugcaaccucgcucucccagguucaagcgauccuccugcgucagccucccgaguagcugggauuacaggugcacaccaccacaccuggcuaauuuuuguauuuuuaguagaaacgggguuucaccauguuggccaggcuggucucgaccuccugaccucaggugauccacccacuucagccucccgaagugcugggguuacaggcgugagucaccacgcccggcccccauccacuuuuaacaaacuuguuuucuuuuugcccacauugacugacaaaagaagguaaugaacagagauguuggaaaguucacguggggcaagaggagugggcugagaacauuggacuuuucccuauggucaauguggccucauucaacaaaaaucaagaugagucagaugcauguagaaagagacuccgaaauguguccugccuagauguuugcaaaccgggacucuguguuaugcucacaggccuuugaaugugucucucccugggcuucaugugcccuugcugguuucuggacuguccuguucugcuccuguccuccuacugacagccuuuccugcuuuccuuucccucccaugccacucccacuccauacaaccucuuccccugcacacugcuccuagaaccccuugguuagccccaucagggaugucccugcuuuccugggacccgaggcacacagaaugaggaugaaacaguugacguaucauguaguaucccccaccuggcuuccuucucagccaggcgucccaaacucaauugucugcagaggccaggcaggcaacaaaaauaagugaugugggccuccugggcagucaggagggcuuggugcagaacuggaagcaccagagguagcaaggaaccaggagaucaggccagcaccugcucugaauggucaggcaccuccaugguugcauagcaaaucaguuguugagaaauguuuugacuaugguccuuguguaggcccaguauaaagggggaaauggccagucuguggcugcugauuauggcccugaaagucugcaggcccagaauggccagaccugguuguucaaaggaaaacuggcaggugggaagggcggagggccuugccccuucccauuugccuccugugccugacagugucaccguagcaauacuuuccuggcagcaggacuuugucccauaacaauaguugauuuuaguguguagggcuuuuguuguuguuguuuauuccauacuuggaaccagcugcguugugcuacuaucagagaugacagcccagccuggagcucugcaagguccuccaggcuucucaguucugaucauuccaccagcagaucccaucaccaaagggguguacuugcuucaugcagcugcugcuucucccagaccucauugucccccuugugccuuuuccauguucaauacaggauuuguuuuuuaucugaaauucuacccguuaaaacauuugguauguuuccucuucucuugugagguguauuucuguauuuccuaccuuugcauccuuugcucaguucaacuugaagcagguuuccaagcucaucacuuggaggcccagggcauugccacugccccccaccccaccgccuaccgcccaccugcaggucugugccaggaagcccugcgugcugucugcaccccguuuggcugcuugcccacaaccaugacugcuccugaggggcucgccagcagcacuguuucccagccugcugugcauaaaggugacgcuucggguuuuccacagugaacaaugguucccagagugggcaggacucccuagugucugcaagggugugugaccaugcaggguggaaacaaccuugucaaaauaaaccagggcagugcugaggggggaagugaggcuagcuggggggaaaugugggcugagugcuucuugggggguuuccucuguaccggugcccagcugcccaagggucccagaaggcagaggcugacacacuuccugugacccuuucagacucgccauuggcccccaccagaucaggaaucuguuuucccuuguugaccuugagccacucacagagugggaaagguuugccuauggaacgaaaacaguccuccuuccaugauuuccccuuugcucccauguucauccaugugggcugcuguaacaaaaucccauaaacugggugguuuacaaacaacaaaaauuuauuucucauaguucucaaagcuaaaaguccaagaucaaugcgcugggagauuuggugucuggugagaaccugcuucuugguucagugucuucuuaccgcguccucacauggaggaaggggcgagaaagcuuucuggagccucuuuugucaaggcacuaaucccauucaugaggacucaacacucgugacuggaucgccucccaaagccccuaccuccaaaucccaucaccuugaggguuaggauuucaacuaugaacuuuggggagacaccgacauucagacuguagcagcuccccagcacaauccugcucgaccgaauucaccuuccugaccaggcacgucaacaaucuuucugucccucugaugccagaacguuauguuucugagggugaaacuugagugauuaauugacaguauuccucaggaauccuugcugauugcugaaugcauaaaugagugaaagaccuggauaauccccaacaggcgccugagucucacauccgcccugggugauuccccauggccaggggcccaccucgguucccagggauccaugggcaugaucauugugaugagccacuacucuccaaucuggccucugcaccugugugacauuuuccucccauugcuuuacauguuacucuuucuuauucaguaggaugugcagauuggucaggguguguauuaguuuccuagagcugcuauaacaaaguaccacaaacuagguugcccaaaacaacagaaauguauucucucauaguuguggaagccagaagucugaaaucaaagaguugugagggcuguguucucccugcagaugcccagaaaaauccucccuuucucucucccggccucugcuggaggcuggccauccuuggcgcucuuuggcuugucauugcaucauccaagucucugccuccauccuccuguguccucuccuguguguuuguguccaaauuucccuuuucuuagaauugcaucuucucuaaaccagcaugaccucaucauaacuugauuacaucugcaaagacccaauuuccaaauaaggcacauucacagguucugggaguuaggacuucaacauaacacuucuggggacacaguuaaacccacaacagaguauaaggagaaaauguuacaacuuccuuucucuucuuuuuuuuccuuuucuuuucuuuuuuucucuucuuucuuuuuccuuccucccucccugucucccucccucucugccucccucccucccucccucuuccuuccuuccuuccuuccuuccucccuucuuuuuucuuucuuuuuuugacggaguccugcucuuugcccaggcuggagugcaguggugcaaucucggcuugcugcaaccuccaucucccaggcagguucaaguaauucuccugccuaagccucccgaguagcugggacuacaggcaccuaccaccacaccuuuuuuuuuuuuaguagagacaggauuucacuguguuagacaauccugccucccucccucccucccuuucuuccuuccuuccuucuuuccuuccuuccuucuuucccuccuuccuuccucucuucuccucuccucucuuacccuccccuccccuucugucuccucugcuccccugcccucccuucuccuccuucuccuucuccuuuuucuucuucucuuuguuguccaggcuggaguacaguggaaggaucauggcccacuguagccuagacaucccaggcugaaaugauccucucuccucagccucccaaguaccugggacuacagguauguguucccaugccugacuaguuuuuguauuuuuuguagagacaggauuucaucauguugcccaggcuggucuugaagauaucugcuugccucugccucccaaaguacugggauuacgggugugcgccauugcgccuggccuguugauuucuuuuuuauaaaaugucuuuguuuucaucccuguuauuauaauaauaauauaggcauucauaugcauauguguaaauuauaagugaguucuuauauagauuugggggacuauucuccaacaugacugaugagggcauagucaaaagacaaauuaaucaggccaccagucugauuuaugaagcgucucugucuuugucuauuugggcugcuauaacaaaauaucauagaauaaagggcuuaguuuauuuucuuacugugcuagaggcugggaaguccaaggucaaggugugaacugauucaguuucuggugggggcucuccucuuggcuugcagaugguugccuucuucuguguccuuacaugguuguaggagcagagaggguucucugguguuucuucuuauaaggacacauauccuuucagauuaggacuucacccuuaggaccucguuuaaccuuaccaaccuccauaagguuucuaucuccaauaaagucaccuuagggguugggacuucaacauaugaaugcagaauggaugcuggcaccuuucaguccacagcaggccgcaacuacuguauuucauuguacaauaagauccccuugacucuugugaauuauaaugaacauuagucuguaaagcagguccuuguaauccagccaguuuguauacaguagguaaucaagaacuauggauuuacuggguuuauugggugggggagaagggagggcuuuauucaggugccagcacuucuucaccuuucucuacauuugcucauccuggaggugggguugagcugggucugccuuguccccucacuucccucucugccgagagaguccugagcccacccauuacugguagcaaagcccggggcacaaucuccguuuuccuauuuguaaaauggagcuaacaguaguacccaucucaucagauggcuguagagaugaaaugagauaauguauuuguggcguuaggacaacagugguccugcuacagggagaagccugggccaggagauagacuagucuccagauaccacugaaguagccuuucgaauaccaauuaccugccucacuuugcagcugugcagcccugaacaaguuacuuucccucucugauuuuccagucuuuguuaccuguaaauguaacaaugccuuucucuauguuguugcgaaguccacauaaagugacaugaaauugauuauaaaauacaacacaggcugggcacaguggcucacgccuguaaucccagcacuuugggagguggaggagggcagaucacuugagguugggaguucaagaccaaccugacuaacauggagaaaccccgucucuacuaaaaauacaaaauuagccaggcaugguggcacaugacuguaaucccagcuacucgggaggcugaggcaggagaaucgcuugaaccugggagguggagguugcagugagcggagaucacaccauugcacuccagccugggcaacaagaacaaaacuccaucucaaaaaaaaaaaaaguuacaacacaaagguuggcaacuaucacuaauaaguuugacugggaaaccucacuacuacauuuguauugucuuagaccaagcuugugagauuuuuuuguuauuuguuuuugaagcucaucagcuaucguuaguguuaguguauuuuauguguggcccaagacaauucuucuucuuccaauguggcccagggaagccaaaagauuggacaccccugucuuagacuuuuaaggagcugugacugaaggauggagacugggccagguggggcuuggugcaaguuuaagcucuuaggucauuucuaaauagcaaaccucucaaauagcauccaacagauaugcccuagucuugucgucuuuccccugcuaucuuuuguacauguaccuucugcugacugcaguguguccuggagcccugacuuaguuaaaccucagaacaucccucugcauccggaugcauccaguacucucgguuugucuggcuccugcuguacucccugcaucugcccagcugcugacacagccacauauggcuuccuuugccccagcuuucagcauucugguggcuuguagugcugagugcuagcaaagaaaguggguacucucacacacugcugcugaaagguggagggugaugaacaggaccaacagcucuaaaagacguuucaaggccaggugugguggcucacacccgcaaugccagcacuuugggaggccaaggcaggcagauuacuugaggucaggaguucgaggccaagcagccaacaaggugaaaccccaucucuaccaaaaauacaaaaauuagccagaugugguagugcgcgccuguagucccagcuacucagggggcugaauaaggagaaucacuugaaccugggaggcagagguugcagugagcugagauugcgccacugcacuccagccucagugacagagugagaccuugucucaaauaauaauaauaauaauaauaauaauaauaauaauaauaauaauaaaaagauaagggaaauuugggcaggacuucuccaaguuuagaguauaugcacccuuuggcccagcaaucccacuucucggagucuguacccuagaaauagugagggaaguuucaaaagauauuuauucaacagcauuaguaauguaucagaaccuugaagacagccuagcuggucaacaguacaaugcucaguugccacuauaaagaaugagaugcuguguccuucucagugccucagaucaggaggcaccugguguuggcuugucacauuacuaaugauguuuacuuccaucacuugauuaaggugaugucugccagauuucucuacuguaaaguuucuauuuuuuuuucuguguaaugaauaaguaucuugucaggagaugcuuuggaccuauguaaguaucuuguuucucaucacacuuucaccaaacuaauuuuagcauucguggauaauucuugucugaaacaguuauuacuacagugugugccaaacagugauuuucuacuuccaucauuacuccuacauuugucaauuaaaauguuacuauaaggaagauauuuucuuuuauauugaaaaaaugcaauuuuuuaaaaaucagucuggacucuuggauucucauuauauugguuauaacccaugacuauaauacauuuugugcucagauuuuucuagauuuuacauugggaugcccuucaaguuggguucuauguauuuuugccauuuuacuguuguuuuuugagcacugccuuaccuuuugaccccacaagauauucuaggcucaguguacacuuugccugguccagcccuggaaucagccauugcugcugugcuauccuugacagaacuauaaccugaauuuaacaaggaggaaauaucaggcaaacacaaauggagugacauucuaguuaacaacugaucagcacucuuuaaaaaugaaagacaaagaaugacugaggaaugaguucagauuaaaagagacgaagggacacgcuccaacuguaacugcaacgcaugacugcgggcugcguucugcauuggaaaaaaguguuacugaugaaauuugaauaucgucucuagauugagcaacuaagcaauaauauuguauuaaauugcuagauugggcaauaguauuguacuaaaguuaauuuccugacacaguuaaauaauuguacuguguauauaagaugucaaaauugagaaguugcaaggcuaaauggaauuucucaguuuuuuaaacucuuacuuuguacaucugaaauuauuuuaaaauaaaaacuaaaaaaaaaaaaccuaaauacaaaccaugagauagauuuauauguacuaauaugggaugguguccacaaucaauuggaaaagauaaguuguaguaccauuuguauagaauuggcccauuuuuguaggagcaagacagaacaauauagugcacauacauauuuaucuacacaugggagaaauucugugaaggguauguacuuccuguuaacagacauuucugggaaauguguuuggaagguaugagacaccuuuuacuuuuugaugucuccugauaaugggaaaacaguaagaauguggguuguaugcaugagugugauucuacacguguagguuuagguuugauguacucccauccagcuuauucucuuuugcauuuuccagcacaggcagugcugugcaaugucuugcccaguggacacccaccuaauuuucacuccacaaaccacuguccuacaucugauccuuaacaaaguauguuaguuguagacacaaagguggccuacauuucauacuuguugacaguaaugcuaguugacucaucuuaccuuugucugaggaggcuggaaauuguuuguccucagaaacuuuagggagaaauuuauuacuaagauuguaucauuuuggucuccccagagaaaugaaaaauuagaaauuggccaugugacaaucguugcauuuaccucuuuaaggagcagugauucuuuaaguggugcuugauuuaucuaaacccgauuaauuagugaacggucaucuguuucucccaggaauuuuuaaugaucauuaggcuuuuguaguuacugugaaauuuuguuuacguggauuuauuuuugugcaggauuguauacagggcagaugcuccuuaauuuaagaagggagaugugagaacaaaagugucuucucuugagugagggccuguuaugugcccugacuuguuacaaauaucgacuaauguaaccuucucuaccauguaccuuucuuccaauuuaucaaugaggaaacugaugcaaaaauguauguucccacaggcucugguguguucacugaguuagcuccagaaagaacuguccccuucucaugccuguucccuacuucuuuugcagcuaauucuccgaaaugguuucugucuucagcuuucugggcugccccaucaccuguguugcuucuaaauguuaguuucauugcugccuucuggguuccucugcuucucucugacaugaugucucuacggaugcaucucucaguaaugauuauaaugguggugaugauaauaaaaagagaauacacaaguguuuuuaucaaucccugaccaugcugggcacaaugcuaagcaugugcaggcaugaugucuuuauucugcccacucagcugaugagauugaaggggcucccugcagguuggggccugaaaaacacagccagguccaucuaggaacuagaagcuauggucaggcuuacaugcuuuuuucauaucaguguucauguagauguuuaagcucuugcaguagguuuuugcaagcuagugaacgcugccaaauuaugcucgccacacaauugcagccaccuauucccaggcaguauaaauauauggcugaacuaacauuaauaccuaucacuguuuuaucaagugacauaaucaagauaauuaugaaguauccaaauauuaauuuucauagauuaaaagcagauaaaguauuagaaaucugcuuauaucauuagcagaaacauuuuugggggccacaggguaaggaaaagaggggaaaauauuguccuucaacaaaaguaaucauauucuaguaaguauaauaaaagaaaugacaagcuuuucagaauuuccacgacuaaaaauuguuuuagcugcagcuaaaaaagcaucacauaacaaaauaucucuuguuuaaaauauuugcuacaaaaaaguccuauucuauauguccugcauaagaacaaguaucuuuauauaagaaauguguuuaauagcccucuuucauucuuuuucugaagcccucccuguuaaauugcacccaaaggggaaacauuaauugaacuguaaagcuuuuuuuuuuucugucuaaagacauuaaagacauauaggugguauuaaaugaaccuuuaacuagagcucugugaguuuucaaaauagauuuuauuuuucuuuaccauaggccaacagagauuuugagaaacacauugaaggaucuguuaacacuugauauacccaauaaaagcagugguugugccagugcugaucugucuugaugugaaugugaacaaugggaaccugagcugagcagguaaauaaucauguaguacagucaccgucuucaguguuugagaugacuagcaggguaaaccacgcugugucuaagaugcaguguuaauucuguuugaaguaaaaauaugcaagugugguacuggauauuuuggcacgcaaucuugcgaaauuucucauugaugagauucugacauaggaacuacauuugaguaagaaucauagcucaauacagcaugauuucaggaaagucgacuaagauaaaaguguuucugaggcugaacagcaagaaucuuuugcuaagaguuagaauagauugacaagaaccuaaaaucagaaguugcaauucugcugagauacugcuuuucaguucuccgguggaagcuucauuggacauauuguacaucaagccucuaugugacugauuccugccucuuuaugucuuguuuuagauucuccauggcaguagcuuuaggcaacccaguuuuacugaaugcagcaaugguuucagugaccauuagaguccaauuuuaggaugauacuucuccaaauuguuaaaacucccuggugcuuuucucuuauaaacugcaaaaugucuucauauuucaucccgcuuuucaguuaaugcuagggugacagaaacuggaccucucccaagacaugugacagaguaauacagcagccaacuucuucgccaaauuaaaguuuuacaagauuuaaccugucaucaagaccugggauuuugguggugagucaucuucaaaagccaaguucggucccugguuugccuucuuuuccgcacaagaacaaggguuuugauggcucuggucuccaggaccaucuguggcuuucuauuagcaauaaucgcaccucggugaaaccucauuggcuacgauacugccacugcgcaaagcucauggcuuucuuuaauagcaaauggccucugacuuuuaagaagccauguggcuaccccucagcagacuuaggagaggucuuggcuauuauuuguuguuuuauaaggugucaucauugagcaucuacucuggaugaggcucugugcugggcuugagggguacagggaaguuucacaugucccgucuuguugaaucacacacacuugaucucacuacaacagcagaaaacaaguuaaaguuccccagggguugacacauuugccugccguguuuauugcugcugugauuucugcagcaugguccaaagaaggcaaucagucaacagugaauggguugagauuuugugauuuugguuuaggagucuuaaucucuagaauaaaaucuaaugaaaggguggggcuauguuuuucucuugccuugacuucuuugacucuauuuguaaauuccaaauuuacccaggccucuggcucauucugucuuaaggugcggggaccucuaaaauguagauggcaacaaucuuuagacuauaugugucuugaugguagggcaaucaaauugauuuccucagcauauacgagucauguuuuguaagcaugguggguacuuagucaaugucucaaucagauuugcuucuguuuagcaagauaaucuuuugugggggaguguuauggacugaacuguuuuccuucuuccaaacguauaugaugaaaccuacccccauguacucaguauuaagaaguggaccuuugggagauaauucagguuaaaugagauuaugaggguggggcucucgugaugaaauuagugcccucaaaauaagagaccucagagagcuuacugucucucuucucucucugcuacgugaggacacaaugagaagggagccauccacaaugcaaggagagggcccucaucagaacagaccauacuagcaccuugaucuugcacuuguagucuucagaacuguaagaaaaugaauuuucuauuauuuaagccacccagucuggugcagucuauuauugccuuccaaauggagaaauacaaggaaacuagggccgucuuagcuucacagagagaagauguggagaggaguuaggagguagagacuggaccuugaugguggugauauucaauuagugaaaggcugagaagaggucaaauauacuucuuguggccccaaagaucagaaccaaaauggaaagguagaaacaguaggcaaacagaaagcaacuuaauaaaaggaaaaggaaccugagagaaugcucugucucugacagugguugggaucucaucacuggagauauccacacagggacuguauuacuacugagaggggguggggcugaaaggauccaagcauugcacugugaugcgaccccauaaggucacuuagucuuugggacuugugagcucacagugaaucauuacaaacagaaacgauucccucuuauuuguggagcacauuaaaauuuccaaagcauuuuugugaguacauuagcucccaugauuuauaucaaaacauuagaguugacauucaauacacauuugcugaaugagggggaugcaugaaggagcuauugugguaccuugguuggcagaagaggaauacaugggcagagucauuucuagacuugcuaggaaaggccaagccaggcuuggaccugggucucuacuguacucuuuacucuacucagucuuuuccaagguggaaauaauauuuucucugaggcugauguuuuucuguuuguuuugcauuuugguaaauucaucaacaucaauauccccuuuaaugcucacaaaugcccuuagaaccagcuuuuauuguucucauuuugcaaaugagaaaauggaggcuucaagaguugagugaguuuagcaagguuuucaacucuucuugggcagagcauuaggguugcagacaguugggcacccucuucaaaugaaugugagccaacguuggcccuguugggugugcaaggaguucuugcagaguugauggagacccuguuucgagucacaugaauaauuaaucuagggaaacaguagucaaacagucaacucauucuuucuugcacucuugcugauccucagcaauuucucggcugcuccuccugccagaguccuguuuuguaccuuguaaacaagucacucuaggaguuccuaguccuggcuguauaccauagucaccuaggggcuugcaaaaucuacuaauauccaccccacucccaccguacuccagagauuaagauuuaauugaucuagagagggaucugggcuuugguguuuuaaaaaaucucuuuagaugguugagaaucaccaaauuuuuguugguguggggcagguuugcacauucagguucauggguuauuggaaugaggcaugaaggggccugcuauguucccagggccugcuagcucugugccgauugcuuuugguuuuguagaaaugauuucauuccuucuucccugaagccauccugauuugaggucauagucuaugggggugccauguggauuuauacugcaacucuuguuuuuacuagcucugugaccucagaaaggccacccccccuucccugugccucuguuuccaucuccucuguaacauggggauaauaauacuaguuuccuuauaagucuguugugagcauuaacucuugggauuaugccuguugaauaguuaggguuccacaaauaagucuugcuuaaugguguuguuaucauuguaauagcugcaugugugugaguguauaaauguauguaagauauuuuuccuguuuuuuuuucccccuggcagaguuagccacuucuuccuauguguaagcauaucaucacuuucuauuucuauuauggaauuguaauguguuuuugugucccuaaccugauauauucauuccacaaauguuuauugaacacuugcugaaugcugaggaauggacaagagagacacaaucucugccucuugagccauuugaacuuugaagaggacagaugaugacaagaggaaguggaaauaggcuaggaugcuacggagacuagaacaaaugguccuuauucguaccuugcugugggggagacucuccugacagaguuaguugugucaccugcauucuuucuuucccuuccacauauaguguccugggacuuacugugauuacuuaucucucuaucccucaacaguaaguccuaaucauuggggcuaggaaaugugccuugucaaaugaauuaaugaaugaaucacgcuggaccaaaaugaacaaaaaguuauuuuuuugacucaauuuagcuuaaacaucacauccugagaugcuguguuaaauccuggagucacaaaagaccuuuacagaaaucuuuacagauuucugggaacuauagacacguauaugaggauagguuuggaccauuguagcugcuguaauagcuguuguucuggugagcaguggggacccaaguguuaguaggcccugcaauaaacauguaugggccugagauaaaugggucagugucucucacgaagcucuguuucgucaaggugagggaaugugucuuuuuugcauuuauucccucccaggguuuaggucacugccugacacauggcaggugcacaguggauacacagagaguggccagacagacgacauagcuuuucucuguggauuuauccucaucucuacaagggggguuagccaguauuuugagggucucccucaaugcucacauucuagaauccugugaugggugcugaaacaacgcucccucauuggagcugcuugagaaggucauucauuauuuugcgauaucuucagacucucaucauugcuagaagcugacuaauuaugagaagagaagugaaggccuugaaaugccucucucugcacaucuggccucacugucaaauaaaguacuuauuucugauaagcucuuuggcuucugugaagccgccuggccgugucuggccgugggcggugcugauaaugaaccgaacagagaacacagacuuggcggggaagguggggacccaguggguagaaagaaugggcuuuuuagaccauuucaaaguaacaagaaagcuuugagagugcuuagugaugucugcuaccacauucauuuccucuguuuccauugaaauugaaguucuagauggacugaaccugacuaagaaaagggaauguggacaggaaagcuaaugacaaaugcaacuggcuuauuucuggagugcuuuguacucucagagucuugugcccugaacuuucuucaucuggacucuaggggcacuuaagcaauuagcaugccacaagcugggugcuguggaaagaucauagacuuuagaaacuguccaagaaacuagugggacuccacaccuugugaguuguguauccuugucaaguuuaauuuaccauguugagccucaguuuccucaccuaagagaaagaaaagagaaauagauuuauuuauuuauuuauuuauuuauuuauuuauuuauuauuuauuuauuuuugagacaggguuucacucuguugcccaggcuggaguacaguggugcgaucucagcuaacugcaaccucugguaucuggguucaagcgauucucgugccucagccuccugaguaacugggauugcaggcgugcaccaacacaucaggcuacuuuuuguauuuuuaguagagacugguuuucacuauguugaccaggcuggucuuaaacuccuggccucaugugaucugcccaucucggccucccaaaaugcugggauuacaaguaugagccacugugccugucugagaagugauuguuuaguuagaguaacucuagaugacauaacaaauaaaccucaguauucuaguagcucaaagacaccucuuucuaagucagauaauaguuugaagcugggcgcaguggcucacgucuguaaccccagcacuuugggaggccaaggugguagaucacgaggucaagaaaucgagaccauccuggccaacauggugaaacccugucucuacuaaaaacaccaaaauuaacuggcugugguggcaugcgccuguagauucagcuauucgggaggcugaggcaggagaaucgcuugaaccugggaggcggagguugcagugagccaagaucacgccacugcacuccagccuggugacugagcaagacuuugucucaaaaaaaaaaaaaaaaaaagguuugagaaggguuuuccuggucauuagguggcuuuucuucauucugugaucuagagacccaggucucuuccauguuguuguucugccaucccugggaccuugaaguuacuccaacuggcagcggagaugaaggacaggagagaaggcacaccacuucuuaaacacgucuucuggaaguaggcuacaaucauuucacuugccagggauaaguucuagacgagcuuuagaagggggauggucuuugggaagccaaggugggaggauugcuucaucucaggaguuggagaucagccugggcaacauagcgaaacccugucucuauaaaaaauacaaaaauuagccacgugugguggcacaugccuguggucucagcuacuuaagagacugaauaggaggaucaccagaaucugggagguggagauugcggugaaccaagaucacaccauugcacuccagccugggcaacagaccaagacccugucucaaaaaaaaaaaaagggggcgaggaugguaaccauucucugccauaaauaccuuaguguugcucaagaauaagugagguuggguuugugaaccuacccuugcauaacaugugucaccaacuauggccuuacuuauuuguggauuguuuguagguacacauggccucacaggaccauucgugugguccugaaauuaauguaucccuuuggaaauaugugguagacaucucucuguguuauuaaggauagaucuccaccaugaauggaauggcuaaugcuuacagcuggaucaugauuuacauuaacuccucccuugcugguaucuuauagauugucuuugguuuuguuuucacuacaaaggagacagcacgaauucuccuacaggcucaccacacaacuggugcugugagggagacgaagaugagucaugccuguacugcucuuuaaacacucacaauugaauaagcuacccaggugacacgacaugguuauccuggccagaaagccauggcuuuuccuaaucagagcuucagugcuguggaaacuugaaguuuggagggucugaugucucagucuggaugaggaugaguucccugccauuccuggguuagcagcucccauccucuuagauuccaagaugguggcucaugccuguaaucccagcacuucgggaggccaagguaagaguauggcuugagcccaggaguucaaggcaaaacugggaaacacagcaagacccugucucaaaagaaaaagaaaaguuuccaagaugguguagaacaucagagaggggcucuuggagauuaucuggccaucgucaccccaccugcuuauagauggaaaugcauagacucagagagguugggggacauaugggcagcuauagaaauccaguggaccucaaaucccgacauuucuaaccugaauuaaauucucucacccuuguauggagguccuagaguccuauuuuccaaacuuugccucugaaugucuccaugucaaaggguuucucagugugccagagggcaauggagaauggagcagaaaugaccacagaagaacaggugggaagauuccugcaacagcaaaaauucugcugcccgguuccugagacaugaagaauguguugucuacacaacuacauggccagcugccuccuuaauuuuuucauuuuguuuuguuucugagacagagucuugcucuguagcccaggcuggagugcagugagcucacugcagccucaaccuccuagguucaagugauccucccaccucagccucccaagcagcugggacuauaagugcaugccaccaagcgcuauuuuuuuuuuuuuuuaauuuuuuuagaggcagggaucuugcuauguugccagggcuggucucaaacuccugggcucaaguuauccuccugccucggccucccaaagugcuggaauuauaggcgugagccaucaugcccagcccuccuuaauuuuuuaacaugaauuaauaggaccuggacacacacagccucauuuauaucggcagccaucacagccugccacaugucagaugaggucucuggggcucucacuccuugugucgggggugaugccacauguggcccagcuguaggucacauucagcuccuguguucaccaggaucagauggaaugccagcacaucuuacccuccugcgcccugggaguuuguaauaaucuacgaauacguagauuuauuucagagaacauuuuccgaauccuguugcgcauacgcacaaaaauauuggcugcaguguguuuauaaccaugaaaauuccaaaauagcuucaaucuccugugagaggggagugguggaaggcccuccagcacgugcacagaauucuuucuucagccauguaaacaugaaaauaaggguuaaaaaugacuucauuauggggaaaagggacaggaugcaaauuguucaaauggcaugaugauauuauaaggaaagaaaaagauguuauaaaaggucacauaaagucacccacaggucagcagucaugucaugauuagcugcucugugccagacacaggcuggaaauugguagaugcucuccccaggaagugggcagcagccccuuugugccucugucaccucuguuaggcuccuggaagcccccuucauugcugcauguaaugacaucuucgucaccacauguaacagcuucuuuaccacuauguguaaugccauucugugugcuuauugggcuaaacaaucacagaggaaaagagugcuggagaaaugccagggagauagguaccgaaacguuccagauggaaagucucgucuucagguggccguagcaguaaaugucagggucaaacaggggguguauucuugggagagcuucagcucgucugugaccuaguguccagccagcuuccugggaaggaggcugcauccugacauugaagcccugugugcuaggaugaguguguuacgcagagccuuacaaaugagaaaaucuugcguccucaggacaggcaguuaguguugcugucuggaauacacuggcuaccucccuccuccccccaccacuuaaaauucccugaauccgacagugguagggaaagggcugauccuggagaagauuguuccuugauaauccuaguaugauucauaaugguugcagcagaugagccgcgagguuuguggcucagucugcagcuaaggaaggcucuucccuggggagguguguccagcuucccggaaagaccucagcugucuagcuggucugggcugcccaguucuuagcagugcaucagcaaugagcagccgcugaccaucaggcagcguuucccaccugccagagaacgucagagccacugcgucuggaccagcugaaggcagccacggugcccaggaugcugcugcugccuccaaggaaaagaacucugaaaaugaggaauuacagccuggugguuuuguuuuauguuaauuuuuuacaucugggagauaauggaaaaaauuaaaaauugcuauaauugcaccaaucuuaaaaauuaauaauauaaagacgggaaaguaaccaacacaagcuugaaacccaucccgccccuucuugagauaaucccuguugucaguuugguaauuuaugcaaauguaguggugcacuguuaaacuucucaagaggagaaacaaaaacccugaauuguagguuugucaauuucaauggugaaaucccaccgcagccgauuucaggcaaccaaagcuuuaaaaacgaguucgcaaauuucuugaauauuuaacaaucagcuuuugcaagugcauacaugcucacaacguuugcuuuuuuguacuuuguuuugagggaggcaggaaauggaaacuugcaaugguauugauaagugugccauuuuuauuuacgguaucacggaugucuuccuagaccagcaugugcagauucacuuagcuucucucacuugugggaugggguuuccaugaaggcucacuguguugcuucuggaaaggcagaaucggccccccaggagacaggaauggcagcagcuuggcacucggaggcuagcuccugcaaugcugugcacuugcaguggacaaaaaaguaaacuuugguguuuacuuggaguucacucuagcuuugguuucuucuaaauauguucuuccaaugaccuguagccuaaucaacucugcuggcaacacaucccuuugcucugcucaauuccaguuuccaucagagaaucucauuuuucuuuugggaaauguuuccugauuuucgucuuuuccaccaccccucacugaggcuggguaaaguccuucuccaugauguuuagaacccaggccuccuucuguggcagggcucucuaccccuuaugauuuauugugugaugucucaaccuguuuccuguggagaagcagagaagcucugguaaacagaauggcccucuaaagaugcccaugcccuaaucucugauguuaugccuaugaaugaauauguuacuuuauauggcaaaggggacuuugcagauguaauuaagguuacuaaucaauugacuucuaauagggagaguauccuugguuauccagguggauccaauccaaucacacgggcccuuaaaggcagagguuuucuccgacugugaucaagaaaaugccaugaaagauuguaagugugagaaggaguugaugugccacugcuggcucugaaauguggggcccacuuguaggaacuggagggagagacugguugcuaacgguggccccuagcuaacagccaacagagaaauggggaccgccggccuacagcugcagggaacugaauucagcaacaugaauaaguuuggaagaggauccuuccagaaccuccugauaggagcccaguccgcugucaccuugaauucagcuucaugaaccaggagcagggaaaccagcugagccaacccacauucugaccuaaggagcacugagguaauuauauguguuguuuuaagccacuaaguuuguaguaauuuguuauaguggcuguagaaaauuaauacaggauccuaguguuugggaaugcaggccccaggccccgcuuuuuccagagcguguuugcacuuucgcaggggaccuucaagucccaguaguagcucacuuucaggugucucagcucagcuugcccugcugcuccugaaugagcagguucuaacaucuuccaaacacuucaucucccccaccugccuauagucaccgcuugguggauuuuuaccacugcaaugugggccuuggcuuccuauuucagacccccugggauguuuugguagcuuccuuaggggucuuuucaacuccaggcccucccucugcccaaccauccuucaaacugccuccagaugcaacuuccuggagugcggcuuugcuuccaucgcucccuagcuacagacauccugugggcuuccuguuucuacugaauccagggcacaucccccagccuaggauucacaaucucuacuggggacaggggcauugccucuccaguccgauuccccaggacuugugcuuuuuuuuuuuuuuuuuuuuugagacggagucuagcucuguugcucaggcuggagcacgguggcgcaaucuuggcucacugcaagcuccgccuccuggguucacgccauucuccugccucagccucccgaguagcugggaccacaggcgcccgccaccaugcccgguuaauuuuuuguauuuuuaguagagacaggguuucaccauguuagccaggauggucuugaucuccugacuucgugauccgcccuccucggccucccaaagugcugggauuacaggcgugagcaaccgcgcccggccugucugggccaucuuuauacucaguauaaucaguccccacaaacagaaaugcuguugcagggugagugugcuaaaaauacuccugggauuuuucaaguccuuggagacauccaucuuaaaauagugcaaaaagaaccgaauaaauacucauuuaugugcuauuuuaaugaacaacugcaggcaauaugccuaauauggcagggaggucuucaguguccuuucuccuucauucuugauuagcgucugagcucagauggcaugcaucaguauguuuguggcauuacagaggugcugggagugagggagagugcagggguagggaagcauuacaugccuguaaucccagcuauuugggaugcugaggcaugagaaucgcuugaacucaagagggagagguugcagugagccaagaucaugccacugcaccccagccugggccacagagcgagacucugucccaaaaauaaagaaaagucagcuucugugcuccugcccagaaccacugaaucagaugcugggugucagcucuggacccuguuuggccuuuucuuuccuaugucaacccagcagagcugcaggccuuguguggagguggguuacaaugugcucuccuuauccccaguaaaaccaggacauuuuaagguggggacggggugggaguggaucaauuaacuuggagucuuggcuugaccuuuacccuggauuuauggggcuuagaaauaaagggaaaguugcauucuucucugaggaacugcuuaauucauauccacucucccaaauaaagcugcugguugacugcagcuauuuaauucagugcuauuugcuuucauucuguauagggugaggauagcuucuguuggccagagcuugugcuagaucuccaccugggucaggaaggcauuucccugcgcucacaaaggccuugcacacauaagaugcacugaagaauuccuggcagggccaaaucugguguccgguucacucuuggccuuccaaguucuugcugccucuccuuuguacccaugauaucugauggcagcagcauggaacuugguacaguugaaauagcccaaguucaaauccugacucagauacuaagcucaguaacuuuacguaaguagcauaauuauauggauccucccuucuucaucuauaaaaugauguggugaacugauuacaggaauggcccuaauucuucacucauucccuguaucucauucuggacugacugugucucauaagcuguuaguaaacaugacgcaagcugagauuuuuuuuuuuuuuuuuuuuuuaagacagagucccgcucuguggcccaggcuggagugcaguggccugaucuuggcucacugcaaacuccaccuccuggguucaagcaauucucuugccucagccucccauguaucugggauuacaggagugcaccaccacaccuggcuaauuuuuguuauuuuuaguagagacagaguuucaccauguuggcuaggcugaucucaaacuccugaccucaggugaucugccugccuuggccucccaaagugcuggaauuauaggcaugagccacuguauccggcugcaagcugagcuuugaaauacuguuuccauuuccacuguugaaucucuuuuaucaccaugaaaagagauuucagggcuagucacugguuccgggagaagaaagaaugacacauagaacauaacucaggugcucuaauggucccaguugacaccaaccuagaucaguugacagccagccaacuccuagaccuccaugugagcccagccaagaucaccaaagcuaccuacuugaccacgcagauauauggacacuuagugcuuaugccacugagcucguugugcaccauuguuuugguaauagguacagugggaaacucaguaauaacuauuacuauuacaauaguaauaacuauuggauucaaauccugccagggcauggguugguuagugcuacaugcauugccugauacaucaacuacuuuuggaaugacugaauggucuuauaaggauaaauuauguaacucuuuugcaccugauuucucuauucagaacaucucuaguaggcugcaaucacugccacucacuugaaauucuuuaagaguggaaaugccauuugcuggacauucagagagagagacgugaaguagcuagguuccuaguuuuacgugagaugucgauugaucuacggaguaauuugggucccuggcuccaaggcaagccuguuacauucuucaaggagaaaacagcuugacaucaguaucaguuugagaacacagcaugagugaacaaaaaaaacagcgguccccauauuuugggcauuugcucuacgccaggcacuucuuaucuauucugcguggaggaauugcucuccugauuuuuaaaggggacaaaacagcucagagacaucaaauagaugaucagagagcacacagcuaaggagguaacagcucaaacuucuagauccagagcuaccucacagcaaaggacagccucuuacaccccaccaccgucugcagagcccacagcaggcauccaggugaagcuccucaguuuaucaaugaaggaauugcaccugugaauggaaguggccugccgaaggcuacacggcagugaguguaaccagauuaccugauaccccuuccagggcccuuggugugacuuauugagaucucaugggccagugggugucacugaaauuccuggauaaaaguugcuuguggagggcugucauaguggcucaugccuguaaucccagcauuucggggagcaauuugggaggccaaggcagguggaugguuugagcccaggaauuccagaucagccugggcaacauggugagacccuguuucuacaaaaaaaauaacggaaauuagccuaguuugguggugcaugccuguagucccagcugcucaggaggcuaaggugggaggaucaccugagcccaggaagguccaggcugcagcaagccaugauugugucacugcacuccagccugggugacagaguaagacccugucucaaaaaaaaaaaguuucccauggagacauuaucaguuucuaggccuccacgugagcaccuuaaaagaagcacuaugguuuaacaacaacaacaaaagacacaccagggaacaccugagcugcuccuaugcgccugugcugucuucagggaagcaagucagcaucaugaggaggaugccuuuugggaagaggccugagggcuggcuagcugcaggugugccaucucuaaucaauucauucauucauucauuuauuuuuauagagguggggucucgcuauguugaccaggcugaucuuaaacuccuggccucaagugaucccaucuuggccucucaaaguguugggauuacaggcgugagccacugugcccagccccagacaugccauuucuagacaacaccuccaaggaucugaggagagaagccccucaugcuggcugccccggcaucuaccuauccuucguucugccugccagcucagagggugggagcggugccagggagcuguuugggcuggcgcaggccaggcaggagcccuacuuggcuagcagccccaggcaccugccacacuuguguauuugcucagcgguucgggguacggaagcaggaugccuuccgucauugcacccuggguguucggggccucgggggccagcugcugggcuggcagcuucucugaggagcuguuucuugcccucuuuguaccccugucucucaacuaccugucaggcagguaauaaucccaccaucaccugauguacccagaggagaaggcaggaggccugcgcaaugugcacagaacaaacacuggcaaggugccugagagcccugcaccaggcaccuucagcccucaggggagagagucuccuguccagcucaccccaggcacccuucuccaaaugcccagucuugcaccauucccagaccauuugggccacaucugaaagaauuugccauacugccugccuuugauuagauguuagggaagauuuaaauucgugcagaaucucaauacagcucccuuccuguuggaaccaugugacagacuauuuccaaggcuguuucuuacaagaggaucugccuuacuaagucagagcauugcaauaauuaacguuuugaaagcucccugauuuccaaagcauuuucacauacauuagcucacuuaaggucucccaaacccugugaauggagcauucuuuuuagccccauuuuacaggugaggcaacugaggccaagagagcuugaguagcucccccaguggcuuaauguagaauaaguaucagagcagagacuggagcccagaucuuccuuaugagaauccagccuccuuuuuuuuuuuuucuuuugagacagacucuugcucuguuguccaggccggagugcaauguugugaucucagcucacugcaaccuccgccuccaggguucaagugauucuccugccagaguagcugggauuacaggugugcacuaccacacccagcuaauuuuugcaauuuuaguagagaugagguuucaccauguuggccaggcuggucucaaacuccugaccucaagugauccaucugccucagccucccaaagugcugggauuacaggcgugagccaccgcacccagucccagccuucuuucugauucacucuuguuuuguaguuguggacauuuaagaagacuuuuuauuuuuuuauuuguauuuuuuuuuuuauucaaagggcuugugcucaaauaaagugagaguagggagagagaaauucauguuucucugcucuguuuuuuguuugggcucucauuuaaucucucugacaaccuuuugcagcagguguuauucucauccauauuuacaccugaggaagcugaggcucacagaggagaaauaucuuuccccaagccccacgucgagcaguggguagaaaaugagcccagaucccucugucuccaucucugcaaccugucucucugcaugccacauuggcuuacgaccgagaucagcugcaccagggcaggcuggagggugaggaggcuggcuagaccccugggaaggcaggcagcacccagagcuguuccagcucugcugauccuguucgagaggccagaaaaguucaaauauuggccuucuccuuauagucucccaccuacccucccucuggaagcacagaacuguagugugcaaagaaagaccuuguggauccucugcucuugcccucucauuuaccaaaugagaagacgcucucuggggaacgugaccggccucauuccauagaagagauggaagagucuggagcagaaucugggacccugacucccaggccugugcacugaggcguucuugucugccaccucccagccccucucuuugccuuccucgaucuucuugaguucucuaaugggucaucuguugugaccguugauuacaagacaccaugcaugguuccccugcuuccauuuauguguggaucucccucuguucuuacauaagaaucucagagaugggucagguugugaccuucucuuuggugcuggcuugaaguugaggaaaaagccaggcuccgagucccuuggaucugggucccaacccugccuguguggcucugaagucaagugacuccuccucccccuguuguauuccccggcagcacuaacaguggcuccccuuagcuggacaccuagagugccaggcucugugcucaggacuucacuguuugaggucccuggagaguggaaccucucacccacaagguggugauucccuugggagugggcagcaugcagucagaagggaacuuggguggggacaggcauccuauauccuggguuuacccacuccuacccaugcacugaugggcuugacugccuggccaacacuuacugagcauauagugaaugacgggcacugaggcucaggggaugaagccauaggcuuugagucccagagucagugauggaaucaccagggagcccaggcaucgugucuaugcucugugccaugugacaagucucugccuucucuucauccugaagagacccuggguucuugccucccugggcuguggcaccaugcaagguggccaagguaggggcccugguguucuggcccccagcuagguucucagcacuacugagugcuggcucauggugaguguucagccacuguuggaugaauggagaaaugacucaaugaauuucccagaaugcacagaugcugcaccuaaucccuuggaguuuaaccagcacaagaguuugcacuuugcuggccaucuccugccaaggcacagccuucccugagccuguuucccuuguauguggcucauaccugaggcccccagcuggcauuugguccccuccugcaggcguaggcugcccagugccaagugcaccuugcaucucuccccaguccucccacugcugucucccgcuuccugcccuccgucccgccacgggcucccgccaaaccagcccacacggccuccuuuuguucagccaccucgguuucaggccaaccaguccagccaggucccccagccugcauugcacacuccuuugaagccuugacaggcagccaaccaagcuggcccgagcgcgcaaggcagggugcuggugccggcgcgcuggcagcugcuucccgccuuucuggcuccugggaccuggcugcucccaggcccauucacauggggacagaaaugccuggacguucuccucggcuggcauggguauugcguccagggccacaggcuggggcuguucccacagcccagaguccuuucccaggcucccuguucuccauagugaagcccucugguuugucccaggcagugcaucccacagccucugucuccacaaaggagaacuggcagcaggaauagccuggcuggguucugagcucucugaggagaggcaggacugggcaaaggguaggagcacuggcuuuggcuucagaugagugucgagcgccucacucugccaucucuagcuagggaccuaucugcuucaugccucaguuuucucuucuguaaguggggagcauagagcacccaguucaccggcacagugaagggugaugaauacuguagguuagcacauugcaagcuaagucuucaacaggaguuguggggagcacuguuaauaugugggggaucaucauucuaguagcugaggagcaucggagccuaaaagacucgugugaaagaggggucuccuguuccuauuuuuaaauuuuuaaauguuauuuuuuauuauuuuggggacagggucuugcucugucacccaggcuggaaugcagugaugugaccucagcucacugcagccuugaccuccugggcucaagcaauccucccaccucagccucccaaguaguugggacuacaggcacauaccacugcaccuggcuaauuuuuuuauuuuuuauagagauggggucuuacuauguugcccaggcuggccucaaacuccuggacucagguaauccucccaccuuagccucccaagcagcucuugggacuacagcaccaccaccauggcuggcuaauuuuuuauuugauuuuauuuuuuguagagugcaguggcucuaucacugcuuacugcagccuuggcuucccaagcucaagcaauccuccuaccucagccuuccaaguagcugggaccacaggugcacaccaccacccucaguuaauuuuuugacuuuuuuuuugcaggaaacgaggucucacuauguugcccaggcuggucucgaacuccugggcucaagcaaccugccuaccucauccucccaaugugcugggauuacaggugugagccauugugccuggccuccuauuuucuaaauuucaaaaguaguacaugcugacugcacaauuuaagaaauuuagauaagugaaagaaaacuuaaaaaauacuuguugcggucgggugcgguggcucacgccuguaaucccagcacuuugggaggccgaggcagguggaucaugagguuaggaguucaaggccagccugaccaacauggugaaacaccgucuuuacuaaaaauacaaaaauuagcugagcgugguggcgcuaaccuuagucccagcuacucgggaggcugaggcaggagaaucacuugaacccaggagguggagguugcagugagccgagaucgcgccacugcacuccagccugggcaacagagggagacucugucucaaaaacaaacaaacaaaaaaacacuuguugcugggugcuguggcuugcgccucuaaucccagcauuuugggagguugagaugggaggauugcuugagcccagcagcuugagaccagccugagcaacagagugacaucuugucuuuauaaaaauuuuuuuuaaaaaauuagcuggacaugguggugggcaccugcaguuucagcuacuugguggcugaagaggaaggaucacuugagccugggaguuagaggcugcggugaguugugacugugucagugcacuccagcuugggugacagaaugagaugccaucuuaagaaaaagaaaaauuaaaaaaaccuuuuuauccuaccaacguauauacucaugugugcacauguacauauguaugcauaccccuacacacacuagaauugcuaguuuauuaccauguguaauaauaguuuauauggacauaacagugcaugccuauuauauuauguacauauguaaugcauuuuauauacuuuucauauauauuucauuucauauuaaauucuugcauauacauauauuugaaaaaguaaagaauagguuccucugguuuuguaaccagcuuuugucauuuaauguaaguugaauuuuuuuucuguuagggaauuuuucugcaggaaaauauuuuaaggccaccugguauguuauaauacaaacauguuauauccauuugacaguugaggagcuggaagugcugagaugcaacauaaguuccccaaaauuaugcuacuugaggcacagcugacauccagaagcuucucugggaaggcuuuuggaguuccccaaggcagagucaacaagaacauaaguuucuuaagaacagggacugugugccucacuuacugucaucuccccagcaucugccacaaaguggacauucuguuaauaguuacugagugaauagacacaggaaguucagucuucuuuuuuaucucauuucuugcucaaagcucaucucagcauugaacgugucuuuccacauggccuccucacuagcuucuguaccccucaaguccaggaccaugucagauugucuuugaaucccucagccccagucccaggccugcccuagagcagguguucaguaaaugacuaucgaauuguggaaacagggaucucuccauccuggauucaagacagcgcccucccuaugaagcuuuucugagcucuuucacaccaaaguucucccaaccaucguguugacagcuaucugccugcugcccucaguccaggagcaacuuggacaucagcucugccugucacacuggggucggcgcaccuggccuguuccaggacagaucacaaggcugaggguuaaguaacaccuggagugguuaggaggcugggcaccuccuugugaaucucccgggcugcguggcggguggcggguggcuggcaggggagggacccuuggcacugcuguggcuuuguauuugcugccagcggggccuuugaugccccaggggcugcucgcccagccaagggcauuguagaacacaaaagcugcagaaagcagcacaaauaaagugaaagcgacccaggaaacugccagggagcuuaucagccuguuuccugaucauagguaugggguguagggaggcacggggagcauuucugggcccggugauugccugcacguugccagggccccugguauugcguacaaagcauuaaccuggaagcuaagcaaggcucuucaccuuguaaaacugacuggaugaguccaaacucuuagaguuuuugugaggauuagacaggucgauaaguuaaagugccuacucugugugugugcaucugauaaugauaacagugacaguaguaauaacgguagcagcuaauacuuucugagcauuucauauaugccaaacacuguuuuaacugauuuuuauauuaauucauuuaaucuucauaaugacacuaagagguagguaguacuguuaucuucauuuuauaaaugagaaaaucgaagcucagagauguuaaguaacuuucuuaagaucucacagcacaugagaagacaauccggcguuugaacccggggcucugguugugaaacacugguccaccuugcuccccauuucuucccccuagccuuuggaauauuguguuccccuaauuauuaugauaggacaaccaugucgugaugaugaugaugacgacgaugacagcgauggcgguggugaaagaggaagacaucccuucauuucauguagcaaucugcuucuugcugggauuucaaauccauuuucauuguugauccugagaacaagccuuggaggcggaaucauuuugaaaucccaggaaaccgggccuuaagagacggcugaagacccgagcagucauucgguggagucugugaggcccagagcugaggaggaggacauggguguagaaacggucgcagcccacacugcugugccuacagcucuggauccugacugugugagugggcccagggcugcuggaaccuguggagcuauagcaagaagggugaggagguugccccacuccugcuuccuucaugaacuucguuguucccucaggacaggaaacuuaggcuguuccguugaccucuccagacagcuuaguggugaucucaagccuucuuaugagaugguggaucacagcuaccauucauugaguuaagaccuucauuuauuucauuucaucucaucaguagcccugggauaugcauauuauauuuccaucaugguguaccauaauugcgucaguuaauuuuugccacggcaaugccaaguaacaaacugcagaaucucaguggcuuucaauauuaagcauuuauuaucuacauaucuggggagauuggccaagcagcccugcugaucuuggcuggacugccuccaugucuaggguguggcugccugguggcugaugugauuuugcuggaguggcuggggugucuccacucugcccucugugucuuucgucuccuucugaaaccagcagacuagcugggggaaugucguucuuauggugaaaagcacagagcaagacaagaccacuccuaggugaguaagcccuuuccaagcuucugcuggccucucuuuugcuagcacuccauuggcugaggcgagugaccucaccacacugagugucggagugggaaggcacugcagaggugcaugguggagggugagggugcagguagggugaagagucacccuucagguaagggugcagguagggugaagaccuguuugcacuugaucacaggugaugucaucucaacugucccucaggcuucucugagcuuugcugucguccuuacuuaaaacuauuugcauuguuagaaagaagaagagacuagcaggcaccuagcagugacugaauacccaacaauccacuuaaggagaugaaugguaugauucuccgaggcucugugggaccacggggcuuuaucaagguugccuaacagagcaguggcucagccagcauugaaaugucaccugccugguucccaugugugugugcauguguguguguauguaugugugugugugaacccaaaccugugcccaagucagacuuaugugacucuugcagccaguucucccucacaguguugcuuggaaggaaacuggaaggaaaagaagcuuuaggagagagaaauugugaccuccuuuccgcagguugcuaucgccacaggcuuuccacaagcuucucccugggcggccaccccagaggcuagaacauagcagaggauuuuucguaaaaucuuuggagucuucagaagaaggucuuuugagauaggucauggagaaaugaggccuuugagccauaaauuggccauagugugcaggcuggggccucaccaguucagcgaaaucuccagccuugagaacugaaacugacuuggggcucugauuuuaacaauggccuugaaguaaggcauuccuccuuguguaguuggagcugcuuccccuccuccuuuguuccccuucaccauggcauagccccagggagucccgaugccaaauucagucuuuggccuguauccugaagucaauucccuuaggaauacuuuucuucacuugccugccugaggccccucuccacacuuuugcuugcuuucccauguuaagaagacguauuugaaagugauuccuggguggccagagucagaaggcugggcaaccaucugccuugccggccaccuccccagcccugccgagcugugagcuuacaggugguaccaucugcacuucugcaccuuuuuuuuuuuuuuuggcccugaccuuuggccuaauaaaagcaaagugcagagcuuugaaugagggagauagaaacaagauguucucuaccucccccacccccucuuuucucuccuccuucuccuccuccucuucuuccucuuuccuucucuacacuuagucugugccaaacauaaauccagggauguauuuauuuuucccagugaacuaaagguuuauaaggaggaugcccuuuucucugcaaggacugguauucucuucccuuggaaaacuccuguucauccuucuggaucugggggaagaaacccauuucccucaagacuguucucaccaccuggguggaguugcugacuuuccauuuuggaacauuacacuuccagggcuucgcucugguccagaauacacuuacugugcuguucuagcucaucucuuggugugcgugucaacugaaccauuugaaggggaugacuguggcuccuuuacuuaucucuguguccucugugcccacuacagggucaaacacagcauggaagcuaaacauacaugugcaaaauggacaaauguagguacaagcaggggcacccuuaguucagaagggagcuugggcuccagaucacuuagcucuaacuuggaagcuggaacaccuggcucuguuacacagacaagaccugugucuccauauauacaauuuauuccucacacuuggcaaaugugugccgaagcugaaagagcucaaccuuagaguuugacagguucagguuugaaucccugcucugccuuuucccaagcaggggacuuugaguaaaugacuucacugcugccuuugccacaguuuccccaucuguaaaauaaacauagaaacacuugcuuugccugauuuguugaaaagaauagagaugauguuugcaaaguccuggcaugagcaguagcuauuauggcuauuuuauuuacccugaaaagcaacuguucauaguaucacaaggcaggcagggguagggggcaauaaaagcauuuguggcaaggauccaguuauuugcaggcuucucuucugucuggcuuuguuuacugucaugcaggaaaagugccuucaccagggcacagcaguaaaccuguuggcuacucuaguccugccuggguucccaggaaauuggcaugagaggagcugccugcugcuugugggccugcuauuuaggcugcaauagcugugggaacacacaggguuaggaaaacaaacacaugacucauuggggacuuccgaccucaagccaaugaggugcugacuccuugcaauuucuaaggguucccaguacauauguauaugucugcucagccuuccuuggaccugagcccaucugucucugcucucacacuuuguggggggccaagggauggaaugcuuguguuccuacccuucaucccuccuucugcguuuauugagccuugcuaggugcugggaaugugaugacgaguaagacagugcaggguacagacaagucaacacauguggucugcuggacagcagccccccaagaugaccauaaucccugggaccuucgacuguuaucucacauggcaaaaaggacuuugcagaugugauuaaauuaaggaucuugagaugggaagagugcugaauuacucagguggacccaaagcaaucacaaauaguuacuuauuagugguuccuuauuagagggaggcagagggagacugaauacccuagaggaggagauaugaccauggaagcagagauuguagugaugcagccaggagccaagaaaugcuggcagccucuagaaguggaagacaagaaacugauuuuccuuuggagcuccagaaggacccagcccugcugaugccuugcuuuuaguuccuuaugacuuaguucagccucugaccuccagaaggguaagaggauaaauuuguguuguuauuagcugccaaguuugcgaugauuuguuacagcagcgagaggaacuaauacaauguguccuugcaguauucuaaguguuaacaccacuucccuagugaugaaggagacugaauggcucagugguuccgagguagaucccuggagucccagugcuuugguucaaguucacguucaccuuuuguuaguuaaggggccuuuugccauguuacuucucaaagccccagguuugucugucaucugauguaacaucaugauguaaaauaaggguaauagugauuuccaucucaugcaugguggugaggauugagcugugaaaugcacuugaagauggcugucuggagcacaguauguaccccagcaccuuccucccgugccuuaccucuuguaccucgucaucgacaggaaggcacuggaugcuggagaaccucuccacagggaugucacaaugcagggcaaugucugcagagguguucugggcugaggcuucuggauaggauugauaggacauuuaguaguuagcagugggaggaggcaggggugcccgagacccagcgcuucuggggggcugggcacugugcugggcccucaguaguuuaguggcuauucugaaacagucacucacuccugauccucccgucacugcaguucacaggcagccuuaguuuuaccucuguaagcuacucaugagcauacaucauucuuuuauuuaguaaaugggaaucuugccccugucauguaccugucaggcauugcaggagugaguggaagcugcugcaggguuaccgcaccuggguuuugccagaaagguaauagaaggcugucaaagcagcuccuggaggacaguugagcaagugacuguuagagaaaccugaggcuucguuagggccaggacuuggcugcagggugcuguuccauuccugccugccucugcugcauugaggaugcagccuccaggcccaccauggguuugggcuccuucccugggacauuugggaugauuuugaugcauaacuugcuguugagauucucaccaaauagcugccugggccccucuccuccugaccagucagccaccgccacugccacugccagagguccacagauggaagcucccccaggcagugggaagaggcaggggugcccgagacccagcacuucuggggaaguugggcacugugcuggggccuuaggcccugcagucaccacuccucugaggggcaggagccacuggguccauuuuacagucuccucaccugucuuucaguuggugaugggacauacgcccauuuguuuucauuuugcauguauguucagaggggaguaaucauuaucacugcuuccaauucuauaauuuauguguuuaauggauuuuucagguguggguuugggggagcuugcuuugauucgcuauagagaauguucuuuuccccaccuggaaaugcaguugucauuguuauuguguuguugcacuuuguuugcauuccugaggccgugucggcaacaggcuuggaaagggaagugggggacagccuugaagcaucuggccuguaaguacaguccauuuggagggaggaucucaaugcauuuuuuagcauaaauacacgcuaggcuagcugugcccacagacagaggagguacccaacccucccacguucucugcccuugcugagaagccuggguucugaaccccaggccuccgugggacacagagcuucucaggagcacacgaagcucagucucugccccugccuuccagguaaacacaaaugcugcucgcguugguggcuuagagcccagcagcacauuuaguucagugccuuuccugggcuuggugggcaggugagggugcaaagucacccuugaugaagaaccacugguguagacuagugguucccaacauuugcuauaccagaaaucccuuuuacugguucuccuucccugugagggaguuuaucaaccaaauaaacuucauuguuaaguauuuauuccucuacuuucuuaucuaaaaauaucugccagugggaguuccugaucugggucaccaggcugaguugauauaauucuggccaguaucgaacaaagaagcuugauauuuuaggugacaaccguggucuuauuggaaaggaaggugaaauuucugguagacuucuugacccuucgaaaaauagacugaggacccccguggaggaguccugagauuggaaucgcugguauaaacuuuuauuuugcuguuuggaauuaagaauuuggaucaaauguugauggaagguuucuuugagcuccacauuucccugggagccuccauccugucuuguccccuuuuagcaugagcagugucauuauucagcauguauuuagucagugaucgccacaugccuggcacuucccugggugugagguugccgcggugaacagcagaugcagacaugguacuaauggggucuguagccaagugagggaggcuaagaaagaaagaaugucauuuccagcagugauaaguccuaagagggaggugcggcacgugaaugggcuugagggugcuggccucuggaguaacaagccucuguaaauaaucaagucacccauaucccagcccugcccugaagcacagucuucacuuggccuguuuaggaucauuucacagauucauugacagggcccaguuccugcuaguugacuccuuggggacggaauccucuauugcuugcaaaaauaugcucugcaguaggcugugucuugcuaauugagagggauucugagaaguggagcagcccugccucacuagauucaguaagaggaggccuuauagguacguugaaucuggccugguggacaaagcacccugcugagagcugggcaggucuucggaaggagauuuaauguucuucaguaggaaacaugguaauuccucucucccucuccagaugucugcaaccaagucauuauaacacagaagggaccuugcagccauugugucuuugugcucagguacugucugagggagggaagggaggcagaaggaaggggagggacggaucagcuccauuugcugagccaaccuacucagcaccaggugccccuccucuuggccacuggaaggcuuucuuucuucuggccacaaucaaacaccguuucuucuuucugccuugguucccugugagucaaugacuguugccgugggaaauaguagcugcuuggcaggggaguucaugaagguugcagagcaccugcucagguucuugccucgccucccuucccccuuuccucccuccucccaccuuuccuuaccuggcagcuaccuaauucuucucuuucaaaauacaguucagagaacaauccacaccagcugguuggggaaucauccaaagagacaauuucuacccugugcccaccucuccucuaguuaacaccuuucaguguucccucccuuccuguuguccuuaaguuaaugcccuaaagucauggcccuugcucagccucuaaggcccuggugggugcugcuuccccuuguagcuggguggguuucaggaaaugccccaucuggucaugagagauaggcagccauaccucaggggagaugguggcuggggagacagucuagccacaaagagcaaaaaagauagggaugagauggcucagagggagucuugguaaggacuuuggcucuuucucuguugagaugggaccaucggaaacuuuuuggcagguucugauuugcauuuuaaugagauccuucuggcugcuguguugaaaguggacuggaaguggcaaagauggaaagacagaccaaucaggaggcuauugugguaauccaggguauugcaguaauccuggccugguggaagcagaggagauugugagacaugaucagauucagaauauaucucaaagguaggauuugcugguggauuggcuauggggugccguaagaaauaugaucccgauuguugauuauccugugcaacuacagaaugaaguuuccauuuauugauaugggccaauccucagggugagcaggagugccuauuuguuuuuuuguggauagagguggaauuguuauguuagagauguuggucagacauccaaguggagacaguaaggaggcagcugcauguacagauccagaguguccacuuggccaggccaugguacucagacaugugaucaaauaccaguugagaugucacauggaguacguuuugaaugagguuaacauuuaaaucaguagacuuugaggaaaggacauuacccuccacaaugugaaugggccucauccaauaguugaaggcuuuaagaguaaaaagacugaggaaaugggaagugggaauucugaccccacauugccuuuggacucaagccgcaguaucagcucuuccuaggggcuccagcuugcuggccugcccugcagaguuuggacuugccagcccccauaaucacacgagccaacuccuuaaaaucucucucuuucugucucucucuucaacauacacacauccuacugauucuguuuuucuggaaaauccuaacacauggaagaaagggauaaauuuggauauccaaaauuuaugcaaaaauggauauucugauuuguauuugggacuuaaguuauuuaagccuuaaauaugagcgugaucaucaagagacaauugugggcagagaggagccaguccauggggccgcacagcacagauuaagagauucagaaauuauguguguauguuuguguguguuauauguguuugggugugagugcuuguguguguguauguguuuuugugcuuuugugugugugugcuuguguuugagugcuucuguguguuguuugugcuuguguguuuguguauguacauuugugcuuguguauuuguauguguauuguuuacgugcauguguuuguguguauauguuugugcaugugugcauaugugugugugcuuguauauguguguguuuucugcuuggguguguuugugugcauauguuugugugugcuuguguguguuuaugcuuuuguguuucugugugcuuugugcucguguguguugagugccuguguguuuguguguuuugugcuuguguguauuugugcauauguuugugugugcuugugugugauuguguguauauguuugugcaugugugugcauguguguuucugcuuguauguguguuucugcauguguuuguguuuugugcuuguguucguguguuugcauguguguuugugugugugcauguguguguguuguuuguguguguguuugugcaugugugugcaucuguguguuuaugcuuguauguuuguguugugcucauguuugugcaugugugugcaucuguguuuaugcuuguauguguugugcucauguguuguuuguguuugugugcauauguguauguguguguuugugugcauguguguuugugcucguguguuugugugcauguguauguguuuggcguguauauguguuuggugugugugccuggugcguauguguuugguauguguguguguguguaugcauguguguuguguacgugugugugcuuggugaauguauguguguauuuuguguguguguuuguguguguuugcguguguguacauguguuugguguguguguguguguugugugcauguguggugaauguguguguauuuugugagugcguguuguucguguguguuuguguguguguuguucgugugugcauguguuuaguauguguguguuuguauugguugcugagcacuugcuaugugucaagcauccccuauuacuagaugcagccucuccuuaaaacaguuuggaugucaucauggagagccaucuaucuccuuacuuuuucuggaaguuugggaagggauucucaugggccaccuauguauuugacugaugcuuugcaguuccuguaucacagucccuccaguguucugggcagcagacuggcauccagccauuccuucuccugugucagaaauugauuauucuggcaucuuccuuccaugccauuuucaguuccccuaaccuccagucucuugaagccauuuagcaucucuugguacugaguaaucccguuuauuaaagcaugugaagcuuccuuaauggcaaguguugguacaaauaguuuugcagccccaagggacagggucauuugaacucggugacuggaaaaaugguuggugugaauaaugugaagugcaggaccauggugaugaauuuccuucacccucuuuguuccuuguuuucuuuguaaggcagaauguuuaacccauauuuuccaagaacuguguagguggguugcuggggacaauugauuuuuagagaaguauuauuucucuggauguagaaaccaagaagcaaagaauaauauugagcaagaguccuccugaugaccaggccugggcuaauuauggcgauaguguugcaauguguuuggaccaucauacaguauaagaacaccacuuccccccaagaugugcaggacacaggauacuccccagggccuugcucuagccccaugucacccaaugucaaguggaucagcuacuuucuaagacuguaauugguccugaagaagaaggaguggagccuggcaggaggaagggacacaggucuuugugugaggaauacuaacugguaaugguaguucugguacugcccuggcuugcugugugagccuucucaccuguaugagcagugggaucaccaucuaugaggagauuggacuaggugguuuauuuuauuuuauuuuauuuuauuuuauuuuauuuuauuuuauuuuaagagagaucuugcucugucacccaggcuggagugcaguggcacaaucuuggcucacugcaaccucugccuccuggguucaggcaauucucaugccucagccucccaaguagcugggauuacaggcuugcaccaccacaccuggcuaauuuuuguauuuuuaguagagacaggguuucaccauguuggccaggcuggucucgaacuccuggccucaggugauccgccugccucagccucccaaagugcuaggaucacaggcgugagccacugugcucagccuuggacuaggugcuuucuaaggaguggggaugggucaaugggagggugccuucccuaaauaaaggggccagcccuccauuagcauccacuuaauguuguauugugggagggugcauucagugcugccaaauuaauuuuuggacuuugaauauaaugaaaauuucugaauuuuggauguaggcaauaacuucaaaaauauuugaaacacccuguggguuagaucuguagcuggauaaagcccccuaggacuucacguugcaacucagcauuccugaauugcucuccauggcuucucacaggcugggggucaggaggugagggaagcucuuuugauuuguuuuguuuugaaaucaguguaaguaucuucaaggaacuaagagaacaaaaucagacuggaagcugggucacaagaugcuguugccuagagacuuagacagagggcauggcauucgcucgcucauagaaggagauggccuacggcaggagccucagcagcccaucccccugggauugaucccuguguccuccaccugcugucucuggcucuguggacuccauggcauucagagcugggggaaaucaaguauuucaacaucuuaauuuuuucagucgauaauuauauuuuggagaucuuuguguguccguauguguguguacacauacauuauuuuuuaacugcuauauaguauuauuuucccaaacuauuuccuacacacacacacacacacacacacacacacauacacaaggaggccaaacaucuugucuuuuuuuuuuuuuuuuuuuuaaagacagggucuugcucugucauccaggcuggagugcaguggugcaaucacggcagccuugaccuccugagcucaagugguccuccugccucagccucccaaguagcugggacuacagacaugcaccaucacacccgguuaauuuuuuuauuauuauuuauuuauuuuuuuuuuuuuuuguagagaaggggucucacuauguugcucaggcuggugucaaccuccuggucucaagugauccugcugcccaggcucccaaaguguugagacuacagguaugagucaccgcaccuagccccaaacaucuuauuggacaagccuuucuuggccacucuaugcagacagcacccaccucgcaccuccaucuccccuuuuuuuuucuaucuuaauugaucaccauagcaccuaucaucaucugacccagcauauaguuacuuguuuauuuguuuguugacagucugacacccccaaccccucaugaaccccaggaaugcagagacuucuguuaauuuuauuaagugcuuuauucccuggaaaaugguaagugccuacuaaauauuuguuaaaugcauaagucucuauuuuggagaugaccuccacacccagccucaggcacagagauguaaaguaacuuacucaaaaucacccagcuacugacaggcaaaucugggcccagagcccaugcucuaaucuaaaucauuacuaccucccugcugguaacaaacaaaaccucagcacagugccugcaacacaguaaggacucaguaaauguuaaauaaagguaauaaugcuuauaacaaccaucuuugcccccagaaagauccuuaccuugaggagauagcaaggauuugagauguucaauauaaaauaccaaguauggugccugugcauaguuggccaucaaugagugguggcuauuuacuauuauacuuguuauuuuauuauacuuuagcacauuguguuguacuuaaauaccacuuguuugcccuacuuaucuuugucccuccugagggugcggagugagccuuauucauuccagcauuccuacaaucuuguacauccauacaauucuugauauguaguugacauacacuacuguaagguacaugaaugaguaaguagauaaaggaaugaacaaauggaccagugguuuguuggggccacucuggccagugguuuggggacaugcuuccuggagucuuauccccucuugucagauucagguuuaggacaacgguacaguuguuccauuguucccagauaacauauccuaucuuaacgucuuugcuggggcagcccuuggacacacccugagcuccugcccuaucacuggccccacuuguaccccuugugggcaggcaccacggcagccugcucugaagggagcuuucauguggccgaccaacucuacuccuugacuccucccuucucucauugaaaaaaaauguuuaaggggacauuucucucuccuaaacuuuuuauguuccauugaagaccuggaaaacauguuaaauaaaaaugcuuugccacagcugaccuaugucuucuggcuuguaccccacaacaucuuaucuaauggguaagucaguucuuaucuuuauuucacuacugaagaaacugaugcauaaguguuauaugcuuuuuaaguuacguaguauuagugaaagagccuagggccagaaccagcugucugcacgcaacccaaugcuuuuuccacaagaguuacccacauggcuguauuuguugguauuuucuacccuuaccugcuuccagaagacuuuggaaggguguguuacaaaagcagugauccagggcaacuuucaagucuguuagcuccuugugacaaccgagcugcccuguaaggcguaaugaggagcggcuucauaaugagcugaaguaguucugcagaugacacugcucaaggauggggaugcuuuccucucugccauguuuuccuuuccuguuggauuugacucuuagaucaguuguucuaagacuggguugaagcuuggaauugccuagaggauuuuuuaaauccugcugcuaguaccccagcugcaaagauuuugauuuugucugaaaugggaccugggcauuuggauuuauaacaucuccccaggugauucuauuaugcaguggaguuugaggaccacagucuuagagcaucccuguuauagggauucuggggacuaacaagaagcuacagaccccaaacuauuucagauguaguuccagcccuccuaagcaaguguuagcucgaaccuucucacucuugcucagauucauagcugcucaccuuucagaagaaaugacaaugcugaaagaggaaaccaaggggacaagagagauggcagccaucccaacagcugucuuguguugugccccuacugugugccagacacuguccuaagcacuuuacuuauauuaacucauccagcucacaaccaacaaaauggcccuaagaggccucugcugauauccccguuuuccaaaugagaaaacuguccacggggucggucaguaacuuguucaaccugggaauggcagagcugggaucugaaguccgggagccuggcuccguaggccucuguuuaagccacugcaucuguugccuuguggaauguucuuagaacuguaggauacugguucccacauggccgagagucuucucucacuaguucgugcuccauggugauggagaagcauaguucuaaucugucauucuguugcucuggagccuacacagccccccaucgcaucuggagggagaagcccagcuccuuagcacagcaccugagaaauacccuuuacagucuggccacuggcugaacauucuuucacucuccaugccacacugcucugugaguaccaucugaagguccucucccuuuucucugucuucuaaauguucacucuucaauaucuaacucaaauauccucuucucuaacuuguccaggaagaaugaguaaggcccuuuccuuuguuccccaggcucuuaguuucuccaucucuaaucacguagauuacagcccuuucuuugguuuucuccaggggaccaaggaguggggcucugccuuucucaugucugcucugccuucacggucccccacagugucuucaguggauggccaaccucucaugaacaggauguccucuugucugagguucuacuuuguuccagccauggagucauacucucuuuaucuuuugacuauccaaagguguucuguuggacgacugaugccuuccuccaagguacuuugggcucccaagugugcaguugacauuugcugugccuucuccaccaggcuuuaguuuuugauguaugcugagcuucaguggagauuugcuagccuugggcuuucuguguucuugaaucucucagaguccagaagaaaaggaaagcugacacuuucuaggaaugaccugugagaagagagguuggugucuugcugcuaaguuccgcuugauucugaacuaagucaccaugggccagaggaggcagggauaagaggagugguuucuuggccaccagaauggaaacguuuuuguuuucuugugugcuuuuguggaaaugguggcaguugcucacuaaagagaacuaaaacccuuuuacuagagccccaccaggucugaagaggaugggcgcgugggagccauuaucuuguaaaggacgcuauugagaccuugcuacugcugcagugaagagcacaggaaaagccaagcuuaaaaaacacugggcgaauccuaagaacuuuucaugcagaaacacaugcaugaugagaagagaaucuucauuacaacauuguuugacacagaaaaacgagacucagcuuaaaugcucauuaguuagugauugguugauuaaguugugauaaaauggaacacuaauacagcuguuuaaaaaauuaguaaaaaaaaaucaguaugugagaugaugcaccuguuaauuaacucaacuuagccauuccacaauguauacaucauucaaaacuucacaucauauauuauaaauauauacaauuuuuauuugugaauuaaaaauuaaucuaaaaaaauuaguggcuauaugaaguaauugggaacaaucuugaagcuauauuaacuaccaaagagcaaagucaaccuuaacaaugcugacuuuuuaaagaauagugccuagaacacuguguggaguaugcuaacagcuacacacuaaugcacagccaccaaccccagaucaguuacgugaacuucugcauucacaaacacacuuaacacacucuguggcuauugccucuuuacugaccuguaagucaguucuagaagacagacgauccaugaaggcagguccuagccugcccauuugcauugguaucuccaaggccaagcuagagaaggcacacaauaggcuuuccacuaauauuugugaaugaaugaaugaacagagagaggaguuuucuuuccacaguuuccuucuaccugcuacuccuugagcauaugaggcuggaaucuaagcccugaggucacucacugcucuccuggguacuaucccuggccucccguccuuuuccuugagcuucugugcucugcaaggcuuucucauuauccuuuaggcuacagagaaacaaggagacgggagagccuugaaauggaccuucaagauuacaauguguagcugacauugucaguuaaguugggcagaucugacuucgcugauuaaguggauguaugagccgauccuccccagaagcugggaucagcuuccccaucugauggugagucagaccugcugggguuuggguccucgcuccagcauggcugccugugugaccuuggccacuuuacuuaaccuugcugaaucucaauuuccugaucuguaaaggaagcuaaaaaugccucucuugagguuguagugaggauuaaaugugauagcauaagugaaagugcccuuugaagaaagaggaaggcgaaagcgcuuauugugucaggagaaauguguggagagcccccuguuguucucaggugucucauccuucccagggaaaaauccccaugccaagucagaagagguuauaauuuggcucuuacucuuuuauucaggcacuucuuucggcugcccaggguuuucagcuuaagcaaauaaauuacccuucuccacuggacucuguguucugcagccagccauauguuuaagcuugauagagauuuuuaucuggcuugguaauauuacccagcaagggaugacauuucuuaucagaggcccugaggaaucagagauaggagcccuuucuuuuuccuggccgccaggccuccaugugcagggcuggcagggaggcugggaggggcuggcugggucugguagugggcaucagcuggcccucauuucuuaagacagcacuucuguuagcugaccuacacagaagcaggucauuucgagauguuugcgucuuggagccacugauagaagcagggcaagggagagugaaugaggaaggaaggcgggagugugaugacgcaugcccagcuuugcgcggaggcagagcacuugccuguguggggcccugcccuucucuugagaggcaggcgggcccuagcugcagcgucaaggucuggggauucuguggcucuguagggugaagggcacuggagaccuaccaggggcugggccauuggaguggugggugcuggggagcuuccgugggccccuccagguccacuccuugcucuucucugccuuguuuugugcccagaaggcugaccuguguggaugcauuaucaggguggaugcaacacagggcugccaugcucucugguaucaguuuggaaggcacuggcaggaugggaaggcaggcggggagugaggucagggggccuauccuuccacugccucccugcugcucccugacugauucagguaagguuuacaccggggcucuagguuugaauuuugauucuggcauguacuugcugugugauauuaggcaagugguggaaccucucugugcguccgacuucucaucuauaguaacgcuuuugcauuccauugaucucuuugccucucauuugcccugaaugcugaaggaaaggacacugcuguauccccugagggacugucugagcccaaaguacacuggggacaagggcuucagggugggcaaggagaugaccgaugaucacgugauuuggaacuauagccuccauuggagacacgugcucugggcucuuucccuccugaguuuugggaaguccuggccugugcagccuaauucucaaguacuaaucuugcaaucauaagaagaggaaggagaagugguuuucccucucccuggacccauuccagccagcaguuccugacuuugcuuccuuccuguuggugcccacucuguuuccuuccaucccuuccccaaccucucccaucccaugccucauguugggcaacuugaguuuaacugucucuucuuccaguggccaaguccaaauucugaaagcacaguucugaccaugucccuguccaacucaaaaacaguagcuccgugucacccacaggcuugaagucagaccucucagggggcauuaaguccaccgcaacaucacuccagccugugaauaaagacugaaugccuccgagccucuuauguggggaaucaguucugguaaacaggucucacuucuugucuuuuaaacacuacuugcuuuccuugacgucugugcuuugaucccauuguuuuuucucccuuggaugccugagagauccaugggcucuggcuucagagagugcuggguucagaccucagcuccaacaguugcuggcucugugacccuaggaaugucaccucaccacuccaagccucuguauccuugacauuaaccugggcugauaguuccuaccugcaggguucuugugagaagaaccugucuaaaggcuccuacuggggcuugacuugucagauaaaugaaugggguuuucccuaaccuucuaauugacuaccccacugauuauucaaacuccaccuguccucaaguuccauuccaucauucacuuccucuguggguuuuucugccacaaagucaucuuccucuguuugaaagacucuuaguuccucauguaugacagcaagaguggaccucaucucuuucuuuuugugucugacuucccagcacagucucaauuucuucagggcauugacugugguguaagauucucagcuugagcacuggaaccauuuaugggacgauugaguauucaacuccaagagaaugaaagagagucacuuguucuuucauugaacgaaauugauugagugcacaugauauguugugucugugcuucacacuggaguuguaaggaugcauaaaaugaagauucugucuucacauagccuaucauccagugaggagguugcauuauugggaaucugugccaagccuggauugcauaagacauagguagcugagaaccuggugcugacuggggacugggggaaguucugugcccaaggagaggaggacucuucccuucagauggaugcccauaauuuuaucuuuaacuuuuaagaauuuggcuuuaaugugccucaaugaagaccuccuuauguuuaauaaauuacaaauuauuuggacuucauggauugagauguuuauuuuccucuccagauuuggagaguucuauguauuuuuuucuuuaaauaaacuuucuaucaccuucuccucugcuuuuauuccuccucuugaguucccauaauguguauuucaguucacuugauggugucccauaagucccauagguuuucuuuuucauuuuuuuuucuuuuuauucuucugacuaauuucaaauggccugucuuugaccucauugauuccaucuucuggucgaucaagucugcugcugaaguuccuuauagaauuuuucaguucagucauuuugcuuuaccaccagaauuucuguuugggucuuuuuuuaugguuuaucucucuuuguugaacuucuacuuuguuuauguauuguuuuucugauuuuguuguuuauguucucuuuaaguugaguuucuucaagacaauuauuuugaauucuuugucagacaauguauaggucucaauuucuuuaggauugguuacuggugcuuuaguuuguuuuuuagucauguuuccuugucuauuuguaacccuuggggucuuguguugaugucuacauauuuuaagaaguagagaucucuuuuauucuuuaccaauuagcuuuggccaagaaagcuguucaccagucaagauauuuuggguggauuggcuggcagggucugagggcaaguuuacugcuggaauucuuaagcgggcuggccuggugccugaguccauggguacaggccuagauucugggucccugggggccagacuggcacugagauacagugggauggcuuuauugacuguguucaugucuguagcaugcgucugugaaggccaaccugguacuaggaucuacacugauguugggugcuuacuucacucuccuuccuccacaugaaggguuucucucuucaugcugcacugugcugucuugggggaagggugaugugagugaugugaaacucuuauuccuacccuuuucaaugcaucuuuuauuauuucuaugcuccacccagcugcuguaauugcucaucuggauuucuuagcucuugugaagguauauuuuucaugggugguuguucaaauugcuguuucuaugaagggauagacacuggagacuacuauucugccaucuugcucacauuacucuucucuucauaguauuauuuaaaaugauacauuuaguuuuguuuauuucacaucuguauuccuucacuagauugggauccuguaaggggaagaaugaggucaauuguguuuaccacagucauaacaauaaaaaccagugcuguugucacacuaugugcagggcacaguuuuaaguucuuuauguuuaccaaauuauuuuauccucauuagacccaacugagauauacugucacuucauuuuacagaugaagaaaccaaggcacacaaaggcuaaguaauguggucuagcucuccuaugaagacaguagaugguaaaaccaggauuuuaaaccucacaguggcuccaggauuuguguaucuaaccacucugccagaccuuucuagugcuuucuucuaguaaccaccccagcaaagaugcucagcaaauggguggugcaugaaacaaagggucauuauccuauuucuuggguaaguucucacugcaguuugugcucugggcacagaguuaacagcauaguaaagaggaggggaccuggaucuaggaauuuaacacagcuagauugagaucugagcucacucaucacuaagugacuaugagcaaaguguuuaacuucauuaagucuugguuuuguuagaucaacauggaagaaaugcauuaauaauuuccuauuaaucuuacauuaaugguggaaaaaaugagaguauagauuauagugggugcucagacagugucaucugccaucuuggagggcuauauauacauauauauauacacacacacacacauauauauguauuuuauauauauuguauauauaauaccuauauauguguauuuuauauauauggguauuauauauauagguauuaauauauauagguauuauuaucagcuuuagcuuuuucauccaugagaugagaauuugauguaguccugccugauguccacacaggcuccucagaauggcuuuguuuuacuagagauguuaccccuaggaaacaagcucaaucccuugccccucaguggacuagaggcagcauguuuaugagacaggaaaggaugugagugaugugaguuucuuagcuggcuuuggaacagaacagaggcucuuuacgaugaugccagugcuccuaauuaauuaucauaacaagucuccuguucucagcaucugucagcagguacagcugcaccagcacaguggacuggcugagcaaccagaaggguuggggcaaggccaggccagggcagccagccuguaucuccaagugcccagcugguuccguccuuguaucugacagggcccucugaucuuccugcauacaauggauugcagggaaaaagaaacuuccuggccugauugacacaaauuuguaggaaacagcugccuuuaguggggacaaaaaagcaaaauccagugugagugauaaccucuugccagucuggguucuggguugcauaucugcuggugacuauaggagguggugggaggaugugaauuccuacaaaugcuaaguuagcauccagugugugacaacagggugagaaucuccuauugguucucccaacaaauaggaagagaagagccugaguuuuggggguucccaaguuuuugagguuucaccagugacuuacuuuauugccaccaggaagugcaugaugcacucuguaccccacuuucuuuguaguggcaaaaugggauuuguuagauuuuuuucccacaguugaaaggagguugcuauggcaaugaccugugccuaagaugaaguugaagagaaguauggaaagaacuugacaguucuuugcagaacagcaagcuuacauggagaacugaggcucagagaggugagguauggcccaaggucucacagcaaguugaggguaaagcuggcuccuggaaccaaccauggcuuccuaauuguugccauccucaguuccuugcaccuguugauugaaacacugauggccugcuucaacugugucaguucuccuugucuucugggcucauuccuugauggguucaauguggcugguugccucuugccacaugauuugggcacuccauguuuaaucugacagauucugacugcaguuuucauuuauuuugcugcuugugugaaucaugacugugacugggaaugcugggcccagguuuucagggacacagaucacagagugagagaaaugccaugugaugguuaauuccaucugucaccuuggguaguuacccagguuuuccuuaaacaccaguccagaugucacugaagguauuuuucagaugagauuaacauuugaaucagcagacguugaguagagcacauuaucuuccauaauguggaugggccucauccaaucaguggaaagccuuaagagaaaacacaugagguucccuaaggaaguagaaauucugccuccaggaugccuuuggauuaaaacuacaacaucaaggcuucucuggaucuccaucuugccaaccugcccuguagaauuuagacuuaacaguccucacaauugugugagucaauuccuuauaaucucucuaugucccuacagacacacacaugcacagacacacacacacccacauacacacacauucuauugguucuauuucuuuggagaaccuugauauuacaugcaagcuuuguguuuauuuguuuuauuuuuauuuuaaaaaccuuggacaucauaauaugcagacuuuagaaugagacagauuuagguaugacuccaagaacugccaaugcugaggguaaguuacuuaacuuuuccgggcuuaagucuccuuaucaauaaaauggaaauaauauuaacaccuccuacauuaaugccaauaaacacuaaacaagacaaugaauguaaugcacuuaauacacugccuggccuagugcucaacacauaaugcugcuuauucuaaaauuuauacuuuacugcaagccauguagcugcaugaaucaguucucuauuugcugcacaugaaaccauaacaaaauguuguggcuuaaaacaacuuauuuuucucauaguucuauaaguuggcugagcucugcuggugguucuucuguuccacaugggagcauuuggaaucgguguguggcugcauuaaauuaggagucuggugcuucagcuggggugacuggaguggcugguggcaucugucuugccaugaggucucucaucacgagcagucuagcucaaccuucuuuaugguagguuggguagcugaaucccaaguggauagaugugaaaguuuccuaggacagaaucauuuccaucaccuuccccugguaaagcagccacagaccagcccagacucaagacagggaaaccaacuccaacucuugaugggagaaacaauaugcauguacagaaaugggaggacucauaucacucacuacuggacacaguccaccccaggcacaaguugcuuuucagguuuaugacucucagcuucuacucugcuuaaccucuuggguugguuuguaauaauguagugaccucugaacagaaacucuggagccagucugcccuuuucaaauccugccucugccacugacuagcuaugggaccuuaggugaguuucuuauuuccuucaugccucagguuccuuauaaaggaaauggggauaauguugguacugaaguggaacuugugugaggauuaauugaaauaggaguguguguguauucaugccuauaugcauaugcaugccuguauacaugcguucauguauuuacauuugaaugugcagguauguauacucauauaugcauacauaugugucugcguauacaccuacauauguauauauuucuauauacaauauauauucauugcguguauacauaaaauugcaugcauagcucgcacagauguuuccuuguuuauacauauguuugcagccuguacacgagucccaggcugcuuuaaccugggcccugccccaguguauuugagaaaauuuuaucacugugcuugagaacuggucuucagcuggguguugaacugggaccucccgaggccaaugccuagugccuucuccaccacacgaaugguugccaagacugcccuugggacgcaucagaaguauaucagugggucuugguaaaaugcagaauccugggccccaccccaggccugcugacuccaagagauugaccuagaaucugguuauuucacgaguugcuccggggugauucugauagaaacgucauaggcgcuucugaucguggcgggucccuggcagcccaugcuugccccagcaguaucuucuuuacucucugguuaauucauuuuccuuucccuccccagaaaaauugaaugcauucucuucaugcacaaccaugaucucagaggagugcagaacacagggccaguuucacauuuggaguuuuaguuuaguuuagcuucccgcaucauugagaaagacaggguauucucaccucaccacuuccaggcugagcugacgucaaguuuagcugugagauaaccagaccacccugagcuucccucccauucacagugagcugauuuaccccagguccagcuucugggugauaugaccucauugcuuuguaacuuccccgaggccuucccacuaagaaaauuacaacugcucuuuauugagcauuaauacuguauacaaacguugcuuuucuuauuacuuaccauguagaaaagguauuauuaccccgaagcuaagggauaauagcuuacaaaagggcacagaacaaggauucaaacccuuaugaccuaaccggaaaaaccccuuucucuuucuacuauacuggcagggagauauguuaagauuuguuuucauggccccagguccuaaauucuuccuaaauacuucucuuuaauauaugugaacaaaaaccugcagggauauuuuauccaauuucaaauguacagauugucuuugggguuacaaacaagcaccagaaagucaggagccacccuggcacuggcugacgugggagguacagaaugagguguccgucccuccaaggcacggugaccuagaaucccacugcucacugccugucucuguucagccuuucaguucauaaacaugcuuuccucccugcauuuugacauccaucaucguuuaaauuccaggucgucauccuuguagaacgagguucggaucucggcauuaaaucucccccacggugugugcggggccuugccauuugcagaacacuuccugagccuuggcuuauccugacagcugcgagagguuacccuguuugugagugaggaaaagaaaggcucacauggugguaucauuggccuagcuuucaauccaaacacuagucuuaccauggauaccagaaggucuuccgucaaauugaucaaaagcugauugugugaggguguaagccaacccugagaucaaauuaggguaagaggcuggacccuucaucaggagcuggggcuccucucugcaaauacuguagaacaucagcgucacugaaugaauggaguugguuaccugaccagcuuuccuacucaacauggagcucugucugucucaucucucucgauucuucagugcauaacccaguuccuagcuugugauggauccuuccuaaggauguauuggguaaauuaaugaauagugauucgaccuaaccaauuaaaucccugggaguuuuaaacucuuguccaacaucaguuuuauuucacgucuuauuauaaaacaguacauaccucuuccagaaaaagugaaaaacccuuauaucacuuagauguaacuaauuaaacaaacugaugcauguguguguguguguguguguguguguguguguauaguuguauggugguauauauauuaguuuguaaauagcucuucuacuaaauacaugauaaauauacuuugacaucaucauguguacuucuacuacaucaccauuugacugcuuggacaccagacuucaccguuguucagaccuaaguggcaaaacccuuuguauuuuucuaagugucuaggcagacauuuaggaaaugaauucaacuuuggcacuauuauaaacaguguugguaugaauauuccuaaagcuaaaucuuugugaauauguuuuccuacuuuaugaggacauauucccauaaacuagaauggcugaaacaagggcugguuaggcuauugagguugcggaguuuccuuucaaaaaguggggaccagugucucccuccacccccagcaugacagacgaccauguccucgagcccuccacagcagggcuucaggguggauuuaccuuuccagccucaucuguuuggcacuugguauugcaccagacgcauggcuguucucaggccaucaucccuucuuuagagggucuccuucacugcuuacuguguagugagugcccuuuuauuccuccuuccagcccuugcuuugugcaacacacaucucagaugaauuaaaucaugauuugucuuguuuggaggggagcccaagugagucaguucccuguugugucccgguggccagcacauauuuuaucauggauagaagcaauggcucacgucagaaagaccuggauuuacaaugacucugcuucuuuucucgccugaguccuggcuuuuucaugugagaacccccuuuguacaauuaugauaagguuugaaugagauauggcagggaaaggcucaauacgcagcucaacacaggugaaugcucagccauuguugcccaggcucaauggcugggcagggcaguugacuauguguuggacacuguuuacguguccaccagggguggucaaacuaugccucaugggccaaaucugugcccaccacuguauuuguacaauccuagugugaaaaaugguuuucacauuuuuuagugguagugaagcaaaucgagagaagaagaauauuuugugauauaugaaaauuacaugaaaugagaauggaaauuucaauguccauaaauaacauuuuauuaaacauagcagacccuuuuucuuaacauaucuccuauggcugcauuauguuacaauggcagagaugacgaggggcaguaaggccagguggccucacaaugcccaggauauugaguaucuggcacuuuauaggaagaguuugcugaccccuggguuacauguguaagcucauccaaucccgcauaguguuggcaguuaucauaccauccccauuuuacacauggggaagugagaugcaaagagguucagaaacuaccugaagccacaugcagcauggaagugguagaguuggggucuuguuccuagaacugggacucuucaucguucagccauaggguaagucauuggucuuugcaggugagggauugugaggcaggaaaaaagaaagucaugcacuaauguaugguagaauaagaauuuagaggcugggcgugguggcucaugccuguaauccuagcacuuugggaggccaaggcggguggaucacaaggucaggagaucgagaccauccuggcuaacauggugaaaccccgucucuacuaaaaauacaaaaaauuagcuggguguggcagcgugcaccuguaguccuagcugcuggggaggcugaggcaggagaauggcgugaacccaggaggcggagcuugcagugagcccagauaaugccacugcacuccagccugggcgacagagugagacuccgucaaaaagaaagaauuuagaaccagguucguuggccucaaaguucuuggucucgcucucaugaugagcuccuuccaccacucuagucuccuaggaucaccugcuaaacgcagggccagacacacagaggcauucaagauaucccuauaaaugcagccacuucauagcaaugucaggacuaaaugugguuuuguacuuccuacuaaacaugagcuuaauaaauguuuguggaauaaacagaugaaucugaugaauaguuccuggacucucggaguuuaaacucugggaacagggcagggacuccugaggaaagcagacaacuccucaaccuucucaugggagggaaggagaccuucuuuccugaacaccaauuaugcuucccagguggcaugggguccuuaggccacaaugccaaacacuuuugcaguuaaacuuccgaugaaggaaaacuggucugucuucucugcccauuacaauugucuuuacucuuuuugauucugaauguucuuuuuucuuuaaacagcuuuguuaagauauaauuuacauaccguacaauuuaccaauuuuagaauauuuuccucaucucaaaagaaagucuguucccuuuagauaucaccucccaaucucccuucuauccccaguccuaggcaacuacuuuuuuuuuuuuuuuuuuuuuugagacggagucucucucugucacccaggcuguagugcaguggcgugaucucggcucacugcaaccuccaccucccagguucaagugauucuccugccucagccucccaaguagcugggacuacaggcaugugucaucacguccagcucaguuuuguauuuuuaguagagacgggguuucgccauguuggcgaggcuggucucaaacuccugaccucaagugaucugccccuuucggccuccaaaaugcugggauuacagacgugagccaccaugccuggccauggauucgccuauuguagacguuucacguaaauggaaccacagaauauauggucuuuugugaggaacuucuucacuuggcauaauguuuucaagguucaucuaaguuacaacauauacuucauucuuuuuuaugcccaaaguauauuccauugugugaauauaugccccauuuuauuuauucauucauuaguugauggacacuggguuguuucuuuggggguggggcuguuaugauuaauucugcucugaagguucguacaagacuucguauggagguauguuuucauuugucuugggcauguguauaccuaggaguggaauugcugggucauaugguaacucuauguauaaccuuuugagcaacugcuaaagucuuuuccaaagugucuacccuguuuuacauucccacuagaagcugcucguucuugggcucauuauucguguuuaucuuuaaacacagaacgugacuccauucauaugacggugcuagaagucaguacagugguuuucucugggacgauggcagaggaaacuaugaagggcccaggaacacuuucugggaaagggaaauguucugugucuugcugguuuggugcauuugaauacuugcauuugucaaaacucaucaaacuguuuauuuacaaauugagcauugcacggcaugugacuuaugcccgauuuuuuaaaaaaauguacaaaugaaaaaacauagaaagagaggaaaaagcaaaauaucuguauuuuaauuaucacaugaccugacuggcugcuuaucuuacccaccuucccauggacacagggccagugccuggcaggcaaggccacgugcaagaaaagcucuuaauugaugugauuaacuacaucucaauagggagccugguuaacaacaggggagugaaaaggaggcuauuuuucacucucccaacuggugaaugccuggaaggggugaugggggcacuuggagggcugcccccugcggugcagggggagacaggacagcugcuuuuuccuuuggcauuaagauaauuuuaaaaaauuauuuucucucaauugcuacaaaaccuacucuucauuuucaucuaugaggaggaagaaaccaaguuaauuuuuguuuaguguguuucugaaggccacauuaucuaccagaacacaacauuuccuaggauacucuuuaacccuuccuaaaugcaccuguucagaggagcaggcaacaacaggaaacaaacaaauaaaaaagaagugaaggauuuccucuuucccccuuagaagguggaaagaaauguauggauugacauaaauucacagaaggugagaacugggcaagcaaacacauuauccauguucuuaaaaaggcaaaauuauauaaauuuugauaaaauuucuaaaauaguaucaugucauuuguaggcuagaaaaaauauguauuugcuaguaaaaauauagaccuauaaaaacaccauuacuugggggaggaugugguuauuuguguauuuuuuuucuuauugcuaaucugugauuuauuuuuuuccaauaaccacuaguugcuugugaauuaaauuguugagaaauuacuuggguuguuauuucugauuugagagaucaguuuccucagucucccccuuucuagaacaggcuuccuucucccaucccuccuguguuuaaagcuagggaacuuucaggcagcacugcacagggcacugaaugugaacuuugugguuagcugggucaggguuugaucuugcaguaucuggggcaagucacagaucuuuucuguguccugguuuccucacuggaagaaagggacagauaaugcucuccccaguggauugaugugagacauacuaggaaaucccuagcacaguacuuggccuuuugaauuaguuuacccuuucuuuccaaccuaccccuuuauccuggucuuuccuggcaccaugaaaaccagcacucagcaguacaguuugaugacuucuuauugcuagguuucaucuguaaucguugcagaugcuuaaauacacacgcaggccaggcacaguggcucaagccuauaaucccagcacuuugggauucugaggugggaggaucacuuuaggucagaaguucaagaucaucuuggccaacauguuaaaaccccaucucaccaaaacuacaaaaauuagccaggugcgguggaggacgccuacaguccuagcuacucuggaggcugagacacaggaauugcuugaacucgggaaguggggauugcagugagcugagauugcaccacuacacuccagccugggcaacagagugagacucugucucaaaaaauaaauaaauaaauuuugagauuuaugugugugccagacacacacacacacacauauguacacaagcaauuuuuguguguguggcucaagccaggcagagaaagacaaauacuaaaugaucucacucauaugugaaaucuaaaaaaguugaucucaaagaaguagaaaggagccuggugguuaucagagucuggggaggggguuggggagauauuggccaaaggauauacaauuucaguuagguaggaggaauaaguucaagaagucgauuuugacuauaguuaauaauguguuguauucaugaacaaggcuaagagaguggauguaaaguguucuuaccacaaaaaggauaacuacaugagguaaugcacauguuaauuagcuagauuuaguaauuccauaauguauccacuguguccuucaaaacaucguguuguaaauaguaaauacauacaauuuuaucugugaauuaaaaaaaaagauuaaagaaaacccccauccccacggaugaguuaagacugaucacugacggagcuaguauguauuacuaaccaaagcuagaacucauugccgcaagcaucugggugacagcgcuauugauaguccuuccugcaguacccgucccuggcagaaacaccuucagucuucaggcugggugcccaaugauaugcuagaaauauuaacuccuccuguaaaucaccagaggggaugcagucucagacugaguuugaguauuguuuuccgggccuggaggaggggcucagcagagagcgauucaugguuuuacaaaauguauuuacucugguggaacgugugggcucacgugggcagaagcacauuugcacacaugcaaaauguaagccaugcaccgucaucuuuucacccuuguuuggucaccuuuuaacccuccuuccuccucccuaauugccucccccagcccauuuccucagccucuuuuuauggcagugguuuucaaaccucaguuugcaaaugaucaucugggaaaugugcuauaauggagauuccuggguucccccaacagauuuucuaauucagugguucuaggguggggcccugccugcaaaugacauuuuuaccgaacaucugagagagucccauuugaccaguuaagugcuauaaacagaaugucugggacuuacugauauuucaaagacccacaaacaaacuugagaacaaacauguaaaauucuuagcugaaaaauaugaaaacaaaacugcaaaauagaaauaguuauacuguauguuuuauagaacuuuaugucaacuugucaaguucgccucaacuuuuacaguuacauaggaauuauuuuuuaaugaaggauaugagugcaauuaaugcauuugauacaaugugugugaggccuacaaaagccuuauaaaagcugucaccccauggacccugcucugagaaauaugcccuuagaugauuucuugcuuguagcauuuuagaucuggaaggccccuuagaaaugugcuucuucaauacccagauuuuacuaucagagaaacagaggccuacagggggaaggaauugcccaaguuuacacagcaaguuccugaagaggccagacuagagugaagcauuuacaauguacgugcaugugcaugcgugugcaagggcugguuacaucccucucagaagucucuucuuuuuuauuuuuuauuuuuuuuugagacacaauuucacucugucucccaggcuggagugcaguggugugaucucagcucacugcaaucugugcuuccuggguucaagggauucucaugccucagccuccagaguagcugggauuacaggcacacgccaccacgccugguuaauuuuuguaucauugacaggguuuugccauguuggccaggcuggucuugaacuccugacugcaagugauccacccaccucaaucuuccaaaaugcugggguugcaggugugagccaccacgcccagccagaagucucuucuucauuucucuuucacucuggcuguuuuuuucccuuuggucccuauguucucaggccagucugaaacuuggcccugaacccugaggguaagggagaaagguuaguggggggaucucaggguugaaaucaauaggcauaguaucugucaagaccagucuucagcuucaagucuucagcucucaagucccuguagggggaaagagagaggaaaugcaccaaggggggaagaagugcugagucaugucacuucaagcagacacaaaaaacuggcuaacuucuuagcagcccacugaguuccgacaaugugcuggacauugugcacacuaaauuaagcugacggagucccugcccuguggaaccuuucguucauucaccuacucauuucacaaauauuugcugagaguccuacugugugccccacacugccaacaaggcagauagggagcuuagaaccuagucugugacacaggcaacaacagaugacagauccauaaacaauuaaggcauuucaguuaagauauuucagauagugacaauuacuaugaagaaaauagaagaagauaaugagaaggaaaguggcugggugcagagcaugccauuuuaaaauaaguucuugcuaguugaauggaugaauaguaaauuccaugugaccugaaaggggauauacuuaggccauuuauuguuucugacucugccuuccacaggguaagacugaacuuucuuacccauugugagcaauucuggccaaggaguagugagcagaauugacaugucauuucuggccuucauguuggaauucuagugagaaacccuccagaggucauucucucuucuggccugcugcugaucagugcuauguguagaggcugccacguuggccuggucuggaugaugcugagauugagcaugaucucagguugaccugugaugaacaugcagcugaaaaaagaaaugaaucuuuguugcuuuaagccacuaaaauuuggaaagacauguuagugcagcauaacagcgucacuucugacuaauacuaauacaaccugcaaggcaaaauaaguuugaacugucacucuggauccauugguagggguuuucuuggcccugaaugggaaacaacucugaggucccaacugggccugguaggaaagugggcucuaaugacuugguguugaccaccacgccuguaggugggagguggcagcucugguaccacaugccugucuuccuacuuuaacuuucauaaaagguucuuaccaggaucuuuuucuagucuguccugagcaucuauccucacaaaugacucucaucagcugcacugcuuuauguggucuucacucgucucuuuccuagugcagauucuucucauuggguuuuaagguucucaaaauucugacccuaacacacccucccucaggggacuucuugcuggccacugagcauccaauaccccuccccugcucuaggccuucaucacugaaugcuauccuuucaccccacccccugcaaaccuaccuguccuguggguauccuuuaaaucuggcucucagaggacuuuccuuugcagccacagugacccugcucuccugaacccagaccacacagugcccacacucaauuaaucuuugacaaucuuguuuuaucuuauacuucauugcugcaugguuaucuaacaauccucauguugaagucucgacucccuaacucgguuauacacucaaggaauggccuggguuuugcaauuucucacugcaacgucuuggugauaacaggcacuugagaaauaaguuuuuaaagaguugauuggauuggugauguggggcuagagaguagaaggggaaaacugacguggagucaucuaaugggcauuguccagcccauucugccuguccugucuccaaggccaguccuuccuuccacggcuggcacaguccccgugugauguccccuuccugaaaugguuagacuucuaaucaaaaggucuauauuggagcagcucaguacaagccauugcagugggaaacucagaaaaggaacacacaggaugucuuggcaggaugagacuaggcagcaauucgacuuuaggggaaaggggaggcuuccugggggaaaggauguuuaggcucuucccagaaggagguguggggauuaacccaacagaggagccagaggaaugcucuguggagaucccaacccaggccugggcuggagaacuggaguuaggggugagcuggagcaaccugugaccagcgaccagggagggggcuggaggagugauguggggccucccugcuugcaggaaggaguuugaccuuauccuuagcccugagggaugccccagagggguuuuaaggauggaagagacugaucaugcugucuucauguccuuauuucauuuucugccuuuccucuucugacucugcucuuauuuuucuauucuuggacuaacauacuuuguguuuuuuuuuuuuugguuaucuuauuugaaaaucaauauaaccacaucuauaaaaacaauuuuaaagaaugcccaaaucccagagccaucaucucacccaauuacaacucuugccuucaugucugcuuggccucuugcccccuguuccugcugugcaugcauacauuuuacagggauguguccucaguggacgugagauuuuuuuuuucuguuuugcaguuuuuuacacaaacauuuucauuuguuguuccuguuuuuccuucuuucccaggaggcuuuaggcucccauucuccucucccuggcuuucucucugucccauccaccgcucuacccuucaggccugccuauaugaaagaggucucuuucuaugcagaaaacucacuuuaacaagaugugggugcucuuacacagaccucauaugaggaaaauagcacaucagugaacuuggggucccugggagucacagugauguucaccagaaaaucagacaacgguaauguaccucccccaucagguugccaaaaauuagaauagguuuuguguuuuuuguuguuguuuguuugagacggagucuugcucugucaccaggcuggagugcaguggugcgaucucggcucacugcaaucuccgacuuccugguucaagugauucuccugccucagccccugagaagcugggauuacagguacaugccaccacacccagcuaauuuuuguauuuuuaguagaaacgguuucaccauguuagccaggauggucuugaucuccugaccucgugauccaccugucucggccucucaaaguguugggauuacaggcgugagccacugcacccggccaguuuugggguuuauuuuaagaaugugucagagccuggcauaugccuccauugccgguggcagcauaauuuguucuuuuggaguaacaauuugucaagaggcaucaaagccuuacuuugaccuuguaucccuauuugggaaguuuauuuagaagacaguuuccagaaaaugagaaagcugugugacaaaaggggguucuugcagccuauugcacuucagggcaaauuagaaacaaaguggacuccaggguccuucuguuucacggaaucuuucccagacaucugaagggucaucauggagaagaggcggcaccuuaaggacagcagugacaaucucugauguggcaauuacauaagguauugcguccuuccugagauuacacaaaaccuguauagagagaggcuagcuguucauuggaaaaaugaagguuuugccuacuuggaauaauaagagcaugacagcuucuuuuuuucucuucuuucaucucaucucuucucuuuuuuuauagcuugucuuauucaguuaaacuucagucauuaccauagaauaaaguaaaaggcaauauauauugaauguguaaggcccauguuccacuaggaaugacgucacgaaaggacagccugacccucgcugcuguaucaggcaugggcacagcgcacacugcugcacucaggggucagagcaggaggugcuccuggguuucaugaucuugcuuuuugucccucauggucaugugucauuucaucugcaccauaaucgugcuggguggguaacguaaauccccauuuuauagaggagagagcugaguccuuagggcuccuggcaguugccauccaggaagccccugcuacguuccaagcuuagaaucuccccacacuaucuccuuggaugcucacauaacagcucugcagagccacucuucaaaccugcucuucaugauggggaaacugaggcacugugauuugccaaagagccguagccaguaaggaucaaggcagcauucacgccuggguucucugacuguaaaucuggcuguguuuuuuucuuucgaauuuuauuaugaaugccuucuuuguucauugucauuauuaucaucaucauugaucucuaccaggcccccuacccccagccacuugccuccucuguugcaagaggagaugaggagacaaauguggaauuuuuauucccauucccuucccuccuccauaggcagccacuccagugugcuugcugcaggcccugcaugagggccugcaugaggauccucccugucuuguucugauuggguaucuguuuuuaauuuagacaaaugggauucugcuauagaucucaauuugguucuuuugcuuacucaacacucuuuuucagagccagucuuggugcucuguguucaccugguucaucugaggagcugcaucuacccugcccaugccauagauccugcccuguuugcuucuccuguugcugcuaguggacaugagguaaccacagccuaguucugugauaagcucuucacaccuguacccauauggacugugggagaguuucucugauauggacugugaugcgggugagucauagugcacacucacacuuaauuucacaaguacugccagauuguguuccagaaugacuguaccaguuuacacuuccacaggcagugcucaagauuucuguuucccucuguccucgccagcaccugguauuggcagaugcaucaaaaaggaugcauuugacagcucaaccaccucagagcacuugauuagcaucccugugauggcccuuucugcugcagacaucacuuugucauaacagcauuuugagcaggaagaagcaucaggcaggaaaaaaggggcccuuuuacugugacucccuaucuucuguuagggaagaaaauuuuccccagaaauccccaguagacuuccccuaugucucaguggccaaacugggccagguaagcucccagccagucccugacagagauaacaagauugucauggcuguuucaagccagggccaauucuucccccugccauggacuuuuuuugagcacauugcuaucucccuugucccugaauagaacugggaauauuuuaauaaagaagaagagaccaguggcugaucaguaacuuggcagccaacagagucuucuacaucagaguucugcauuugccaacuuuuugcaugcaugcugccucuucuauauaagggaucuucccccacaucuguuugauuugcagagaaugucagaagcggcgagucacucauacauguccauugcuuuggggauuagauccauccagcucauuuuggaaacggcaauucuuuuugccaggcagacaugagacccauuuccacaccagcugcuccagcugagguucccaugcagguucugcgugacagaaaucaauagaaagauucgaagggcagagcaccaaaguuccugcccugcaccaugaugucaaagcagaaugccugcugaggacaggugcagaugaauaccugucagagaguaucacuucugcaagcagcaacuuccccuucuugucagccacguggaugccauaguaaccuuguguuucuggcuagcucaagaaauuaauuuauaggaugugugcagcaggucaugccuguaaucccagaacuuuuggaggcugaggcgggaggaucacuugaggccaggagauuaauaccacccuaggcaacuaaggagacccccaucucuauaaaaauuuuuaaaaaaaaaaagcaguuuugguggcacaugccuguggucccagcuaguuaggaggcugaggugggaggaucgcuugagcccaggaggucaaggcuacagugagcucugaucaugccauugcucuccagccugagagacagauuugagacucugucucuaaaauaaauaaauaaauaaauaaauaaauaaauaaaaauaaaagaaauggaaaccguauaguuauaauuuguugagcacuuaucuuugccagguggccugggaagcauuuuauuucuacgaucucauagauaucucuuggcagcccucugagagcauugauauauuauugcuacaucacaggcuccuacagaauccugauucugacaauuaucagccauguggccuuaggaaagucacuucauuuuuuguaccuuagcuuucucauuucuacaugaagaaugauaauaguauauugcaccugcucacagaguuaauaaacauaaagugccuagaauggcacuugauacuuauuagcuacuauuguugccauuuuuuaaaaugaagaaauugagagguucagaggggucaauuugccaaaaguuaguuauuaaguagcagggccaugauuugaauccaaaagcuucuggcuccgaaacugggcuuuuauccaagggaacaucaccauugcgccccucaucaguagaaucaauuuucaggugaagacucggugacaaagaccacaaagacauaguguaauucuucuaacacaugacuggaucauuucuggaagguggcuggggacauggauacugggccacagaacaagcaugcaugggauggaaaagacacagcgcucaauuccuaauuugaccacucaaucuugcagagccuccaccuccuuauuuuuaaaaucagguuuucauuauaguuccucccagcaaggauuuuaaaagugccuuauaagcugaccaucuccagguuccuuauuccaaaauuaggauuuuauaugucacuuuauauuaugugucucaucucaguuuccacuuacacugacaaaaagucuaagagucauuuccccccaacuccauuuuagucaccgcgaggcucaggaaaacagaauuucagaaucuucuggaagagauguuuccuuucuuaaccaagcuaaauggacuggaggcaggcaccgcugguguuuuuagaaggcugguuaaccacagugccuagcgguuuggggaaaaauaaaucagguagcuuucuguggcacgagacauucccuuaccacauuuguccacuugagcacuuuuauuuuauuuuauuuuauuuuuauuuuuauuauuuuuauuuuuuugacagagucucacuguugcccagguuggaguacaguggugcaaucucaacucacugcaaccuccaccuccuggguuccagcaauucuccugccucagccuccuaaguagcugggauuacaguugugcgccaccaugccuagcuaauuuuuguauuuuuaguagagaugggguuucaccauguuggccaggcuggucucgaacuccugaccucgagugaucugcccuucucggccucccaaagugcuggauuacaggcgugaaccaccgcacccggcccaccugagcauuuuuagauguagaccuggugaugggucugaggggcagcauguucugucugaauggggaucucaagcucagugauguggcuuuaagcaaaaaggauggcuucaaggucuagauuuccuugggagcacguuuuaaccuaaaccugcauaacuaguaacucgaagaucuuuuaauuuuauuguuuuuuaauuuaacugaccccguucucccuccuuuucucccuccaucccuucauuccucccucccuuccuuuugacacaggucacccgauauagaaucacacaccugggagauggcaccagccagugaggcucaaauuugaaccacacacaaaucuccagggguacuugguaaaugcagacuuuugaccaauuuuucggcguggggcugagcaucuacucuagcaaugagcucccaggcaguacugaugccgcugguccaugcaucaacccacuucaacuugugaggaauggucugcuacccucccuagcccuccucaugcgccaacccauuucaacuugugaggaagggucugguccccucccuagcccuccucacacaggcaguugcagauacugucuagaauaccagauugauugugcacacauuugaccuuccugaccauccugggagcugugagaauaacaacaauuuuuuuuucuuuuuuuuuuuuuuuaagaugagaaaacugcuagucagagaugcuaaaaauaacuaggcacagcugauaaguagcaaagaugaaaguccaagugcagaggcaguuccaagucucuguagucuucuccaagagcugauggaugaauguggcccuccugggauggaagguguccuugugcuagucaugaacccaacagaaagcaagugccauuuucucuucucuuccccucuuuaucucugagaucuuaacuuggcugcuucuuuucagaagacagugaugcacuguauucaagugauagccccagcaguaacauugaugcagagaaaauggaauacuuuuuacaagagaccagaagacacaugaagcuagaaaaaggagcccagaaaacugccacauuuugcccauauagaaaagcauaucccgaccgggcacaguggcucacgccuguaaucccaggacuuuggaagcccaagauggguggaucacaaggucaggaguucgagaccagccuggccaauauggugauacccuaucucuacuaaaaaugaaaaaauaaaaauaaaaaaaaaaauuaguggggugugguggugcaugccuguaaucccagcuacucaggaggcugagacaggagaauugcuugaagccgggaggcggagguugcagugagccgagaucaugccacagcacuccagccugagugacagagugagacugucuaaaaaaaaaaaaaaaaaggggggggcuccuucccacucauuucucccauaacauguaaugcuuuuuauagugauuuggucacugcugagcuaucuucauuuaaugugguuuugacagaauaguuggucaggaaaauuuauuuucaauuaaaauaacuuguugaacugucucgguuuugaaaggauuccguuaggauggcuaauuauauagcgguugcuacaaggagauauuugcacucaauuucagcucuuagguaauucaaaucaaaugcuugagauuuuccucccuggagcugugugcaaccaucuuccucucacacugcaggcuucccaugaguuauuuuuagaaacccaaauuuaagcagcaauuuuggcagagccauuucuagucuaguggaguaaaccauauguacugauaaaugcagccaaagaguuaguuucuuuaaaaaguaacaaaaccaucucucuccguucauggggguuauauguuuacaaacugcaaacuauccguuguacuauuauauucauuugugaacucuagcugaagugagagaucauggauauuacuuuaaaauuacaaagauguguccuuuugcaaacuguugucauaauacucuuuuuuuuucaagauggcaggccuuggcagaauugacuggagacucuguuuuggccuuuggauuucccgugaaacauggagaucccuuucuuuauuuuccuacucugcucugauuucuucauucaccagagcacuuguaauauaucucaucaugcuuauaagcaggaaaccuccuccuucuguguuagaacauauucuuguggucaggggcuggauuuuuuuaccuucuucaugccuggcacauaauagaugcucaaauagugcaugaauagaucgaugaaucauuaaaauuauauuucuauuuucuccuuuuuuuaaaaaaaaaucuuuuauuacguaaauauuaaaugauugcauucauuucggaaaaauuaaaaauuuuccacaaaaggccaaaguccuuuuagcucacccaucuucaauccuugucuccucauuaguucuguguaggucauguuuguuaucuuuuagagcacauuccugcagaccauucuaauucauuuaaguguauacgcaugcacauauacacacugaguacuauuguguacaccucugguagaguauuuugcaguuuaccccuuuucacucagcaauauauugaggagugcuauccaugguagccacucuauucuuuuuaacugcuacauuguucuauuguuucauguggauguacccaccuuuuauuuggaccaaauacacaaauuauuuaucugcuuucccauucauuauacuuacagaucgcuucucuuguauaaguugacaaacccagccagguucacugcuaucuuuugguagcuacaacacauuuuaucaaaaucagccacuugccuuagaaauuauaucaaaccaguagacagauuauguaaaauucgaaguguugucagagggaccagaguuuccuuuguccucacagucuagagaaguacccugugcucugggaaccccacaggguuggauagugagugaugcugaccaccacucacucuguguugugacacagugaucuggugucugcucugcccacagccagcuggguuuccuugagcagaucauuucuucucccgggacguuacuucucuuaucugcacaauggacccagugagcagccugaagcucuuuagacugaauaacugggccuacacacugccaccaggauugacauaaagaauguccuguuagcucacccuucacuauauguugggguggggaagggcaauuccugauaaaguuccaagcuccagcccagagcucugagcugagacaaugucucaaagagcccaugaguggcaaggaauguauugucuucagauuuuccuccucuuuccuacuauuuuaccauccaauuaaaaugaauauauauuuuuuucuuuugcuuagguuugucuuuguucuaagcaaggcaguaugaugaugggaaaaaagguuguggaccccugaauucuacuuccaaaguuguuuaauucuagcuguguguucuuaggcgagucgcuuaccuucucugggcuuccgucuauugacaucacaauucccagugagccagguauccacuaaaaugacacugaaaaguugaaaaccacacucgcuuaugagugauucauuuggcauuugugagccuugucaccugcaaauaggucaucucaugaacugaugaggcauccucagagaccacgagagcccaugaaaucuucuuguuucacaggagaauuugcagcuguccuggccccuggugacacaugcuaagcccuucaggggcuucugagagaggcccagagaaggugcugagcugccaugauucacaggugaaguuuucucaccuaggcccugaggcuuugugguggauccacggcaaaggguauuccccugcuuugaggcucaggaccacagaggucacaggaucugauucagaugccagcggguuucccuagggggcccaaugaggcuuuccauguagggcaagaguuauggcucccugcuggguguuucacaugggucagcagacucaaugugguucugaaggugaaaggucaguguaaaugggugugaagccacgugggaggcauagcccaucuaagugucugggguuuugguuccccuagucccagaacuuuguuuuuugccccuacugugaguuucuguuccugaacaccccuuaguuaaguguucccugguugagcagguuucuaccaaaggagaccaaagcucagugcuuuuccgcugcugagcucgcugggguaggugacuaacccucuccuagcaucugcuuccuaaccugcuugggcuucagggggugaaaugagauucugcaauaggugcucaauccacauuucuuuuauuucccuuuuccuguuuuauauggaaaaaaaacucauaauuuuauaagcacugaaucuauaacugagcuuccaaaaacccacccugggcauuuuuucacauuaaccaagauaaaccaaaaaggcaguaccacgaauagagaaaaugucauuaggaagguguacaugauaaauucguuuuuuaaaacaggaauggugaucguuuccauuuaucaagccucucugcaaauuuuucagcagcugccuuccucauuuuaauaaaaugcuugcagaucugguuugcauuuuuguagauaaauguagaacaagucacauugacacucccuacaucugaucauccucccagccaucaauaccauuuucauucacagccuggaaucuuuaagaaaugagucaaccugaccuaugauucacagauacuugaucugaaaugcuugguggugugggguugguggaugggguagaaacaaaaauaaauuuccugacaccaaaagucaguucaagugaacuagaaugggcagagaggggucguggggaugguuccugcccuucaggagcugcacuuccaagucugacuuagggugaucacacauccaggcuugcugguggagcuucaguuuaugccuguggucccagccucuuaaacaguuagcgugccuguccacgauuagaaaugucacacguuggaagauguaggguucugaggagaguagaguggcaguucuuaaaggccagagauaacauuuaaucauguguaucuccagugccuagccucuuguaagaaauuaauacauaaaugcuugcuggguaggcgagugagugaguaagugguuucuuaaacuccccuccuuguucucuaaauuauuucucauuuuucuuugcauguuugaagcaccuggugacucuacuggguucucaauaaguauauuuugaauaagccagagguucagagaucaguuucuuacuugcuuguaagcaaccccaugcucucuagcucugcgacuuugaguggguuagcccagauuacuuagaacuuaguacuaagaacaguggcuuccacguagucaguuccuaagaaaugguaauggaggagguggaggugguguuauuguuauuagccaucuagcuuuacugccaguuuuugucuuuucucccccuaacuguaggaaucguagacuauauauauauaagaccucauauauauuuuuagaagauaagucaaauauaagaaauugaaaaaaugaauaaaauaguuauccuaaucuugugcccuugguaacauacuaucaauuaucauuaucaaugugcuauaccccauuuauguccguuuauaccaguguugacagggucucacuuuguugccuaggcugccaugcaguggcgcaaacauggcucacugcagccucgacguccugggcucaagcaauucucccaccucagcaccccccgaguagcugggacuauaggcaccagccaccacacuuggcuaguuaggguuuuuuuguuuuguuuuguuuuuggguuuuuuccuuuucuuuucuuuuuuuuuuuuuuuuuacauaguuguuaucuuaaggugauuuccaauuuuuuuuuccauuuacauuuuuccacaagcauuguccacuuuauucuguaaccuuuucaacuaccauuuugaaauuugcuuuuauccaugugguuguuugugaugaacuacagguugcugacuuucuuccccuucuguaaauaaaguuuucuuccuaguauguccuguaucucaagaggaucucaucaguggaaucauuagaucaaaggauaugacuguugcucagcucucuguguguauguaaauuaauaggcuguuuauuugagcaguuguaggcuuacaaaaauauugagucaaaaguauagaauucccauauauucuccucuucucccgucauauccccuauuauucgcaucuugaauuaauaugguacauuuuuuacaauuuaugaacuaauauugauacauuaagaguuacuggaguccauaguuuacauugggcuucacucuuuguguuguauaguucuguggguuuugacaaaugcauaguguuguguaccuaccauuauaauaucauacaaaauaguuucacugcccuaaaauuccccugugcuuccccuaucucuccucauuacucccucucucacacuaaccccuggcaacccacuaaucuccauaguuuuguuuuuuucagaaucacacaguuggaaucacauaggauauagccuuuucuuuuuuucuuucuuuuuuugagauggagucucacucugucgcccaggcuggaguguaguggugugaucucggcucacugccagcuccgccuccuggguucaagcaauucuucugccucagccucccgaguaguugggacuauaggcacccgccaccaugccuggcuaauuuuuuguauuuuuaguagagacaggguuucaccaugguagccaggaugguuucaaucucgugaccucguaauccgcccgccucggccucccaaggauguagccuuuucagacugauucuuucacuuaguaauaugcauuuaaggucccuccaugucuuuucauagcuuaacaccucauucguuuuuagugcugaauaauauuucuuugucuggauguaccacaguuuauuuacccugucaccuacugaaaggcaucuugguugcuuccagguuuuuggcaauuaugcauaaagcugcuauaaacauuuguguguagguuuuuguguggauguaaguuuucagcuuauuuggguaaauaucaagguguucuguugcuagaucuuaugguaagaauauguuuugcuuuauagaaaacugccaaauugucuuccaaaguggcuauaucauuuugcauucccaccaacaaugagagucccuguugcuccaaauccucuaccagaauuugguauucauguuuuggauuucagcauucuaauagguguguagugguaucuaauuguuguuuuaauuugcacuucccugaugacauauguuuauuugccauguguauaccuucuucgaugagaugccugcucaguucuuuugcucauguuuuaacuggguugcucauuucccuauucuugagauuuaagaguucuuuguauacuuuguauaaaauuccuuuaagugacaugucuugugcaaauauuuucucccagucaaugccuugucuuuucauucucuuuguagugucuuugcagaucagaaguuuuuaauuuuaauggaguccaggucaucaauuaguuuuuucauagauuguggcuuugguguuguaucuaaaaaguuauugccauacucgaggucaucuaggauucucuccuuuguuaucuucugagaguuuuaucguuuuaaauuuacuuuuaggucuaugaugcauuuugagguaauuuuugugaaggguuuaagaucuauauuuagauucuuuuuuugcaaaugaaugucugguuguuucagcaccauuuguugaaaaaaauuaucuuuccucgauugcaaugucuuugcuccuuugucaaaggucaguugacuauauauaugugggucuguuuccaggcugucuguucuguuccauugaucugcuuguuuauuauuuugccaauaccacgccaucuugaugaccauagcuuuauaggaaguguuggaguugaguagugucaguccuccagcuuguguguucuuuuccugcaguauugugucagcuauucugggucuucugccucgcuauaaaagaaucagcuuguagauauccacaaaauaacuugcugggauuuugacauaccacagauuguuuaucuauucacuuauugaaggacaucuuaguugcuuccaauuuuuggcaacuacaaauaaaggugcuacagacauucguacauagguuuuugugggaagaggaaaucuacucauuuggguagacaccaaggagcgcaauuauuggaucacauggugagacuauguuuagcucauuaggaaacugccauagcuauauguuuuuugcauuuguucagagauuuuucguuacaaugucacuaacaugauuaauccucagaauaaaccuuuggguuggggguuauuagccuugccuucuggcuaauguuauuaaauguuauugcugaaagaaacccugaagguuccuaagccucuaagcuuucugagugugagauccacauccccuaucacugcucuucuauggcuuccauggcaccgugaguauaauaguugcugaauuaguguccacuacacacugaauaccaauaauggaaaaaccacuucacuguacagaugaaaacacaaaggucccaaaacgagaaaugagauacuucuggccaaacggcauuuuaacuaguaacagaaccaaggcuaaaacuaaacuauuguagauccguagaccuguauuuugagccaccaguccuugacucgcuacauucaagcaagacaagcuggaagauucuuaaaucuguaauuaguauuguauugaacacccccccucacuuucaggccuacccacuacugacugccauuaccagauagcccaaagacgcccaaaaugguguucuaaucugaguacaaggccacuauagcuacaaagucucauaggguaaugagugauaauagcagugacaacaauaauaaaaauagccaagaauuauugauugcuuaguauugucagggucuuugcauauauuauuucauuuuacacucauagcugccccuugguucaacaucauuacuagccacaauuuagagauaaauagauugagcuuuagggagguuaaguaacuuguucggggugcuacagcuuucagugguaaagccacauguguguccauccauucucgacuccacuuagcaauguacuacuuuacaguuaaaauaaugagauuuagaguuagauggaccugcauucguauucuggagcugccauauugucagucaugugaucuuaaccuugugacuucuagcugcaauguucccaucaugggguagcaacauccauggcagacgcugucucuuguuaccucaaaaccauugccucccacuguacagaacaucaauauguucaaaggguuggcaggaggcaccaagucucagggaagucagacucuuaucccaaccuggugacugguuuaaacuagauaugguaauggcaggcaaguuacccagucuuguuaggaacaguaugcugaggagggagucucuucucaaaugaaaaggcaaagccccuuacaaaggaagcuuauuacuccuuuccuuucuuccucccuagaucuuggacaugauaccuggaugugcagcagccaucugguaauuaugaggugacaagucaauagacugagaugguggagcagcaaagauagaaaaggucuggauuuuuuauagcauuguugaacuguuccaucagccuaagacaguugacuaucuccagacuucuuguuauguacaacauguccuguuguuuaagucacucuaacuuggauuguuucuuauuuucagcugaaauuauuucuaauagauauacagauuuccaacaaagcacaguguagagcagcuuaacaugguaccuaugugccaaaguuccagagcaagaguuccuggguucuaaucuuggcucuguggcgugacuuuagacaagucacuuagcuucucugugacucgcuuuucucauguauaaaaugcucaguaacuguguauugacuguugaauaaaggauaauagugauacugaauucauaugauuguuaggaucaucgaauggcuaaacauuuuauaaaaugauuagaacaucgcuuggcgcauuguaauuggcugcagaugugcuugucaaaguaaaauuaaaagaaaaguagucacuauuauaggccuggguuugcaucuugaucccaucauugggccacuugugguauuuaagcagaaccuucacccuuucacuacugaggcucauagagcaugaaacucccccuaaaaucugucucaaagcagccacaauggugguuucuuuuugacaaaaaaaggcuccuuagagaacguuggcuugcaaaggagaggcugugacuaccaagucgugucaacaacugaauggcugaaauacccaaacuugcccaugcaaaugggcuugggucucuccuggcagccgccuuugaaggcucuagacuuaucugugaacuccuuuuuugagagggucuuuccaacuagugguuuauucuuugacucuccucauaccuuuuuugccagagagugagagugagaagggagggcuaaugccugagcuccugcccuuucuaugcagugagggucaagauccucagcuaguguuugagggaacugguguaaccugggucucucauuuucuaccauccaaguugccaccucugucggggucccacucuaauuugggcagccacuaagcaauauuuugaaauauaccuuguucaugaguuuaaaggaucaacugguagguguguccauuagcaaauccuauggaacaaauaucugcucuuuuuacccccuacuuaccuucuccaccaaggacaguucagacaaaguugucaccaccuuuagccugauuuacugcaggagccuccuaaucuaucuuccuguuucuacucuauccuuuaucccccccuuggcagccaggggauccuuuaaaaaugugaaccaaagcaugagacuaaaccacucaaaaucuucccauggaucucaucucagauuaaaauccuaagugccuucucuguccuuagugaaccccaggugcacccuuccucugccacuuucccccuuguuuauucuacuuuccacacuggccuccuugcugugggccagacauaucugagaccaguguggcuucagggcuuuugcacauacgauuuuccuuuucuggaacacucucucuuccuugcacaucugccuggcucucugcucagaugucaacucucagagaggccuuuucugaccacucccucuaaaagaguuucccccgccccucauuucccaucauuaucuguaguacugaugacuugcagauguuauuacaaauuugguuauuuuuugcauccuccagcaaaauguaagccaagugaagaaugagguaucguuuuguucaucaaggaauccacagaaaccagaacauucuguagcaggugaucacuaaauauuuguuaaacuacaaagagccauuuuagguuagaaauaagguauagcugacagaauucuaagccugauguuucuuaugagccugcucaauuggcccugaaaccacuucccagaaagcucuagauauguucugaauaaugggagcaaugcuggaccaguguuugagguuccaaagugaauacaugaaagugaaaaugaagcuacaugugacuggaugaacccucuugcauugguuuaaaaauccuauucaucaugauuaguucacgcucucuuuuucuugcuuugcucccaggcaccagacaagucauuccaaauauggggucuugguaccagucagaacgagguucccaucuguggugguuuaaaaacaaaaugaccuuguuccuugauauucuuuccauugaaagaugggauauaugacuuuuccuugagucugugcaggcuugugacugcuuuaugcagcuccugccugguuuucugagcauaauuauuccagggaaagcacugggacugucaagccgaagaggucccuggugggugcucuuguuuguagccucagcugagcucccagcaucagccagcaauccugagagccgccaucuuggaugcacauguaggcccucugcaccuucaaaaguccgcggcccggcugacaucugacuacaagggcauggaaaacuccaagugagaagcacccagccaagcccaucccaaauucuugaccaaaaaaaucaugcaacaugaaacaauuauuguuuuacaacacuaaguuuugcaguaaauauguaauccacaauaguaaugagaaccccaccuuaacucuuccuccuauguacuaggcaaucaugagaaaaaccuuuuuuuuuuaacacucugggcaucagguuucucaucuguaaguuaagagugauaacauauauugaugugguuguuguuucaagcaaaagcaaguuuuguccaaaaccuagcacgcuucuccacacaaacaauauuuucucaaacuuaagaugcuuucauuuuacgacucacccuuaauucauguguacuaagaaagaaacaaaugcuuccaauuaaacuacugcauuacuguaugccacugguuguaggacacauaccuguuuuggagauauugaaauuugaaaagauguaugucuuagcaucuuugauuuaaagacugauuaacauaagcaccuagcuaagcccaggcaaaaaacgagauccccaagauuagaguuugugaaguguaagaggagacauuaaagcaaauguaccuuuguaugaaugucuccaaucugccauucuguuuuauacgauaaaacacaaagauuaguacagacauccuugugguccagacaaaaagugccuuccuugucagccgucgaaugguuagaauucaaaugacaucaugucacaguuauugagccaaaauguauuuugcaaaagggaugaagucagaucccuaaaucuggcugugagucgauaaguuguuuucagcaguaacucaucccuaguaauaguaauaguccaagccccauuucucuuugguucuugagaauuuccuuuuuuuaggacacgaacuaguaguuccuugaguauuccagccaaugggcagaggggggucuaggcagugggcaaaaggaugacacagggagacccagggccacaucuagggggacagaagcauaagcaucagcuuccuagcaggcuugacguuaaguguucacauggagcucugcaguuaguacggcugccccaagugcuacuaugcuaauccucaugugaaaggcaaaccuacuucaggacaagagggguuaagucucuuccccaaagucacacagcuugauuaugucaacuuagaccaucagacaccagagccuguacuuauacccacagcacuguacuaacaagaauguuugcaaagacacagaaauagucauaaaaggcuccaacaaacccaaagcucacaccacaacagcugucuugucagcuuuaccuaaacagagaauuucuuuucauccauaccaucuuacuuuguucaguauggguuuuccgauaaggauguucuuaccuccuucucuuucugguaaaaaccaaaacauccuucaagacccagcucaaauggaacagcuuaacuccuuguuccuacagggugggcccuggcugcguuuggcuccagcauauugucccuugggcugcauggcuggcucuccuggaauuguugggagugguuucuguugauuacuccuauuggacuggaaguuucuugagguucuggaguuagacugaguuugacucuaugauuuacagcuauguccuuggacaaaugucuuagcuuuccugagcuuuaauuuucuuaucuacuucccagaauugucauaaugcagcgucuuugcuuagguugcacgaucagugcccaauauuguuuacuguuaugugauuggcaauaguggagcaucuuugugcauuaucucagucuucaauagcccucugagguagguucuuucacuaccaccccuuuuucacagaugaggaaacugaggugaaacuucuugcccaugguuccacagcucagaugugacaaaacugggcuguaaucguaccuuuuuaaacucccuucccucgauggaaucccagugagagccuccaugaacugauugccaaggauguuuugucauguaucagucucuuuagaugucuuuuaauucagaucuuaauuuuccacucauuugugccuaggugacauuauccuaguuugccggaaaaugaugcugcaaccagcuuugucucuguaaacugugguuguuuacacauuucaggcaucuggcaauaaugugucccucccccaggcuguuaugcguggcagauuauuaacaccacaacugccguuuuaguuaaugaaucaaaaacauggaucacucccauuauuggccuugaaaagcucaagcaaacucuuaagcauaacuaagggcccacaucguuuuccaacccaaagaaugccagggcuaugccuccuauuuacuuugaaugauuggcucaccaaaguuuuugcugguuuucuguguuguugcaaucauggaaacccucuaacucugcugacauuccugaugugcuacuuuuuuuuuuuuuuuuuuuuuuugagauggagucucguucugucucccaggcuggagugcaguggagcaaucucggcucacugcaaccuccaccuuccaccucccagguucaagcauucuccugccucagcuucccgaguagcugggauugcagacacgugccaccacacccggcuauuuuuuguguuuuuagcagagaugggguuucaccauguuguccaggcuggucucaaacuccugaccucaagugaucugcccaccucggccuccuaaagugcugggauuacagguguaagccaccgugcccagccgcuacuuguuuuuuuucccucaagacauaacaguuaaauuccccaaacaaaacaaguuugauuuuauuugccagaaaauauucugaguaagcagaacaagauccauuacuaaaucaagccucaccccauaccugggcagcccccucagcaaguuaggugccuuguuuggcagaaugguggaggucuuccugucuaagcauggaucucgugaaagcccaugggcucagcgcaggggccaagguuaauucacggucccagcucguggcgcagacuugccagugaaagacacacucagggcuucagcaauguccuuggcugcugguuuaccuucacuuucagcagcagcagagggguuggucauaccugagguggagaaagauguuggggcagggguugggggauggagguaauauuauugaaagccuacuuugugccaagcacugagcgagguuccccauuugcagguauucggggauugucuaccuacuuacuauuguuaacuucuaguuucuuuccauuguccucagaguagaugcugugcacgacuucaguccuuugaaagugguugagguuauuuuauggcucaguguccugugacgaauguugcaugugcaccugaaaagaaugcauccucugcaguuuggggauggaguguuccauaaauaucaacugugaaagguccaguacucagcugguauagacucacuguucaagaaaaacucguucuuucacuuauugccaugauuaccagauacacccacaagcaagaggcuauuuugcuaguuguguagaccagcgguuucgggagagaauguagucuucacucugcagugagcucagaggaggagagaggggaaaaguccaugugggugagaaggcacugccaggcccugaccccaggaggcaggugcugugccaacuuguccuccauguggcccaaauaagaagaaaaggccaagaacucuaaacagaucacugaggccaggggaaaauaucuugagauuugcuggagggagggaaauuuacccauggaaaugagagaaguuaugugugguaagaccccuucucaucucaagcacagccaaaacugaucugaucagagaccuacugucuuaguccauuuuggcugcuacaacagaauacuguaagacuaaguuuacuucucauaguucuagagguuuggaaguccaagaucaaggugcugacagauucugugucuggugaaggcccaguuccucguucauaaaugauugcuuuuuugcaguguccuaaugugaaggaaggggcaggagagcucucugaggucgcuuauauaaugguacuaaucucagucaugugggguccaccgucaugaccaucaccccccaauaaugguaguaaucccaaucaugaggagggcuccacugucaugaccaucacccccaaaaggccccaccucccaauaccauuacccuggagguuagaauuucagcauaugaauuuugggaggacacaaauguucagucuauaacugggaugcaaggauucaacauugccccugcccuucuggaauuugcaggccaugagggcauacagauaauuaaacacacaauuacgcauagcaggguguggggggggucauaauuggaaaaguauguugagauuagaagaaaaucauucuuucuuuguuucucccucucucuuucucuguuacacauauuugcagacaaaccaggaggauuuccacagggaagcugaaaggggaaaacaacaggauccuaucuauaagccuauuagaaaccguuagagaaugauuucaugaagaguaaggaacaugugaguucgcuagggccucacccacuaggaucaggaaugcuuggaacguuuuuuguaccauaaacccuuuuggcaaacuagagaagcuauggacaucuuuucagaauaaugcuuuuaaaaugcauauaacaaaauccucagauuuuauuucaaaggauugcaaagaaaaccaauuguguugaauucaguucuaugcauaggccuuccccuccaccucacucaaucuaugggauggggaccugaauguuuauggacuaguggggagauacuuugcagagaaagaaaaaagucuuucccagggccagcaguuuucuauauuuauggaauucguuaccuccaaggagggccugacuggaguuuuuacuuucaaauagguuuggguaacuccacgcaagacugucuuuaccugccuuuggugagcuuaugguuucuguuucuuuucucaaaagacugcgugcccaaacuuccagaaagcagacauauugaugcaguugaauugcccaccuuuuacauuucccuuauuguuccauggauggaguauaaugaauuggcaauggagggaagagaaaaguuaaaggcugacuuugauggggggcuaaguccucagagaacguguuucuuagggagccuuuugucacuuguuaggcuuuggaauccucuuugggaguucaccaaacagagagugcagcccaggaggauggggggcugaggagaagucagagguucagggaggacccaggucauauucugggagguggcaggggcugugggucccaugagaucagacacuaguuaugaaggaacuacuggcagacacuuugcucauuaaugucaccccccaugcucauuaccacccuaggaccugggguccccacuauaccacugagacaacaguugcugagcauaguuaauccaagaucauccagugagcagcaguggagcuaagaucugauuccacauaaucuaggcuccuaaauauuuuuuuuucuauugccacaugcccagcgaccuuccugcggcauggaggucgugggugcagcuuguggagucagguugccagguuucgagucuagcuccucuauuuaaauagcuugaugaucccaggucaguuccugauccuccucuguaaaaugggaauaauuuuuucaccuuucccacagacuuuccugggggauuaaagggagaauguaucuaaagcucugagcacacgugccuagcaugugagugcuccgugaauguuaguuacugugauuauuuuuagcccagcaggacagggaggaguguuaggucccugggggcgaucacuccucuguuuacuccucggacugucccggccuggcaggcguucaugaguuuguuucuccugucccaagguugcccuggugcucugcaguggcagggcugagaugauuauacaaccugcacuccaggccaaguccgguacucgucccagcugucggcuaagccugcacugcuaugggugagggaaucacuccucuccagcuggcuuucucacgcuggagaagccugaccuuuauucagaaucauccuccagcgcccacaucacacagcacccuggcucacccgcuccucccccaacauguccuuuacauucucaucuggggagauaauggggcuccaguguccccaagacagcugcuuuuccuuucuucuucauucgugauaacucucuguucuccagaagugcugcuuagacucuagagggauacaugaaagagcgguaaggugacaaagaaaacagcuggguucaauccuggcugcauacucagugugggacagaacaagugcucuaccuuuaaaguuacuuaucaggauaauauacaguauuucauguauauauacauacauuuauaagauguaauaaauuuuuguaaaguugugaggaugguaaaagcuuagcccagugccuggcacaucauaagcaccccacaggugucagcuggcaucauuagcagucauaggaaaacucaggguaugucuccauuccaggcuuuguggcauaugggucucaguguccccauuguccugugggguugcugagagcuguccucauaagauugugagggugggaauaugagaggaguuugagaaagcugaagccuaacaggucaacaaccggacugagcucuccccuucuccccugggccgugugcaagcuuugggccugguggugacaccuaccucuccaucccaccuggcgggcccagcugacccucccagugcaggggcugggaagcugcaaagaacccuuaggcucagaauuuccugcugucagccagccccccugcuguuucccauuuauuuuucucuaucuccuuuuccaucuccccuuccagcaccuucugaaacucccuaguccuguacuaccaacacaccaaccuuugcuuaauugucacgucagacagauggcucagguguccccagcucccugaagcucuucccuuccccuccccugggcaggggccucaggccuuccucugacugauccagcccaccucccaguguccauacuauuagguuggugcaaaaguaauugcaguuuuugccauuaccuuuaauggcagccccggcacccuggccauuggccccuggacagcuguucacucccuucucaggcuugcuggggacacauacgucaugcccugaagcguuccggaaccgguaggggcugccuguccugccacucacccacuccagcuaggaacuccucagugggcaagauaauugagcccagguugaauuaugacguucacagguaagaagcaggguucagaugagggcugggucuacagccaagugugggagagcuggugaaagccuugagagaggcagagacuggccagccucacccugcauucccaauccccuccucuuugucaaaaucuuacucucagcauggugccauuaccuuuaauggcaaaaacugcaauuauuuuugcaccaaccuaaauacuuuugcaccgccaggagaucuccugccaucuauucagucuuccaucccgcucucuggggcuuuauucuuucuguucuuucugcuucuugcugcgcacggugcccccaccuccuguggcugaaaugcugcccucucccauccugcccagaugccucuuccaccaagcuuuucugacugccgcaucuggaauaauauauauaugcaacuuuaagaucugucuuucuuuuuugaucuuuucauauuuuuuuauuucuauuuugguuauuugcugccauguuccuuaaggaaaagauucuacccucacaaugccuaagcagcuuggaucacggaaagagcuugggcuucucuccccacuucuguuuucucaucaguaaaauggggauaagcauuguaaauaaccaacccucuuaagaguugcuguaaggcuuggccaggagcaguggcucaugccuauaaugccagcacuuugggaggccgaggugggcggaucaccugaggucaggaguucgagaccagccuggcaaacauggugaaaccccgucaauacuaaaaauaaaaaauuagccaggcuugguggcagcugccuguaaucccagcuacucaggaggcugaggcaggagaaucucuugaacaugggaggcggagguugcagugaacugagaucgcgccauugcccuccagccugggggacaagagcaagacuuugucuuaaaaaauaaaaaauaaaaagaguugcuauaaggcuugaaagaggccuuuggcacgacuaucaccucccucagggcucugcacauuuuuuucuuuuuuugagacagagucuagcucugucacccaggcuggagcgcuacagcacagucucggcucacugcaaccuccgccucccagguucaagcgauuccucugccucagccuccugaguggcugggauuacaggugcgcgccaccacgcccaguuaauuuuuguauuuuuaguagagacaggguuucaccauauuggccaggguggucucaaacuccugaccucgugaucugcccgccucagcuuccuaaagugcugggauuacaggcgugagccaccgugccgugccagcucugcaaggaaccaaugaauaagugauugaaugauugaauggauaaaggccuuuacuguucuacuugaggcugucaaaauggauagguuuuugcuacaguccucaccaccccucuuaaugccaugucagcagcauggcauauggaccugcaaacccaggcucugcaucagguugccaggucaccuaaaugacagcugugaauucuucuaaaacaggggucagcaaacuaugauccgcaaguuaaauccaguccacagccuguuuuuguacagcuugcacauuaaggauuuuugcuacuuuuuaaaugauuuuuacauagaaaauguuacauuuuuaaauguaaauguaaauuaaaugcaaauauaaacauuuacauuuuuagauguuuaaauaaaaaaaucacaagaaauguaauuuuauagcaugaaaauuauaggaaauucuaucauuagcacuuguaaauaaaguuuuauuggcacacaacuaugcuuguucauuuauguauugucuacauaagcuauaguuggugugugcagagcuuucacucaaugauggcacaguugaguaguuucaacagagaugggauggcccagaaaaccaaaauauuuacuacuuggcccauuacaaaaaaauuuugugcugauccuuggucugugaaacaggagcaaugaugaauaccuacccaucguguguggguaaaauguuaaagugcuugauaucaagugggcacucaagaaaaguuuuuccuucuacucucuauuccucccugucuucauucccuuucacagagggcucuuuuauuucaggguccaagccaugaaaaccauagaaaaaggaugacagggagaaucugaaccaguaccaugcccauaccaggccucaaaacagcagagcuguguuugucaucuccaccuuccugcuccagagccuccccagaccucucagucuaugggacuguugguggacaggcagaguuuaaauccauugcgucuuuugcgucucgugguuccagauguggauggggccagcccugcaugaccagccccggagagcaacuucuauuagguuuaucagaggcuggacagcguccacugcaucuuuucuugcuuugggcguuuuaaaacuugggcugcuguugcauaggagauugcagcugcaguuuggcuuggcuuaagauaagaugcagccucugggcugaaauugaggguccugauucugcuuugagagaugguauggcauccugaaaagaaccgagauuuggaaucugggcuggaaucccagcugugccccucacaaguucuaggauucguaccuuuugcuuuuucugaaaagugggggugaugcuuuuucuuggggugagggugggguguuggcaggguucuccaccacguaagcuugagggagcaggguuuugucuuuuucugcacugaagcccagcuucuagaacagugccuggcugcgggugagcacucggcaaauaccugccuuagaaaggugauuaaaagauguagaguuccuggcacacgauagaaucucauuaaguggucacauugccauugucuguacucaaccaggaauuggcacacuauggcccacagccuguuuuuguaaauaaaguuuuauuggaacacagcuaugcccauuucuuuacauauugucugugacugcuuuccugcuauagugggggaguggaaucgugagacagaccugugcccugccgagccuaaaauauauauugucuggcucuuuacagcaaaacuuugugguuucugcucugaaugucaggguaacccugucugaggaugaucacggauuucauuuucccuuguuuguuagcguugcggucagccgcaaguugaaaacaaggaaccagcuugagguacgcauucucgaugcccuuucuaagauacuuauggagacuuuucuuuuccacuccaauucugccaugcucuuucggcauggucagagcuggcuucucugugcccuccagaucucauauguaagaugguguuacuuucauuucuuuguaaaaagaaacucaacccaccugucaauugcugguauauucauuagggauuaaccauggguccugcaacaaguaggcucagagcacagaggacaugagucaaaauaaaaaaagauaaccaaccagguacaacugugcuuuguaauauuauagaauagaaugcugaugggguucaggaaggaguccacuguguuuguggggcacaggauacauaagauucugauuuacuuuuccaucauggugaauggcaugaucuuagacaccuuaguuagcuuuauucaaacucaguuuuucaaucuguaaaauggcaauguucacuauauguugucacucucuuugaugggcagggcccacaguuaggagccucucgaggccuugguaucuagaauggugaaggagagcuuucuggaaugagugaacaugugucaaaugcucugacguccucauuugaagggggcccuguccccuguaccagcugagcaaugcgagugggccacuguccugcuaccauuuuauagucagcggaucuuuuuuuuuuucucuuucucuccagaaggacagaauaacgggcucccagauucacaagccccaccaagaggaucaccccaggaacgcuuggaggcugaggaguucacugaggcuacugcaucuugagacucaggaugaagacccagcuuggggcugucaaaggugcgaccugccagcugagaccuccaggggucgagcccaggccccuuugccuuguucauggcuuaggccagugcuuagcauauaguaaacaacuuguaaauguuuauuagaggauguauggugggucaucccuucugaauggcacacaguccauugucauuguccucagaggcuccagccucaggugcuucuuaaacugcgaugggaaugauggcagcagaugggcccagggcucagcaugagagcucacagcaggcugugcuccaccccacccaggcccccagucuugccauguuuccucugccuccccaggcuggccuagaaacugcuuccaacugaaaccagccaaaugccugccccuaaccacaccuacaacucuaggguuaccuuuagucuagaucagggguccuuaaacuguagccuuugcuggguacaguggcucacaccuguaaucccagaacuuugggaggccaaggcggguggaucacuugaggucagaaguucgagaccagccuggccaacauggcgaaaccccaucucuacuaaaaauacaaaaauuauccaggcaugguagcgcacaucuguaaucccaccugcuuggaaggcugaggcaggagaaucacuugaaccuaggagguggagguugcagggagcugagauagcgccacugaaccuccagccugggcgacagagugagacuacuucucaaaacaaacaaacaaacaaaaacuaagccuuugggcuaaaucuggugaguguucugugcuuguaagaacucugaguuaagaauaauuuuuaugucacuaaaggguugaagaauacaaaaagaauauucagcagagaccaucuggcuagcaaagccuaaaauauugacccucuggcccuuuacagaaaaagugugccagucgcaggauuaggcaguacugaccacaccccaggcucccugugaaaauuucaaccacacagacucauuuccuuucucuuaucaacacugaggcaggugugauuaucauuccuuguaaacauggagaaacuaaggcauggagagguuuaacucguuuaccugagaaucuauuaaguaacagagccaggguucaaacccaggcaguccagcuucagaguccauacuuccuagcugcacucugggccuucagcguagggaugagcuucagacaagaacuccccucuuaauuucugcccucuccugccccacagccaguggacaggcauuuugcaccccagccugcccccagccagcuccuacucagagauuuccugcagggacuuagacgaggcucugggaccacccuccuuuucugcccuacccggcaccuggaacucugcuugauccugcucccucugaggcuggacacaucuccaugagccaggccugaaguucuuccccucucuggaccucggggccucccuuccuaggggcaguuccuguguccccucuacucucugccuuccccccgccccaccauguccuuggggcuggaauuguagugugcagccuugggaacagggcugggcucagggguugggaacagaggcccagggcucuggcugacccucucucauccccaggaggagaagcugcuguguuuagagugucacaaagaacagugcuggaggcuucagaaaucucgggagauucugaacuucuaggcggagcagaugggauggugccucugugaucaacaggccuggcagaggggugcaggagggggugcgaauggaaagacagcugccaaggggaacggagagcuuuucaagucacccuuguccccuccccaccccaccaucagggcuaagacuaaaccucaccauccgguugcggccucucggcccuggggauggagauuaguacauguagaguggagguagagaggccauguucugguugugugaccuugcacagguuacauaacauucugugccucacuuuacuuguuuuuaaaaugaugaagaugauaacuaccuggcagcgugucuuauauuagagauaauaugguuccuggcacuuuguaagcacucggugugaaauugucuucugcugcuccucuucaucaguccaccccuccucugcagagguuuccuccaugcugagcaagcuggcagcaccuaaauuccuguuagugcacccuagugccuucugcccaggccucgggacccccagggauccuggccccuguggacagggacuuuugugcccuccuucucuguuaccagcaagagugaguccugcacugaauuuccaugggaucauugcuugcuaacauuugugagugaguuacugucuagaaagcagcuuuucuggacuuuucccauuaauuucacgaaaguuaucuuccuuugcccuuacuacauguucauuacuacagguucauuaccccauuuuacagacaauuaauacuccgagaugaagugacucaccaggggucgccuagcuaagcaguggagagugggccucccacccaggccuucucacucugacuccuguucuccacgucauugcauauggcgacaugcgggucacgugaucacacaucccuagccgauauggaauugugagcuucuccugggucuuccgaggaaggaugcuuucaggagugcuuuggaaugaaggcaguggaggccaagagaccucuaggucaaagccaggcgggaggguccucucaggggcccagccgacaaguugcauuucucccucagaggccugaagaggcagaacaccccagaggagccuggggccaccacccagcaucacugugggaaaacggcagcaggaaauguccucucgccugcgugcuccaccucgguccacgccuucccuccuucuggaagccuugccugaccacuggccugccccuucuaugggaaucacuacugaccuugcagcuuauuauagacuuauauguaugcagaaauauaauuuuaauuacuuuuauauugcuccgagagugauaccaaaucaugauagaaaauuuaaauaaacaaaauagccaaauuaauaccaguaaucaccccagucaaauauacccagcucacauuuugauguaaaaucuuccaguacaguuucuauguacauauauauauuuuuaggaaggagauuauauuuuacaugcuguuuucuagaacguucuuuuaaaacuguaucauaaacaucuugccuuauaauucaauagucuucuacaacaaacuuugcuaaugaauuuuuuuuuuuaucauggucacuguuguguuaugugcaucuuaguuuagcaucuucaguuacguuauaagugucuuaagcccucagguuccccagccagccgcaggguggguuuguucauugauugauggcuguaugggguggaggagggaaguagaaagugagugagauuuggguaagcaaaccuggguuuaaaugcugagucugcaaauuccauaaauucuccuucccucccucccucccaaccuuccucccuccaucccucccucccuuccuuccuuccuuccuuccuucuuuccucccucccuuccuucccuccuucccgaaacaaaugccuuguuagauauuuuauaucuuuauguaaauaugcacucauuuaaauaucaugugggcaccuccucugaguggcccugagcuugguucuuggauguagcacugcacaagagaaaccaggucucugcucuccuggagaucgaugcauccaguguggggcacagacucaaaucaaggcaauagaccaaaaccuaagcaggccacuaacuuguguuuaaguacaacauccacauggacgggaaugagaauuacagggggagcacacuugagcugcgguccagcaaagcccucucuggggaggugacagucaagcccagaccuaaaggaaccugcugcagggaggaugggaaagauguucugacaaaggccuugagauggggaaggcuaugguuuagaugaggaacuucaguuggucauccccucucucauccauccuguugaaaccaccuuugcaaaaggugugucaaugagaaaauuauaacaguaagcuaagccaacccaaccuccaucuugccuuucucuuaauuauuccugggcuauugggucaagcuaacuuuggaagacauuuaggcuacaguuuaaaugauaauaggccuugcccaaaacucagccacuuuuguaaagcuguuagggggccaucagggugcggggaggagaagagccugaauccuacuaagcugcagacauuauuccgaagguuauaagauaugcaacuuucccaauugcuccugugaauaacacuacuauuacagauuggccuuuugaaauaucuuuccagguuuuuugcaugucugacacccaugacuccaccuggaccuuauggcuccacccagaagcaauucagcccaacaggaggacagcuucaacccauuacgauuucaucucugccccaaccacucagcagcaagcaccuguuaccuguccacccccaccccuucccccaaacugccuuugaaaaaucccuaaccuaugagcuuugaauaagaugaguacgaacuucaucgcccacguggcguggccggccucgugucuauuaaauucuuuuucuacua

SEQ ID NO: 192970 - RNA, 306721 nt, Homo sapiens
uaguagaaaaagaauuuaauagacacgaggccggccacgccacgugggcgaugaaguucguacucaucuuauucaaagcucauagguuagggauuuuucaaaggcaguuugggggaagggguggggguggacagguaacaggugcuugcugcugagugguuggggcagagaugaaaucguaauggguugaagcuguccuccuguugggcugaauugcuucuggguggagccauaagguccagguggagucaugggugucagacaugcaaaaaaccuggaaagauauuucaaaaggccaaucuguaauaguaguguuauucacaggagcaauugggaaaguugcauaucuuauaaccuucggaauaaugucugcagcuuaguaggauucaggcucuucuccuccccgcacccugauggcccccuaacagcuuuacaaaaguggcugaguuuugggcaaggccuauuaucauuuaaacuguagccuaaaugucuuccaaaguuagcuugacccaauagcccaggaauaauuaagagaaaggcaagauggagguuggguuggcuuagcuuacuguuauaauuuucucauugacacaccuuuugcaaaggugguuucaacaggauggaugagagaggggaugaccaacugaaguuccucaucuaaaccauagccuuccccaucucaaggccuuugucagaacaucuuucccauccucccugcagcagguuccuuuaggucugggcuugacugucaccuccccagagagggcuuugcuggaccgcagcucaagugugcucccccuguaauucucauucccguccauguggauguuguacuuaaacacaaguuaguggccugcuuagguuuuggucuauugccuugauuugagucugugccccacacuggaugcaucgaucuccaggagagcagagaccugguuucucuugugcagugcuacauccaagaaccaagcucagggccacucagaggaggugcccacaugauauuuaaaugagugcauauuuacauaaagauauaaaauaucuaacaaggcauuuguuucgggaaggagggaaggaagggagggaggaaagaaggaaggaaggaaggaaggaagggagggagggauggagggaggaagguugggagggagggagggaaggagaauuuauggaauuugcagacucagcauuuaaacccagguuugcuuacccaaaucucacucacuuucuacuucccuccuccaccccauacagccaucaaucaaugaacaaacccacccugcggcuggcuggggaaccugagggcuuaagacacuuauaacguaacugaagaugcuaaacuaagaugcacauaacacaacagugaccaugauaaaaaaaaaaauucauuagcaaaguuuguuguagaagacuauugaauuauaaggcaagauguuuaugauacaguuuuaaaagaacguucuagaaaacagcauguaaaauauaaucuccuuccuaaaaauauauauauguacauagaaacuguacuggaagauuuuacaucaaaaugugagcuggguauauuugacuggggugauuacugguauuaauuuggcuauuuuguuuauuuaaauuuucuaucaugauuugguaucacucucggagcaauauaaaaguaauuaaaauuauauuucugcauacauauaagucuauaauaagcugcaaggucaguagugauucccauagaaggggcaggccaguggucaggcaaggcuuccagaaggagggaaggcguggaccgagguggagcacgcaggcgagaggacauuuccugcugccguuuucccacagugaugcugggugguggccccaggcuccucugggguguucugccucuucaggccucugagggagaaaugcaacuugucggcugggccccugagaggacccucccgccuggcuuugaccuagaggucucuuggccuccacugccuucauuccaaagcacuccugaaagcauccuuccucggaagacccaggagaagcucacaauuccauaucggcuagggaugugugaucacgugacccgcaugucgccauaugcaaugacguggagaacaggagucagagugagaaggccugggugggaggcccacucuccacugcuuagcuaggcgaccccuggugagucacuucaucucggaguauuaauugucuguaaaaugggguaaugaaccuguaguaaugaacauguaguaagggcaaaggaagauaacuuucgugaaauuaaugggaaaaguccagaaaagcugcuuucuagacaguaacucacucacaaauguuagcaagcaaugaucccauggaaauucagugcaggacucacucuugcugguaacagagaaggagggcacaaaagucccuguccacaggggccaggaucccugggggucccgaggccugggcagaaggcacuagggugcacuaacaggaauuuaggugcugccagcuugcucagcauggaggaaaccucugcagaggagggguggacugaugaagaggagcagcagaagacaauuucacaccgagugcuuacaaagugccaggaaccauauuaucucuaauauaagacacgcugccagguaguuaucaucuucaucauuuuaaaaacaaguaaagugaggcacagaauguuauguaaccugugcaaggucacacaaccagaacauggccucucuaccuccacucuacauguacuaaucuccauccccagggccgagaggccgcaaccggauggugagguuuagucuuagcccugauggugggguggggaggggacaagggugacuugaaaagcucuccguuccccuuggcagcugucuuuccauucgcacccccuccugcaccccucugccaggccuguugaucacagaggcaccaucccaucugcuccgccuagaaguucagaaucucccgagauuucugaagccuccagcacuguucuuugugacacucuaaacacagcagcuucuccuccuggggaugagagagggucagccagagcccugggccucuguucccaaccccugagcccagcccuguucccaaggcugcacacuacaauuccagccccaaggacaugguggggcggggggaaggcagagaguagaggggacacaggaacugccccuaggaagggaggccccgagguccagagaggggaagaacuucaggccuggcucauggagauguguccagccucagagggagcaggaucaagcagaguuccaggugccggguagggcagaaaaggaggguggucccagagccucgucuaagucccugcaggaaaucucugaguaggagcuggcugggggcaggcuggggugcaaaaugccuguccacuggcuguggggcaggagagggcagaaauuaagaggggaguucuugucugaagcucaucccuacgcugaaggcccagagugcagcuaggaaguauggacucugaagcuggacugccuggguuugaacccuggcucuguuacuuaauagauucucagguaaacgaguuaaaccucuccaugccuuaguuucuccauguuuacaaggaaugauaaucacaccugccucaguguugauaagagaaaggaaaugagucugugugguugaaauuuucacagggagccugggguguggucaguacugccuaauccugcgacuggcacacuuuuucuguaaagggccagagggucaauauuuuaggcuuugcuagccagauggucucugcugaauauucuuuuuguauucuucaacccuuuagugacauaaaaauuauucuuaacucagaguucuuacaagcacagaacacucaccagauuuagcccaaaggcuuaguuuuuguuuguuuguuuguuuugagaaguagucucacucugucgcccaggcuggagguucaguggcgcuaucucagcucccugcaaccuccaccuccuagguucaagugauucuccugccucagccuuccaagcaggugggauuacagaugugcgcuaccaugccuggauaauuuuuguauuuuuaguagagaugggguuucgccauguuggccaggcuggucucgaacuucugaccucaagugauccacccgccuuggccucccaaaguucugggauuacaggugugagccacuguacccagcaaaggcuacaguuuaaggaccccugaucuagacuaaagguaacccuagaguuguaggugugguuaggggcaggcauuuggcugguuucaguuggaagcaguuucuaggccagccuggggaggcagaggaaacauggcaagacugggggccugggugggguggagcacagccugcugugagcucucaugcugagcccugggcccaucugcugccaucauucccaucgcaguuuaagaagcaccugaggcuggagccucugaggacaaugacaauggacugugugccauucagaagggaugacccaccauacauccucuaauaaacauuuacaaguuguuuacuauaugcuaagcacuggccuaagccaugaacaaggcaaaggggccugggcucgaccccuggaggucucagcuggcaggucgcaccuuugacagccccaagcugggucuucauccugagucucaagaugcaguagccucagugaacuccucagccuccaagcguuccuggggugauccucuugguggggcuugugaaucugggagcccguuauucuguccuucuggagagaaagagaaaaaaaaaaagauccgcugacuauaaaaugguagcaggacaguggcccacucgcauugcucagcugguacaggggacagggcccccuucaaaugaggacgucagagcauuugacacauguucacucauuccagaaagcucuccuucaccauucuagauaccaaggccucgagaggcuccuaacugugggcccugcccaucaaagagagugacaacauauagugaacauugccauuuuacagauugaaaaacugaguuugaauaaagcuaacuaaggugucuaagaucaugccauucaccaugauggaaaaguaaaucagaaucuuauguauccugugccccacaaacacaguggacuccuuccugaaccccaucagcauucuauucuauaauauuacaaagcacaguuguaccugguugguuaucuuuuuuuauuuugacucauguccucugugcucugagccuacuuguugcaggacccaugguuaaucccuaaugaauauaccagcaauugacagguggguugaguuucuuuuuacaaagaaaugaaaguaacaccaucuuacauaugagaucuggagggcacagagaagccagcucugaccaugccgaaagagcauggcagaauuggaguggaaaagaaaagucuccauaaguaucuuagaaagggcaucgagaaugcguaccucaagcugguuccuuguuuucaacuugcggcugaccgcaacgcuaacaaacaagggaaaaugaaauccgugaucauccucagacaggguuacccugacauucagagcagaaaccacaaaguuuugcuguaaagagccagacaauauauauuuuaggcucggcagggcacaggucugucucacgauuccacucccccacuauagcaggaaagcagucacagacaauauguaaagaaaugggcauagcuguguuccaauaaaacuuuauuuacaaaaacaggcugugggccauagugugccaauuccugguugaguacagacaauggcaaugugaccacuuaaugagauucuaucgugugccaggaacucuacaucuuuuaaucaccuuucuaaggcagguauuugccgagugcucacccgcagccaggcacuguucuagaagcugggcuucagugcagaaaaagacaaaacccugcucccucaagcuuacgugguggagaacccugccaacaccccacccucaccccaagaaaaagcaucacccccacuuuucagaaaaagcaaaagguacgaauccuagaacuugugaggggcacagcugggauuccagcccagauuccaaaucucgguucuuuucaggaugccauaccaucucucaaagcagaaucaggacccucaauuucagcccagaggcugcaucuuaucuuaagccaagccaaacugcagcugcaaucuccuaugcaacagcagcccaaguuuuaaaacgcccaaagcaagaaaagaugcaguggacgcuguccagccucugauaaaccuaauagaaguugcucuccggggcuggucaugcagggcuggccccauccacaucuggaaccacgagacgcaaaagacgcaauggauuuaaacucugccuguccaccaacagucccauagacugagaggucuggggaggcucuggagcaggaagguggagaugacaaacacagcucugcuguuuugaggccugguaugggcaugguacugguucagauucucccugucauccuuuuucuaugguuuucauggcuuggacccugaaauaaaagagcccucugugaaagggaaugaagacagggaggaauagagaguagaaggaaaaacuuuucuugagugcccacuugauaucaagcacuuuaacauuuuacccacacacgauggguagguauucaucauugcuccuguuucacagaccaaggaucagcacaaaauuuuuuuguaaugggccaaguaguaaauauuuugguuuucugggccaucccaucucuguugaaacuacucaacugugccaucauugagugaaagcucugcacacaccaacuauagcuuauguagacaauacauaaaugaacaagcauaguugugugccaauaaaacuuuauuuacaagugcuaaugauagaauuuccuauaauuuucaugcuauaaaauuacauuucuugugauuuuuuuauuuaaacaucuaaaaauguaaauguuuauauuugcauuuaauuuacauuuacauuuaaaaauguaacauuuucuauguaaaaaucauuuaaaaaguagcaaaaauccuuaaugugcaagcuguacaaaaacaggcuguggacuggauuuaacuugcggaucauaguuugcugaccccuguuuuagaagaauucacagcugucauuuaggugaccuggcaaccugaugcagagccuggguuugcagguccauaugccaugcugcugacauggcauuaagagggguggugaggacuguagcaaaaaccuauccauuuugacagccucaaguagaacaguaaaggccuuuauccauucaaucauucaaucacuuauucauugguuccuugcagagcuggcacggcacgguggcucacgccuguaaucccagcacuuuaggaagcugaggcgggcagaucacgaggucaggaguuugagaccacccuggccaauauggugaaacccugucucuacuaaaaauacaaaaauuaacugggcgugguggcgcgcaccuguaaucccagccacucaggaggcugaggcagaggaaucgcuugaaccugggaggcggagguugcagugagccgagacugugcuguagcgcuccagccugggugacagagcuagacucugucucaaaaaaagaaaaaaaugugcagagcccugagggaggugauagucgugccaaaggccucuuucaagccuuauagcaacucuuuuuauuuuuuauuuuuuaagacaaagucuugcucuugucccccaggcuggagggcaauggcgcgaucucaguucacugcaaccuccgccucccauguucaagagauucuccugccucagccuccugaguagcugggauuacaggcagcugccaccaagccuggcuaauuuuuuauuuuuaguauugacgggguuucaccauguuugccaggcuggucucgaacuccugaccucaggugauccgcccaccucggccucccaaagugcuggcauuauaggcaugagccacugcuccuggccaagccuuacagcaacucuuaagaggguugguuauuuacaaugcuuauccccauuuuacugaugagaaaacagaaguggggagagaagcccaagcucuuuccgugauccaagcugcuuaggcauugugaggguagaaucuuuuccuuaaggaacauggcagcaaauaaccaaaauagaaauaaaaaaauaugaaaagaucaaaaaagaaagacagaucuuaaaguugcauauauauauuauuccagaugcggcagucagaaaagcuugguggaagaggcaucugggcaggaugggagagggcagcauuucagccacaggaggugggggcaccgugcgcagcaagaagcagaaagaacagaaagaauaaagccccagagagcgggauggaagacugaauagauggcaggagaucuccuggcggugcaaaaguauuuagguuggugcaaaaauaauugcaguuuuugccauuaaagguaauggcaccaugcugagaguaagauuuugacaaagaggaggggauugggaaugcagggugaggcuggccagucucugccucucucaaggcuuucaccagcucucccacacuuggcuguagacccagcccucaucugaacccugcuucuuaccugugaacgucauaauucaaccugggcucaauuaucuugcccacugaggaguuccuagcuggagugggugaguggcaggacaggcagccccuaccgguuccggaacgcuucagggcaugacguauguguccccagcaagccugagaagggagugaacagcuguccaggggccaauggccagggugccggggcugccauuaaagguaauggcaaaaacugcaauuacuuuugcaccaaccuaauaguauggacacugggaggugggcuggaucagucagaggaaggccugaggccccugcccaggggaggggaagggaagagcuucagggagcuggggacaccugagccaucugucugacgugacaauuaagcaaagguugguguguugguaguacaggacuagggaguuucagaaggugcuggaaggggagauggaaaaggagauagagaaaaauaaaugggaaacagcaggggggcuggcugacagcaggaaauucugagccuaaggguucuuugcagcuucccagccccugcacugggagggucagcugggcccgccaggugggauggagagguaggugucaccaccaggcccaaagcuugcacacggcccaggggagaaggggagagcucaguccgguuguugaccuguuaggcuucagcuuucucaaacuccucucauauucccacccucacaaucuuaugaggacagcucucagcaaccccacaggacaauggggacacugagacccauaugccacaaagccuggaauggagacauacccugaguuuuccuaugacugcuaaugaugccagcugacaccuguggggugcuuaugaugugccaggcacugggcuaagcuuuuaccauccucacaacuuuacaaaaauuuauuacaucuuauaaauguauguauauauacaugaaauacuguauauuauccugauaaguaacuuuaaagguagagcacuuguucugucccacacugaguaugcagccaggauugaacccagcuguuuucuuugucaccuuaccgcucuuucauguaucccucuagagucuaagcagcacuucuggagaacagagaguuaucacgaaugaagaagaaaggaaaagcagcugucuuggggacacuggagccccauuaucuccccagaugagaauguaaaggacauguugggggaggagcgggugagccagggugcugugugaugugggcgcuggaggaugauucugaauaaaggucaggcuucuccagcgugagaaagccagcuggagaggagugauucccucacccauagcagugcaggcuuagccgacagcugggacgaguaccggacuuggccuggagugcagguuguauaaucaucucagcccugccacugcagagcaccagggcaaccuugggacaggagaaacaaacucaugaacgccugccaggccgggacaguccgaggaguaaacagaggagugaucgcccccagggaccuaacacuccucccuguccugcugggcuaaaaauaaucacaguaacuaacauucacggagcacucacaugcuaggcacgugugcucagagcuuuagauacauucucccuuuaaucccccaggaaagucugugggaaaggugaaaaaauuauucccauuuuacagaggaggaucaggaacugaccugggaucaucaagcuauuuaaauagaggagcuagacucgaaaccuggcaaccugacuccacaagcugcacccacgaccuccaugccgcaggaaggucgcugggcauguggcaauagaaaaaaaaauauuuaggagccuagauuauguggaaucagaucuuagcuccacugcugcucacuggaugaucuuggauuaacuaugcucagcaacuguugucucagugguauaguggggaccccagguccuagggugguaaugagcauggggggugacauuaaugagcaaagugucugccaguaguuccuucauaacuagugucugaucucaugggacccacagccccugccaccucccagaauaugaccuggguccucccugaaccucugacuucuccucagccccccauccuccugggcugcacucucuguuuggugaacucccaaagaggauuccaaagccuaacaagugacaaaaggcucccuaagaaacacguucucugaggacuuagccccccaucaaagucagccuuuaacuuuucucuucccuccauugccaauucauuauacuccauccauggaacaauaagggaaauguaaaaggugggcaauucaacugcaucaauaugucugcuuucuggaaguuugggcacgcagucuuuugagaaaagaaacagaaaccauaagcucaccaaaggcagguaaagacagucuugcguggaguuacccaaaccuauuugaaaguaaaaacuccagucaggcccuccuuggagguaacgaauuccauaaauauagaaaacugcuggcccugggaaagacuuuuuucuuucucugcaaaguaucuccccacuaguccauaaacauucagguccccaucccauagauugagugagguggaggggaaggccuaugcauagaacugaauucaacacaauugguuuucuuugcaauccuuugaaauaaaaucugaggauuuuguuauaugcauuuuaaaagcauuauucugaaaagauguccauagcuucucuaguuugccaaaaggguuuaugguacaaaaaacguuccaagcauuccugauccuagugggugaggcccuagcgaacucacauguuccuuacucuucaugaaaucauucucuaacgguuucuaauaggcuuauagauaggauccuguuguuuuccccuuucagcuucccuguggaaauccuccugguuugucugcaaauauguguaacagagaaagagagagggagaaacaaagaaagaaugauuuucuucuaaucucaacauacuuuuccaauuaugaccccccccacacccugcuaugcguaauuguguguuuaauuaucuguaugcccucauggccugcaaauuccagaagggcaggggcaauguugaauccuugcaucccaguuauagacugaacauuuguguccucccaaaauucauaugcugaaauucuaaccuccaggguaaugguauugggagguggggccuuuugggggugauggucaugacaguggagcccuccucaugauugggauuacuaccauuauuggggggugauggucaugacgguggaccccacaugacugagauuaguaccauuauauaagcgaccucagagagcucuccugccccuuccuucacauuaggacacugcaaaaaagcaaucauuuaugaacgaggaacugggccuucaccagacacagaaucugucagcaccuugaucuuggacuuccaaaccucuagaacuaugagaaguaaacuuagucuuacaguauucuguuguagcagccaaaauggacuaagacaguaggucucugaucagaucaguuuuggcugugcuugagaugagaaggggucuuaccacacauaacuucucucauuuccauggguaaauuucccucccuccagcaaaucucaagauauuuuccccuggccucagugaucuguuuagaguucuuggccuuuucuucuuauuugggccacauggaggacaaguuggcacagcaccugccuccuggggucagggccuggcagugccuucucacccacauggacuuuuccccucucuccuccucugagcucacugcagagugaagacuacauucucucccgaaaccgcuggucuacacaacuagcaaaauagccucuugcuuguggguguaucugguaaucauggcaauaagugaaagaacgaguuuuucuugaacagugagucuauaccagcugaguacuggaccuuucacaguugauauuuauggaacacuccauccccaaacugcagaggaugcauucuuuucaggugcacaugcaacauucgucacaggacacugagccauaaaauaaccucaaccacuuucaaaggacugaagucgugcacagcaucuacucugaggacaauggaaagaaacuagaaguuaacaauaguaaguagguagacaauccccgaauaccugcaaauggggaaccucgcucagugcuuggcacaaaguaggcuuucaauaauauuaccuccaucccccaaccccugccccaacaucuuucuccaccucagguaugaccaaccccucugcugcugcugaaagugaagguaaaccagcagccaaggacauugcugaagcccugagugugucuuucacuggcaagucugcgccacgagcugggaccgugaauuaaccuuggccccugcgcugagcccaugggcuuucacgagauccaugcuuagacaggaagaccuccaccauucugccaaacaaggcaccuaacuugcugagggggcugcccagguauggggugaggcuugauuuaguaauggaucuuguucugcuuacucagaauauuuucuggcaaauaaaaucaaacuuguuuuguuuggggaauuuaacuguuaugucuugagggaaaaaaaacaaguagcggcugggcacgguggcuuacaccuguaaucccagcacuuuaggaggccgaggugggcagaucacuugaggucaggaguuugagaccagccuggacaacauggugaaaccccaucucugcuaaaaacacaaaaaauagccgggugugguggcacgugucugcaaucccagcuacucgggaagcugaggcaggagaaugcuugaaccugggagguggaagguggagguugcagugagccgagauugcuccacugcacuccagccugggagacagaacgagacuccaucucaaaaaaaaaaaaaaaaaaaaaaaguagcacaucaggaaugucagcagaguuagaggguuuccaugauugcaacaacacagaaaaccagcaaaaacuuuggugagccaaucauucaaaguaaauaggaggcauagcccuggcauucuuuggguuggaaaacgaugugggcccuuaguuaugcuuaagaguuugcuugagcuuuucaaggccaauaaugggagugauccauguuuuugauucauuaacuaaaacggcaguugugguguuaauaaucugccacgcauaacagccugggggagggacacauuauugccagaugccugaaauguguaaacaaccacaguuuacagagacaaagcugguugcagcaucauuuuccggcaaacuaggauaaugucaccuaggcacaaaugaguggaaaauuaagaucugaauuaaaagacaucuaaagagacugauacaugacaaaacauccuuggcaaucaguucauggaggcucucacugggauuccaucgagggaagggaguuuaaaaagguacgauuacagcccaguuuugucacaucugagcuguggaaccaugggcaagaaguuucaccucaguuuccucaucugugaaaaaggggugguagugaaagaaccuaccucagagggcuauugaagacugagauaaugcacaaagaugcuccacuauugccaaucacauaacaguaaacaauauugggcacugaucgugcaaccuaagcaaagacgcugcauuaugacaauucugggaaguagauaagaaaauuaaagcucaggaaagcuaagacauuuguccaaggacauagcuguaaaucauagagucaaacucagucuaacuccagaaccucaagaaacuuccaguccaauaggaguaaucaacagaaaccacucccaacaauuccaggagagccagccaugcagcccaagggacaauaugcuggagccaaacgcagccagggcccacccuguaggaacaaggaguuaagcuguuccauuugagcugggucuugaaggauguuuugguuuuuaccagaaagagaaggagguaagaacauccuuaucggaaaacccauacugaacaaaguaagaugguauggaugaaaagaaauucucuguuuagguaaagcugacaagacagcuguuguggugugagcuuuggguuuguuggagccuuuuaugacuauuucugugucuuugcaaacauucuuguuaguacagugcuguggguauaaguacaggcucuggugucugauggucuaaguugacauaaucaagcugugugacuuuggggaagagacuuaaccccucuuguccugaaguagguuugccuuucacaugaggauuagcauaguagcacuuggggcagccguacuaacugcagagcuccaugugaacacuuaacgucaagccugcuaggaagcugaugcuuaugcuucugucccccuagauguggcccugggucucccugugucauccuuuugcccacugccuagaccccccucugcccauuggcuggaauacucaaggaacuacuaguucguguccuaaaaaaaggaaauucucaagaaccaaagagaaauggggcuuggacuauuacuauuacuagggaugaguuacugcugaaaacaacuuaucgacucacagccagauuuagggaucugacuucaucccuuuugcaaaauacauuuuggcucaauaacugugacaugaugucauuugaauucuaaccauucgacggcugacaaggaaggcacuuuuugucuggaccacaaggaugucuguacuaaucuuuguguuuuaucguauaaaacagaauggcagauuggagacauucauacaaagguacauuugcuuuaaugucuccucuuacacuucacaaacucuaaucuuggggaucucguuuuuugccugggcuuagcuaggugcuuauguuaaucagucuuuaaaucaaagaugcuaagacauacaucuuuucaaauuucaauaucuccaaaacagguauguguccuacaaccaguggcauacaguaaugcaguaguuuaauuggaagcauuuguuucuuucuuaguacacaugaauuaagggugagucguaaaaugaaagcaucuuaaguuugagaaaauauuguuuguguggagaagcgugcuagguuuuggacaaaacuugcuuuugcuugaaacaacaaccacaucaauauauguuaucacucuuaacuuacagaugagaaaccugaugcccagaguguuaaaaaaaaaagguuuuucucaugauugccuaguacauaggaggaagaguuaaggugggguucucauuacuauuguggauuacauauuuacugcaaaacuuaguguuguaaaacaauaauuguuucauguugcaugauuuuuuuggucaagaauuugggaugggcuuggcugggugcuucucacuuggaguuuuccaugcccuuguagucagaugucagccgggccgcggacuuuugaaggugcagagggccuacaugugcauccaagauggcggcucucaggauugcuggcugaugcugggagcucagcugaggcuacaaacaagagcacccaccagggaccucuucggcuugacagucccagugcuuucccuggaauaauuaugcucagaaaaccaggcaggagcugcauaaagcagucacaagccugcacagacucaaggaaaagucauauaucccaucuuucaauggaaagaauaucaaggaacaaggucauuuuguuuuuaaaccaccacagaugggaaccucguucugacugguaccaagaccccauauuuggaaugacuugucuggugccugggagcaaagcaagaaaaagagagcgugaacuaaucaugaugaauaggauuuuuaaaccaaugcaagaggguucauccagucacauguagcuucauuuucacuuucauguauucacuuuggaaccucaaacacugguccagcauugcucccauuauucagaacauaucuagagcuuucugggaagugguuucagggccaauugagcaggcucauaagaaacaucaggcuuagaauucugucagcuauaccuuauuucuaaccuaaaauggcucuuuguaguuuaacaaauauuuagugaucaccugcuacagaauguucugguuucuguggauuccuugaugaacaaaacgauaccucauucuucacuuggcuuacauuuugcuggaggaugcaaaaaauaaccaaauuuguaauaacaucugcaagucaucaguacuacagauaaugaugggaaaugaggggcgggggaaacucuuuuagagggaguggucagaaaaggccucucugagaguugacaucugagcagagagccaggcagaugugcaaggaagagagaguguuccagaaaaggaaaaucguaugugcaaaagcccugaagccacacuggucucagauaugucuggcccacagcaaggaggccaguguggaaaguagaauaaacaagggggaaaguggcagaggaagggugcaccugggguucacuaaggacagagaaggcacuuaggauuuuaaucugagaugagauccaugggaagauuuugagugguuuagucucaugcuuugguucacauuuuuaaaggauccccuggcugccaagggggggauaaaggauagaguagaaacaggaagauagauuaggaggcuccugcaguaaaucaggcuaaagguggugacaacuuugucugaacuguccuugguggagaagguaaguaggggguaaaaagagcagauauuuguuccauaggauuugcuaauggacacaccuaccaguugauccuuuaaacucaugaacaagguauauuucaaaauauugcuuaguggcugcccaaauuagagugggaccccgacagagguggcaacuuggaugguagaaaaugagagacccagguuacaccaguucccucaaacacuagcugaggaucuugacccucacugcauagaaagggcaggagcucaggcauuagcccucccuucucacucucacucucuggcaaaaaagguaugaggagagucaaagaauaaaccacuaguuggaaagacccucucaaaaaaggaguucacagauaagucuagagccuucaaaggcggcugccaggagagacccaagcccauuugcaugggcaaguuuggguauuucagccauucaguuguugacacgacuugguagucacagccucuccuuugcaagccaacguucucuaaggagccuuuuuuugucaaaaagaaaccaccauuguggcugcuuugagacagauuuuagggggaguuucaugcucuaugagccucaguagugaaagggugaagguucugcuuaaauaccacaaguggcccaaugaugggaucaagaugcaaacccaggccuauaauagugacuacuuuucuuuuaauuuuacuuugacaagcacaucugcagccaauuacaaugcgccaagcgauguucuaaucauuuuauaaaauguuuagccauucgaugauccuaacaaucauaugaauucaguaucacuauuauccuuuauucaacagucaauacacaguuacugagcauuuuauacaugagaaaagcgagucacagagaagcuaagugacuugucuaaagucacgccacagagccaagauuagaacccaggaacucuugcucuggaacuuuggcacauagguaccauguuaagcugcucuacacugugcuuuguuggaaaucuguauaucuauuagaaauaauuucagcugaaaauaagaaacaauccaaguuagagugacuuaaacaacaggacauguuguacauaacaagaagucuggagauagucaacugucuuaggcugauggaacaguucaacaaugcuauaaaaaauccagaccuuuucuaucuuugcugcuccaccaucucagucuauugacuugucaccucauaauuaccagauggcugcugcacauccagguaucauguccaagaucuagggaggaagaaaggaaaggaguaauaagcuuccuuuguaaggggcuuugccuuuucauuugagaagagacucccuccucagcauacuguuccuaacaagacuggguaacuugccugccauuaccauaucuaguuuaaaccagucaccagguugggauaagagucugacuucccugagacuuggugccuccugccaacccuuugaacauauugauguucuguacagugggaggcaaugguuuugagguaacaagagacagcgucugccauggauguugcuaccccaugaugggaacauugcagcuagaagucacaagguuaagaucacaugacugacaauauggcagcuccagaauacgaaugcagguccaucuaacucuaaaucucauuauuuuaacuguaaaguaguacauugcuaaguggagucgagaauggauggacacacauguggcuuuaccacugaaagcuguagcaccccgaacaaguuacuuaaccucccuaaagcucaaucuauuuaucucuaaauuguggcuaguaaugauguugaaccaaggggcagcuaugaguguaaaaugaaauaauauaugcaaagacccugacaauacuaagcaaucaauaauucuuggcuauuuuuauuauuguugucacugcuauuaucacucauuacccuaugagacuuuguagcuauaguggccuuguacucagauuagaacaccauuuugggcgucuuugggcuaucugguaauggcagucaguaguggguaggccugaaagugaggggggguguucaauacaauacuaauuacagauuuaagaaucuuccagcuugucuugcuugaauguagcgagucaaggacugguggcucaaaauacaggucuacggaucuacaauaguuuaguuuuagccuugguucuguuacuaguuaaaaugccguuuggccagaaguaucucauuucucguuuugggaccuuuguguuuucaucuguacagugaagugguuuuuccauuauugguauucaguguguaguggacacuaauucagcaacuauuauacucacggugccauggaagccauagaagagcagugauaggggauguggaucucacacucagaaagcuuagaggcuuaggaaccuucaggguuucuuucagcaauaacauuuaauaacauuagccagaaggcaaggcuaauaacccccaacccaaagguuuauucugaggauuaaucauguuagugacauuguaacgaaaaaucucugaacaaaugcaaaaaacauauagcuauggcaguuuccuaaugagcuaaacauagucucaccaugugauccaauaauugcgcuccuuggugucuacccaaaugaguagauuuccucuucccacaaaaaccuauguacgaaugucuguagcaccuuuauuuguaguugccaaaaauuggaagcaacuaagauguccuucaauaagugaauagauaaacaaucugugguaugucaaaaucccagcaaguuauuuuguggauaucuacaagcugauucuuuuauagcgaggcagaagacccagaauagcugacacaauacugcaggaaaagaacacacaagcuggaggacugacacuacucaacuccaacacuuccuauaaagcuauggucaucaagauggcgugguauuggcaaaauaauaaacaagcagaucaauggaacagaacagacagccuggaaacagacccacauauauauagucaacugaccuuugacaaaggagcaaagacauugcaaucgaggaaagauaauuuuuuucaacaaauggugcugaaacaaccagacauucauuugcaaaaaaagaaucuaaauauagaucuuaaacccuucacaaaaauuaccucaaaaugcaucauagaccuaaaaguaaauuuaaaacgauaaaacucucagaagauaacaaaggagagaauccuagaugaccucgaguauggcaauaacuuuuuagauacaacaccaaagccacaaucuaugaaaaaacuaauugaugaccuggacuccauuaaaauuaaaaacuucugaucugcaaagacacuacaaagagaaugaaaagacaaggcauugacugggagaaaauauuugcacaagacaugucacuuaaaggaauuuuauacaaaguauacaaagaacucuuaaaucucaagaauagggaaaugagcaacccaguuaaaacaugagcaaaagaacugagcaggcaucucaucgaagaagguauacacauggcaaauaaacauaugucaucagggaagugcaaauuaaaacaacaauuagauaccacuacacaccuauuagaaugcugaaauccaaaacaugaauaccaaauucugguagaggauuuggagcaacagggacucucauuguuggugggaaugcaaaaugauauagccacuuuggaagacaauuuggcaguuuucuauaaagcaaaacauauucuuaccauaagaucuagcaacagaacaccuugauauuuacccaaauaagcugaaaacuuacauccacacaaaaaccuacacacaaauguuuauagcagcuuuaugcauaauugccaaaaaccuggaagcaaccaagaugccuuucaguaggugacaggguaaauaaacugugguacauccagacaaagaaauauuauucagcacuaaaaacgaaugagguguuaagcuaugaaaagacauggagggaccuuaaaugcauauuacuaagugaaagaaucagucugaaaaggcuacauccuugggaggccgaggcgggcggauuacgaggucacgagauugaaaccauccuggcuaccauggugaaacccugucucuacuaaaaauacaaaaaauuagccaggcaugguggcgggugccuauagucccaacuacucgggaggcugaggcagaagaauugcuugaacccaggaggcggagcuggcagugagccgagaucacaccacuacacuccagccugggcgacagagugagacuccaucucaaaaaaagaaagaaaaaaagaaaaggcuauauccuaugugauuccaacugugugauucugaaaaaaacaaaacuauggagauuaguggguugccagggguuagugugagagagggaguaaugaggagagauaggggaagcacaggggaauuuuagggcagugaaacuauuuuguaugauauuauaaugguagguacacaacacuaugcauuugucaaaacccacagaacuauacaacacaaagagugaagcccaauguaaacuauggacuccaguaacucuuaauguaucaauauuaguucauaaauuguaaaaaauguaccauauuaauucaagaugcgaauaauaggggauaugacgggagaagaggagaauauaugggaauucuauacuuuugacucaauauuuuuguaagccuacaacugcucaaauaaacagccuauuaauuuacauacacacagagagcugagcaacagucauauccuuugaucuaaugauuccacugaugagauccucuugagauacaggacauacuaggaagaaaacuuuauuuacagaaggggaagaaagucagcaaccuguaguucaucacaaacaaccacauggauaaaagcaaauuucaaaaugguaguugaaaagguuacagaauaaaguggacaaugcuuguggaaaaauguaaauggaaaaaaaaauuggaaaucaccuuaagauaacaacuauguaaaaaaaaaaaaaaaaagaaaagaaaaggaaaaaacccaaaaacaaaacaaaacaaaaaaacccuaacuagccaagugugguggcuggugccuauagucccagcuacucggggggugcugaggugggagaauugcuugagcccaggacgucgaggcugcagugagccauguuugcgccacugcauggcagccuaggcaacaaagugagacccugucaacacugguauaaacggacauaaaugggguauagcacauugauaaugauaauugauaguauguuaccaagggcacaagauuaggauaacuauuuuauucauuuuuucaauuucuuauauuugacuuaucuucuaaaaauauauaugaggucuuauauauauauagucuacgauuccuacaguuagggggagaaaagacaaaaacuggcaguaaagcuagauggcuaauaacaauaacaccaccuccaccuccuccauuaccauuucuuaggaacugacuacguggaagccacuguucuuaguacuaaguucuaaguaaucugggcuaacccacucaaagucgcagagcuagagagcaugggguugcuuacaagcaaguaagaaacugaucucugaaccucuggcuuauucaaaauauacuuauugagaacccaguagagucaccaggugcuucaaacaugcaaagaaaaaugagaaauaauuuagagaacaaggaggggaguuuaagaaaccacuuacucacucacucgccuacccagcaagcauuuauguauuaauuucuuacaagaggcuaggcacuggagauacacaugauuaaauguuaucucuggccuuuaagaacugccacucuacucuccucagaacccuacaucuuccaacgugugacauuucuaaucguggacaggcacgcuaacuguuuaagaggcugggaccacaggcauaaacugaagcuccaccagcaagccuggaugugugaucacccuaagucagacuuggaagugcagcuccugaagggcaggaaccauccccacgaccccucucugcccauucuaguucacuugaacugacuuuuggugucaggaaauuuauuuuuguuucuaccccauccaccaaccccacaccaccaagcauuucagaucaaguaucugugaaucauaggucagguugacucauuucuuaaagauuccaggcugugaaugaaaaugguauugauggcugggaggaugaucagauguagggagugucaaugugacuuguucuacauuuaucuacaaaaaugcaaaccagaucugcaagcauuuuauuaaaaugaggaaggcagcugcugaaaaauuugcagagaggcuugauaaauggaaacgaucaccauuccuguuuuaaaaaacgaauuuaucauguacaccuuccuaaugacauuuucucuauucgugguacugccuuuuugguuuaucuugguuaaugugaaaaaaugcccaggguggguuuuuggaagcucaguuauagauucagugcuuauaaaauuaugaguuuuuuuuccauauaaaacaggaaaagggaaauaaaagaaauguggauugagcaccuauugcagaaucucauuucacccccugaagcccaagcagguuaggaagcagaugcuaggagaggguuagucaccuaccccagcgagcucagcagcggaaaagcacugagcuuuggucuccuuugguagaaaccugcucaaccagggaacacuuaacuaagggguguucaggaacagaaacucacaguaggggcaaaaaacaaaguucugggacuaggggaaccaaaaccccagacacuuagaugggcuaugccucccacguggcuucacacccauuuacacugaccuuucaccuucagaaccacauugagucugcugacccaugugaaacacccagcagggagccauaacucuugcccuacauggaaagccucauugggcccccuagggaaacccgcuggcaucugaaucagauccugugaccucugugguccugagccucaaagcaggggaauacccuuugccguggauccaccacaaagccucagggccuaggugagaaaacuucaccugugaaucauggcagcucagcaccuucucugggccucucucagaagccccugaagggcuuagcaugugucaccaggggccaggacagcugcaaauucuccugugaaacaagaagauuucaugggcucucguggucucugaggaugccucaucaguucaugagaugaccuauuugcaggugacaaggcucacaaaugccaaaugaaucacucauaagcgagugugguuuucaacuuuucagugucauuuuaguggauaccuggcucacugggaauugugaugucaauagacggaagcccagagaagguaagcgacucgccuaagaacacacagcuagaauuaaacaacuuuggaaguagaauucagggguccacaaccuuuuuucccaucaucauacugccuugcuuagaacaaagacaaaccuaagcaaaagaaaaaaauauauauucauuuuaauuggaugguaaaauaguaggaaagaggaggaaaaucugaagacaauacauuccuugccacucaugggcucuuugagacauugucucagcucagagcucugggcuggagcuuggaacuuuaucaggaauugcccuuccccaccccaacauauagugaagggugagcuaacaggacauucuuuaugucaauccugguggcaguguguaggcccaguuauucagucuaaagagcuucaggcugcucacuggguccauugugcagauaagagaaguaacgucccgggagaagaaaugaucugcucaaggaaacccagcuggcugugggcagagcagacaccagaucacugugucacaacacagagugagugguggucagcaucacucacuauccaacccugugggguucccagagcacaggguacuucucuagacugugaggacaaaggaaacucuggucccucugacaacacuucgaauuuuacauaaucugucuacugguuugauauaauuucuaaggcaaguggcugauuuugauaaaauguguuguagcuaccaaaagauagcagugaaccuggcuggguuugucaacuuauacaagagaagcgaucuguaaguauaaugaaugggaaagcagauaaauaauuuguguauuugguccaaauaaaagguggguacauccacaugaaacaauagaacaauguagcaguuaaaaagaauagaguggcuaccauggauagcacuccucaauauauugcugagugaaaagggguaaacugcaaaauacucuaccagagguguacacaauaguacucaguguguauaugugcaugcguauacacuuaaaugaauuagaauggucugcaggaaugugcucuaaaagauaacaaacaugaccuacacagaacuaaugaggagacaaggauugaagaugggugagcuaaaaggacuuuggccuuuuguggaaaauuuuuaauuuuuccgaaaugaaugcaaucauuuaauauuuacguaauaaaagauuuuuuuuuaaaaaaaggagaaaauagaaauauaauuuuaaugauucaucgaucuauucaugcacuauuugagcaucuauuaugugccaggcaugaagaagguaaaaaaauccagccccugaccacaagaauauguucuaacacagaaggaggagguuuccugcuuauaagcaugaugagauauauuacaagugcucuggugaaugaagaaaucagagcagaguaggaaaauaaagaaagggaucuccauguuucacgggaaauccaaaggccaaaacagagucuccagucaauucugccaaggccugccaucuugaaaaaaaaagaguauuaugacaacaguuugcaaaaggacacaucuuuguaauuuuaaaguaauauccaugaucucucacuucagcuagaguucacaaaugaauauaauaguacaacggauaguuugcaguuuguaaacauauaacccccaugaacggagagagaugguuuuguuacuuuuuaaagaaacuaacucuuuggcugcauuuaucaguacauaugguuuacuccacuagacuagaaauggcucugccaaaauugcugcuuaaauuuggguuucuaaaaauaacucaugggaagccugcagugugagaggaagaugguugcacacagcuccagggaggaaaaucucaagcauuugauuugaauuaccuaagagcugaaauugagugcaaauaucuccuuguagcaaccgcuauauaauuagccauccuaacggaauccuuucaaaaccgagacaguucaacaaguuauuuuaauugaaaauaaauuuuccugaccaacuauucugucaaaaccacauuaaaugaagauagcucagcagugaccaaaucacuauaaaaagcauuacauguuaugggagaaaugagugggaaggagccccccccuuuuuuuuuuuuuuuuuagacagucucacucugucacucaggcuggagugcuguggcaugaucucggcucacugcaaccuccgccucccggcuucaagcaauucuccugucucagccuccugaguagcugggauuacaggcaugcaccaccacaccccacuaauuuuuuuuuuuauuuuuauuuuuucauuuuuaguagagauaggguaucaccauauuggccaggcuggucucgaacuccugaccuugugauccacccaucuugggcuuccaaaguccugggauuacaggcgugagccacugugcccggucgggauaugcuuuucuauaugggcaaaauguggcaguuuucugggcuccuuuuucuagcuucaugugucuucuggucucuuguaaaaaguauuccauuuucucugcaucaauguuacugcuggggcuaucacuugaauacagugcaucacugucuucugaaaagaagcagccaaguuaagaucucagagauaaagaggggaagagaagagaaaauggcacuugcuuucuguuggguucaugacuagcacaaggacaccuuccaucccaggagggccacauucauccaucagcucuuggagaagacuacagagacuuggaacugccucugcacuuggacuuucaucuuugcuacuuaucagcugugccuaguuauuuuuagcaucucugacuagcaguuuucucaucuuaaaaaaaaaaaaaaagaaaaaaaaauuguuguuauucucacagcucccaggauggucaggaaggucaaaugugugcacaaucaaucugguauucuagacaguaucugcaacugccugugugaggagggcuagggaggggaccagacccuuccucacaaguugaaauggguuggcgcaugaggagggcuagggaggguagcagaccauuccucacaaguugaaguggguugaugcauggaccagcggcaucaguacugccugggagcucauugcuagaguagaugcucagccccacgccgaaaaauuggucaaaagucugcauuuaccaaguaccccuggagauuugugugugguucaaauuugagccucacuggcuggugccaucucccaggugugugauucuauaucgggugaccugugucaaaaggaagggagggaggaaugaagggauggagggagaaaaggagggagaacggggucaguuaaauuaaaaaacaauaaaauuaaaagaucuucgaguuacuaguuaugcagguuuagguuaaaacgugcucccaaggaaaucuagaccuugaagccauccuuuuugcuuaaagccacaucacugagcuugagauccccauucagacagaacaugcugccccucagacccaucaccaggucuacaucuaaaaaugcucaggugggccgggugcggugguucacgccuguaauccagcacuuugggaggccgagaagggcagaucacucgaggucaggaguucgagaccagccuggccaacauggugaaaccccaucucuacuaaaaauacaaaaauuagcuaggcaugguggcgcacaacuguaaucccagcuacuuaggaggcugaggcaggagaauugcuggaacccaggagguggagguugcagugaguugagauugcaccacuguacuccaaccugggcaacagugagacucugucaaaaaaauaaaaauaauaaaaauaaaaauaaaauaaaauaaaauaaaagugcucaaguggacaaaugugguaagggaaugucucgugccacagaaagcuaccugauuuauuuuuccccaaaccgcuaggcacugugguuaaccagccuucuaaaaacaccagcggugccugccuccaguccauuuagcuugguuaagaaaggaaacaucucuuccagaagauucugaaauucuguuuuccugagccucgcggugacuaaaauggaguuggggggaaaugacucuuagacuuuuugucaguguaaguggaaacugagaugagacacauaauauaaagugacauauaaaauccuaauuuuggaauaaggaaccuggagauggucagcuuauaaggcacuuuuaaaauccuugcugggaggaacuauaaugaaaaccugauuuuaaaaauaaggagguggaggcucugcaagauugaguggucaaauuaggaauugagcgcugugucuuuuccaucccaugcaugcuuguucuguggcccaguauccauguccccagccaccuuccagaaaugauccagucauguguuagaagaauuacacuaugucuuuguggucuuugucaccgagucuucaccugaaaauugauucuacugaugaggggcgcaauggugauguucccuuggauaaaagcccaguuucggagccagaagcuuuuggauucaaaucauggcccugcuacuuaauaacuaacuuuuggcaaauugaccccucugaaccucucaauuucuucauuuuaaaaaauggcaacaauaguagcuaauaaguaucaagugccauucuaggcacuuuauguuuauuaacucugugagcaggugcaauauacuauuaucauucuucauguagaaaugagaaagcuaagguacaaaaaaugaagugacuuuccuaaggccacauggcugauaauugucagaaucaggauucuguaggagccugugauguagcaauaauauaucaaugcucucagagggcugccaagagauaucuaugagaucguagaaauaaaaugcuucccaggccaccuggcaaagauaagugcucaacaaauuauaacuauacgguuuccauuucuuuuauuuuuauuuauuuauuuauuuauuuauuuauuuauuuuagagacagagucucaaaucugucucucaggcuggagagcaauggcaugaucagagcucacuguagccuugaccuccugggcucaagcgauccucccaccucagccuccuaacuagcugggaccacaggcaugugccaccaaaacugcuuuuuuuuuuuaaaaauuuuuauagagaugggggucuccuuaguugccuagggugguauuaaucuccuggccucaagugauccucccgccucagccuccaaaaguucugggauuacaggcaugaccugcugcacacauccuauaaauuaauuucuugagcuagccagaaacacaagguuacuauggcauccacguggcugacaagaaggggaaguugcugcuugcagaagugauacucucugacagguauucaucugcaccuguccucagcaggcauucugcuuugacaucauggugcagggcaggaacuuuggugcucugcccuucgaaucuuucuauugauuucugucacgcagaaccugcaugggaaccucagcuggagcagcugguguggaaaugggucucaugucugccuggcaaaaagaauugccguuuccaaaaugagcuggauggaucuaauccccaaagcaauggacauguaugagugacucgccgcuucugacauucucugcaaaucaaacagaugugggggaagaucccuuauauagaagaggcagcaugcaugcaaaaaguuggcaaaugcagaacucugauguagaagacucuguuggcugccaaguuacugaucagccacuggucucuucuucuuuauuaaaauauucccaguucuauucagggacaagggagauagcaaugugcucaaaaaaaguccauggcagggggaagaauuggcccuggcuugaaacagccaugacaaucuuguuaucucugucagggacuggcugggagcuuaccuggcccaguuuggccacugagacauaggggaagucuacuggggauuucuggggaaaauuuucuucccuaacagaagauagggagucacaguaaaagggccccuuuuuuccugccugaugcuucuuccugcucaaaaugcuguuaugacaaagugaugucugcagcagaaagggccaucacagggaugcuaaucaagugcucugaggugguugagcugucaaaugcauccuuuuugaugcaucugccaauaccaggugcuggcgaggacagagggaaacagaaaucuugagcacugccuguggaaguguaaacugguacagucauucuggaacacaaucuggcaguacuugugaaauuaagugugagugugcacuaugacucacccgcaucacaguccauaucagagaaacucucccacaguccauauggguacaggugugaagagcuuaucacagaacuaggcugugguuaccucauguccacuagcagcaacaggagaagcaaacagggcaggaucuauggcaugggcaggguagaugcagcuccucagaugaaccaggugaacacagagcaccaagacuggcucugaaaaagaguguugaguaagcaaaagaaccaaauugagaucuauagcagaaucccauuugucuaaauuaaaaacagauacccaaucagaacaagacagggaggauccucaugcaggcccucaugcagggccugcagcaagcacacuggaguggcugccuauggaggagggaagggaaugggaauaaaaauuccacauuugucuccucaucuccucuugcaacagaggaggcaaguggcuggggguagggggccugguagagaucaaugaugaugauaauaaugacaaugaacaaagaaggcauucauaauaaaauucgaaagaaaaaaacacagccagauuuacagucagagaacccaggcgugaaugcugccuugauccuuacuggcuacggcucuuuggcaaaucacagugccucaguuuccccaucaugaagagcagguuugaagaguggcucugcagagcuguuaugugagcauccaaggagauaguguggggagauucuaagcuuggaacguagcaggggcuuccuggauggcaacugccaggagcccuaaggacucagcucucuccucuauaaaauggggauuuacguuacccacccagcacgauuauggugcagaugaaaugacacaugaccaugagggacaaaaagcaagaucaugaaacccaggagcaccuccugcucugaccccugagugcagcagugugcgcugugcccaugccugauacagcagcgagggucaggcuguccuuucgugacgucauuccuaguggaacaugggccuuacacauucaauauauauugccuuuuacuuuauucuaugguaaugacugaaguuuaacugaauaagacaagcuauaaaaaaagagaagagaugagaugaaagaagagaaaaaaagaagcugucaugcucuuauuauuccaaguaggcaaaaccuucauuuuuccaaugaacagcuagccucucucuauacagguuuuguguaaucucaggaaggacgcaauaccuuauguaauugccacaucagagauugucacugcuguccuuaaggugccgccucuucuccaugaugacccuucagaugucugggaaagauuccgugaaacagaaggacccuggaguccacuuuguuucuaauuugcccugaagugcaauaggcugcaagaacccccuuuugucacacagcuuucucauuuucuggaaacugucuucuaaauaaacuucccaaauagggauacaaggucaaaguaaggcuuugaugccucuugacaaauuguuacuccaaaagaacaaauuaugcugccaccggcaauggaggcauaugccaggcucugacacauucuuaaaauaaaccccaaaacuggccgggugcaguggcucacgccuguaaucccaacacuuugagaggccgagacagguggaucacgaggucaggagaucaagaccauccuggcuaacauggugaaaccguuucuacuaaaaauacaaaaauuagcugggugugguggcauguaccuguaaucccagcuucucaggggcugaggcaggagaaucacuugaaccaggaagucggagauugcagugagccgagaucgcaccacugcacuccagccuggugacagagcaagacuccgucucaaacaaacaacaacaaaaaacacaaaaccuauucuaauuuuuggcaaccugaugggggagguacauuaccguugucugauuuucuggugaacaucacugugacucccagggaccccaaguucacugaugugcuauuuuccucauaugaggucuguguaagagcacccacaucuuguuaaagugaguuuucugcauagaaagagaccucuuucauauaggcaggccugaaggguagagcgguggaugggacagagagaaagccagggagaggagaaugggagccuaaagccuccugggaaagaaggaaaaacaggaacaacaaaugaaaauguuuguguaaaaaacugcaaaacagaaaaaaaaaaucucacguccacugaggacacaucccuguaaaauguaugcaugcacagcaggaacagggggcaagaggccaagcagacaugaaggcaagaguuguaauugggugagaugauggcucugggauuugggcauucuuuaaaauuguuuuuauagaugugguuauauugauuuucaaauaagauaaccaaaaaaaaaaaaacacaaaguauguuaguccaagaauagaaaaauaagagcagagucagaagaggaaaggcagaaaaugaaauaaggacaugaagacagcaugaucagucucuuccauccuuaaaaccccucuggggcaucccucagggcuaaggauaaggucaaacuccuuccugcaagcagggaggccccacaucacuccuccagcccccucccuggucgcuggucacagguugcuccagcucaccccuaacuccaguucuccagcccaggccuggguugggaucuccacagagcauuccucuggcuccucuguuggguuaauccccacaccuccuucugggaagagccuaaacauccuuucccccaggaagccuccccuuuccccuaaagucgaauugcugccuagucucauccugccaagacauccuguguguuccuuuucugaguuucccacugcaauggcuuguacugagcugcuccaauauagaccuuuugauuagaagucuaaccauuucaggaaggggacaucacacggggacugugccagccguggaaggaaggacuggccuuggagacaggacaggcagaaugggcuggacaaugcccauuagaugacuccacgucaguuuuccccuucuacucucuagccccacaucaccaauccaaucaacucuuuaaaaacuuauuucucaagugccuguuaucaccaagacguugcagugagaaauugcaaaacccaggccauuccuugaguguauaaccgaguuagggagucgagacuucaacaugaggauuguuagauaaccaugcagcaaugaaguauaagauaaaacaagauugucaaagauuaauugagugugggcacuguguggucuggguucaggagagcagggucacuguggcugcaaaggaaaguccucugagagccagauuuaaaggauacccacaggacagguagguuugcaggggguggggugaaaggauagcauucagugaugaaggccuagagcaggggagggguauuggaugcucaguggccagcaagaaguccccugagggaggguguguuagggucagaauuuugagaaccuuaaaacccaaugagaagaaucugcacuaggaaagagacgagugaagaccacauaaagcagugcagcugaugagagucauuugugaggauagaugcucaggacagacuagaaaaagauccugguaagaaccuuuuaugaaaguuaaaguaggaagacaggcaugugguaccagagcugccaccucccaccuacaggcgugguggucaacaccaagucauuagagcccacuuuccuaccaggcccaguugggaccucagaguuguuucccauucagggccaagaaaaccccuaccaauggauccagagugacaguucaaacuuauuuugccuugcagguuguauuaguauuagucagaagugacgcuguuaugcugcacuaacaugucuuuccaaauuuuaguggcuuaaagcaacaaagauucauuucuuuuuucagcugcauguucaucacaggucaaccugagaucaugcucaaucucagcaucauccagaccaggccaacguggcagccucuacacauagcacugaucagcagcaggccagaagagagaaugaccucuggaggguuucucacuagaauuccaacaugaaggccagaaaugacaugucaauucugcucacuacuccuuggccagaauugcucacaauggguaagaaaguucagucuuacccuguggaaggcagagucagaaacaauaaauggccuaaguauauccccuuucaggucacauggaauuuacuauucauccauucaacuagcaagaacuuauuuuaaaauggcaugcucugcacccagccacuuuccuucucauuaucuucuucuauuuucuucauaguaauugucacuaucugaaauaucuuaacugaaaugccuuaauuguuuauggaucugucaucuguuguugccugugucacagacuagguucuaagcucccuaucugccuuguuggcaguguggggcacacaguaggacucucagcaaauauuugugaaaugaguaggugaaugaacgaaagguuccacagggcagggacuccgucagcuuaauuuagugugcacaauguccagcacauugucggaacucagugggcugcuaagaaguuagccaguuuuuugugucugcuugaagugacaugacucagcacuucuuccccccuuggugcauuuccucucucuuucccccuacagggacuugagagcugaagacuugaagcugaagacuggucuugacagauacuaugccuauugauuucaacccugagauccccccacuaaccuuucucccuuacccucaggguucagggccaaguuucagacuggccugagaacauagggaccaaagggaaaaaaacagccagagugaaagagaaaugaagaagagacuucuggcugggcgugguggcucacaccugcaaccccagcauuuuggaagauugagguggguggaucacuugcagucaggaguucaagaccagccuggccaacauggcaaaacccugucaaugauacaaaaauuaaccaggcgugguggcgugugccuguaaucccagcuacucuggaggcugaggcaugagaaucccuugaacccaggaagcacagauugcagugagcugagaucacaccacugcacuccagccugggagacagagugaaauugugucucaaaaaaaaauaaaaaauaaaaaagaagagacuucugagagggauguaaccagcccuugcacacgcaugcacaugcacguacauuguaaaugcuucacucuagucuggccucuucaggaacuugcuguguaaacuugggcaauuccuucccccuguaggccucuguuucucugauaguaaaaucuggguauugaagaagcacauuucuaaggggccuuccagaucuaaaaugcuacaagcaagaaaucaucuaagggcauauuucucagagcaggguccauggggugacagcuuuuauaaggcuuuuguaggccucacacacauuguaucaaaugcauuaauugcacucauauccuucauuaaaaaauaauuccuauguaacuguaaaaguugaggcgaacuugacaaguugacauaaaguucuauaaaacauacaguauaacuauuucuauuuugcaguuuuguuuucauauuuuucagcuaagaauuuuacauguuuguucucaaguuuguuugugggucuuugaaauaucaguaagucccagacauucuguuuauagcacuuaacuggucaaaugggacucucucagauguucgguaaaaaugucauuugcaggcagggccccacccuagaaccacugaauuagaaaaucuguugggggaacccaggaaucuccauuauagcacauuucccagaugaucauuugcaaacugagguuugaaaaccacugccauaaaaagaggcugaggaaaugggcugggggaggcaauuagggaggaggaaggaggguuaaaaggugaccaaacaagggugaaaagaugacggugcauggcuuacauuuugcaugugugcaaaugugcuucugcccacgugagcccacacguuccaccagaguaaauacauuuuguaaaaccaugaaucgcucucugcugagccccuccuccaggcccggaaaacaauacucaaacucagucugagacugcauccccucuggugauuuacaggaggaguuaauauuucuagcauaucauugggcacccagccugaagacugaagguguuucugccagggacggguacugcaggaaggacuaucaauagcgcugucacccagaugcuugcggcaaugaguucuagcuuugguuaguaauacauacuagcuccgucagugaucagucuuaacucauccguggggauggggguuuucuuuaaucuuuuuuuuuaauucacagauaaaauuguauguauuuacuauuuacaacacgauguuuugaaggacacaguggauacauuauggaauuacuaaaucuagcuaauuaacaugugcauuaccucauguaguuauccuuuuugugguaagaacacuuuacauccacucucuuagccuuguucaugaauacaacacauuauuaacuauagucaaaaucgacuucuugaacuuauuccuccuaccuaacugaaauuguauauccuuuggccaauaucuccccaacccccuccccagacucugauaaccaccaggcuccuuucuacuucuuugagaucaacuuuuuuagauuucacauaugagugagaucauuuaguauuugucuuucucugccuggcuugagccacacacacaaaaauugcuuguguacauaugugugugugugugugucuggcacacacauaaaucucaaaauuuauuuauuuauuuuuugagacagagucucacucuguugcccaggcuggaguguaguggugcaaucucagcucacugcaauccccacuucccgaguucaagcaauuccugugucucagccuccagaguagcuaggacuguaggcguccuccaccgcaccuggcuaauuuuuguaguuuuggugagaugggguuuuaacauguuggccaagaugaucuugaacuucugaccuaaagugauccucccaccucagaaucccaaagugcugggauuauaggcuugagccacugugccuggccugcguguguauuuaagcaucugcaacgauuacagaugaaaccuagcaauaagaagucaucaaacuguacugcugagugcugguuuucauggugccaggaaagaccaggauaaagggguagguuggaaagaaaggguaaacuaauucaaaaggccaaguacugugcuagggauuuccuaguaugucucacaucaauccacuggggagagcauuaucugucccuuucuuccagugaggaaaccaggacacagaaaagaucugugacuugccccagauacugcaagaucaaacccugacccagcuaaccacaaaguucacauucagugcccugugcagugcugccugaaaguucccuagcuuuaaacacaggagggaugggagaaggaagccuguucuagaaagggggagacugaggaaacugaucucucaaaucagaaauaacaacccaaguaauuucucaacaauuuaauucacaagcaacuagugguuauuggaaaaaaauaaaucacagauuagcaauaagaaaaaaaauacacaaauaaccacauccucccccaaguaaugguguuuuuauaggucuauauuuuuacuagcaaauacauauuuuuucuagccuacaaaugacaugauacuauuuuagaaauuuuaucaaaauuuauauaauuuugccuuuuuaagaacauggauaauguguuugcuugcccaguucucaccuucugugaauuuaugucaauccauacauuucuuuccaccuucuaagggggaaagaggaaauccuucacuucuuuuuuauuuguuuguuuccuguuguugccugcuccucugaacaggugcauuuaggaaggguuaaagaguauccuaggaaauguuguguucugguagauaauguggccuucagaaacacacuaaacaaaaauuaacuugguuucuuccuccucauagaugaaaaugaagaguagguuuuguagcaauugagagaaaauaauuuuuuaaaauuaucuuaaugccaaaggaaaaagcagcuguccugucucccccugcaccgcagggggcagcccuccaagugcccccaucaccccuuccaggcauucaccaguugggagagugaaaaauagccuccuuuucacuccccuguuguuaaccaggcucccuauugagauguaguuaaucacaucaauuaagagcuuuucuugcacguggccuugccugccaggcacuggcccuguguccaugggaagguggguaagauaagcagccagucaggucaugugauaauuaaaauacagauauuuugcuuuuuccucucuuucuauguuuuuucauuuguacauuuuuuuaaaaaaucgggcauaagucacaugccgugcaaugcucaauuuguaaauaaacaguuugaugaguuuugacaaaugcaaguauucaaaugcaccaaaccagcaagacacagaacauuucccuuucccagaaaguguuccugggcccuucauaguuuccucugccaucgucccagagaaaaccacuguacugacuucuagcaccgucauaugaauggagucacguucuguguuuaaagauaaacacgaauaaugagcccaagaacgagcagcuucuagugggaauguaaaacaggguagacacuuuggaaaagacuuuagcaguugcucaaaagguuauacauagaguuaccauaugacccagcaauuccacuccuagguauacacaugcccaagacaaaugaaaacauaccuccauacgaagucuuguacgaaccuucagagcagaauuaaucauaacagccccacccccaaagaaacaacccaguguccaucaacuaaugaaugaauaaauaaaauggggcauauauucacacaauggaauauacuuugggcauaaaaaagaaugaaguauauguuguaacuuagaugaaccuugaaaacauuaugccaagugaagaaguuccucacaaaagaccauauauucugugguuccauuuacgugaaacgucuacaauaggcgaauccauggccaggcaugguggcucacgucuguaaucccagcauuuuggaggccgaaaggggcagaucacuugaggucaggaguuugagaccagccucgccaacauggcgaaaccccgucucuacuaaaaauacaaaacugagcuggacgugaugacacaugccuguagucccagcuacuugggaggcugaggcaggagaaucacuugaaccugggagguggagguugcagugagccgagaucacgccacugcacuacagccugggugacagagagagacuccgucucaaaaaaaaaaaaaaaaaaaaaaguaguugccuaggacuggggauagaagggagauugggaggugauaucuaaagggaacagacuuucuuuugagaugaggaaaauauucuaaaauugguaaauuguacgguauguaaauuauaucuuaacaaagcuguuuaaagaaaaaagaacauucagaaucaaaaagaguaaagacaauuguaaugggcagagaagacagaccaguuuuccuucaucggaaguuuaacugcaaaaguguuuggcauuguggccuaaggaccccaugccaccugggaagcauaauugguguucaggaaagaaggucuccuucccucccaugagaagguugaggaguugucugcuuuccucaggagucccugcccuguucccagaguuuaaacuccgagaguccaggaacuauucaucagauucaucuguuuauuccacaaacauuuauuaagcucauguuuaguaggaaguacaaaaccacauuuaguccugacauugcuaugaaguggcugcauuuauagggauaucuugaaugccucugugugucuggcccugcguuuagcaggugauccuaggagacuagagugguggaaggagcucaucaugagagcgagaccaagaacuuugaggccaacgaaccugguucuaaauucuuucuuuuugacggagucucacucugucgcccaggcuggagugcaguggcauuaucugggcucacugcaagcuccgccuccuggguucacgccauucuccugccucagccuccccagcagcuaggacuacaggugcacgcugccacacccagcuaauuuuuuguauuuuuaguagagacgggguuucaccauguuagccaggauggucucgaucuccugaccuugugauccacccgccuuggccucccaaagugcuaggauuacaggcaugagccaccacgcccagccucuaaauucuuauucuaccauacauuagugcaugacuuucuuuuuuccugccucacaaucccucaccugcaaagaccaaugacuuacccuauggcugaacgaugaagagucccaguucuaggaacaagaccccaacucuaccacuuccaugcugcauguggcuucagguaguuucugaaccucuuugcaucucacuuccccauguguaaaauggggaugguaugauaacugccaacacuaugcgggauuggaugagcuuacacauguaacccaggggucagcaaacucuuccuauaaagugccagauacucaauauccugggcauugugaggccaccuggccuuacugccccucgucaucucugccauuguaacauaaugcagccauaggagauauguuaagaaaaagggucugcuauguuuaauaaaauguuauuuauggacauugaaauuuccauucucauuucauguaauuuucauauaucacaaaauauucuucuucucucgauuugcuucacuaccacuaaaaaaugugaaaaccauuuuucacacuaggauuguacaaauacaguggugggcacagauuuggcccaugaggcauaguuugaccaccccugguggacacguaaacaguguccaacacauagucaacugcccugcccagccauugagccugggcaacaauggcugagcauucaccuguguugagcugcguauugagccuuucccugccauaucucauucaaaccuuaucauaauuguacaaaggggguucucacaugaaaaagccaggacucaggcgagaaaagaagcagagucauuguaaauccaggucuuucugacgugagccauugcuucuauccaugauaaaauaugugcuggccaccgggacacaacagggaacugacucacuugggcuccccuccaaacaagacaaaucaugauuuaauucaucugagauguguguugcacaaagcaagggcuggaaggaggaauaaaagggcacucacuacacaguaagcagugaaggagacccucuaaagaagggaugauggccugagaacagccaugcgucuggugcaauaccaagugccaaacagaugaggcuggaaagguaaauccacccugaagcccugcuguggagggcucgaggacauggucgucugucaugcuggggguggagggagacacugguccccacuuuuugaaaggaaacuccgcaaccucaauagccuaaccagcccuuguuucagccauucuaguuuaugggaauauguccucauaaaguaggaaaacauauucacaaagauuuagcuuuaggaauauucauaccaacacuguuuauaauagugccaaaguugaauucauuuccuaaaugucugccuagacacuuagaaaaauacaaaggguuuugccacuuaggucugaacaacggugaagucugguguccaagcagucaaauggugauguaguagaaguacacaugaugaugucaaaguauauuuaucauguauuuaguagaagagcuauuuacaaacuaauauauauaccaccauacaacuauacacacacacacacacacacacacacacacacaugcaucaguuuguuuaauuaguuacaucuaagugauauaaggguuuuucacuuuuucuggaagagguauguacuguuuuauaauaagacgugaaauaaaacugauguuggacaagaguuuaaaacucccagggauuuaauugguuaggucgaaucacuauucauuaauuuacccaauacauccuuaggaaggauccaucacaagcuaggaacuggguuaugcacugaagaaucgagagagaugagacagacagagcuccauguugaguaggaaagcuggucagguaaccaacuccauucauucagugacgcugauguucuacaguauuugcagagaggagccccagcuccugaugaaggguccagccucuuacccuaauuugaucucaggguuggcuuacacccucacacaaucagcuuuugaucaauuugacggaagaccuucugguauccaugguaagacuaguguuuggauugaaagcuaggccaaugauaccaccaugugagccuuucuuuuccucacucacaaacaggguaaccucucgcagcugucaggauaagccaaggcucaggaaguguucugcaaauggcaaggccccgcacacaccgugggggagauuuaaugccgagauccgaaccucguucuacaaggaugacgaccuggaauuuaaacgaugauggaugucaaaaugcagggaggaaagcauguuuaugaacugaaaggcugaacagagacaggcagugagcagugggauucuaggucaccgugccuuggagggacggacaccucauucuguaccucccacgucagccagugccaggguggcuccugacuuucuggugcuuguuuguaaccccaaagacaaucuguacauuugaaauuggauaaaauaucccugcagguuuuuguucacauauauuaaagagaaguauuuaggaagaauuuaggaccuggggccaugaaaacaaaucuuaacauaucucccugccaguauaguagaaagagaaagggguuuuuccgguuaggucauaaggguuugaauccuuguucugugcccuuuuguaagcuauuaucccuuagcuucgggguaauaauaccuuuucuacaugguaaguaauaagaaaagcaacguuuguauacaguauuaaugcucaauaaagagcaguuguaauuuucuuagugggaaggccucggggaaguuacaaagcaaugaggucauaucacccagaagcuggaccugggguaaaucagcucacugugaaugggagggaagcucaggguggucugguuaucucacagcuaaacuugacgucagcucagccuggaaguggugaggugagaauacccugucuuucucaaugaugcgggaagcuaaacuaaacuaaaacuccaaaugugaaacuggcccuguguucugcacuccucugagaucaugguugugcaugaagagaaugcauucaauuuuucuggggagggaaaggaaaaugaauuaaccagagaguaaagaagauacugcuggggcaagcaugggcugccagggacccgccacgaucagaagcgccuaugacguuucuaucagaaucaccccggagcaacucgugaaauaaccagauucuaggucaaucucuuggagucagcaggccugggguggggcccaggauucugcauuuuaccaagacccacugauauacuucugaugcgucccaagggcagucuuggcaaccauucgugugguggagaaggcacuaggcauuggccucgggaggucccaguucaacacccagcugaagaccaguucucaagcacagugauaaaauuuucucaaauacacuggggcagggcccagguuaaagcagccugggacucguguacaggcugcaaacauauguauaaacaaggaaacaucugugcgagcuaugcaugcaauuuuauguauacacgcaaugaauauauauuguauauagaaauauauacauauguagguguauacgcagacacauauguaugcauauaugaguauacauaccugcacauucaaauguaaauacaugaacgcauguauacaggcaugcauaugcauauaggcaugaauacacacacacuccuauuucaauuaauccucacacaaguuccacuucaguaccaacauuauccccauuuccuuuauaaggaaccugaggcaugaaggaaauaagaaacucaccuaaggucccauagcuagucaguggcagaggcaggauuugaaaagggcagacuggcuccagaguuucuguucagaggucacuacauuauuacaaaccaacccaagagguuaagcagaguagaagcugagagucauaaaccugaaaagcaacuugugccugggguggacuguguccaguagugagugauaugaguccucccauuucuguacaugcauauuguuucucccaucaagaguuggaguugguuucccugucuugagucugggcuggucuguggcugcuuuaccaggggaaggugauggaaaugauucuguccuaggaaacuuucacaucuauccacuugggauucagcuacccaaccuaccauaaagaagguugagcuagacugcucgugaugagagaccucauggcaagacagaugccaccagccacuccagucaccccagcugaagcaccagacuccuaauuuaaugcagccacacaccgauuccaaaugcucccauguggaacagaagaaccaccagcagagcucagccaacuuauagaacuaugagaaaaauaaguuguuuuaagccacaacauuuuguuaugguuucaugugcagcaaauagagaacugauucaugcagcuacauggcuugcaguaaaguauaaauuuuagaauaagcagcauuauguguugagcacuaggccaggcaguguauuaagugcauuacauucauugucuuguuuaguguuuauuggcauuaauguaggagguguuaauauuauuuccauuuuauugauaaggagacuuaagcccggaaaaguuaaguaacuuacccucagcauuggcaguucuuggagucauaccuaaaucugucucauucuaaagucugcauauuaugauguccaagguuuuuaaaauaaaaauaaaacaaauaaacacaaagcuugcauguaauaucaagguucuccaaagaaauagaaccaauagaauguguguguaugugggugugugugugucugugcaugugugugucuguagggacauagagagauuauaaggaauugacucacacaauugugaggacuguuaagucuaaauucuacagggcagguuggcaagauggagauccagagaagccuugauguuguaguuuuaauccaaaggcauccuggaggcagaauuucuacuuccuuagggaaccucauguguuuucucuuaaggcuuuccacugauuggaugaggcccauccacauuauggaagauaaugugcucuacucaacgucugcugauucaaauguuaaucucaucugaaaaauaccuucagugacaucuggacugguguuuaaggaaaaccuggguaacuacccaaggugacagauggaauuaaccaucacauggcauuucucucacucugugaucugugucccugaaaaccugggcccagcauucccagucacagucaugauucacacaagcagcaaaauaaaugaaaacugcagucagaaucugucagauuaaacauggagugcccaaaucauguggcaagaggcaaccagccacauugaacccaucaaggaaugagcccagaagacaaggagaacugacacaguugaagcaggccaucaguguuucaaucaacaggugcaaggaacugaggauggcaacaauuaggaagccaugguugguuccaggagccagcuuuacccucaacuugcugugagaccuugggccauaccucaccucucugagccucaguucuccauguaagcuugcuguucugcaaagaacugucaaguucuuuccauacuucucuucaacuucaucuuaggcacaggucauugccauagcaaccuccuuucaacugugggaaaaaaaucuaacaaaucccauuuugccacuacaaagaaagugggguacagagugcaucaugcacuuccugguggcaauaaaguaagucacuggugaaaccucaaaaacuugggaacccccaaaacucaggcucuucucuuccuauuuguugggagaaccaauaggagauucucacccuguugucacacacuggaugcuaacuuagcauuuguaggaauucacauccucccaccaccuccuauagucaccagcagauaugcaacccagaacccagacuggcaagagguuaucacucacacuggauuuugcuuuuuuguccccacuaaaggcagcuguuuccuacaaauuugugucaaucaggccaggaaguuucuuuuucccugcaauccauuguaugcaggaagaucagagggcccugucagauacaaggacggaaccagcugggcacuuggagauacaggcuggcugcccuggccuggccuugccccaacccuucugguugcucagccaguccacugugcuggugcagcuguaccugcugacagaugcugagaacaggagacuuguuaugauaauuaauuaggagcacuggcaucaucguaaagagccucuguucuguuccaaagccagcuaagaaacucacaucacucacauccuuuccugucucauaaacaugcugccucuaguccacugaggggcaagggauugagcuuguuuccuagggguaacaucucuaguaaaacaaagccauucugaggagccuguguggacaucaggcaggacuacaucaaauucucaucucauggaugaaaaagcuaaagcugauaauaauaccuauauauauuaauaccuauauauauaauacccauauauauaaaauacacauauauagguauuauauauacaauauauauaaaauacauauauauguguguguguguguauauauauauguauauauagcccuccaagauggcagaugacacugucugagcacccacuauaaucuauacucucauuuuuuccaccauuaauguaagauuaauaggaaauuauuaaugcauuucuuccauguugaucuaacaaaaccaagacuuaaugaaguuaaacacuuugcucauagucacuuagugaugagugagcucagaucucaaucuagcuguguuaaauuccuagauccagguccccuccucuuuacuaugcuguuaacucugugcccagagcacaaacugcagugagaacuuacccaagaaauaggauaaugacccuuuguuucaugcaccacccauuugcugagcaucuuugcuggggugguuacuagaagaaagcacuagaaaggucuggcagagugguuagauacacaaauccuggagccacugugagguuuaaaauccugguuuuaccaucuacugucuucauaggagagcuagaccacauuacuuagccuuugugugccuugguuucuucaucuguaaaaugaagugacaguauaucucaguugggucuaaugaggauaaaauaauuugguaaacauaaagaacuuaaaacugugcccugcacauagugugacaacagcacugguuuuuauuguuaugacugugguaaacacaauugaccucauucuuccccuuacaggaucccaaucuagugaaggaauacagaugugaaauaaacaaaacuaaauguaucauuuuaaauaauacuaugaagagaagaguaaugugagcaagauggcagaauaguagucuccagugucuaucccuucauagaaacagcaauuugaacaaccacccaugaaaaauauaccuucacaagagcuaagaaauccagaugagcaauuacagcagcuggguggagcauagaaauaauaaaagaugcauugaaaaggguaggaauaagaguuucacaucacucacaucacccuucccccaagacagcacagugcagcaugaagagagaaacccuucauguggaggaaggagagugaaguaagcacccaacaucaguguagauccuaguaccagguuggccuucacagacgcaugcuacagacaugaacacagucaauaaagccaucccacuguaucucagugccagucuggcccccagggacccagaaucuaggccuguacccauggacucaggcaccaggccagcccgcuuaagaauuccagcaguaaacuugcccucagacccugccagccaauccacccaaaauaucuugacuggugaacagcuuucuuggccaaagcuaauugguaaagaauaaaagagaucucuacuucuuaaaauauguagacaucaacacaagaccccaaggguuacaaauagacaaggaaacaugacuaaaaaacaaacuaaagcaccaguaaccaauccuaaagaaauugagaccuauacauugucugacaaagaauucaaaauaauugucuugaagaaacucaacuuaaagagaacauaaacaacaaaaucagaaaaacaauacauaaacaaaguagaaguucaacaaagagagauaaaccauaaaaaaagacccaaacagaaauucuggugguaaagcaaaaugacugaacugaaaaauucuauaaggaacuucagcagcagacuugaucgaccagaagauggaaucaaugaggucaaagacaggccauuugaaauuagucagaagaauaaaaagaaaaaaaaaugaaaaagaaaaccuaugggacuuaugggacaccaucaagugaacugaaauacacauuaugggaacucaagaggaggaauaaaagcagaggagaaggugauagaaaguuuauuuaaagaaaaaaauacauagaacucuccaaaucuggagaggaaaauaaacaucucaauccaugaaguccaaauaauuuguaauuuauuaaacauaaggaggucuucauugaggcacauuaaagccaaauucuuaaaaguuaaagauaaaauuaugggcauccaucugaagggaagaguccuccucuccuugggcacagaacuucccccaguccccagucagcaccagguucucagcuaccuaugucuuaugcaauccaggcuuggcacagauucccaauaaugcaaccuccucacuggaugauaggcuaugugaagacagaaucuucauuuuaugcauccuuacaacuccagugugaagcacagacacaacauaucaugugcacucaaucaauuucguucaaugaaagaacaagugacucucuuucauucucuuggaguugaauacucaaucgucccauaaaugguuccagugcucaagcugagaaucuuacaccacagucaaugcccugaagaaauugagacugugcugggaagucagacacaaaaagaaagagaugagguccacucuugcugucauacaugaggaacuaagagucuuucaaacagaggaagaugacuuuguggcagaaaaacccacagaggaagugaaugauggaauggaacuugaggacagguggaguuugaauaaucagugggguagucaauuagaagguuagggaaaaccccauucauuuaucugacaagucaagccccaguaggagccuuuagacagguucuucucacaagaacccugcagguaggaacuaucagcccagguuaaugucaaggauacagaggcuuggaguggugaggugacauuccuagggucacagagccagcaacuguuggagcugaggucugaacccagcacucucugaagccagagcccauggaucucucaggcauccaagggagaaaaaacaaugggaucaaagcacagacgucaaggaaagcaaguaguguuuaaaagacaagaagugagaccuguuuaccagaacugauuccccacauaagaggcucggaggcauucagucuuuauucacaggcuggagugauguugcgguggacuuaaugcccccugagaggucugacuucaagccugugggugacacggagcuacuguuuuugaguuggacagggacauggucagaacugugcuuucagaauuuggacuuggccacuggaagaagagacaguuaaacucaaguugcccaacaugaggcaugggaugggagagguuggggaagggauggaaggaaacagagugggcaccaacaggaaggaagcaaagucaggaacugcuggcuggaauggguccagggagagggaaaaccacuucuccuuccucuucuuaugauugcaagauuaguacuugagaauuaggcugcacaggccaggacuucccaaaacucaggagggaaagagcccagagcacgugucuccaauggaggcuauaguuccaaaucacgugaucaucggucaucuccuugcccacccugaagcccuuguccccaguguacuuugggcucagacagucccucaggggauacagcaguguccuuuccuucagcauucagggcaaaugagaggcaaagagaucaauggaaugcaaaagcguuacuauagaugagaagucggacgcacagagagguuccaccacuugccuaauaucacacagcaaguacaugccagaaucaaaauucaaaccuagagccccgguguaaaccuuaccugaaucagucagggagcagcagggaggcaguggaaggauaggcccccugaccucacuccccgccugccuucccauccugccagugccuuccaaacugauaccagagagcauggcagcccuguguugcauccacccugauaaugcauccacacaggucagccuucugggcacaaaacaaggcagagaagagcaaggaguggaccuggaggggcccacggaagcuccccagcacccaccacuccaauggcccagccccugguaggucuccagugcccuucacccuacagagccacagaauccccagaccuugacgcugcagcuagggcccgccugccucucaagagaagggcagggccccacacaggcaagugcucugccuccgcgcaaagcugggcaugcgucaucacacucccgccuuccuuccucauucacucucccuugcccugcuucuaucaguggcuccaagacgcaaacaucucgaaaugaccugcuucuguguaggucagcuaacagaagugcugucuuaagaaaugagggccagcugaugcccacuaccagacccagccagccccucccagccucccugccagcccugcacauggaggccuggcggccaggaaaaagaaagggcuccuaucucugauuccucagggccucugauaagaaaugucaucccuugcuggguaauauuaccaagccagauaaaaaucucuaucaagcuuaaacauauggcuggcugcagaacacagaguccaguggagaaggguaauuuauuugcuuaagcugaaaacccugggcagccgaaagaagugccugaauaaaagaguaagagccaaauuauaaccucuucugacuuggcauggggauuuuucccugggaaggaugagacaccugagaacaacagggggcucuccacacauuucuccugacacaauaagcgcuuucgccuuccucuuucuucaaagggcacuuucacuuaugcuaucacauuuaauccucacuacaaccucaagagaggcauuuuuagcuuccuuuacagaucaggaaauugagauucagcaagguuaaguaaaguggccaaggucacacaggcagccaugcuggagcgaggacccaaaccccagcaggucugacucaccaucagauggggaagcugaucccagcuucuggggaggaucggcucauacauccacuuaaucagcgaagucagaucugcccaacuuaacugacaaugucagcuacacauuguaaucuugaagguccauuucaaggcucucccgucuccuuguuucucuguagccuaaaggauaaugagaaagccuugcagagcacagaagcucaaggaaaaggacgggaggccagggauaguacccaggagagcagugagugaccucagggcuuagauuccagccucauaugcucaaggaguagcagguagaaggaaacuguggaaagaaaacuccucucucuguucauucauucauucacaaauauuaguggaaagccuauugugugccuucucuagcuuggccuuggagauaccaaugcaaaugggcaggcuaggaccugccuucauggaucgucugucuucuagaacugacuuacaggucaguaaagaggcaauagccacagaguguguuaaguguguuugugaaugcagaaguucacguaacugaucugggguugguggcugugcauuaguguguagcuguuagcauacuccacacaguguucuaggcacuauucuuuaaaaagucagcauuguuaagguugacuuugcucuuugguaguuaauauagcuucaagauuguucccaauuacuucauauagccacuaauuuuuuuagauuaauuuuuaauucacaaauaaaaauuguauauauuuauaauauaugaugugaaguuuugaaugauguauacauuguggaauggcuaaguugaguuaauuaacaggugcaucaucucacauacugauuuuuuuuuacuaauuuuuuaaacagcuguauuaguguuccauuuuaucacaacuuaaucaaccaaucacuaacuaaugagcauuuaagcugagucucguuuuucugugucaaacaauguuguaaugaagauucucuucucaucaugcauguguuucugcaugaaaaguucuuaggauucgcccaguguuuuuuaagcuuggcuuuuccugugcucuucacugcagcaguagcaaggucucaauagcguccuuuacaagauaauggcucccacgcgcccauccucuucagaccugguggggcucuaguaaaaggguuuuaguucucuuuagugagcaacugccaccauuuccacaaaagcacacaagaaaacaaaaacguuuccauucugguggccaagaaaccacuccucuuaucccugccuccucuggcccauggugacuuaguucagaaucaagcggaacuuagcagcaagacaccaaccucucuucucacaggucauuccuagaaagugucagcuuuccuuuucuucuggacucugagagauucaagaacacagaaagcccaaggcuagcaaaucuccacugaagcucagcauacaucaaaaacuaaagccugguggagaaggcacagcaaaugucaacugcacacuugggagcccaaaguaccuuggaggaaggcaucagucguccaacagaacaccuuuggauagucaaaagauaaagagaguaugacuccauggcuggaacaaaguagaaccucagacaagaggacauccuguucaugagagguuggccauccacugaagacacugugggggaccgugaaggcagagcagacaugagaaaggcagagccccacuccuugguccccuggagaaaaccaaagaaagggcuguaaucuacgugauuagagauggagaaacuaagagccuggggaacaaaggaaagggccuuacucauucuuccuggacaaguuagagaagaggauauuugaguuagauauugaagagugaacauuuagaagacagagaaaagggagaggaccuucagaugguacucacagagcaguguggcauggagagugaaagaauguucagccaguggccagacuguaaaggguauuucucaggugcugugcuaaggagcugggcuucucccuccagaugcgauggggggcuguguaggcuccagagcaacagaaugacagauuagaacuaugcuucuccaucaccauggagcacgaacuagugagagaagacucucggccaugugggaaccaguauccuacaguucuaagaacauuccacaaggcaacagaugcaguggcuuaaacagaggccuacggagccaggcucccggacuucagaucccagcucugccauucccagguugaacaaguuacugaccgaccccguggacaguuuucucauuuggaaaacggggauaucagcagaggccucuuagggccauuuuguugguugugagcuggaugaguuaauauaaguaaagugcuuaggacagugucuggcacacaguaggggcacaacacaagacagcuguugggauggcugccaucucucuuguccccuugguuuccucuuucagcauugucauuucuucugaaaggugagcagcuaugaaucugagcaagagugagaagguucgagcuaacacuugcuuaggagggcuggaacuacaucugaaauaguuuggggucuguagcuucuuguuaguccccagaaucccuauaacagggaugcucuaagacugugguccucaaacuccacugcauaauagaaucaccuggggagauguuauaaauccaaaugcccaggucccauuucagacaaaaucaaaaucuuugcagcugggguacuagcagcaggauuuaaaaaauccucuaggcaauuccaagcuucaacccagucuuagaacaacugaucuaagagucaaauccaacaggaaaggaaaacauggcagagaggaaagcauccccauccuugagcagugucaucugcagaacuacuucagcucauuaugaagccgcuccucauuacgccuuacagggcagcucgguugucacaaggagcuaacagacuugaaaguugcccuggaucacugcuuuuguaacacacccuuccaaagucuucuggaagcagguaaggguagaaaauaccaacaaauacagccauguggguaacucuuguggaaaaagcauuggguugcgugcagacagcugguucuggcccuaggcucuuucacuaauacuacguaacuuaaaaagcauauaacacuuaugcaucaguuucuucaguagugaaauaaagauaagaacugacuuacccauuagauaagauguugugggguacaagccagaagacauaggucagcuguggcaaagcauuuuuauuuaacauguuuuccaggucuucaauggaacauaaaaaguuuaggagagagaaauguccccuuaaacauuuuuuuucaaugagagaagggaggagucaaggaguagaguuggucggccacaugaaagcucccuucagagcaggcugccguggugccugcccacaagggguacaaguggggccagugauagggcaggagcucaggguguguccaagggcugccccagcaaagacguuaagauaggauauguuaucugggaacaauggaacaacuguaccguuguccuaaaccugaaucugacaagaggggauaagacuccaggaagcauguccccaaaccacuggccagaguggccccaacaaaccacugguccauuuguucauuccuuuaucuacuuacucauucauguaccuuacaguaguguaugucaacuacauaucaagaauuguauggauguacaagauuguaggaaugcuggaaugaauaaggcucacuccgcacccucaggagggacaaagauaaguagggcaaacaagugguauuuaaguacaacacaaugugcuaaaguauaauaaaauaacaaguauaauaguaaauagccaccacucauugauggccaacuaugcacaggcaccauacuugguauuuuauauugaacaucucaaauccuugcuaucuccucaagguaaggaucuuucugggggcaaagaugguuguuauaagcauuauuaccuuuauuuaacauuuacugaguccuuacuguguugcaggcacugugcugagguuuuguuuguuaccagcagggagguaguaaugauuuagauuagagcaugggcucugggcccagauuugccugucaguagcugggugauuuugaguaaguuacuuuacaucucugugccugaggcuggguguggaggucaucuccaaaauagagacuuaugcauuuaacaaauauuuaguaggcacuuaccauuuuccagggaauaaagcacuuaauaaaauuaacagaagucucugcauuccugggguucaugagggguugggggugucagacugucaacaaacaaauaaacaaguaacuauaugcugggucagaugaugauaggugcuauggugaucaauuaagauagaaaaaaaaaggggagauggaggugcgaggugggugcugucugcauagaguggccaagaaaggcuuguccaauaagauguuuggggcuaggugcggugacucauaccuguagucucaacacuuugggagccugggcagcaggaucacuugagaccaggagguugacaccagccugagcaacauagugagaccccuucucuacaaaaaaaaaaaaaaauaaauaaauaauaauaaaaaaauuaaccgggugugauggugcaugucuguagucccagcuacuugggaggcugaggcaggaggaccacuugagcucaggaggucaaggcugccgugauugcaccacugcacuccagccuggaugacagagcaagacccugucuuuaaaaaaaaaaaaaaaaaaaagacaagauguuuggccuccuuguguauguguguguguguguguguguguguguguguaggaaauaguuugggaaaauaauacuauauagcaguuaaaaaauaauguauguguacacacacauacggacacacaaagaucuccaaaauauaauuaucgacugaaaaaauuaagauguugaaauacuugauuucccccagcucugaaugccauggaguccacagagccagagacagcagguggaggacacagggaucaaucccagggggaugggcugcugaggcuccugccguaggccaucuccuucuaugagcgagcgaaugccaugcccucugucuaagucucuaggcaacagcaucuugugacccagcuuccagucugauuuuguucucuuaguuccuugaagauacuuacacugauuucaaaacaaaacaaaucaaaagagcuucccucaccuccugacccccagccugugagaagccauggagagcaauucaggaaugcugaguugcaacgugaaguccuagggggcuuuauccagcuacagaucuaacccacaggguguuucaaauauuuuugaaguuauugccuacauccaaaauucagaaauuuucauuauauucaaaguccaaaaauuaauuuggcagcacugaaugcacccucccacaauacaacauuaaguggaugcuaauggagggcuggccccuuuauuuagggaaggcacccucccauugacccauccccacuccuuagaaagcaccuaguccaaggcugagcacaguggcucacgccugugauccuagcacuuugggaggcugaggcaggcggaucaccugaggccaggaguucgagaccagccuggccaacauggugaaacccugucucuacuaaaaauacaaaaauuagccaggugugguggugcaagccuguaaucccagcuacuugggaggcugaggcaugagaauugccugaacccaggaggcagagguugcagugagccaagauugugccacugcacuccagccugggugacagagcaagaucucucuuaaaauaaaauaaaauaaaauaaaauaaaauaaaauaaaauaaaauaaaccaccuaguccaaucuccucauagauggugaucccacugcucauacaggugagaaggcucacacagcaagccagggcaguaccagaacuaccauuaccaguuaguauuccucacacaaagaccugugucccuuccuccugccaggcuccacuccuucuucuucaggaccaauuacagucuuagaaaguagcugauccacuugacauugggugacauggggcuagagcaaggcccuggggaguauccuguguccugcacaucuuggggggaagugguguucuuauacuguaugaugguccaaacacauugcaacacuaucgccauaauuagcccaggccuggucaucaggaggacucuugcucaauauuauucuuugcuucuugguuucuacauccagagaaauaauacuucucuaaaaaucaauuguccccagcaacccaccuacacaguucuuggaaaauauggguuaaacauucugccuuacaaagaaaacaaggaacaaagagggugaaggaaauucaucaccaugguccugcacuucacauuauucacaccaaccauuuuuccagucaccgaguucaaaugacccugucccuuggggcugcaaaacuauuuguaccaacacuugccauuaaggaagcuucacaugcuuuaauaaacgggauuacucaguaccaagagaugcuaaauggcuucaagagacuggagguuaggggaacugaaaauggcauggaaggaagaugccagaauaaucaauuucugacacaggagaaggaauggcuggaugccagucugcugcccagaacacuggagggacugugauacaggaacugcaaagcaucagucaaauacauagguggcccaugagaaucccuucccaaacuuccagaaaaaguaaggagauagauggcucuccaugaugacauccaaacuguuuuaaggagaggcugcaucuaguaauaggggaugcuugacacauagcaagugcucagcaaccaauacaaacacacacauacuaaacacaugcacacacgaacaacacacacacaaacacacacgaacaacacgcacucacaaaauacacacacauucaccacacaugcacacaacacacacacacacaccaaacacauguacacacacgcaaacacacacaaacacacacacaaaauacacacauacauucaccaagcacacacacguacacaacacacaugcauacacacacacacacauaccaaacacauacgcaccaggcacacacaccaaacacauauacacgccaaacacauacacaugcacacaaacacacgagcacaaacacacaugcacacaaacacacacauacacauaugcacacaaacacaaacaacacaugagcacaacacauacaagcauaaacacagaugcacacacaugcacaaacaugagcacaacacaaacauacaagcauaaacacacagaugcacacacaugcacaaacacacacacaaacaacacacacacaugcacacacacaaacacacaugcaaacacacgaacacaagcacaaaacacaaacacaugcagaaacacacauacaagcagaaacacacaugcacacacaugcacaaacauauacacacaaucacacacaagcacacacaaacauaugcacaaauacacacaagcacaaaacacacaaacacacaggcacucaacacacacgagcacaaagcacacagaaacacaaaagcauaaacacacacaagcacacacaaacauaugcacacaaacacacccaagcagaaaacacacacauauacaagcacacacacauaugcacacaugcacaaacauauacacacaaacacaugcacguaaacaauacacauacaaauacacaagcacaaauguacauacacaaacacacaagcacaaacaacacacagaagcacucaaacacaagcacacacacacaaaagcacaaaaacacauacacacacacaagcacucacacccaaacacauauaacacacacaaacauacacacauaauuucugaaucucuuaaucugugcugugcggccccauggacuggcuccucucugcccacaauugucucuugaugaucacgcucauauuuaaggcuuaaauaacuuaagucccaaauacaaaucagaauauccauuuuugcauaaauuuuggauauccaaauuuaucccuuucuuccauguguuaggauuuuccagaaaaacagaaucaguaggauguguguauguugaagagagagacagaaagagagagauuuuaaggaguuggcucgugugauuaugggggcuggcaaguccaaacucugcagggcaggccagcaagcuggagccccuaggaagagcugauacugcggcuugaguccaaaggcaauguggggucagaauucccacuucccauuuccucagucuuuuuacucuuaaagccuucaacuauuggaugaggcccauucacauuguggaggguaauguccuuuccucaaagucuacugauuuaaauguuaaccucauucaaaacguacuccaugugacaucucaacugguauuugaucacaugucugaguaccauggccuggccaaguggacacucuggaucuguacaugcagcugccuccuuacugucuccacuuggaugucugaccaacaucucuaacauaacaauuccaccucuauccacaaaaaaacaaauaggcacuccugcucacccugaggauuggcccauaucaauaaauggaaacuucauucuguaguugcacaggauaaucaacaaucgggaucauauuucuuacggcaccccauagccaauccaccagcaaauccuaccuuugagauauauucugaaucugaucaugucucacaaucuccucugcuuccaccaggccaggauuacugcaauacccuggauuaccacaauagccuccugauuggucugucuuuccaucuuugccacuuccaguccacuuucaacacagcagccagaaggaucucauuaaaaugcaaaucagaaccugccaaaaaguuuccgauggucccaucucaacagagaaagagccaaaguccuuaccaagacucccucugagccaucucaucccuaucuuuuuugcucuuuguggcuagacugucuccccagccaccaucuccccugagguauggcugccuaucucucaugaccagauggggcauuuccugaaacccacccagcuacaaggggaagcagcacccaccagggccuuagaggcugagcaagggccaugacuuuagggcauuaacuuaaggacaacaggaagggagggaacacugaaagguguuaacuagaggagaggugggcacaggguagaaauugucucuuuggaugauuccccaaccagcugguguggauuguucucugaacuguauuuugaaagagaagaauuagguagcugccagguaaggaaaggugggaggagggaggaaagggggaagggaggcgaggcaagaaccugagcaggugcucugcaaccuucaugaacuccccugccaagcagcuacuauuucccacggcaacagucauugacucacagggaaccaaggcagaaagaagaaacgguguuugauuguggccagaagaaagaaagccuuccaguggccaagaggaggggcaccuggugcugaguagguuggcucagcaaauggagcugauccgucccuccccuuccuucugccucccuucccucccucagacaguaccugagcacaaagacacaauggcugcaaggucccuucuguguuauaaugacuugguugcagacaucuggagagggagagaggaauuaccauguuuccuacugaagaacauuaaaucuccuuccgaagaccugcccagcucucagcagggugcuuuguccaccaggccagauucaacguaccuauaaggccuccucuuacugaaucuagugaggcagggcugcuccacuucucagaaucccucucaauuagcaagacacagccuacugcagagcauauuuuugcaagcaauagaggauuccguccccaaggagucaacuagcaggaacugggcccugucaaugaaucugugaaaugauccuaaacaggccaagugaagacugugcuucagggcagggcugggauaugggugacuugauuauuuacagaggcuuguuacuccagaggccagcacccucaagcccauucacgugccgcaccucccucuuaggacuuaucacugcuggaaaugacauucuuucuuucuuagccucccucacuuggcuacagaccccauuaguaccaugucugcaucugcuguucaccgcggcaaccucacacccagggaagugccaggcauguggcgaucacugacuaaauacaugcugaauaaugacacugcucaugcuaaaaggggacaagacaggauggaggcucccagggaaauguggagcucaaagaaaccuuccaucaacauuugauccaaauucuuaauuccaaacagcaaaauaaaaguuuauaccagcgauuccaaucucaggacuccuccacggggguccucagucuauuuuucgaagggucaagaagucuaccagaaauuucaccuuccuuuccaauaagaccacgguugucaccuaaaauaucaagcuucuuuguucgauacuggccagaauuauaucaacucagccuggugacccagaucaggaacucccacuggcagauauuuuuagauaagaaaguagaggaauaaauacuuaacaaugaaguuuauuugguugauaaacucccucacagggaaggagaaccaguaaaagggauuucugguauagcaaauguugggaaccacuagucuacaccagugguucuucaucaagggugacuuugcacccucaccugcccaccaagcccaggaaaggcacugaacuaaaugugcugcugggcucuaagccaccaacgcgagcagcauuuguguuuaccuggaaggcaggggcagagacugagcuucgugugcuccugagaagcucugugucccacggaggccugggguucagaacccaggcuucucagcaagggcagagaacgugggaggguuggguaccuccucugucugugggcacagcuagccuagcguguauuuaugcuaaaaaaugcauugagauccucccuccaaauggacuguacuuacaggccagaugcuucaaggcugucccccacuucccuuuccaagccuguugccgacacggccucaggaaugcaaacaaagugcaacaacacaauaacaaugacaacugcauuuccagguggggaaaagaacauucucuauagcgaaucaaagcaagcucccccaaacccacaccugaaaaauccauuaaacacauaaauuauagaauuggaagcagugauaaugauuacuccccucugaacauacaugcaaaaugaaaacaaaugggcguaugucccaucaccaacugaaagacaggugaggagacuguaaaauggacccaguggcuccugccccucagaggaguggugacugcagggccuaaggccccagcacagugcccaacuuccccagaagugcugggucucgggcaccccugccucuucccacugccugggggagcuuccaucuguggaccucuggcaguggcaguggcgguggcugacuggucaggaggagaggggcccaggcagcuauuuggugagaaucucaacagcaaguuaugcaucaaaaucaucccaaaugucccagggaaggagcccaaacccauggugggccuggaggcugcauccucaaugcagcagaggcaggcaggaauggaacagcacccugcagccaaguccuggcccuaacgaagccucagguuucucuaacagucacuugcucaacuguccuccaggagcugcuuugacagccuucuauuaccuuucuggcaaaacccaggugcgguaacccugcagcagcuuccacucacuccugcaaugccugacagguacaugacaggggcaagauucccauuuacuaaauaaaagaaugauguaugcucaugaguagcuuacagagguaaaacuaaggcugccugugaacugcagugacgggaggaucaggagugagugacuguuucagaauagccacuaaacuacugagggcccagcacagugcccagccccccagaagcgcugggucucgggcaccccugccuccucccacugcuaacuacuaaauguccuaucaauccuauccagaagccucagcccagaacaccucugcagacauugcccugcauugugacaucccuguggagagguucuccagcauccagugccuuccugucgaugacgagguacaagagguaaggcacgggaggaaggugcugggguacauacugugcuccagacagccaucuucaagugcauuucacagcucaauccucaccaccaugcaugagauggaaaucacuauuacccuuauuuuacaucaugauguuacaucagaugacagacaaaccuggggcuuugagaaguaacauggcaaaaggccccuuaacuaacaaaaggugaacgugaacuugaaccaaagcacugggacuccagggaucuaccucggaaccacugagccauucagucuccuucaucacuagggaagugguguuaacacuuagaauacugcaaggacacauuguauuaguuccucucgcugcuguaacaaaucaucgcaaacuuggcagcuaauaacaacacaaauuuauccucuuacccuucuggaggucagaggcugaacuaagucauaaggaacuaaaagcaaggcaucagcagggcuggguccuucuggagcuccaaaggaaaaucaguuucuugucuuccacuucuagaggcugccagcauuucuuggcuccuggcugcaucacuacaaucucugcuuccauggucauaucuccuccucuaggguauucagucucccucugccucccucuaauaaggaaccacuaauaaguaacuauuugugauugcuuuggguccaccugaguaauucagcacucuucccaucucaagauccuuaauuuaaucacaucugcaaaguccuuuuugccaugugagauaacagucgaaggucccagggauuauggucaucuuggggggcugcuguccagcagaccacauguguugacuugucuguacccugcacugucuuacucgucaucacauucccagcaccuagcaaggcucaauaaacgcagaaggagggaugaaggguaggaacacaagcauuccaucccuuggccccccacaaagugugagagcagagacagaugggcucagguccaaggaaggcugagcagacauauacauauguacugggaacccuuagaaauugcaaggagucagcaccucauuggcuugaggucggaaguccccaaugagucauguguuuguuuuccuaacccuguguguucccacagcuauugcagccuaaauagcaggcccacaagcagcaggcagcuccucucaugccaauuuccugggaacccaggcaggacuagaguagccaacagguuuacugcugugcccuggugaaggcacuuuuccugcaugacaguaaacaaagccagacagaagagaagccugcaaauaacuggauccuugccacaaaugcuuuuauugcccccuaccccugccugccuugugauacuaugaacaguugcuuuucaggguaaauaaaauagccauaauagcuacugcucaugccaggacuuugcaaacaucaucucuauucuuuucaacaaaucaggcaaagcaaguguuucuauguuuauuuuacagauggggaaacuguggcaaaggcagcagugaagucauuuacucaaaguccccugcuugggaaaaggcagagcagggauucaaaccugaaccugucaaacucuaagguugagcucuuucagcuucggcacacauuugccaagugugaggaauaaauuguauauauggagacacaggucuugucuguguaacagagccagguguuccagcuuccaaguuagagcuaagugaucuggagcccaagcucccuucugaacuaagggugccccugcuuguaccuacauuuguccauuuugcacauguauguuuagcuuccaugcuguguuugacccuguagugggcacagaggacacagagauaaguaaaggagccacagucauccccuucaaaugguucaguugacacgcacaccaagagaugagcuagaacagcacaguaaguguauucuggaccagagcgaagcccuggaaguguaauguuccaaaauggaaagucagcaacuccacccagguggugagaacagucuugagggaaauggguuucuucccccagauccagaaggaugaacaggaguuuuccaagggaagagaauaccaguccuugcagagaaaagggcauccuccuuauaaaccuuuaguucacugggaaaaauaaauacaucccuggauuuauguuuggcacagacuaaguguagagaaggaaagaggaagaagaggaggaggagaaggaggagagaaaagagggggugggggagguagagaacaucuuguuucuaucucccucauucaaagcucugcacuuugcuuuuauuaggccaaaggucagggccaaaaaaaaaaaaaaaggugcagaagugcagaugguaccaccuguaagcucacagcucggcagggcuggggagguggccggcaaggcagaugguugcccagccuucugacucuggccacccaggaaucacuuucaaauacgucuucuuaacaugggaaagcaagcaaaaguguggagaggggccucaggcaggcaagugaagaaaaguauuccuaagggaauugacuucaggauacaggccaaagacugaauuuggcaucgggacucccuggggcuaugccauggugaaggggaacaaaggaggaggggaagcagcuccaacuacacaaggaggaaugccuuacuucaaggccauuguuaaaaucagagccccaagucaguuucaguucucaaggcuggagauuucgcugaacuggugaggccccagccugcacacuauggccaauuuauggcucaaaggccucauuucuccaugaccuaucucaaaagaccuucuucugaagacuccaaagauuuuacgaaaaauccucugcuauguucuagccucugggguggccgcccagggagaagcuuguggaaagccuguggcgauagcaaccugcggaaaggaggucacaauuucucucuccuaaagcuucuuuuccuuccaguuuccuuccaagcaacacugugagggagaacuggcugcaagagucacauaagucugacuugggcacagguuuggguucacacacacacauacauacacacacacaugcacacacacaugggaaccaggcaggugacauuucaaugcuggcugagccacugcucuguuaggcaaccuugauaaagccccguggucccacagagccucggagaaucauaccauucaucuccuuaaguggauuguuggguauucagucacugcuaggugccugcuagucucuucuucuuucuaacaaugcaaauaguuuuaaguaaggacgacagcaaagcucagagaagccugagggacaguugagaugacaucaccugugaucaagugcaaacaggucuucacccuaccugcacccuuaccugaagggugacucuucacccuaccugcacccucacccuccaccaugcaccucugcagugccuucccacuccgacacucaguguggugaggucacucgccucagccaauggagugcuagcaaaagagaggccagcagaagcuuggaaagggcuuacucaccuaggaguggucuugucuugcucugugcuuuucaccauaagaacgacauucccccagcuagucugcugguuucagaaggagacgaaagacacagagggcagaguggagacaccccagccacuccagcaaaaucacaucagccaccaggcagccacacccuagacauggaggcaguccagccaagaucagcagggcugcuuggccaaucuccccagauauguagauaauaaaugcuuaauauugaaagccacugagauucugcaguuuguuacuuggcauugccguggcaaaaauuaacugacgcaauuaugguacaccaugauggaaauauaauaugcauaucccagggcuacugaugagaugaaaugaaauaaaugaaggucuuaacucaaugaaugguagcugugauccaccaucucauaagaaggcuugagaucaccacuaagcugucuggagaggucaacggaacagccuaaguuuccuguccugagggaacaacgaaguucaugaaggaagcaggaguggggcaaccuccucacccuucuugcuauagcuccacagguuccagcagcccugggcccacucacacagucaggauccagagcuguaggcacagcagugugggcugcgaccguuucuacacccauguccuccuccucagcucugggccucacagacuccaccgaaugacugcucgggucuucagccgucucuuaaggcccgguuuccugggauuucaaaaugauuccgccuccaaggcuuguucucaggaucaacaaugaaaauggauuugaaaucccagcaagaagcagauugcuacaugaaaugaagggaugucuuccucuuucaccaccgccaucgcugucaucgucgucaucaucaucaucacgacaugguuguccuaucauaauaauuaggggaacacaauauuccaaaggcuagggggaagaaauggggagcaagguggaccaguguuucacaaccagagccccggguucaaacgccggauugucuucucaugugcugugagaucuuaagaaaguuacuuaacaucucugagcuucgauuuucucauuuauaaaaugaagauaacaguacuaccuaccucuuagugucauuaugaagauuaaaugaauuaauauaaaaaucaguuaaaacaguguuuggcauauaugaaaugcucagaaaguauuagcugcuaccguuauuacuacugucacuguuaucauuaucagaugcacacacacagaguaggcacuuuaacuuaucgaccugucuaauccucacaaaaacucuaagaguuuggacucauccagucaguuuuacaaggugaagagccuugcuuagcuuccagguuaaugcuuuguacgcaauaccaggggcccuggcaacgugcaggcaaucaccgggcccagaaaugcuccccgugccucccuacaccccauaccuaugaucaggaaacaggcugauaagcucccuggcaguuuccugggucgcuuucacuuuauuugugcugcuuucugcagcuuuuguguucuacaaugcccuuggcugggcgagcagccccuggggcaucaaaggccccgcuggcagcaaauacaaagccacagcagugccaagggucccuccccugccagccacccgccacccgccacgcagcccgggagauucacaaggaggugcccagccuccuaaccacuccagguguuacuuaacccucagccuugugaucuguccuggaacaggccaggugcgccgaccccagugugacaggcagagcugauguccaaguugcuccuggacugagggcagcaggcagauagcugucaacacgaugguugggagaacuuuggugugaaagagcucagaaaagcuucauagggagggcgcugucuugaauccaggauggagagaucccuguuuccacaauucgauagucauuuacugaacaccugcucuagggcaggccugggacuggggcugagggauucaaagacaaucugacaugguccuggacuugagggguacagaagcuagugaggaggccauguggaaagacacguucaaugcugagaugagcuuugagcaagaaaugagauaaaaaagaagacugaacuuccugugucuauucacucaguaacuauuaacagaauguccacuuuguggcagaugcuggggagaugacaguaagugaggcacacagucccuguucuuaagaaacuuauguucuuguugacucugccuuggggaacuccaaaagccuucccagagaagcuucuggaugucagcugugccucaaguagcauaauuuuggggaacuuauguugcaucucagcacuuccagcuccucaacugucaaauggauauaacauguuuguauuauaacauaccagguggccuuaaaauauuuuccugcagaaaaauucccuaacagaaaaaaaauucaacuuacauuaaaugacaaaagcugguuacaaaaccagaggaaccuauucuuuacuuuuucaaauauauguauaugcaagaauuuaauaugaaaugaaauauauaugaaaaguauauaaaaugcauuacauauguacauaauauaauaggcaugcacuguuauguccauauaaacuauuauuacacaugguaauaaacuagcaauucuaguguguguagggguaugcauacauauguacaugugcacacaugaguauauacguugguaggauaaaaagguuuuuuuaauuuuucuuuuucuuaagauggcaucucauucugucacccaagcuggagugcacugacacagucacaacucaccgcagccucuaacucccaggcucaagugauccuuccucuucagccaccaaguagcugaaacugcaggugcccaccaccauguccagcuaauuuuuuaaaaaaaauuuuuauaaagacaagaugucacucuguugcucaggcuggucucaagcugcugggcucaagcaauccucccaucucaaccucccaaaaugcugggauuagaggcgcaagccacagcacccagcaacaaguguuuuuuuguuuguuuguuuuugagacagagucucccucuguugcccaggcuggagugcaguggcgcgaucucggcucacugcaaccuccaccuccuggguucaagugauucuccugccucagccucccgaguagcugggacuaagguuagcgccaccacgcucagcuaauuuuuguauuuuuaguaaagacgguguuucaccauguuggucaggcuggccuugaacuccuaaccucaugauccaccugccucggccucccaaagugcugggauuacaggcgugagccaccgcacccgaccgcaacaaguauuuuuuaaguuuucuuucacuuaucuaaauuucuuaaauugugcagucagcauguacuacuuuugaaauuuagaaaauaggaggccaggcacaauggcucacaccuguaaucccagcacauugggaggaugagguaggcagguugcuugagcccaggaguucgagaccagccugggcaacauagugagaccucguuuccugcaaaaaaaaagucaaaaaauuaacugagggugguggugugcaccuguggucccagcuacuuggaaggcugagguaggaggauugcuugagcuugggaagccaaggcugcaguaagcagugauagagccacugcacucuacaaaaaauaaaaucaaauaaaaaauuagccagccauggugguggugcuguagucccaagagcugcuugggaggcuaaggugggaggauuaccugaguccaggaguuugaggccagccugggcaacauaguaagaccccaucucuauaaaaaauaaaaaaauuagccaggugcagugguaugugccuguagucccaacuacuugggaggcugaggugggaggauugcuugagcccaggaggucaaggcugcagugagcugaggucacaucacugcauuccagccugggugacagagcaagacccuguccccaaaauaauaaaaaauaacauuuaaaaauuuaaaaauaggaacaggagaccccucuuucacacgagucuuuuaggcuccgaugcuccucagcuacuagaaugaugaucccccacauauuaacagugcuccccacaacuccuguugaagacuuagcuugcaaugugcuaaccuacaguauucaucacccuucacugugccggugaacugggugcucuaugcuccccacuuacagaagagaaaacugaggcaugaagcagauaggucccuagcuagagauggcagagugaggcgcucgacacucaucugaagccaaagccagugcuccuacccuuugcccaguccugccucuccucagagagcucagaacccagccaggcuauuccugcugccaguucuccuuuguggagacagaggcugugggaugcacugccugggacaaaccagagggcuucacuauggagaacagggagccugggaaaggacucugggcugugggaacagccccagccuguggcccuggacgcaauacccaugccagccgaggagaacguccaggcauuucuguccccaugugaaugggccugggagcagccaggucccaggagccagaaaggcgggaagcagcugccagcgcgccggcaccagcacccugccuugcgcgcucgggccagcuugguuggcugccugucaaggcuucaaaggagugugcaaugcaggcugggggaccuggcuggacugguuggccugaaaccgagguggcugaacaaaaggaggccgugugggcugguuuggcgggagcccguggcgggacggagggcaggaagcgggagacagcagugggaggacuggggagagaugcaaggugcacuuggcacugggcagccuacgccugcaggaggggaccaaaugccagcugggggccucagguaugagccacauacaagggaaacaggcucagggaaggcugugccuuggcaggagauggccagcaaagugcaaacucuugugcugguuaaacuccaagggauuaggugcagcaucugugcauucugggaaauucauugagucauuucuccauucauccaacaguggcugaacacucaccaugagccagcacucaguagugcugagaaccuagcugggggccagaacaccagggccccuaccuuggccaccuugcauggugccacagcccagggaggcaagaacccagggucucuucaggaugaagagaaggcagagacuugucacauggcacagagcauagacacgaugccugggcucccuggugauuccaucacugacucugggacucaaagccuauggcuucauccccugagccucagugcccgucauucacuauaugcucaguaaguguuggccaggcagucaagcccaucagugcauggguaggaguggguaaacccaggauauaggaugccuguccccacccaaguucccuucugacugcaugcugcccacucccaagggaaucaccaccuugugggugagagguuccacucuccagggaccucaaacagugaaguccugagcacagagccuggcacucuagguguccagcuaaggggagccacuguuagugcugccggggaauacaacagggggaggaggagucacuugacuucagagccacacaggcaggguugggacccagauccaagggacucggagccuggcuuuuuccucaacuucaagccagcaccaaagagaaggucacaaccugacccaucucugagauucuuauguaagaacagagggagauccacacauaaauggaagcaggggaaccaugcauggugucuuguaaucaacggucacaacagaugacccauuagagaacucaagaagaucgaggaaggcaaagagaggggcugggagguggcagacaagaacgccucagugcacaggccugggagucagggucccagauucugcuccagacucuuccaucucuucuauggaaugaggccggucacguuccccagagagcgucuucucauuugguaaaugagagggcaagagcagaggauccacaaggucuuucuuugcacacuacaguucugugcuuccagagggaggguaggugggagacuauaaggagaaggccaauauuugaacuuuucuggccucucgaacaggaucagcagagcuggaacagcucugggugcugccugccuucccaggggucuagccagccuccucacccuccagccugcccuggugcagcugaucucggucguaagccaauguggcaugcagagagacagguugcagagauggagacagagggaucugggcucauuuucuacccacugcucgacguggggcuuggggaaagauauuucuccucugugagccucagcuuccucagguguaaauauggaugagaauaacaccugcugcaaaagguugucagagagauuaaaugagagcccaaacaaaaaacagagcagagaaacaugaauuucucucucccuacucucacuuuauuugagcacaagcccuuugaauaaaaaaaaaaauacaaauaaaaaaauaaaaagucuucuuaaauguccacaacuacaaaacaagagugaaucagaaagaaggcugggacugggugcgguggcucacgccuguaaucccagcacuuugggaggcugaggcagauggaucacuugaggucaggaguuugagaccagccuggccaacauggugaaaccucaucucuacuaaaauugcaaaaauuagcugggugugguagugcacaccuguaaucccagcuacucuggcaggagaaucacuugaacccuggaggcggagguugcagugagcugagaucacaacauugcacuccggccuggacaacagagcaagagucugucucaaaagaaaaaaaaaaaaaggaggcuggauucucauaaggaagaucugggcuccagucucugcucugauacuuauucuacauuaagccacugggggagcuacucaagcucucuuggccucaguugccucaccuguaaaauggggcuaaaaagaaugcuccauucacaggguuugggagaccuuaagugagcuaauguaugugaaaaugcuuuggaaaucagggagcuuucaaaacguuaauuauugcaaugcucugacuuaguaaggcagauccucuuguaagaaacagccuuggaaauagucugucacaugguuccaacaggaagggagcuguauugagauucugcacgaauuuaaaucuucccuaacaucuaaucaaaggcaggcaguauggcaaauucuuucagauguggcccaaauggucugggaauggugcaagacugggcauuuggagaagggugccuggggugagcuggacaggagacucucuccccugagggcugaaggugccuggugcagggcucucaggcaccuugccaguguuuguucugugcacauugcgcaggccuccugccuucuccucuggguacaucaggugauggugggauuauuaccugccugacagguaguugagagacagggguacaaagagggcaagaaacagcuccucagagaagcugccagcccagcagcuggcccccgaggccccgaacacccagggugcaaugacggaaggcauccugcuuccguaccccgaaccgcugagcaaauacacaaguguggcaggugccuggggcugcuagccaaguagggcuccugccuggccugcgccagcccaaacagcucccuggcaccgcucccacccucugagcuggcaggcagaacgaaggauagguagaugccggggcagccagcaugaggggcuucucuccucagauccuuggagguguugucuagaaauggcaugucuggggcugggcacaguggcucacgccuguaaucccaacacuuugagaggccaagaugggaucacuugaggccaggaguuuaagaucagccuggucaacauagcgagaccccaccucuauaaaaauaaaugaaugaaugaaugaauugauuagagauggcacaccugcagcuagccagcccucaggccucuucccaaaaggcauccuccucaugaugcugacuugcuucccugaagacagcacaggcgcauaggagcagcucagguguucccuggugugucuuuuguuguuguuguuaaaccauagugcuucuuuuaaggugcucacguggaggccuagaaacugauaaugucuccaugggaaacuuuuuuuuuuugagacagggucuuacucugucacccaggcuggagugcagugacacaaucauggcuugcugcagccuggaccuuccugggcucaggugauccucccaccuuagccuccugagcagcugggacuacaggcaugcaccaccaaacuaggcuaauuuccguuauuuuuuuuguagaaacagggucucaccauguugcccaggcugaucuggaauuccugggcucaaaccauccaccugccuuggccucccaaauugcuccccgaaaugcugggauuacaggcaugagccacuaugacagcccuccacaagcaacuuuuauccaggaauuucagugacacccacuggcccaugagaucucaauaagucacaccaagggcccuggaagggguaucagguaaucugguuacacucacugccguguagccuucggcaggccacuuccauucacaggugcaauuccuucauugauaaacugaggagcuucaccuggaugccugcugugggcucugcagacgguggugggguguaagaggcuguccuuugcugugagguagcucuggaucuagaaguuugagcuguuaccuccuuagcugugugcucucugaucaucuauuugaugucucugagcuguuuuguccccuuuaaaaaucaggagagcaauuccuccacgcagaauagauaagaagugccuggcguagagcaaaugcccaaaauauggggaccgcuguuuuuuuuguucacucaugcuguguucucaaacugauacugaugucaagcuguuuucuccuugaagaauguaacaggcuugccuuggagccagggacccaaauuacuccguagaucaaucgacaucucacguaaaacuaggaaccuagcuacuucacgucucucucucugaauguccagcaaauggcauuuccacucuuaaagaauuucaagugaguggcagugauugcagccuacuagagauguucugaauagagaaaucaggugcaaaagaguuacauaauuuauccuuauaagaccauucagucauuccaaaaguaguugauguaucaggcaaugcauguagcacuaaccaacccaugcccuggcaggauuugaauccaauaguuauuacuauuguaauaguaauaguuauuacugaguuucccacuguaccuauuaccaaaacaauggugcacaacgagcucaguggcauaagcacuaaguguccauauaucugcguggucaaguagguagcuuuggugaucuuggcugggcucacauggaggucuaggaguuggcuggcugucaacugaucuagguuggugucaacugggaccauuagagcaccugaguuauguucuaugugucauucuuucuucucccggaaccagugacuagcccugaaaucucuuuucauggugauaaaagagauucaacaguggaaauggaaacaguauuucaaagcucagcuugcagccggauacaguggcucaugccuauaauuccagcacuuugggaggccaaggcaggcagaucaccugaggucaggaguuugagaucagccuagccaacauggugaaacucugucucuacuaaaaauaacaaaaauuagccaggugugguggugcacuccuguaaucccagauacaugggaggcugaggcaagagaauugcuugaacccaggagguggaguuugcagugagccaagaucaggccacugcacuccagccugggccacagagcgggacucugucuuaaaaaaaaaaaaaaaaaaaaaaucucagcuugcgucauguuuacuaacagcuuaugagacacagucaguccagaaugagauacagggaaugagugaagaauuagggccauuccuguaaucaguucaccacaucauuuuauagaugaagaagggaggauccauauaauuaugcuacuuacguaaaguuacugagcuuaguaucugagucaggauuugaacuugggcuauuucaacuguaccaaguuccaugcugcugccaucagauaucauggguacaaaggagaggcagcaagaacuuggaaggccaagagugaaccggacaccagauuuggcccugccaggaauucuucagugcaucuuaugugugcaaggccuuugugagcgcagggaaaugccuuccugacccagguggagaucuagcacaagcucuggccaacagaagcuauccucacccuauacagaaugaaagcaaauagcacugaauuaaauagcugcagucaaccagcagcuuuauuugggagaguggauaugaauuaagcaguuccucagagaagaaugcaacuuucccuuuauuucuaagccccauaaauccaggguaaaggucaagccaagacuccaaguuaauugauccacucccaccccguccccaccuuaaaauguccugguuuuacuggggauaaggagagcacauuguaacccaccuccacacaaggccugcagcucugcuggguugacauaggaaagaaaaggccaaacaggguccagagcugacacccagcaucugauucagugguucugggcaggagcacagaagcugacuuuucuuuauuuuugggacagagucucgcucuguggcccaggcuggggugcaguggcaugaucuuggcucacugcaaccucucccucuugaguucaagcgauucucaugccucagcaucccaaauagcugggauuacaggcauguaaugcuucccuaccccugcacucucccucacucccagcaccucuguaaugccacaaacauacugaugcaugccaucugagcucagacgcuaaucaagaaugaaggagaaaggacacugaagaccucccugccauauuaggcauauugccugcaguuguucauuaaaauagcacauaaaugaguauuuauucgguucuuuuugcacuauuuuaagauggaugucuccaaggacuugaaaaaucccaggaguauuuuuagcacacucacccugcaacagcauuucuguuuguggggacugauuauacugaguauaaagauggcccagacaggccgggcgcgguugcucacgccuguaaucccagcacuuugggaggccgaggagggcggaucacgaagucaggagaucaagaccauccuggcuaacauggugaaacccugucucuacuaaaaauacaaaaaauuaaccgggcaugguggcgggcgccuguggucccagcuacucgggaggcugaggcaggagaauggcgugaacccaggaggcggagcuugcagugagccaagauugcgccaccgugcuccagccugagcaacagagcuagacuccgucucaaaaaaaaaaaaaaaaaaaaagcacaaguccuggggaaucggacuggagaggcaaugccccuguccccaguagagauugugaauccuaggcugggggaugugcccuggauucaguagaaacaggaagcccacaggaugucuguagcuagggagcgauggaagcaaagccgcacuccaggaaguugcaucuggaggcaguuugaaggaugguugggcagagggagggccuggaguugaaaagaccccuaaggaagcuaccaaaacaucccagggggucugaaauaggaagccaaggcccacauugcagugguaaaaauccaccaagcggugacuauaggcaggugggggagaugaaguguuuggaagauguuagaaccugcucauucaggagcagcagggcaagcugagcugagacaccugaaagugagcuacuacugggacuugaagguccccugcgaaagugcaaacacgcucuggaaaaagcggggccuggggccugcauucccaaacacuaggauccuguauuaauuuucuacagccacuauaacaaauuacuacaaacuuaguggcuuaaaacaacacauauaauuaccucagugcuccuuaggucagaauguggguuggcucagcugguuucccugcuccugguucaugaagcugaauucaaggugacagcggacugggcuccuaucaggagguucuggaaggauccucuuccaaacuuauucauguugcugaauucaguucccugcagcuguaggccggcgguccccauuucucuguuggcuguuagcuaggggccaccguuagcaaccagucucucccuccaguuccuacaagugggccccacauuucagagccagcaguggcacaucaacuccuucucacacuuacaaucuuucauggcauuuucuugaucacagucggagaaaaccucugccuuuaagggcccgugugauuggauuggauccaccuggauaaccaaggauacucucccuauuagaagucaauugauuaguaaccuuaauuacaucugcaaaguccccuuugccauauaaaguaacauauucauucauaggcauaacaucagagauuagggcaugggcaucuuuagagggccauucuguuuaccagagcuucucugcuucuccacaggaaacagguugagacaucacacaauaaaucauaagggguagagagcccugccacagaaggaggccuggguucuaaacaucauggagaaggacuuuacccagccucagugaggggugguggaaaagacgaaaaucaggaaacauuucccaaaagaaaaaugagauucucugauggaaacuggaauugagcagagcaaagggauguguugccagcagaguugauuaggcuacaggucauuggaagaacauauuuagaagaaaccaaagcuagagugaacuccaaguaaacaccaaaguuuacuuuuuuguccacugcaagugcacagcauugcaggagcuagccuccgagugccaagcugcugccauuccugucuccuggggggccgauucugccuuuccagaagcaacacagugagccuucauggaaaccccaucccacaagugagagaagcuaagugaaucugcacaugcuggucuaggaagacauccgugauaccguaaauaaaaauggcacacuuaucaauaccauugcaaguuuccauuuccugccucccucaaaacaaaguacaaaaaagcaaacguugugagcauguaugcacuugcaaaagcugauuguuaaauauucaagaaauuugcgaacucguuuuuaaagcuuugguugccugaaaucggcugcggugggauuucaccauugaaauugacaaaccuacaauucaggguuuuuguuucuccucuugagaaguuuaacagugcaccacuacauuugcauaaauuaccaaacugacaacagggauuaucucaagaaggggcgggauggguuucaagcuuguguugguuacuuucccgucuuuauauuauuaauuuuuaagauuggugcaauuauagcaauuuuuaauuuuuuccauuaucucccagauguaaaaaauuaacauaaaacaaaaccaccaggcuguaauuccucauuuucagaguucuuuuccuuggaggcagcagcagcauccugggcaccguggcugccuucagcugguccagacgcaguggcucugacguucucuggcaggugggaaacgcugccugauggucagcggcugcucauugcugaugcacugcuaagaacugggcagcccagaccagcuagacagcugaggucuuuccgggaagcuggacacaccuccccagggaagagccuuccuuagcugcagacugagccacaaaccucgcggcucaucugcugcaaccauuaugaaucauacuaggauuaucaaggaacaaucuucuccaggaucagcccuuucccuaccacugucggauucagggaauuuuaagugguggggggaggagggagguagccaguguauuccagacagcaacacuaacugccuguccugaggacgcaagauuuucucauuuguaaggcucugcguaacacacucauccuagcacacagggcuucaaugucaggaugcagccuccuucccaggaagcuggcuggacacuaggucacagacgagcugaagcucucccaagaauacacccccuguuugacccugacauuuacugcuacggccaccugaagacgagacuuuccaucuggaacguuucgguaccuaucucccuggcauuucuccagcacucuuuuccucugugauuguuuagcccaauaagcacacagaauggcauuacacauagugguaaagaagcuguuacauguggugacgaagaugucauuacaugcagcaaugaagggggcuuccaggagccuaacagaggugacagaggcacaaaggggcugcugcccacuuccuggggagagcaucuaccaauuuccagccugugucuggcacagagcagcuaaucaugacaugacugcugaccugugggugacuuuaugugaccuuuuauaacaucuuuuucuuuccuuauaauaucaucaugccauuugaacaauuugcauccugucccuuuuccccauaaugaagucauuuuuaacccuuauuuucauguuuacauggcugaagaaagaauucugugcacgugcuggagggccuuccaccacuccccucucacaggagauugaagcuauuuuggaauuuucaugguuauaaacacacugcagccaauauuuuugugcguaugcgcaacaggauucggaaaauguucucugaaauaaaucuacguauucguagauuauuacaaacucccagggcgcaggaggguaagaugugcuggcauuccaucugauccuggugaacacaggagcugaaugugaccuacagcugggccacauguggcaucacccccgacacaaggagugagagccccagagaccucaucugacauguggcaggcugugauggcugccgauauaaaugaggcuguguguguccagguccuauuaauucauguuaaaaaauuaaggagggcugggcaugauggcucacgccuauaauuccagcacuuugggaggccgaggcaggaggauaacuugagcccaggaguuugagaccagcccuggcaacauagcaagaucccugccucuaaaaaaauuaaaaaaaaaaaaaaauagcgcuugguggcaugcacuuauagucccagcugcuugggaggcugaggugggaggaucacuugaaccuaggagguugaggcugcagugagcucacugcacuccagccugggcuacagagcaagacucugucucagaaacaaaacaaaaugaaaaaauuaaggaggcagcuggccauguaguuguguagacaacacauucuucaugucucaggaaccgggcagcagaauuuuugcuguugcaggaaucuucccaccuguucuucuguggucauuucugcuccauucuccauugcccucuggcacacugagaaacccuuugacauggagacauucagaggcaaaguuuggaaaauaggacucuaggaccuccauacaagggugagagaauuuaauucagguuagaaaugucgggauuugagguccacuggauuucuauagcugcccauaugucccccaaccucucugagucuaugcauuuccaucuauaagcagguggggugacgauggccagauaaucuccaagagccccucucugauguucuacaccaucuuggaaacuuuucuuuuucuuuugagacagggucuugcuguguuucccaguuuugccuugaacuccugggcucaagccauacucuuaccuuggccucccgaagugcugggauuacaggcaugagccaccaucuuggaaucuaagaggaugggagcugcuaacccaggaauggcagggaacucauccucauccagacugagacaucagacccuccaaacuucaaguuuccacagcacugaagcucugauuaggaaaagccauggcuuucuggccaggauaaccaugucgugucaccuggguagcuuauucaauugugaguguuuaaagagcaguacaggcaugacucaucuucgucucccucacagcaccaguuguguggugagccuguaggagaauucgugcugucuccuuuguagugaaaacaaaaccaaagacaaucuauaagauaccagcaagggaggaguuaauguaaaucaugauccagcuguaagcauuagccauuccauucaugguggagaucuauccuuaauaacacagagagaugucuaccacauauuuccaaagggauacauuaauuucaggaccacacgaaugguccugugaggccauguguaccuacaaacaauccacaaauaaguaaggccauaguuggugacacauguuaugcaaggguagguucacaaacccaaccucacuuauucuugagcaacacuaagguauuuauggcagagaaugguuaccauccucgcccccuuuuuuuuuuuuugagacagggucuuggucuguugcccaggcuggagugcaauggugugaucuugguucaccgcaaucuccaccucccagauucuggugauccuccuauucagucucuuaaguagcugagaccacaggcaugugccaccacacguggcuaauuuuuguauuuuuuauagagacaggguuucgcuauguugcccaggcugaucuccaacuccugagaugaagcaauccucccaccuuggcuucccaaagaccaucccccuucuaaagcucgucuagaacuuaucccuggcaagugaaaugauuguagccuacuuccagaagacguguuuaagaaguggugugccuucucuccuguccuucaucuccgcugccaguuggaguaacuucaaggucccagggauggcagaacaacaacauggaagagaccugggucucuagaucacagaaugaagaaaagccaccuaaugaccaggaaaacccuucucaaaccuuuuuuuuuuuuuuuuuuugagacaaagucuugcucagucaccaggcuggagugcaguggcgugaucuuggcucacugcaaccuccgccucccagguucaagcgauucuccugccucagccucccgaauagcugaaucuacaggcgcaugccaccacagccaguuaauuuugguguuuuuaguagagacaggguuucaccauguuggccaggauggucucgauuucuugaccucgugaucuaccaccuuggccucccaaagugcugggguuacagacgugagccacugcgcccagcuucaaacuauuaucugacuuagaaagaggugucuuugagcuacuagaauacugagguuuauuuguuaugucaucuagaguuacucuaacuaaacaaucacuucucagacaggcacaguggcucauacuuguaaucccagcauuuugggaggccgagaugggcagaucacaugaggccaggaguuuaagaccagccuggucaacauagugaaaaccagucucuacuaaaaauacaaaaaguagccugauguguuggugcacgccugcaaucccaguuacucaggaggcugaggcacgagaaucgcuugaacccagauaccagagguugcaguuagcugagaucgcaccacuguacuccagccugggcaacagagugaaacccugucucaaaaauaaauaaauaauaaauaaauaaauaaauaaauaaauaaauaaauaaaucuauuucucuuuucuuucucuuaggugaggaaacugaggcucaacaugguaaauuaaacuugacaaggauacacaacucacaagguguggagucccacuaguuucuuggacaguuucuaaagucuaugaucuuuccacagcacccagcuuguggcaugcuaauugcuuaagugccccuagaguccagaugaagaaaguucagggcacaagacucugagaguacaaagcacuccagaaauaagccaguugcauuugucauuagcuuuccuguccacauucccuuuucuuagucagguucaguccaucuagaacuucaauuucaauggaaacagaggaaaugaaugugguagcagacaucacuaagcacucucaaagcuuucuuguuacuuugaaauggucuaaaaagcccauucuuucuacccacuggguccccaccuuccccgccaagucuguguucucuguucgguucauuaucagcaccgcccacggccagacacggccaggcggcuucacagaagccaaagagcuuaucagaaauaaguacuuuauuugacagugaggccagaugugcagagagaggcauuucaaggccuucacuucucuucucauaauuagucagcuucuagcaaugaugagagucugaagauaucgcaaaauaaugaaugaccuucucaagcagcuccaaugagggagcguuguuucagcacccaucacaggauucuagaaugugagcauugagggagacccucaaaauacuggcuaaccccccuuguagagaugaggauaaauccacagagaaaagcuaugucgucugucuggccacucucuguguauccacugugcaccugccaugugucaggcagugaccuaaacccugggagggaauaaaugcaaaaaagacacauucccucaccuugacgaaacagagcuucgugagagacacugacccauuuaucucaggcccauacauguuuauugcagggccuacuaacacuuggguccccacugcucaccagaacaacagcuauuacagcagcuacaaugguccaaaccuauccucauauacgugucuauaguucccagaaaucuguaaagauuucuguaaaggucuuuugugacuccaggauuuaacacagcaucucaggaugugauguuuaagcuaaauugagucaaaaaaauaacuuuuuguucauuuugguccagcgugauucauucauuaauucauuugacaaggcacauuuccuagccccaaugauuaggacuuacuguugagggauagagagauaaguaaucacaguaagucccaggacacuauauguggaagggaaagaaagaaugcaggugacacaacuaacucugucaggagagucucccccacagcaagguacgaauaaggaccauuuguucuagucuccguagcauccuagccuauuuccacuuccucuugucaucaucuguccucuucaaaguucaaauggcucaagaggcagagauugugucucucuuguccauuccucagcauucagcaaguguucaauaaacauuuguggaaugaauauaucagguuagggacacaaaaacacauuacaauuccauaauagaaauagaaagugaugauaugcuuacacauaggaagaaguggcuaacucugccagggggaaaaaaaaacaggaaaaauaucuuacauacauuuauacacucacacacaugcagcuauuacaaugauaacaacaccauuaagcaagacuuauuuguggaacccuaacuauucaacaggcauaaucccaagaguuaaugcucacaacagacuuauaaggaaacuaguauuauuauccccauguuacagaggagauggaaacagaggcacagggaaggggggguggccuuucugaggucacagagcuaguaaaaacaagaguugcaguauaaauccacauggcacccccauagacuaugaccucaaaucaggauggcuucagggaagaaggaaugaaaucauuucuacaaaaccaaaagcaaucggcacagagcuagcaggcccugggaacauagcaggccccuucaugccucauuccaauaacccaugaaccugaaugugcaaaccugccccacaccaacaaaaauuuggugauucucaaccaucuaaagagauuuuuuaaaacaccaaagcccagaucccucucuagaucaauuaaaucuuaaucucuggaguacggugggagugggguggauauuaguagauuuugcaagccccuaggugacuaugguauacagccaggacuaggaacuccuagagugacuuguuuacaagguacaaaacaggacucuggcaggaggagcagccgagaaauugcugaggaucagcaagagugcaagaaagaaugaguugacuguuugacuacuguuucccuagauuaauuauucaugugacucgaaacagggucuccaucaacucugcaagaacuccuugcacacccaacagggccaacguuggcucacauucauuugaagagggugcccaacugucugcaacccuaaugcucugcccaagaagaguugaaaaccuugcuaaacucacucaacucuugaagccuccauuuucucauuugcaaaaugagaacaauaaaagcugguucuaagggcauuugugagcauuaaaggggauauugauguugaugaauuuaccaaaaugcaaaacaaacagaaaaacaucagccucagagaaaauauuauuuccaccuuggaaaagacugaguagaguaaagaguacaguagagacccagguccaagccuggcuuggccuuuccuagcaagucuagaaaugacucugcccauguauuccucuucugccaaccaagguaccacaauagcuccuucaugcaucccccucauucagcaaauguguauugaaugucaacucuaauguuuugauauaaaucaugggagcuaauguacucacaaaaaugcuuuggaaauuuuaaugugcuccacaaauaagagggaaucguuucuguuuguaaugauucacugugagcucacaagucccaaagacuaagugaccuuauggggucgcaucacagugcaaugcuuggauccuuucagccccacccccucucaguaguaauacagucccuguguggauaucuccagugaugagaucccaaccacugucagagacagagcauucucucagguuccuuuuccuuuuauuaaguugcuuucuguuugccuacuguuucuaccuuuccauuuugguucugaucuuuggggccacaagaaguauauuugaccucuucucagccuuucacuaauugaauaucaccaccaucaagguccagucucuaccuccuaacuccucuccacaucuucucucugugaagcuaagacggcccuaguuuccuuguauuucuccauuuggaaggcaauaauagacugcaccagacuggguggcuuaaauaauagaaaauucauuuucuuacaguucugaagacuacaagugcaagaucaaggugcuaguauggucuguucugaugagggcccucuccuugcauuguggauggcucccuucucauuguguccucacguagcagagagagaagagagacaguaagcucucugaggucucuuauuuugagggcacuaauuucaucacgagagccccacccucauaaucucauuuaaccugaauuaucucccaaagguccacuucuuaauacugaguacauggggguagguuucaucauauacguuuggaagaaggaaaacaguucaguccauaacacucccccacaaaagauuaucuugcuaaacagaagcaaaucugauugagacauugacuaaguacccaccaugcuuacaaaacaugacucguauaugcugaggaaaucaauuugauugcccuaccaucaagacacauauagucuaaagauuguugccaucuacauuuuagagguccccgcaccuuaagacagaaugagccagaggccuggguaaauuuggaauuuacaaauagagucaaagaagucaaggcaagagaaaaacauagccccacccuuucauuagauuuuauucuagagauuaagacuccuaaaccaaaaucacaaaaucucaacccauucacuguugacugauugccuucuuuggaccaugcugcagaaaucacagcagcaauaaacacggcaggcaaaugugucaaccccuggggaacuuuaacuuguuuucugcuguuguagugagaucaagugugugugauucaacaagacgggacaugugaaacuucccuguaccccucaagcccagcacagagccucauccagaguagaugcucaaugaugacaccuuauaaaacaacaaauaauagccaagaccucuccuaagucugcugagggguagccacauggcuucuuaaaagucagaggccauuugcuauuaaagaaagccaugagcuuugcgcaguggcaguaucguagccaaugagguuucaccgaggugcgauuauugcuaauagaaagccacagaugguccuggagaccagagccaucaaaacccuuguucuugugcggaaaagaaggcaaaccagggaccgaacuuggcuuuugaagaugacucaccaccaaaaucccaggucuugaugacagguuaaaucuuguaaaacuuuaauuuggcgaagaaguuggcugcuguauuacucugucacaugucuugggagagguccaguuucugucacccuagcauuaacugaaaagcgggaugaaauaugaagacauuuugcaguuuauaagagaaaagcaccagggaguuuuaacaauuuggagaaguaucauccuaaaauuggacucuaauggucacugaaaccauugcugcauucaguaaaacuggguugccuaaagcuacugccauggagaaucuaaaacaagacauaaagaggcaggaaucagucacauagaggcuugauguacaauauguccaaugaagcuuccaccggagaacugaaaagcaguaucucagcagaauugcaacuucugauuuuagguucuugucaaucuauucuaacucuuagcaaaagauucuugcuguucagccucagaaacacuuuuaucuuagucgacuuuccugaaaucaugcuguauugagcuaugauucuuacucaaauguaguuccuaugucagaaucucaucaaugagaaauuucgcaagauugcgugccaaaauauccaguaccacacuugcauauuuuuacuucaaacagaauuaacacugcaucuuagacacagcgugguuuacccugcuagucaucucaaacacugaagacggugacuguacuacaugauuauuuaccugcucagcucagguucccauuguucacauucacaucaagacagaucagcacuggcacaaccacugcuuuuauuggguauaucaaguguuaacagauccuucaauguguuucucaaaaucucuguuggccuaugguaaagaaaaauaaaaucuauuuugaaaacucacagagcucuaguuaaagguucauuuaauaccaccuauaugucuuuaaugucuuuagacagaaaaaaaaaaagcuuuacaguucaauuaauguuuccccuuugggugcaauuuaacagggagggcuucagaaaaagaaugaaagagggcuauuaaacacauuucuuauauaaagauacuuguucuuaugcaggacauauagaauaggacuuuuuuguagcaaauauuuuaaacaagagauauuuuguuaugugaugcuuuuuuagcugcagcuaaaacaauuuuuagucguggaaauucugaaaagcuugucauuucuuuuauuauacuuacuagaauaugauuacuuuuguugaaggacaauauuuuccccucuuuuccuuacccuguggcccccaaaaauguuucugcuaaugauauaagcagauuucuaauacuuuaucugcuuuuaaucuaugaaaauuaauauuuggauacuucauaauuaucuugauuaugucacuugauaaaacagugauagguauuaauguuaguucagccauauauuuauacugccugggaauagguggcugcaauuguguggcgagcauaauuuggcagcguucacuagcuugcaaaaaccuacugcaagagcuuaaacaucuacaugaacacugauaugaaaaaagcauguaagccugaccauagcuucuaguuccuagauggaccuggcuguguuuuucaggccccaaccugcagggagccccuucaaucucaucagcugagugggcagaauaaagacaucaugccugcacaugcuuagcauugugcccagcauggucagggauugauaaaaacacuuguguauucucuuuuuauuaucaucaccaccauuauaaucauuacugagagaugcauccguagagacaucaugucagagagaagcagaggaacccagaaggcagcaaugaaacuaacauuuagaagcaacacaggugauggggcagcccagaaagcugaagacagaaaccauuucggagaauuagcugcaaaagaaguagggaacaggcaugagaaggggacaguucuuucuggagcuaacucagugaacacaccagagccugugggaacauacauuuuugcaucaguuuccucauugauaaauuggaagaaagguacaugguagagaagguuacauuagucgauauuuguaacaagucagggcacauaacaggcccucacucaagagaagacacuuuuguucucacaucucccuucuuaaauuaaggagcaucugcccuguauacaauccugcacaaaaauaaauccacguaaacaaaauuucacaguaacuacaaaagccuaaugaucauuaaaaauuccugggagaaacagaugaccguucacuaauuaaucggguuuagauaaaucaagcaccacuuaaagaaucacugcuccuuaaagagguaaaugcaacgauugucacauggccaauuucuaauuuuucauuucucuggggagaccaaaaugauacaaucuuaguaauaaauuucucccuaaaguuucugaggacaaacaauuuccagccuccucagacaaagguaagaugagucaacuagcauuacugucaacaaguaugaaauguaggccaccuuugugucuacaacuaacauacuuuguuaaggaucagauguaggacagugguuuguggagugaaaauuagguggguguccacugggcaagacauugcacagcacugccugugcuggaaaaugcaaaagagaauaagcuggaugggaguacaucaaaccuaaaccuacacguguagaaucacacucaugcauacaacccacauucuuacuguuuucccauuaucaggagacaucaaaaaguaaaaggugucucauaccuuccaaacacauuucccagaaaugucuguuaacaggaaguacauacccuucacagaauuucucccauguguagauaaauauguaugugcacuauauuguucugucuugcuccuacaaaaaugggccaauucuauacaaaugguacuacaacuuaucuuuuccaauugauuguggacaccaucccauauuaguacauauaaaucuaucucaugguuuguauuuagguuuuuuuuuuuuaguuuuuauuuuaaaauaauuucagauguacaaaguaagaguuuaaaaaacugagaaauuccauuuagccuugcaacuucucaauuuugacaucuuauauacacaguacaauuauuuaacugugucaggaaauuaacuuuaguacaauacuauugcccaaucuagcaauuuaauacaauauuauugcuuaguugcucaaucuagagacgauauucaaauuucaucaguaacacuuuuuuccaaugcagaacgcagcccgcagucaugcguugcaguuacaguuggagcgugucccuucgucucuuuuaaucugaacucauuccucagucauucuuugucuuucauuuuuaaagagugcugaucaguuguuaacuagaaugucacuccauuuguguuugccugauauuuccuccuuguuaaauucagguuauaguucugucaaggauagcacagcagcaauggcugauuccagggcuggaccaggcaaaguguacacugagccuagaauaucuuguggggucaaaagguaaggcagugcucaaaaaacaacaguaaaauggcaaaaauacauagaacccaacuugaagggcaucccaauguaaaaucuagaaaaaucugagcacaaaauguauuauagucauggguuauaaccaauauaaugagaauccaagaguccagacugauuuuuaaaaaauugcauuuuuucaauauaaaagaaaauaucuuccuuauaguaacauuuuaauugacaaauguaggaguaaugauggaaguagaaaaucacuguuuggcacacacuguaguaauaacuguuucagacaagaauuauccacgaaugcuaaaauuaguuuggugaaagugugaugagaaacaagauacuuacauagguccaaagcaucuccugacaagauacuuauucauuacacagaaaaaaaaauagaaacuuuacaguagagaaaucuggcagacaucaccuuaaucaagugauggaaguaaacaucauuaguaaugugacaagccaacaccaggugccuccugaucugaggcacugagaaggacacagcaucucauucuuuauaguggcaacugagcauuguacuguugaccagcuaggcugucuucaagguucugauacauuacuaaugcuguugaauaaauaucuuuugaaacuucccucacuauuucuaggguacagacuccgagaagugggauugcugggccaaagggugcauauacucuaaacuuggagaaguccugcccaaauuucccuuaucuuuuuauuauuauuauuauuauuauuauuauuauuauuauuauuauuauuugagacaaggucucacucugucacugaggcuggagugcaguggcgcaaucucagcucacugcaaccucugccucccagguucaagugauucuccuuauucagcccccugaguagcugggacuacaggcgcgcacuaccacaucuggcuaauuuuuguauuuuugguagagaugggguuucaccuuguuggcugcuuggccucgaacuccugaccucaaguaaucugccugccuuggccucccaaagugcuggcauugcgggugugagccaccacaccuggccuugaaacgucuuuuagagcuguugguccuguucaucacccuccaccuuucagcagcagugugugagaguacccacuuucuuugcuagcacucagcacuacaagccaccagaaugcugaaagcuggggcaaaggaagccauauguggcugugucagcagcugggcagaugcagggaguacagcaggagccagacaaaccgagaguacuggaugcauccggaugcagagggauguucugagguuuaacuaagucagggcuccaggacacacugcagucagcagaagguacauguacaaaagauagcaggggaaagacgacaagacuagggcauaucuguuggaugcuauuugagagguuugcuauuuagaaaugaccuaagagcuuaaacuugcaccaagccccaccuggcccagucuccauccuucagucacagcuccuuaaaagucuaagacagggguguccaaucuuuuggcuucccugggccacauuggaagaagaagaauugucuugggccacacauaaaauacacuaacacuaacgauagcugaugagcuucaaaaacaaauaacaaaaaaaucucacaagcuuggucuaagacaauacaaauguaguagugagguuucccagucaaacuuauuagugauaguugccaaccuuuguguuguaacuuuuuuuuuuuuugagauggaguuuuguucuuguugcccaggcuggagugcaauggugugaucuccgcucacugcaaccuccaccucccagguucaagcgauucuccugccucagccucccgaguagcugggauuacagucaugugccaccaugccuggcuaauuuuguauuuuuaguagagacgggguuucuccauguuagucagguuggucuugaacucccaaccucaagugaucugcccuccuccaccucccaaagugcugggauuacaggcgugagccacugugcccagccuguguuguauuuuauaaucaauuucaugucacuuuauguggacuucgcaacaacauagagaaaggcauuguuacauuuacagguaacaaagacuggaaaaucagagagggaaaguaacuuguucagggcugcacagcugcaaagugaggcagguaauugguauucgaaaggcuacuucagugguaucuggagacuagucuaucuccuggcccaggcuucucccuguagcaggaccacuguuguccuaacgccacaaauacauuaucucauuucaucucuacagccaucugaugagauggguacuacuguuagcuccauuuuacaaauaggaaaacggagauugugccccgggcuuugcuaccaguaaugggugggcucaggacucucucggcagagagggaagugaggggacaaggcagacccagcucaaccccaccuccaggaugagcaaauguagagaaaggugaagaagugcuggcaccugaauaaagcccucccuucucccccacccaauaaacccaguaaauccauaguucuugauuaccuacuguauacaaacuggcuggauuacaaggaccugcuuuacagacuaauguucauuauaauucacaagagucaaggggaucuuauuguacaaugaaauacaguaguugcggccugcuguggacugaaaggugccagcauccauucugcauucauauguugaagucccaaccccuaaggugacuuuauuggagauagaaaccuuauggagguugguaagguuaaacgagguccuaagggugaaguccuaaucugaaaggauauguguccuuauaagaagaaacaccagagaacccucucugcuccuacaaccauguaaggacacagaagaaggcaaccaucugcaagccaagaggagagcccccaccagaaacugaaucaguucacaccuugaccuuggacuucccagccucuagcacaguaagaaaauaaacuaagcccuuuauucuaugauauuuuguuauagcagcccaaauagacaaagacagagacgcuucauaaaucagacugguggccugauuaauuugucuuuugacuaugcccucaucagucauguuggagaauagucccccaaaucuauauaagaacucacuuauaauuuacacauaugcauaugaaugccuauauuauuauuauaauaacagggaugaaaacaaagacauuuuauaaaaaagaaaucaacaggccaggcgcaauggcgcacacccguaaucccaguacuuugggaggcagaggcaagcagauaucuucaagaccagccugggcaacaugaugaaauccugucucuacaaaaaauacaaaaacuagucaggcaugggaacacauaccuguagucccagguacuugggaggcugaggagagaggaucauuucagccugggaugucuaggcuacagugggccaugauccuuccacuguacuccagccuggacaacaaagagaagaagaaaaaggagaaggagaaggaggagaagggagggcaggggagcagaggagacagaaggggaggggaggguaagagaggagaggagaagagaggaaggaaggagggaaagaaggaaggaaggaaagaaggaaggaaggaagaaagggagggagggagggaggcaggauugucuaacacagugaaauccugucucuacuaaaaaaaaaaaagguguggugguaggugccuguagucccagcuacucgggaggcuuaggcaggagaauuacuugaaccugccugggagauggagguugcagcaagccgagauugcaccacugcacuccagccugggcaaagagcaggacuccgucaaaaaaagaaagaaaaaagaagggaggaaggaaggaaggaaggaaggaagagggagggagggagggaggcagagagggagggagacagggagggaggaaggaaaaagaaagaagagaaaaaaagaaaagaaaaggaaaaaaaagaagagaaaggaaguuguaacauuuucuccuuauacucuguuguggguuuaacuguguccccagaaguguuauguugaaguccuaacucccagaaccugugaaugugccuuauuuggaaauugggucuuugcagauguaaucaaguuaugaugaggucaugcugguuuagagaagaugcaauucuaagaaaagggaaauuuggacacaaacacacaggagaggacacaggaggauggaggcagagacuuggaugaugcaaugacaagccaaagagcgccaaggauggccagccuccagcagaggccgggagagagaaagggaggauuuuucugggcaucugcagggagaacacagcccucacaacucuuugauuucagacuucuggcuuccacaacuaugagagaauacauuucuguuguuuugggcaaccuaguuugugguacuuuguuauagcagcucuaggaaacuaauacacacccugaccaaucugcacauccuacugaauaagaaagaguaacauguaaagcaaugggaggaaaaugucacacaggugcagaggccagauuggagaguaguggcucaucacaaugaucaugcccauggaucccugggaaccgaggugggccccuggccauggggaaucacccagggcggaugugagacucaggcgccuguuggggauuauccaggucuuucacucauuuaugcauucagcaaucagcaaggauuccugaggaauacugucaauuaaucacucaaguuucacccucagaaacauaacguucuggcaucagagggacagaaagauuguugacgugccuggucaggaaggugaauucggucgagcaggauugugcuggggagcugcuacagucugaaugucggugucuccccaaaguucauaguugaaauccuaacccucaaggugaugggauuuggagguaggggcuuugggaggcgauccagucacgaguguugaguccucaugaaugggauuagugccuugacaaaagaggcuccagaaagcuuucucgccccuuccuccaugugaggacgcgguaagaagacacugaaccaagaagcagguucucaccagacaccaaaucucccagcgcauugaucuuggacuuuuagcuuugagaacuaugagaaauaaauuuuuguuguuuguaaaccacccaguuuaugggauuuuguuacagcagcccacauggaugaacaugggagcaaaggggaaaucauggaaggaggacuguuuucguuccauaggcaaaccuuucccacucugugaguggcucaaggucaacaagggaaaacagauuccugaucuggugggggccaauggcgagucugaaagggucacaggaagugugucagccucugccuucugggacccuugggcagcugggcaccgguacagaggaaaccccccaagaagcacucagcccacauuuccccccagcuagccucacuuccccccucagcacugcccugguuuauuuugacaagguuguuuccacccugcauggucacacacccuugcagacacuagggaguccugcccacucugggaaccauuguucacuguggaaaacccgaagcgucaccuuuaugcacagcaggcugggaaacagugcugcuggcgagccccucaggagcagucaugguugugggcaagcagccaaacggggugcagacagcacgcagggcuuccuggcacagaccugcaggugggcgguaggcggugggguggggggcaguggcaaugcccugggccuccaagugaugagcuuggaaaccugcuucaaguugaacugagcaaaggaugcaaagguaggaaauacagaaauacaccucacaagagaagaggaaacauaccaaauguuuuaacggguagaauuucagauaaaaaacaaauccuguauugaacauggaaaaggcacaagggggacaaugaggucugggagaagcagcagcugcaugaagcaaguacaccccuuuggugaugggaucugcugguggaaugaucagaacugagaagccuggaggaccuugcagagcuccaggcugggcugucaucucugauaguagcacaacgcagcugguuccaaguauggaauaaacaacaacaacaaaagcccuacacacuaaaaucaacuauuguuaugggacaaaguccugcugccaggaaaguauugcuacggugacacugucaggcacaggaggcaaaugggaaggggcaaggcccuccgcccuucccaccugccaguuuuccuuugaacaaccaggucuggccauucugggccugcagacuuucagggccauaaucagcagccacagacuggccauuucccccuuuauacugggccuacacaaggaccauagucaaaacauuucucaacaacugauuugcuaugcaaccauggaggugccugaccauucagagcaggugcuggccugaucuccugguuccuugcuaccucuggugcuuccaguucugcaccaagcccuccugacugcccaggaggcccacaucacuuauuuuuguugccugccuggccucugcagacaauugaguuugggacgccuggcugagaaggaagccaggugggggauacuacaugauacgucaacuguuucauccucauucugugugccucgggucccaggaaagcagggacaucccugauggggcuaaccaagggguucuaggagcagugugcaggggaagagguuguauggagugggaguggcaugggagggaaaggaaagcaggaaaggcugucaguaggaggacaggagcagaacaggacaguccagaaaccagcaagggcacaugaagcccagggagagacacauucaaaggccugugagcauaacacagagucccgguuugcaaacaucuaggcaggacacauuucggagucucuuucuacaugcaucugacucaucuugauuuuuguugaaugaggccacauugaccauagggaaaaguccaauguucucagcccacuccucuugccccacgugaacuuuccaacaucucuguucauuaccuucuuuugucagucaaugugggcaaaaagaaaacaaguuuguuaaaaguggaugggggccgggcguggugacucacgccuguaaccccagcacuucgggaggcugaaguggguggaucaccugaggucaggaggucgagaccagccuggccaacauggugaaaccccguuucuacuaaaaauacaaaaauuagccaggugugguggugugcaccuguaaucccagcuacucgggaggcugacgcaggaggaucgcuugaaccugggagagcgagguugcagugagacgagaucacaccacugcacuccagcuugggcgaaagugugagaauccauuucaaaaaaaaaaaaaaugggugaaaugugguaaugaauuagaguuggagacagcaguauaaacucauaguuagcuuaacauagauaagauggauaccuggagaaauauuuacacauacgugcaugcacauggauucauauacacacauuuauuuauuuauguauuuauuuauuuuuaaaaauuuuuacagggaaaaguguaaaugcagucccccauuaccacaaauuaugcagucaagucucccacauuugggggaaucacaggggucagcacaucgggagugcaauggauaagccucacccuggggaaaccaccuuugugaucaugguaucuccccugccagguaaguauucauauguguuaaaaaaauuguucuccccauccucccuacacacauauauuucacugcucugucaguugagaagaucuggaggaaacaacaccucaagcacaucuagcacccagaucuuggauucuaaguccuuucuccaguaaaaugacaggggauccuugaagaaauggcugauucuauaacuggggcuggaaauauacaagauaagcccuaagcaucuuauagugccagaaaguauggaugcaccaaaaaaagagagagagagagagagagggagggagggaaggaaggaaggaaggaaggaaggaaggggaggaggagaagaggaaggaggaaaggaaggaagaaaggaaggaaggaaaaggaagguaggaaaagaaaggaagaaaaggaaggaaggaaggagaaaggaaggaaagaaagaaagaaagaagaaagaaaagaggaagggagggaaggaaggaaggaaaaaaggaagaaaaaggaaggaaggagggagugagggagggaggaaggaaggaaagaaaagaaaaaagaaaagaaaagagggagggaggaagggaaggaaggaagagagagagagagagagagagaaagaaagaaggaaagaaaaggaagaaagaaagacccauaauaagaaaguaugucaaaugggcacaggaaguaacugaagaguucccaauagccaaggaagaaaaaccaugagcaacaaaauaaaaccauauuauuggauuauaacucaaauaaauuaaaaauuaucaaauaaauaccugcaaguccaugcugauauauaaauaaauaaauaggagagaggaguuaaaucucccagguagaaaaaaucuaaauaguucauguagauccucuagccauggagaaggaagagcaggaaugcccucuucuuaggggauggcuaugcacagugacuuccuucugaagaguuuaauauaaaaagggaguuaagaaagaacaaaaacacaaaaguaucuuuaaaguggacaaaccugacaaccacuacagcagccagguaaucaaagucaacaucagugauaggucaugcugauggugccuacccuugauuucauaaaagcggaacuuuaccucuguggccuuccuccauaaucccaaucuaauaagaagaagaaucagacaacccucacagagguacguucuaugaaauaccugaccagucaaaacuggucaucaaaacucaagacugucaaugucaucacaaaccaggagagucugagaaagcggcacagcccagggcaaucuaagaagacaugaucacuaaaugugaugugggaucccagaugggauccuggaccagguaaaaacuaaaguaauguuucaacuucaguaaauaauaauguaucaauauugguccauuaauuguggcaaaugugccacacuaaugcaaagcguuaguaacagggaaaacugggagcaggguauaugagaacuuuuugaacuguuuucacaauucuccuguaaaucuaaaacucuucugaaaauagaguuuauucuuuaaaagugucuggaggaugugcacaaggguguggcagcagaggggcuacagguaaaaaaucaugacaucuggaauauuuccuucaauuuuugcuccacacggugacuaucuuacccugcucccauuaaacucugaacaauguuaucagccugaaaaauggauuggcaggaauguguaaugucgaagcugggagggacuauggcggccauccaggccccugcuuucaauuacacuugaggaaaaucaaauccaaagaccggaagcggccaggcucgguggcucacuccuguaaucccagcacuuugggaggcugaggcagacggaucaccugaggucaggaguucgagaccagccugaccaacacggagaaaccccaucacuacuaaaaauacaaaauuagccggacgugguggcgcaugccuguaaucucagcuacuggggagaaucgcuugaccccgggaggcagagcuuguggugagcugagaucacgccauuguacuccacccuaggcaacaagagugaaacucuguaucaaaaaacaaacaaacaaaaaaaaaaaacgaaagcaaaugaccagugaauguuccaguucagugcccauggguagagcugaaauccucaggguccuggaagacugauggacagcaaugucagccuguccucagaacaggccacucugcagaggaaaccgaggcucacaagagccaagagccuucuucccagccagagggcuggcaagcagcaaagcagagagccagguucaggucuccuuuccggcuucacagaagugcuaccucccugcuaccacuaacccucacacccccgaccccuguccccauggccagucacuuucccguuuccucccacagcagcagggggcggcggcugaagacucagguaagaugcaacucagggaggauggcacuuagauugguuucucuuucuuuuuuucuugauucugucuuuaugaaacuuugcuuuaacccaacauuguuuaaaucccgaccugguuucucgugagcuugaagccagggugcccacacucugcaaaagaagaaaaaugccaguaugaguccuugaggcucaguguuguugugcaguccguggacaggacaauguccucauuucaagguuucauuuuuggaggaaaaaaaauuccucaggaugcaggaugcccugcaucccauaauggguaugcccccauugaaaccagcucugggagggugaccaaacuaaaaaggaaacaguuccaagcagaaggacacaaauuaccagcagagucauuauuacucacagcaauucaggcccagggucuauguggugcaggguuucugaaagccggccuauaccugggaaggagggagagaaccagaggccuggaugcuggguggagguucugugauuuacuuuguuacaaauuuaagaauaaaaccugcuggaucaggagcuuuuccuaucuccucaaauaaaccuggaucccaagaggaacagaaaggagaaaggugagugugggagaggaauuggagugcaagcucagagguccuugagggagggaggagaaggugucugcuuuggggaauggcaauaagagguauguugggauggagauacccaaauguguagcacuuauaccgauuuagcaaaugguccucucauuagcaaaagcuucuaaacauuagccuuaaguuuaaaaaaaaaaaggacauuugaaauuaugcaaaagcccagagcaccaauaugcgcuucacauacguuccgcaggaagauuccuucauuugcaaacuggaguauauuacguaaucauuuccauuuccuggcagguugugaagaguaaaugacaucauauaauguaaagugcuugaaacaccaugaauaauacauuugagcuauuacuauuuuuaccaugauuacugguagauuaaaagcagucucuucauggccaucuugauuacuacuaguacuaacacgaccaucaccgcaaacacuacuacuacuauaaggauaguacuuuauuagcggugcuuaauagaaucuauuauaauucucaauacuuagcauauuucaggaggaaaacugacugacggacugauauaaugcacaauuaaagaaaugaacaaagaaauggauagauuccuauaaugugggggguguaucuuaaaagaaaagcaguccaauagguuucaaagagcaaaaccaggagucaagagcugucucuaaucccaggagccggaugcugugaacacaggaguguucaauaaauaccuaacugaugucugagcaaggaagagacaaagaaugacaacagucaauugggcuuagcuuagauaaacacucaaagccaggauacagacagaacaggacaagaguggcucuuacagucacuugauucaggguccuuguuuuaaugauggggcugugaaggaucaaaggggucagcuggggcucaacacucaaagggcagcuuugggccaagucaaucaaaccagccuggugagcugagaugcacguuacccaguaaauacagguauugggauagacugugucucugcagugugaugguuaauuuugugugucaacuugacugggccacaggauuuccagagagcugguuaaacagcauuucugaguauguccagaugagauuaucacuucaaccaggagacugaguaaagcagaugguccucuucaauguggguugggccucauucaacccacugaaggccugaauagaacagaaaggcacaggaagguugaauuucaucucugccugauugcuuguucugggacaucgaucuucuccugcccuuggcauuccugguccucaggccuucgaaucuggacuggaaucuacacuacagguucuccagcccucugcccuuugugacacgacagcuguuuccuaggucuccagccugcagguggcaaaucacaggaccccucuggguccauaauugcaugagccaauaccuuauaauaaauaaaucuccuagauauagauauaaauaucaagguagauauugauauagacauggauacgcaucuaucuucauguucuauugguccuguuucucuggaaagcccugacuaauacaucuguauauuuugaaggcuuuaaagaaggacaaagcucuuuuuuauccacucuguuaacuccucauagccuaucucagcaacugacucauaacaggaaaguggacaagggcagagaggacaggagggaauggcuaccuccugccagucaccacacaaggugcuggggagguggguucagugagacccaaggcucugcucccagggaaaguuggagagaucguguuuccaggcgagaucccaaacacagcccccaucagcagaacccgucccacaagaggcacuguagagagaaagauccucauuuucagaagaaacagagcugaaagaagggacuaggagugggcagaggacaaugguggagaaggagagacaguuggagagggggugaggagcagcacaagagaguacagagaaugugcugggagaacaggcaggcacagggcagguuuaagggauucagaagacucauguccugauuugggagccaccauccaugagcaggggggaucucaagcaaugcaauugcuccaagccuccagucccuucaucugugaaauucuggcauccaugaagcuagcuucacucccugugauuccuucagagaaagcacaguggcuuuucuccuuuauucuaggcacccugcacaguggcacacugcagguucucguucgauauuugugcaauacaagaaaggagaaaggaugagaaaucacuuuauaaacuguaaaguccugggcagaugacagggcugccuuuguuucuuaaggcagacuggggagcuucugaaaggggaauacuuucuuccucacuuugccuuuccagccccaagucaguguccugaauucaguuaacucaagaaaacguucuccaagcauguccuaugugcugucaaaaugccaaaagcuggaagcagacagagaacaagaccuagacccugcaauccaggggagaagagcugauguucaggaaagugaaaugcugcuucuggagacagaauaaauccccccggagagaggauaagaauugacuauucuaaagcccagccuuuccucaaaaccauaaugauaaucaucacccauagugacagcuacgguggguggucaccuguguggcuggcugcuagaugagcuggacugaaagagacucagaaaugcuuucguuuucaggugguggcgcagccacugcuccccgacugggccuagugcauugcagacaucacggaggaagcuccgugucugugggugugacgguguaugaucagugaaagauguuaucagaagaaaaaaaguugggcacauuuuccccuagacuuacuaauccuuccucugcaauuacccucauguuuugacauuaauugaacucugucuuuauuacuaaaaauaaacuccagggcaauugcaaugcaccaaaaaccucaguaugaaaccacaagaaacaguaauagagaaaugggccaauaccagagguguuuugagaagauguuucuguuucaagcguagaguuccgagugggccaggaguucuuuaaaauccuguggacaccaaguacaggaagcaaucuuuacacacauaccuuguggcgaaagaccggugcuggcuuguaucccuugacagggaagcaggagccugcugaugcggugucaccaaaggccaggaggccagcaugaccaguguggcaguaucaggcagggagccagcagaugacaccaggggaaggcaaggccagaagaggaguccaaaagagcaaagugaaggucuaaagggaagaagcccauccugucugcauauccagggagcagggccaggggugagcaagaaugacacugagagggucaggagcuagacaggucaggagcuggaaggagaaacaaacaggcuccuguucauugcccauuuccucgggcaagguuccgucauccucacaaccagaccaaguggcuucugguccaugauguggcugggaaaauugaagucuggcuggguguguggugugugccuauaguacuagcuacucaggagacugaggugggaggauugcuuaagcccagggauuggaggccagccugggccacauagcuaagacccugucuuuaaaaaaauaaaagaaaaaaauuuguacguguguuuugagacagagucuugcucuguugcccaggcuggagugcaguggcacaaucuuggcuaacuacaacucugccucccaguuucaagugacucuugugccuaagccucccaaguagcuaggauuacaggcgugugccaccaugccuggcuaaucuuuguauuuuuaauagagacaggguuucaccauguuggccaggcuggucucgaacuccuggccucaagugauuagcccaccucagccucccaaaaugcuggaauuacaggcgugagccacugugccuggcaagaaauuuuuuuccuuuuuuuuuuuuuuuguuuuaagaaagagagaaguuugaaaagcuguaaaagacuugcccagagucaaauaggcagugggaaguggagccugggguagacccuaagugucugacuccguguuccuggugccuuugcugcacagcaggcaacagucccgacucaugggugggaaaggugaggaugcccuccuauuggugugcgucccagccaggcugauuucuagacagguacagacaggcaggcucccagugugagaagugccuuuaggacaaguagaacugcacacauagaugcaaaugccugggccuuucuucagguucugucauagaacagacugccugaggccaugcucaggacugcgggccucagaaacccagcacuugccccugcucugucuuucugcucccagcagcugaauucuagggaaaugucucuccgucaccccaccccgagacagaccugccaagcuucuggcuuucagauucucugccacaugacugaggucccaucagcccuuuuccccaauaugagaauagcuuguuccagcccuccaggugcagcagggcauggggaucagcuggaaaggcugcuacaccuguaugcucuccugcucccuaagccugccucagaagcaugggcucccaagacauaauucagugacugucccugagggucaaaaagagcuacgaggccaaggcgggcagaucacaaggucaggagaucaagacuauccuggcuaacacagugaaaccccgucucuaauaaaaauacaaaaaaaaguagccaggcgugguggugggcaccuguagucccagcuacucaagaggcugaggcaggagaauggcgugaacccgggagguggagcuuacagugagccgagauugcgccacugcacuccagccugggugacagagcaagauuccgucucaaaaaaaaaaaaaaaaaaaagaaagaaaagaaaaaaaagagcuacguagggcucccaaggaagacuugucagcuguagacauacauugcaguagcagaagugagaaauucaacaaugauacgaaaaugaaugcguaauaugaaugcacaaaggugcugagcucuaaacaauggaaaggauuuuuaauuacuaaacagcagcucagcucccaguaugcuuuauucacaagcaucuuucaagagucacgagaggcagcaccugcuccaggaagccucccggcauggagaaaauccccuccaccauccucacagacaccuagggaguauguaguauccuaugugugccaguauccccaccuugacugaagggcaaggccucaugcucuucaccucugcaugccacaggaaugcugacuaucacagcagauuugaaacgcaaaugcgcuuuugaaaauuuaaggcacaauacaaaagaugaagaugacauauguagcacaacagaaguacaguucucugcuaugcucucaguucugacuucucugucuucucaccaguccacagcuucucacccaccuuuccacccuugcauagcuuucaaauucaugauaggaaucaugucaguuuccuuuucaucaugucauuuauucuuuccaacaucuuacuuaaaaaaaauugcaacugaccucauucuuuccucugaaccuuuaaaaacuuucuucuuuugguuacuucucuaucucuuuuucucucuccuuucaauuacucauucauuuguuguuucacccucggucaggcacuaugccagauccugugauguguaagacaguccuugcucuaagcaauuucaccagcaauagggggaaugggcaggggaaggggcaagggacauuucaacccagugcaguagccaugguauaguggagacaugccuucacuagcccgcugccguccaggggaggggggaaucaacucugcuuuggguaaggggcugggcacaacugggaaggugauucucagcuguuucccaggcugacuuggugauaggugaaaggcuggggggacagcaaaugaaagacuucaaaauagccugauacauggaaggaauucuaaauggcauaauugaggaauaauuugcaaaaacucucuucccuuuuggagcauuucuuccucagugcaaggcagccugcuaagcuguuuugcuccaauaucucacucaacacaaacaacaucuucaugaggcaggcacuaauaccaucccuauuuuacuaaugaggagaccaaggcuuugagaggcugagugacuuguccaaaaugaggcaaguagcaaaaccaagaaaacccaagucuaccugaagcacucagucuuaaccucuaacccuuuaccuccugcacccucagccuuaguguggaaggagcauagaauucaaggaggugaaaggaggaagcacggauuggcugggaaaggaggaagagcucauguucuggaugucccaaagguguuucaaucugauuauauaacccucaccucaccuuuuccucuuuuccccaaggcugucuccacauguuuucacaagacagcuggagcauccugcaccuucugcuacaaguggcgcauucacuaggagauggugggcuccucccuccacuagggacagagggagagcuuccuaggcacaaugaauaaguggacuagacucugagaaccaggucggggagagguuauggggagccagcuucccgaacacauuggagcggcacaggaagacacaccgagaggucaagaaccacaacccaagcugugcugcaggaggucgucaacuccaaaagcuauuuuugguuucacaaggaucaggaagauaaagucgcuuaccuuaauucuccaaucucaaaauacuccagcuuuaggucacguaaggacaguucucaaguccguccagagugcugaaaggauauguauuuuuucagauugaaagugccuaaaucccagguguaacaggauucuagaaacacacaaaaaggauacauauuaauaucaauguuuaccuugaauagauuugguaaugagauguuucauucauuuaaaagauaaggacugcacauuuacuauacacugaaugaggagcacaagaagagaagacauuuaaugagcaaugcuuauguggcaagcacuguguuaggcauuuuauacacauuaaacuguuuaauccuaugagauaggcuuugauaucccccauuucugaagucacacaggcagucagggcagaagugaugguugggucuuucugacucauaagcccccacccauuaaucauguuucccuccccuacuagagcauuuucauucaccuucuuccaagaauacuagguagagaggaauaagaaacacacccaauaaccccauucugagaauagccugucccugggugcccagcccauuucauacaugguggggaucaugugagccauggaggcugcaucagauuaauuuuguuguaaguuuuaucugagcccaacacugucaucuaguaacauguguucaguggacaucaugcauuauucaggaaacaaaaaaauguagccucacuagagauucuuaucuuaacugaucaucaagauggcuagaugagguggucaaaaggggugggacaguguggagaaugaggcccaggggccacccuucuaggcuauccuaaagcagcgccugguacuuagccuggggauccaggcacugaccuucucuccuguccuucaaagaacugugaugcuccgguguggcccccacagaaaaccccauucauacauuuacaguacggugcccuuuucccuuuucaggcccccccaccauccucacuggcagccaaaucaugaaugacaugaagcuuagucagcacaaacucagaauaaagaacgcugaaaaguucugaaggggaauuugcucucaacucuggaauagcuggugaaacauccuugccccacaggcaagaacggcgggcagguggcuuguauuccccacuuugauuuccucaucucuccccaaggaacaacuuggccauaauugucuucucugaggcacucugguugucauauuccuuccuuagauguguugguaucacggacagaucugcagugguucugcaagccucagaguccucgccuccucccauucagugcaggcuuaacgcauccugcacucagaguccaguucccagcagcacagagugaauucccccuuacucugaaaaguccccuugacuagcuaggcacgcagaaagaugcuguccucagcgccucugggcuccccagugagcagccucccacacgccucaggcauugugaccaggaaagcacuuuuagccuuauugucaaaaugaauuugcuucguuacccaaaaagggcagaggcacagccucuugguugacggugggcucuucucaggcuuccuggguuggugucccaguucuacuacuuaaagaggcuuuuuaggacccugaacaaguacucaaacuugagcucucugagccucaguuucucaucuuagaggcuuguuccugguguuaagugagaaucuuugcagaguuuagcacuugucucuggauauuauaagcccauagaaaugucagcuuuuauuagcacuacuuaggcaaaugcuagagacuuaacuucuuccucuccucccaggaggaaaugaaaaggccuccccucuuucuaucucaccacuguaacuuaguguagggacucagcacauggggccaagggagcaaaugaaggcaaugagauugggccaaagccuggggcuuccaucaaagguucucagcuccaggccuggcuguaacccucccuuuccaguguacucaucugugaaaaagaguggauucaaacacuacccgucugccaggugcgcugacaggauuaaaugagacagugcgcagaagaggcagucuguaaacuaccagggaaauccagcuaauuauaacaacagcgccuuuacuagcaaauucuguagaggacauuucacuaaggacuguccuccuggcaccucacugaacacacacagaguccccaagaaaucaggagacacauaaccuuucuucccauuuuacagauguggaaacuaaaguucagaggagcuaaggagucugccugacaccaagagacaaauccacaaauacagggcugaaguguugguuugcaagcugauguccuguccccuccuccuuguaaggggcuggggagaugggguugcaauaacccagcacguuggcuccugcagaaaaaagaaccucuuuccaaggcagccaaacugauuaauguuuuuaauuaauguuuuuagccacacacacaaagcaauguuccauggaaauuaaggaaauuaaaauuucuaagcuucucccaggagcugcaaagaauccugggcaggccaggguguuuagagcccggugcaaagcagaaggucauagccccaccucaaaacacugaaccugcucagcagggggucacuucccacccacagagugacaggccacaaggagagaacuugcucagaaauaugccaaugccaauaauuggugggagaaacagggagugaagaggaaggucugaugggaggugcuagauccugggacugaagggucagguggcugcccccagacccucuggcuauccucccaccugacacaguucucaaggauaucuaccugcugugugguugacugaggucccugcaccugauguggccgagcaagccaugggcuuucuaaggacacugacaacacuucccugaugucuccugggaccgcagaaggucaugcugggcccaacgcugugcuuugacgucugaagagccugagugccaaggacaggcugacucaggaccuccaaggcucccaggagguucggggcagaggugugcucuguguuaacaucuguucuccucucugccagcagaauaucaagcaugccacaguuucacaucauccauuccucucuacaggccgagaggcagggccguauugucuuccuucuccaaucagaaggugaauugcacaagggcuagguaaccugaacaaggggaggcaguccuacauguaaggcaggucucuguuggaaagauggagagacccaggguauaacacacauugacuaaucaccaucucugcuaccaguucuuggaugccaccagaacguggcccaggcaguggggccaacugggugggcagauggcagccaggagcagccaccaagggcuaggguaggagcccuuggccacuuggcaggagacagugaacaagcuucgaaaucagcaacagcacuuggguucaugauguggaaaucaucaaaacaccaucgcccacugcaaauagaucauggagguagacuaugguaccugcaagagcuguagauggcagagaguggagcaguuuccccugggaagcuccugagugcaagcuccagcuuugggauauguuccuucccucuggagaaggccccagaaaaggacacagaaacagacacugcuucucacagggagucagcagagccuggcccccacgcuugcuagauucuaucaaauccagcaagccgagcauggggugcagggcagggugggaagugcauagucugcccagcucugagcugauccccaccaguuaguugcugugucaacaugggaagucagccuagcuucucuggucuucaucuguaaaucgaggauuaaaaaaaaaaaaaaagcagcuacucagccgggcacaguggcucacaccuguaaucccagcucuuugggaggcuuaggcaggaagaucguuugaggccagaagauugaaaccagccuggaaggcugggcgcgguggcucacgccuguaaucccaacacuuugggaggccgagaggggaggaucaugaggucaggaguucaaaaccagccuggccaagauggugaaacccugucucugcuaaaacuacaaaaauuagccaggggcaguggcaggcaccuguaaucccagcuacucggggaguugaggcaggagaaucacuugaagcuaggcagcagagguuacagugagccgagaucacgccacuacacuccagccucggcgacagagugagaaucugucaaaaaaaaaaagaaggaaaggaaggaaggaaggaaggaaggaaggaaggaaggaaggaaagagaaagaaagaaaggaaggaaggagggaggaaggaaggaaggaaggggaaagaaagaaagaaagagaaagagaaagaaagaaagaaagaaagaaagaaagaaagaaagaaagaaagaaagaaagaaagaaagaaagaaagaaagaaagaaagaaaagaaaagaaagaaaccagccuggccaacauggcgagaccccugucuccacuaaaaauacaaaaauuagcugggcaugguggcguaugccuguaaucccaacugcuuggguggcugaggcaggagaauuguuugaaccugggaggcagagguugcagugagcugagauuguaccacagcacuccagccugggcgacagagcaaaacucugucucaaaacaacaacaacauaaaacagcugcuccuggacuggggugggauggaugggaguauuguacugcagugucugcagagugcucaacacaaccucuggcucagagugggugcuugauaaacacuuuguuauucucagggucuaauuguuguccuuauuccuguugccugguaggcaaauuagguuucaggacagauagucuggauuugaauccuagcucugccacuugcugggaaugugacuauugacaaaccacucuacuucccgauggcuccguuuucuuaucuacagagacgcggacgugaucagcagccauaggggaccauugaggauuacagaauuaaagcaaguggugcaguaugagcuuucaaaaauaacagucucaacccaaacugaggaguguuucuauaaaacaacuuaccuggacucuucaaaaaugucagagucguccgggugcggugacucucgccuguaaucccagcacguugaaaggccaaagugaguggaucacuugaggucaggaguucgagaccaaccuggccaacauggugaaaccccgucucuacuaaaaauacaaaacuuagccaggcuuuguggcacacgccuguaauaccagcuacucgggaggcugaggcaggaggaucacuugaacccgggagguggggguugcagugaccugggaucaugccacuguacuucagccuggaccacagagugagacucuauaucaaaaaaaaaaaaaaaaaaaaucaaagucaaguaugacuggggaacaugagacacagccacuaaaugcaauaaugauccauaauugggaaaaaauagucaaaagggacauuauugggacuacugaucaaauuguguguggccugaggauuggauaauacaauugcagcaaugcuaaauuuccugaguuugauaauuauacagucguuauguaaaagaaugucguuauccuuggggagcacacacugaauauuuagggaugaaagggcaugucuacaacuuacucaaauggaucaggaaaaaauagcguauuugguggugggguggagugugaguuaacaacugaugaucugggugugcaguaguucuucauauguucauaauuuuuuucugcaaguuuuaaauuauauuaaaauaaauaaggaccacaagcuacagaacaagagggcgagaaucacccugaagagccuggaguauuaaccauccaugcaagcaagaaaucaaagccuuucucaaaaaaaccuaugucaccuuaaucacagauguuaggauuuauuacguagaaaacuacaaaggguaaggcugaaauuucauuugaaccaccaccuccguccaagaagaagaaagaaaaauggauggcuacuacuguuccuacagcccauggccaggcuggcagggccaucaggaaauaauuaggccacauccgagccauccagcagccuggcacauaggugagcugggauuugaccccaggcugccucaacaggaggccagagggaggcagguacuccaagucaagcagcagccagccccaagaucagcccuuccucugaagccgaggccccacgcacuguaaggccgagcccuuaauacggcugcaaacuucaggggagcccagacccgugucucccugcccuguguacucccaucacacugcccccaccacugugcacaacaggugcucaacacucgucuguagauguacucauggacacacaucuucuuuucaauaaugcacagacucuuucaggaagaaggagcaagaaaccugcaacaacugugucccagggaggagaaacaggggucuggggacaugaggguuggcagucuucauuggaaaacuuuguauaccuuuuggauuuugugucuuguaaaugcuuuacugauucaaaaaguuuuguuuuguuuuucuuaauucuuuuaauugauucauuuauuuuauuaauuaauuaauuaauuaauuaauuauuuuuguagaggcagagucucacuguguugcccaggcuggucuggaacucuugagcucaagccauccucccuccccugccucccaaagugcugagaucacaggcaugagccacugaacccagccauuuuguuuuuuuaauauaaaaggaaaaaaagaaauugacaaaguuaccugugaggcugccaugagugcgaagucaugaguaaucccaugcuacuuaaugcugaguccccggcacacagcuguugcucacuaugcuacacauccucuuguuuucagagggugaagagacuagaaugauuaaagacucagagucagcagcaucacugauuuuacuggagaguguuuagauuugaucaccaaaaguccaguccuuauguuucugaaacucuagagcugcuguuaaaacaagguaggaaagccagccucaaguaauccuaacaucguuauccaacuccaauaggugccaggaacugugaagauguuuucaucccuacaacaacccaagaagguggguaggugcucacauuauccccaucuuacauuucaagaaaccacgucacagaauggucacaaaaggcgcccaagaccucugcagagggagaagccugguaggugaaggaaggaagucuagcgccagagacugggcuucuaaagucuauagucuugaagggaaugugaggaccaccacugucccaggaaaaaaggauuuugacucagagaacccuggguuccaagccaagcucccuccaaaagccgcagguguggucagacagccuuugguggcaccaccuccugggaggacugaagaagauaauaugugaggaaaugcuuuggaaacuguaaagugccaugcaaaucucaccguagaaacagaggaugcagugggggugugggaagaaaggaggcaucuggaaguucaaccuuaccaggacguuuucccugagccauuagaaguauuuccacuccuagucuucuaccucaaacuuuccuuuuuguacuacacuuacauucaacuuucccucaaaaacauccucccacuucagagguguuaaguuauuaagucagcccuaaauguaaauaguuuucauuucucuaaccccaaaaaccucccuucccgccagcaugcuuuggucuugucacccagaacaucaaagccauuguuuuccguaaaagcguucugaucacuugggugacuugugcagauaaacaccacccaccacaugccaggcugugcagcaccuuccuggugcccugucaggaggugaacgcgccaggaaaaaaugccgaacucuacuggcaaaugcuuugcacauggucacaugcccugcaccucucuccaagcucuuuggguagccuuggccagucccuuccccacaagggcccucuugcagaggaaagagguuggaccaagcaaucucuaguucuccuugagaucuaaaauucacugauuccaucucauccucccugcuaggaacuuccugaaauauaauaguucauuuacaaacacacacacacacagaagcuaaguaacuggguauaagcugggcucuaagccugggcgcgguagcucacgucuauaaucccagcacuuugagaggacaaggcaguggaucucuugaggucugaaguucaagaccagccuggccaacauggugaaaccccaucucuacuaaaaauacaaaaauuagcuggguguugugguggaugcccguaaucccaccuacucaagaggcugaggcaaggaaucacuugaacccagggggugaaaauugcagugaaccaagauugcaccacugcacuauauccugggcaacagagcgagacucugucucaaacaaaaaaaaaaaaaaaaaaaagaagcuguaguuuuuggugacucacagaggagaaaauauauuuuuccacuuagcucaaaagaaugguuccuccauucuucaauuacucaacugauguaaugauguaaagucaccaagccaauggggcaccuggggaaguuccaggcuccugggaguucaaacgucaaugaagguaagugaagcagggaauuuccuaugguggacaggugcgcccagaggugggcugcaacagagagcccccucccugagaaaacaucccauauccauucaagucuccagcucaauaagccaccuucuagggaacccaggaaacacugagcccaacgcuggcccagagcccaucguccaggaagucacgcccccaguaugcagguugccucuuccaggaagucaguguugagccaccgcucagcccaaacccccuagacuauaaccuccguaaggguaguaaucgugacugacaugucauaggaacauaauagauauacauauuugcuaaaugaauuacucacagugcuuccguaaagcuuagguaauuccauuccccccaauacugugugcuuuuauguacuagauacuggggauaaaaugguaagcaaagcagauauuuggccaggcacagugguucacaccuauaaucccagcgcuucaggaggucgaggcaggaagaucgcuuaaugccaggagcucaagaccagccuggggagcacagugagaccccaucucuacaaaaauauuuuaaaaauuagccggaugcugugguauggaccuguaggucuaacuacuugggaggcugagguggaaggaucgccugagcccaggagaucaaggcuguagugggcuaugaucaugccaauacacuccaaccugggugacagagcaagacccuuucacugaaaacaaaccaccaccacaacaaaaaaacaaagcagauguuucuccauccaggcuucuucuaaagcaguuacuaaagugcuggcagaugaccaucagcuaucagcccucucugggaacugccuuggccgaauacaaucaccuuguucaagauuaggcauccuuugggugguggggucgggggcacaugaaaugacugaucaacccucaccucaauucaggacaauucugaaggaucagucuagcucccaggcuccucuggcauuggccuuuguugggacauuguuacagcuccacuucucccucugcccaacuaugguuucuucuccuucaguuucacagcuguugaucccaaaggaaucccauaauaaacauccuacuugcuaaucuacaucuuagcgucuguuuccuagagaacacagccugcaucgcaaagguuuauaugacagaugcucaggccuugugucaccaagaugaagguuccaggaccagaagggcaaacauaucauagcaaaugggagcuacuuugugggaacaccuugcugacaaggauggaaagccuggacucaaggcuggcaucaacaagcaaggguagugagcagugugcaaacacuugugaucguuugaaugcguggaugaaucccagcucauugaguuagagacccauuuucuucaacuuuguucaccuagcaccuaauauaaaaaaggaguuugguaaaacuucuguugggugauuagaugaugaccagauggacaaauagauagaugaacuuacacauuugguugaguuuauuguuagacaauaaaugaaagaugauuauuugguacagguuaaauugugucauuuguguaaaguauuaaucacaauguccaaauaacaauaaugcuaaaaauggcaaccgccaaggcggaagggucacuugaggccaggaguuugagaucagccugggcaacauagugagaccuacaaacacagacacacacguaaauacauuagcaaggcagcuuaagucuaggaguucaagaauacacugaguuauguuucugccacugcauuccagccuaggcaacaaagcaaaaccuugucuccaaaaaaaauuauaauaauaaugguccgggugcggugauucacaccuguaaucccagcacuuugggaggcuaaggagggcaaaucaccuguuuucacgaguucuagaccagccuggacaauauggugaaaccucaucucuacuaaaaccacaaaaaaauuagccaggugugguggcacgugccuguaaucccagcuacucaagaggcugaggcaggagaaucacuggaacccaggaggcagaaguuguagugagccgaaauugugccgccucugcacuccagccugggcaacagagcgagacuccguuuaauaauaauaauaauaaauaauaauaauaaacaaaaacaugacaacuaaggcuggaugugguggcucaggaaugugcauugggaggccaaagcaggaggaccacuugaagccaggaauuugagaucagccugggcaacauagugagauacugucucuacaaaaaaaaauuuuuuuuuaaauuagccagguauggugguacacaccuauaaucccagcuacucagggaggcugaggcagaaggauugcuugagcccaggaauuugaggcugcaguaaacuaugauugcaccacugcacuccagccugggugacagagcaagacccuaucucuuaaaaaaaaagagaaagagaaguaagcuacucauggagaacuuccuguaagacguaacuugugaucagcagcuugaaagaagugacaguguggaaguaagcaugcaagagaagagaagagcaacaagacauuagcacauaagcccugacucugcucugcucaucagaugcugggguaaauauaacacugucacuaggauagcccagcaaugcauggggaagcaugcugucaccuaacacccaucaccacggacgugggugagaacaugccugcaaccaggggagaugaacaguugacagaaggcaccgaacuuacaacugcgguuuacagacuuaauccuauagugauaagaagccuucaagcuuauggaacuaagguguugggugacagcuaguaaugcaagugucagaacugauacaagguaucuuuuuuuugacacagagucuggcuucguugccgaggcuggaguguggaggcaugaucucggcucacugaaaccuccaccuccuggguccaagaaauucuccagccucagccucccgaguagcugggguuacaggcaugugccaccaugccaggcuaacuuuuuuguauuuuuaguagagaugggguuucaccauguuggccaggcuggucucgaacuccugaucucaagugauccgcccaccucagccucccaaaagugcugggauuacaggugugaaccaccaugcccagccaagauuucuuaaauaauccaaccuuugaacuguccacaguuucuucagguaucuccugcagcagaugggggcuuaggaaguaccuggagccuccauugugagaaaacagcuucaggggcagaacccacacuugagaagcccagacuccagcuucaguuuccccccaggaaauguacacacccugggggccauccucauucagaugcccaccagaccuacugcacauccuuauuucugagggugauaccuggagaaagagaugagaggauuaaggacaaggggaauaaauuagagccugggcuuugugcaaacaagaguaagugaugaggacaauaagaaagggauaguaaaguuugcuugggaaaaucacaaaaccaguggcgucacagaggcuauuugcuaagugguacgaaguauucuagagaacacugaugccuuuagccuauuacuacacaucguggaucugggagcaccuaaaacacuaaauacuggggcugucagagauggcaggugggaugacaacucaaaaaaccaaacuccagggaaggcugggaugcugugugucagguugaaggucacaagucacaaagaggcaguaaagcucagagcugaagcagacaggccuugcugcugagcuaccugggcuggaacugagucuccaccacuuccuuccugugugaccucuguguggcagagcaacgagcaccucccugaggcucagaccugauauaugauauggggauaaggauacagagcccccaaagugucugucagaacugaacaugaccugugccaagccccugaugccugguuaauguucaauaaguaggugccgguguuauuauaaccauaggucacagugccacccuuuccaacuguacuccacaaaucccuagggggucaagagagccuccugagugacuucugggggccagguggagaugggagguucagcaggaggacuauaacccuauuuuuaucaaagcagcucuccuuuaacaaguuacagguauaaagcuugcauauaagauuucaguagccaguggaguuugagggcuuuaagacagcagaagaacuucaaauauucauccucuuguuuauuaguaauaauaauaaacacucaagaaagcaaggaacucaucuaaacucaccuggcaagucagaggcagggaaagggaagcugcagcugcuggcccugaaucucccacacaggcaauuaaagcugcucuggagaaggguuggaagagaugaccucugagguuucuuuuaacucugagauucugcaacugcaaguugaaauucuaacucccauccuuuuauucccccugaguugaaugugggcauuucugcaaacccaaagauguaagcuccacucuuccuuagagacaacaaggcucuuuaaaauccauccuggcuucucccugcuagccucagccuuccuacagaggaagguuccagcuggagagcuagggagggcuccaggcacucaaugucagacaggcagagacaaacagggcuagagaagccuccagcuccacaggauguggugagugaagcagcaagagaaaaccagaaaaaaccaucuagaaacacaacagccccacaaauaaagagacaacaugaacacacagggacuuuucuucucuucguuuuucaagcuaggaaaccgaaaaauaguugaaggagcuguaucucaaagcuuucugaagaaaaacccugccuagcucauaagacaaaucuagggggacaacuguuaaguuugaagucauaaagaccauaaggccaguucagugauuucaugcagaaccccacgacgugaagagcaggguguugcaaucucagccuucaaacucaggggccagugugcuaagcugaauuucauacaaaggcucaauguugaagcucgcucauuuuaagucaaggcugcguugcaacuggcucaacuugaaggcauccacauggaaaguaacgaacuuggcuggaggagcagccaaugucagcauucccaaagagaguugguaaacacacagaggcaaaaaagaaaauuggccucacuaaggauaaaaaaauauauaaaucuaacaagagaucauucugcauccauugaaugauaauuuuuuuaagcuaauaauacccaguguugaugagguuguggugaaacuggcauguccacauguugauggaagcagcauaaacaaccuuauuugaaaguaauuuggcaaugugggacaagagucauaaaacugugcccuuugacucaauaauccugcugagaaucuguccaaaagauuuuccaagaagaaaaagguuauaugcacgaagaugcucauggcacccuuagaaguguaacggcaaacuacuaggcacuuuaauuuuuaacaacagagaacugauuuagaauaugacuuguccacuugaugaagcauuauauacucucuaaaaaugaucauuuguaagcugcuuuaauaaaaugaaaaaauauuuaggguacaucaaauguuuaggauauauuauaauaaaaauguuuccgcuuuaggauuaaaaaaaagugacuacaaacuauucccuacaccuaugacuauauaaaaucauuaauuaauguaaagacaaaacauaucagauaucugaaaacaaucugauuagucaaggaagaguuacugauuuuguuuucucacccguaucuauucuuuggaaauacaaugcuguguaauaaaugacaucaauaaugaugaugggcugggugcaguggcucgcaccuguaaucccagcacuuugggaggccgaggcagguggaucauuugaggucaugaauuugagacuagccuggccaacacgguaaaaccccaucucuacuaaaaaauacaaaaguuagagccguguagcagugcgcaccuguagucccagcuacucagguggcugaagcaggugaauugcuugaacccgagagaaagagguugcagugaaucaagauugugccacugcccuccagccugggugagagugagacuccaucucaaaagaaaaauuaauaauaaugaugaugaugaugaugaugaugcugacuuuuuuugggaaaacuucaauaauggauaaaauuaggauaaaacucuggggaacuggaaauagaauucaggauaugagaaaggaucaaacucagaggcauuugagcaucaagucaaagaaauaugaucucuaaucagagaauggaaacuguaggcaccaauggggugauauauuagcaacgucagcucuccaggccccauggcacauccggcaguaucugaucaucucagcucuguaagauucagucuucuuccuccuccuccucacacagcccaguguucaaagaggaacagaaaaacccaaucuguguaauuuaagugcccacccuucgaaaauauaaagcccugcugagaggccaagaaauaaauacugaauuuccuaaacuaugucuucuuuuuuuuuuuuucugagacggagucucgcucuguccccaggcuggagugcaguggugcgaucucggcucacugcaagcuccuccucccggguucacgccauucuccugccucagccucccgaguagcugggacuacaggcauccaccaccacgcccggcuaauuuuuuuguauuuuuaguagagaugggguuucaccauguuagccaggauggucucgaucuccugaccucguugauccacccaccucagacucccaaagugcugggauuacaggugugagccaccguguuuggccuucuuuuuuuuuuuuucaaaaaggcaacuugggucagcuucuacacuggcacuagaaguaaugaggaacuuuaguuuuccaucaggugggaccuaguugggauuuccaguguggaccacaaucccaacacacaguuguccucacugaaaguccaagcagggguggccaaggcaaagguagcacuuuggaaucacaggggaccuaagucuaguucugacuccaacaguaccagcucugugccuuugggcauguuauuuuacccccaugaccucaguauucacauccauaaaauggggacauuucagaacuuuccuccuagcagcauggugaguacuuaguguagcuccuggcaguagucgcggcucacuaacugguggcucucuccauuauucuuauuuccuauguaccccugucauugauucgucucccaggucuucagguaccaggugugcacacauggcaagggagggcacacagguaaaugacuaaaugcagcugaacagccaggcaugguggcccacaccuguaauccuggcacuuugggaggucaaggcaggaggauugcuuggaguucaagaccagccugggcaacauagcaaaacuccaucucuacaaaaaauauauacauauauaaaaacuuaacuggacauuguggcaugaaccuguaguccuagcuacucgggaggauugcuugaagccaguaguucgagguuauagugagcuaugauuacaucacugcacuccaaccugugugacagaaugagacucucucucuaaaaauuuguuuuaaucaaaaauuuuuuuuaauauacagcucaaacuuggcugacauuaggaucaccugggagcuucaagaagcacagaugccccaguccuucccagagcaauuaugucaucagcuucucugggagcggaacccuggcaaagcuauuucuauuuauuuauuauuauuuuuuuugagacagagucuugcacuguugcccaggguagagugcaauagcgggaucucggcuuacugcaaccucugccuccuggguucaagugauccuccugccuuagccucuugaguagcugggauuacaggugccugccaccacacccagcuaauauuuuguauuuuuaguagagacaggguugcaccauguuggucaggcuggucuugaacuccugaccuugugauccgaccaccucggucucccaacgcacagcuauuuuuaaagcugauuccacugugccacuggguuggggcacaucuaacucaagcaggagcaacccagugauaauugacuuaggccacaguucaacagcuccaauugaaaccaucgaacacccugugagugaccagcaaauaaauggcaaggggcuccccaacucccugccugcugcucagcccagugacuuucugcaaagcaagaaagcuggccggcuggaguggccugccccacggaggccacugggaagcaccugaccaauauggguggcgcacugacagucuuggggugaacacaagccccuggggcagaacuucgccccagcaugcagcuugaaggucuugcugcugccaucccaacacuggagugcagcaguaguuccugaggaaucugcaggcuccucaggagcagguguccagggaggcugaggccagaugccuugccuuucccagccccagugaagagaccaggacagcaauucucagacuggcuuuuccaagggcgaucugaguagaggaggggcuugcugggccaucuucaccacagucaucugccugacagucucacuuggccggacuguccgaagaccagcauucuacucuuccuuucuccauuucuaaagaauccucaguaaacagccugaagccucgauaauaacagcccguuucugucccgguggugacagauaugcuaagaauguuccaugcacacaaccugcaguagcuccuguaaccucacagugggcauuugggguugaugcuguccuuauccccauuuuacggaugagaaaagcgaggcccagagagguagucuaccuuguccaaggucauagcagacuggaacucguggccuggcauggguuccagaggcugggcugcucuaugcuacacugcagugcccuggcuugagggcugcccucuucauugauuccuuccuuuaaucaaaaaauauuauugggccccugcucuaugccagugcagggcagggggcuggagcuauugcaugggaagagauauaggcggucuucucaagagcucucaccugaaagcuaacugucacaaacaaucccuaacagaucauguacucuuggaaaccucucuaagcagugugggccuggaccgucuccugcagaggcccagcaggggauggaggcagaggagcaggggaucagggugcaggcuucagggucaggcagaccuggaggugaaugccagcuguguagggacuggcugcaugaucugggcaagcuccucccuggcccucggcugccaaggccugcuaugcagagcaaaugagaaacugucugcccuccauaaaaaaauagcuccgacuaguuagaaaucagaagugcaguuuagaaccggggcuggcaaucuuuuucuuuaaggguuagacagaaacuauuuuaggcuuuuugcaggccacagggucucugucaggaccagacucugcuguuauaaugguaccuaagcagcacugauagcacauagaagaauugacauggcuaugugccaauacaauuuuauuuacaaaaacugauagccugucaguuugcuggccccugauuuagaugacaugagaugggacauguaacagccaugacaucaguuagcugagucauaaccugcucuguuuucauuuucuuuugccuccuccuagagcacuugggcuuuaagguaauagugauucucaguuuuuugagguuuccuacuuucuuugguggucuuuaguuuuuguuuuuauuuuuuggggaggugucuuacauagcuuuauuuaacccuaaagugcccauaaccaacgaugagaccccaguccuaagucuucccccuggcaccuguuaggcugugacagaggguuggagauugacggcuaguaaaaaaacaagucggcugggcgugguugcucaugccuguaaucccagcauuuugggaggccgaggcgggcggaucacgaggccagaagaucaagaccauccuggcuaacacggugaaacccuaucucuauuaaaaauacaaaaaaaauuagccaggcaugguggcgggcgccuguagucccagcuacucgggaggcugaggcaggugaauggcgugagccugggaggcagagcuugcagugagcugagauugcgccacugcacuccagccugggugacagaguaagacucuaucucaaaaaaaaaaaaaaaaaaaaaaaaaacaaaucauggcagauggagaggaaugugaaugcggacaaaacucuguagcuuaugcugaaaugugugcccccugagggucugaggagacagagaaaggagaagagaagguuaggcauagcaggaaaggugaguaagccacaugccuggaugcacaauuccugcucauaugguaaggccuuuccuucuuauucaagagccaaagggggguugggcauacuugcuccaggcaaaaagggcugcuggagaccaugggugucagagcccugucuucuugucuucuuuucugggaagaaaaguuccacuucauccaugcaacaaguuccuaucaccccugggcccacugcaaagaauaucgcccagacuggauggacagcgcugcuccugcucuguccucugcagacaagcuuuuguccugggccaauaguggccucuaugucagacaggccaggguucaaucccagcacuugcacugguaaacuguguagaccuuaggcaaguuucuuauuucugagucucacuuucccaucuuuaucuugguggugaaaauagcuauauucauccacucagcaaucauuuacuggaguggauaugacucuuuacuuccuagcacuguacccaggaagggcugagagaagccuggaacacagugaguacucaggaagaggcagugaagaggacugcagauuccuuggaagcccagcacaaugcugacucacaggaaacaaacaggaauguuugaauggcugcauaccaaucugaggaugacucgagcccccagauggucaguguccaacucagagggcuguagaacuucagaacaugauaugugguggccagcaggggcuccaaaaggcauccuggaaaggccggggucugaaaugaacagauuuuaggugggucagaaaagcucucggccagggagaaucaagauaaaggaauggaaucaagauaaaggaauggaaaccagcagagccugggggucgccaccugguugaugcaaacuauggguuggaggcuuggauuaccagauuucagcagauuuaaugacaaguccuaugacauaauaaauacccauuaauaaugaagaaugaaagagaggauucccagccauaucagcagaggcaagugucaaaguucgcuuauaaacaugcaauuccuugcucuaaauggagucuaggaaagccaucaccucaagauaggaugagauucccuucuguauuagauucucaggguacaaauggucgcaaaauagguggcuugaaacaacagaaauguuuucucucacuguucuggaggcugcaaguccaaaaucaaggggacagcagggccgugcugucugugaagccucugaggggaaacccuuccuugccucuccuggcuucugguggcugccaggaauccauggccucccuugacuuggugcuguaucccucuaaucuccaccuccaucaucacauggccuuccucccagagugugucuguauccacguguccuuucucuuagaaaaacauccuucauuggauuaagagcucaccauaccccaagaugaccucaccauaacuuuauuacgcccucaaagauccuuccaacuaaggucacguucaagggcacagggguuaggaccugaacauaucuauuuaggggauacaauucacccacuguacuaacccuuuuagggccucccugauacacccuacuggccagcuuuugccuaagccaggccucucauugugucuucaguuaacaggaacauaauccugcgucccugguggcaacuguaaaaucagagaagcuucaugugcugaccucaucuccaagagcacuuacguucugcauccacgucagugcugucuuggugucucccuaaugguauuuuugaaagagguuucaaaccaccccccaucccaccccacccuacagcugagccagcacucuacacucaacaggcauccagaugcauggugucuuaacaacagacauccccagaccugcaacaguuaggaagccaggcaguuagugagggaccaucgaggacagauccuguucccaaaagccaggcaggagggucacuuuggaaaagggacguauacaccccugccuguuuugcagguucucccaaucaguucugacagauccagaacuucuccccagcugccauuuggaaaacccuaugcaaucuguguauggagucagccaggcagaccuuccauaaacauuugucaggcuccacucuccuacacaggauuguuggcugagcacaaaugugaacaaaggucagcaccgaauaggaaugagugcuccaaagucauacguuuccggagccuucaaacccaaagcgcccucucaaggcagcauccaagcacauacuacaggcgcucaauaaaugucaguggaggcaaacugaccagaaagacuuuuccagucuguaaagggagccugugugugcucagagacucagcaaugaaucuccugugagaugucuggcaaguuacaggaccaucgugagcucuucuccuuaucuggauguagaaagcugacauuaaaaggagucuuaaagcacuugccauacuuuuccuuuccgucuuuguggcaggagcgguacugcccaggcaagcuguccuuuauucaggagauggcucaaaguaggcugggaaaauacagggugagccuuuccugacgaggccuuauucuuggcagggccacagagcacccucuggaaugagcuuugugguagaugccaggcagaagcauuuacugaccucgugguacuguccagaacaugcacagaugaacacaccacuugcucaggguggccccagugcuagccucugccguuuuucuuccuuugagccaguauuguauuacaagcccacuuugugucccacacaggaggagacuugggcaaacaagagcgcagccuucgugggacuaaucccaggcuccucuccuccuuccccccucuucucuaagccccccagaaguuaaccucuccuucuccccacuucacugcccaguucauucuucaucuuccaggagagaucccgggucagguuuuccauucaaagaaaggcccuguccuucugaccugucccuuugucaucagcggguggguaugcauccauucucaccaaacagcauccaaccugcaaucagcccuggggugggugucccaugagccuccagaaacaaacacucauuacccaaggcguugucaggugugccacccucgaauuaaagucuuccagggcuagcaucagcugccuccucgggauuuuccuuucuggggcaaaggggccuagggcucaggacccaucucagccagcaaacccacuagccauagcucugggauacccgugacagggggcauggagucucggcacaucaagggaagaaaaaaagaaaggcauucuaauauccccgucagcagguacuccccaccauaccccuaaaagaugaaaggagaaucccaacagucaaaugguuuccugaaaaguccuuccuaugucccauuguggcucacacuugacuuuuacagcgcugacauaugcuguccaaugggguggccacuggcuacauagggagggcuauuuaaauuuaagucuguugaaauuaauucacacaaaaauugcagucccucagcugcuacagccccaggucaaguguucaacagccccacguggcuaagggcaaggaugucaggcaguucagguuacagaaagcucuucacugcucccaaggccuuaucuggcugcugagaagaggggcaagcuccaucccccaucuugugccccaguuaugucccaguuuagcuuccuagagguauaguggaaaacaauuccauagugagagaaaugggcauagcucagaaaucagcaaaagaacuagugugggguuuuuucuaagacucaggguccaagugcagcucuguuacuuacuaggugcaugaaccucagcaauucaggucaccucuagcuuccucauccccacaaugggggcaaaaauacucucccugacucuuuccacagcuuuugguacaauuaugagacuccauaacccagguaaauucaauaccauacaguggcaggaucaaaaacaacacuguacuauuaacguuugcauucucuuagacgcuguuauuaucauucuuguuuuguuaugaaaccaucagcuacauugauccaccagcauuuauagggacucuaaguaaugcaauuuaauuuaaugcaaaccaagcaagcuacccccuccaugugccucuggcaaaaccucuaaaacuggacuuucaauuauacuauuuauugugacauucucuuucacugguuuuccaucccugauucugcauucauaucaaaguagucuuuccaaaagguaaauccuguaaccuccuugccucucccccucaccuaaagucugcaucaucaggaagguaggauggaagcucuucagagcuucaagcacagagcuccuggcggacucugaacagccugcucaucuccugccaaucucuguucugcacccaacaccugacucuguuaguuccuagauguagggcagaggcucggacacccagcucaaaauggaccaaaaggcagcaggcggugcagggagccgccuucucuaaauaacucuacugcaucugaagugccugcaacugacacauccaagggcagaguggagagaacaaggaagggucccccaggacccaggauggccauuuggcuuuaaauggggggugaacagagcugugucuuuggccucucugugacugugccaggacgaugccacauucccagugacagauguaacgccagagccuacagcaagccuuagagugagcagcugccugagaaaccaaucauaacuguccagccccaugguaaacucucugucugacgcugugagggguagggggagccugaggcucugaugaaucugccaacuggcugugagaaaauguguacauuauacccacuuagggggcaacauuuuuucauuggugaacuuggguaaaguauaugagggaguucuuuguacucuucuugcagcuuuuacucaaugugaaagugaaauuauaucaacaaaauuuuaauuaccuuuuuaaaauauguauauauuucucauauaagauaagaaaaagugacaaaaccacagaaaagagcaucuggauaugaggucuaaaccuuggcuuuccccagaagugcuggggccuacuaguguggguugaaugcugucuucacccaccgaaaaaagauauugcccuuagaaucuggugccuaugaccuuauuugggaaaagggcuuuugcugauguaaugaaguuaagaaucuuggauaggagugggggcucacgccuguaaucccaugcugugggaggcugaggcaguacaauggcuugagcucaagaguaggagagcugcaaggggaacaugguaaaaccccauucuuaaaauaaaucaauaaaauaauaauaaaauuaaauaaaguuguuuaaaaauaauaaucuugagaugagaucauuggaggcccuaaaacaugaggagagacggacauagagaagguacguggagacaagagcagagauuggaaugauucugccacaagccgagcaacauccagugccacaagcagcuggaagaggcaaggaaagggugucccuuagcaccucagagggugucaaccucgcugacaccuugauuucagacuucuggccuccagaacuguaagacaauaaauuucuguuguuuuaagcuaccaaaucugucgaaauuuguuacugcagccacaaaaaaacaauaagggccuuugccuccagcaggagaaggaagccaggcuuugacucuggagggucugaagcccaguguggcuagaacccuuccgaggaccuccauccuccaguucugcucccacugguggcuucgguuggucgcugcuguauccgccaagcugagaaugggccaccacaagacaggcauaaccaggaacuauuucugaaccagugagcuaauggccucccacucugacauccaggugcaugcaggccugcugcagggaacacaccaccgaacaucugggaaugacaacugucaaaacaggacucccagcagaugcugcuccucuccaggcauggcugacuugccccucuuugcccagccuucccugaacccaucugcuuguccuggaaggacgcuccugggggucaucgucgucauggcacuccuucaucugcaauaagccuucgcagucccuguggggaucucccuccagcugugaguucccucacagugcaaauucagccauucuccacucgacauucaaccccugacaaacguuacuggacgaauaaacgauccuagaacugaaaacagaauacgaagauauuucuauuccaacucuucagucaauauauauucaaaccaagaaucagagaaguggagggaaccaccaggaccaggucccaaggcacgcaggacaaaggccaugcuggauuuagggcaggacuccauuccuccauuccaaccccaccugggccccagcuagaucagcuuccuccccaaacaucauucccugauguuucccaagugccaaaaaucaugccugacacauaguacauguuugagugaauauuuauuaaauaggcccagaagucagaguggagauguacaaaguugguuucaauauuuguaaaugcugcugcuucaaaaaaaggguggagggggguggggggugcugccuuucuauggaaaaguuaaaaauaucuaagagugcuaaaucccccuguguuaguaguucagggaacuuuucugccacacuuuuucucagaggaggcaggagugggugagaacaagaauugagugauuuccaauaacaacgcuaguguaaacaaccacacucacccaugcaccaaacagguggcaaaucucaccaggugucagacacugagagaagcaccagggacacacaaauggcaaaccccaguccugccccguggaccgcaccauccaagguagagggcaggcagucaccaacaugguggcaaguggccgaugcgagccuaggaccugggauaacagagcauggugugaagucagccugggcaggggcaggaaggcugccgugcgagggguggaagaucucagaacugaaaagauccugucuugggcacuucuaggaagaagagaaagcugcugggcagggugagacccagacucuguugaggaaagagaggagagcuggccagcccgaucucaaucccgcaggccagagguccauuggggcccucuuccaaacaccuccucuucccugaccaccccagugaggaucugacacuacugcccaucugcaaguaaaauagggacugcuccuuuguaaaacagggacccuaaaaugcagaugaggccaggcauggaggcucaugccuguaaucccagcacuuugggaggccgaggugggcgaucaccugaggucagguguuugagaccagccuggccaacacggugaaaccccgucucuacuaaaaauacaaaaauuagccaggugcaguggugugccccuguaaucccagcuacucgggaggcugagacagcagaaucacuugaacccaggaggcagaggcugcagugagccgagauagcacccccgcacuccagccucgucaacaaaucgucaacaaaaaaaaauaaaaugcagacgaaccuccagaagacaaggacaaaaaccgcaaccugggugugagaacacccaggcccuaggccuuaagagggaugguaaccccuagcccugucaucuacaaaauaaggucacagcagagcuagaugaucuauaaugucacagcugaaguuaaaaaauucaaugaguugaucacacccaacucaaggugcuggcuuaaggauuaagaaggaacacaugugucaaaaaccauuaggcugcaaagcagugccaccgaugaucauguguacaacaacaacccccuaaauguguggcccacucccagugagccagcccugggcucagaauucuacauucauggccgggagcgguggcucacgccuguaaucccagcacuuugggaggccaaggcagguggaucacgagaucaagagauugagaccauccuggccaacauggugaaaccccgucuguacugaaaauauaaaaauuagcugggagugccccugcaggcccagcuacuugggaggcugaggcaggagaaucgcuugaaccccagaggcggagguugcagugaggcgagaucgcgccacugcacuccagccuaggcgacagagcgagacuccgucucaaaaaaaaaaauucuacauucauuaucuccuucguccucacaacaaaccuggagaaugcagaggugcuacauuucuacccacuuuauagaccaaaaugugaaguuacagguuagucauuguugaagccagaaaccaggagucagacucgggcagggggggccucuggagcuccugaaggccauccccacucccuaaacaagguugagaaggugugguuuaaagaggaacaccauggaaggaaaccagugcuuucuucacuuuuuagucuggcaaaacaauccuucaaguuguuccgugguuuggagaacaguaauguguauggguaacaggugcucagugguacggacaagguuauacauuuccagccucagagucuucaaggcagcuugcugguaggagaaccuggauuugcucaugcagucuugggcacagcccucacuuaccuuagaugcucacccagcuugggguggggcacagccccuccagacuccagcccaaacaauccccaucaccuccgcauuuccuaguacaacacacagcaccgaaucuauucaguggccuaagcuggacacagaaaagaacauuuuaccccuuccuuccuguaaccccagaggcucuucgugcaccgcguucagggacuucucucuugggucuccagugcaucccugucuccuccagcucaggccccgucaccacuggccaccagcuuggaccucccucugaucuugucuuccuauggcagaggccaugcuuucugaaaugcuaaucucucccucucucaccucugcuuaaaaucugcaucaugagaccaucgcccucagcacaaagucaaaauggucuuucuaggaucuggccucugcuuaccuuuccugucucccuccugccucuucucugggcaaacuccuuccuuccccugaccacccuaaguccacacccugggcccuucugugugccuauggcacccuguguccccaggcaggcaccuuggcugugauuaucugauuucucaucuaaauuccuccccuauucgugcccgcccgccccccccacccccaaacacacacacaagagaacaaaaaaucucuaaggaaaaagagcacuuccaacucauuccuguacuuccagaaugcaugcagcaccaugccuggccugcaguaugugcucaauuaaacuauugcauaaugagaaauacccuauguuuugaaguguccaggaaauugaaacaauaauacucucuccccacaaaaaacagaaaacaguuaucuaugccucaguuuuugugucugaaaaauggagacagacuccagaacaggguugacaggaaggaaguaccucaaagcaaacccugcagaggccuucagugauaaguguucacuuucccuaucuucagcuugcugauuucccuaucguggugcauccauccagaaggccacaaagauccuaucucccaccaacugaacuucaaaagcaucuuuaucugcagaacccaccucaaggaaggucgauuccuaacuucucucggugauccuuuuauucugggcuagcuaggcacacccgcccagccuuaucuguaauguccccaagcuguugucuuuccaggaagggugucuccuaucuacaggccuccaggaggcaagaccagggaggcaaauggaggagagccacucugugaccugagaucuggcuucugccacccucaagcugugugaccugggacaaaucaacccauucaucagaggcucagcuuccccauguaccccucuguucaaaaaagggaguagacucacggacccuccaacuuggaaacugcaguaacaggcuguacuggacauguugaaugaacaccacaauggcugccuaagccgaucccuucuagcaaaagagggagagugaagcagaaagaaaucagggaaauuuccagaaaucaugucauccuggguugccugaagaugacaaaacuacgacguacaggagaccccuuccaggaaucacauacugcauccggggaaggccagaaguaagugcagacauacaugaaaaggcaggcauuagggaugguuaaguggaugccaauucccugcuuccagaaaugaacucagccuaaugaaaauucugcaggcgccucaccuguauauugcacuuggggcuaggagugcaagccacccaggggcuccugacgggcugcucaccuaggucccaacccccuucugccauuuccuaaccgguuuguucucagccucuuugaacuucagaugcugagcagcuuaacaaugucugaacagccuaaaucagccucuggcccauuaaagaugucuguuuccugccuccuuuccuuaaagaguuucaauaagaagagcuccuuuaaggguaggcacugggucuuuuuuuuuuuuuuuuuuuuuuuuccugagacagagucucgcgcuguugccaggcuggaguagaguggcgccaucucggcuaacugcaaccucugccucccggguucaagcgauucucuugccuuagccuaccgaguagcugggacuauaggcacgugccaccacgugcagcuaauuuuuguauuuuuaguagagauggguuuucaccauguuggccaggcugaucucgaucucuugaccucguaauccgcccgccuuggccucccaaaguguugggauuacaggcgugagccaccgcgcccagccugggucuuuuaacuuuuauauccccagaguguagaauauuuagaauaccagaauuccuuuauaaaugcccacuaaaugcguggauaagauaaaaacauaagacaggaagcaaucaggggacugauagucaucaguucgcuugguaaaaugcacucacguggcuagcacucagaagacaucccaaaucucccuucugcucuuucucccuuagagccacacagaagcucugcaggccugagcccaccuaccccaccccaccccaccccgcuaaggggcagcacagaacagcagcaaaccaugaggacccaggccaccugcuggguucccaucuuggugcugugaccgugacaacugacugaaacccuuaagacuccccuucgauaguauccacuucacagugagcuaggaggacucugugaguucaaauaugacaugugcuuagaaccaggccuggcacauggcucccguggcugucagcuaugggaucauucgugcuacuauuguuauuccguacaaccagauguuggaaaaauucuggagucaccgagccacagaaggcacacauccagaucccagauugcagcugucaagucacacuuugagccuuggacuuggaauccuaaaucacugggucaaauccuggcucucaucuaccucuggcgccugacuuucuccucucugagccucaguuuccuccccuggaaagcagaccuuucaaccugcccugucuuccccaaaaaggggaucaaauaaaacagaaagcaugggccgggcaugguggcucaugccuguaaucccagcacuuugggaggccaaagcaggcggaugccugagcucaggaguucgagaccagccugggcaacacggugaaaccccagcuccaauaaaauacaaaaaauuaacugggcauggcggugugcaccuguagucucaccuacucggggggcugaggcaggacaaucacuugaacccaggaggcggagguugcagugaguggauaucgcgccacugcacuccugccugggcgacacagccagacucugucucaaaaaaaaagaaagaaaagaaaagaaaaacaaaaaaagaagagaaaaaaacagaaaguaugaaguuuucuaagguugguauaguaggugcugaauaaauauauucauuuaaaugaauaguuuacaaccuccuccacacuuagaucagccaaccaaccacucuguccauccuguuugaugccacgcccguguucccuucaccucaccaccugucauucccaugugccucucugcuuucuguuaggggcacucagcuuugaucacccagcagggcuucuggugccagggaauuagaaaccauggccaagaucugagaacaugucuguccccauaucacacaggcugcccgcuguuucucggccuugcccugcagaacgaggcacggcagggaagcuggaaagugcacccacaccuccccgccaugcgcaugccugugugcaccuugugugugugugcauguucagggguugcagugcuaucagcugcgcagcacaagcugcaaagccucccaaggcaaagagaaacacucgcucccaggaccgggaaggccugaagaggaacgagcuguuuggcccuaggcaagugacuccuccuguaucucagucuguucaccuauaaaaugaagaccaugucccccauggccugcagaagacuuuuuuuucuuuucuuuucuuuuuuuuuuuuuuuuuuuugagacggagucucgcucugucaccaggcuggagugcaguggcgcaaucucggcucacugcaaccuccaccuccuggguucaagugauucuccugccucagccuccugaguagcugcacgguacaggcuugcaccaccacacucagcuaauuuuuguguuuuuaauagagaugggguuucaccauguuggccaggauggucuugaucucuugaccucgugaucugcccaccucggucucgcauagugcuggaauuacaggcaugagccaccguguccagccagaagacauguuuaaaaccaccccugaaacuugagucuguagagggcuucaugucacaggcuaucauggugcuuuuccuagugcucgggagcagaguguggauccugccauccccaagcugugcaaccuggggcaagugacuuggcaucucugaaccuacacuuccacaugugcaaaauagggaugguacuaguagcuaaaguagagguaaauggugguugaaaaguuguuugaaaagcauuaaaccaccaugcaagcuaggccagugaugacugguuaaucacuagagagaauaaaaagugauaaugauagugaugaugauaauaauaguaauaauagugccuaccauaauaaugaggccuaugacaggccauucuuaagauaaaauaaaaaugaaaaaauaagaacaagcuucugcuaaaaggagggcucuagcucaagugugaagcagacccuguuuucaaguuuugcagagaaacaugagacuuacaaaaaaauuaaacuggcagggcgcaguggcucacgccuguaaucccaacacuuugggaggccaagguaggcggaucacgaggucaagagauccagaccauccugcccaacauggugaaauuccaucucuacuaaaaauacaaaaguuagcugggcgugguggcgcgugccuguaguuucagcuacucgggaggcugaggcaggagaaucgcuugaacucaggaggcagagguuacagugagccgagaucacgccacugcacuccagccuggcaacagagcgagacuucgucucaaaaaacaaaaacagaaaaaacacaacaacaacaaaaaauuaaacugcagagcugugucuucccuucaccacggaaccuggaaaagagguggcaguucuuucuccugcaacagcucccuaucugucccuacacaguauggaaagacagagcagacuguucagagcucccuucuugccagccaaggaaaggccuuugauggugcuggauggaugaggggcaggccccucucagccucagcuccagccccagcccugccagccuggcucugcaccauccuuccuguggaacaagcacuaaggcucaaccuggaacagcugagugcuggggccaaagccaaggcucuuccccuugagcuugggucccagaugcccuucucacacuccauugugacauacuauaguuguagauguaccugucuaccuccccaagcucugagagggcacuaacccaggcuaucucugucaaagaggugguacaguaugacaggcaaauucaaaggccuagaggccaacuacccagcuacaaauuuagcccuugcagaaacuaauugggcaucuugggcaaauuacuaagccucuuggagcuuggcuuuuuauuugcagaauagaaaugauauuacagccggguguggugguucacgccuguaacccagcacuuugggaggccgaggcgggcagaucacuugaggcuaggaguuugagaccagccugggcaacaugaaaaaaucccauuccuacugaaaauaaaaaaaaauuagcaggguaugguggaacgugccuguaaucccagcuacucgggaggcugagacaugagaaucacucgaacuugggagguggcgguuguagugggccgagauugcaccacugcacuccagccugggcgacagagacugucucgggaaggggaggggagggcaggggaggggaggggauuacagacucuugggcauaacucuuauacuguguguuggaaacuuaguaucuugaccugaacuaccaugaagcuauuuauggauuuuauuuaucccacuuacuaugaaaauuaauauauuucccuguagaaauuuugggcuugguuagaggcacugccccagacacacgguauauuggucugcuagggcugccauaaaaaaggaguauagacuggguggcuuuaacaacagaaauuuauuuucucauaauucuggaggccagaagaucaaguugaagguguuggcaguugggugucuccugaggccucucuuuggcuugcagauggcugucuuuucacuguguccacacauggccuucccucugugugugcgcauccuggugucucuguccaaauuuccucuucuuacagggacucuagcccaguuggcuuagggcccacccuaauagccuaauucuaacuuaauuaccucuuuaaaggcccuaccuucaaauccagucauauucugagguccuuggcacuaggacuucaacaugugaauuugcagagacacaauucagcccauaacacauaguaugauaugcguacuguauugcguuucuaaaaucucaaaacaggauaaacucccaaacauaauucauccuaaauguuuugaauaaaggauggaggaccuggaggacaggcuuguaggguggugcaaaggauaaauguggcagcacacagaaagcgcuggcccaugguacagagcucacagacccccaggaccaagccgagcaccaguugcagagcagcagcucagucauugcuucauggaggaauccacgaacucagaggcccgaauccuucuucuacacuguaugacuuuggggaagccacucccugggccucaguuuguucaccugcucaaggcaggcaacucccaccugggagaggcacugggggcgcugaaccacacccacagguagaagugaguacuuguuggccuggcgcaguggcucaugccuguaaucccagcacguugggaggccgaggcggguggaucacaaggucaagagaucgagaccauccuggccaacauagugaaaccccaucucuacuaaaaauacaaaaauuagcugggggugguggugcgugccuguagucccagcuacuggggaggcugaggccggaaaaucgcuugaaccugggaagcagagguugcagugaaccgagauggcgccacugcacucuagccuggugacagagugagacugucucaaaaaaaaaaaaaaaaaaaaguggguacuuguugagucucagucacagcagucacacaaccacaacaagacaauuucaucacaaagcaucuguucuaguuaagacauagguauugcaggccucugucaucccucagaaugauucucaaauaacauucugaggcacauaaggaaacuuaagaguaacggaggucaacuucacccucaaaggcaaguuuuuucuuggagcaaugucaagcaguggcaaaaguccaugguuuugguuucuuuuugcauaugguugugccuuacugcuaguaauuaagagauauucaagaugaucaguauuucaaguuuugugcacguuuucuccaaaguccuggagccaaccugccuagaccaugcuuugcauuuauguauguaucuucuguaguugggauucuacugggaaggagaaauuaugaacgaggcaccuacgugagcuguagcaaaagaaaagaaaaggaaacaaaagaaaagaagaggaaaggaaagaaaagaagaaaaaaaauguuccagucaucuaggaaguccacauagaaaugagcucacaacagauuucuuggaguagggagaagggaaugucuucccuaaucucaggagaucuggguuucagcccaauucugcaaguuagaguuucagucucagcuuuuuuaucuguaaaauggaagcaaauuacccguucaauuuaucucaugguuaauuugggagggguguggauagugcuguugcuaccagagcaaacuuuagaaugguuucugauacuaaauacuaaauaaacguuacuauaauacuaaauacuaaauaaauguuagcuauuauaauuuauuuuucuaacaaucuuuauggccauccccugauaaagguauuccaaagagccugauuuuugcagauggagacaagagugggguuugagucagguucucaggcaaucuacaggcugauaucuccaacaucaagaucuaucuguucauucauuuuaugcagaguccaguaaaagcauuccugcacagggagguugcaguagggugaucucccagcagaucggggccaagauacuccaggacaauucaaaaggacagagauugcccagccugaccuucaaagcaagaauaaguaaugugccauaaccaucaguucagagccaaauuccagacagguccuuguucucccauugaggaaggacagagaagcuucugccuacuggagagaaugaccugaaaaaugcaggcacgggccggacgcgguggcucacgccuguaaucccagcacuuucggaggccaaggcgggcggaucacgagggcaggagaucgagaccauccuggccaacauggugaaaccccgucucuacuaaaaacauaaaaaauuagccaggcgugguggcgggcgccuguagucccagcuacuugggaggcugaggcaggagaauggcgugaaccugggagguggagguugcagugagcugagaucgcgccuuugcacuccagccugggccacagagcgagacuccgucucaaaaaaaaaaaaugcaggcacaaccuaggugcagacacagcuugugauucuaaaacaugagaccuugcugagcuccccagacugugccucuguugccucaucggaaaaugagggcacauauuacauuuuguuucaaaguaugacuauaaagccaauggagaaaaaagacuuagcacaaaauagguacccaaaacaugccaguucuuucuagaauaggguguuuaaagaaaaaaauggcagaucuucaagauguaaaggaagcaucaaaugaaaugagugaggaaaccaggggucuggaaacagggaaggggcuuugcagcccuggggaaauuugugcugaguaagcaaugagacagugaguguuaagacagccucagagcucagggagcucaaagggcuuuaacagacaugaucucacugggauuuuuuuauuagcuucuuagacaguuuaacagguuccuccagcucugcugagacagugaaacugugggcuccucuggccucccugggcacauggaggccagggcagucuuucugaaccugcuuggguggcaaaggcccaagaucuguuucuugaucuacaaucggucgugagccaggcauugcagaaggaaauucauuuuuuaaaaauaaauuuccuagagcaacauugaaagaauucuguuuuuuggccaggcgcgguggcucacgucuguaaucucagcacuuugggaggccaaggcaggcagaucacgaggucaggaguucgagagcagccuggccaaugugguaaaaccucgucucuacuaaaaacacaaacauuagucgagcgugguggcauauaccuguaaucccagcuacucgggaggcugaggcaggagaaucgcuugaacccaggaguuggagguugcaguaagccgagaucaugccacugcacuccagccugggcaacagagugagacuccaucuuaaaaaaaaaaaaaaaggaauucuguuuuuguuuuuguaaggagcagagcagcauggaaagaagggaggcuuugggaucaacccugggcuuaauucccagcucagcugcuuccuggauguguuucuuagucugcaaaauagggcaaacaguucuucccuugaaggacagugccaaggaccagugcaaugacaaaugugagguucaggcacagucuaggcauguaaugaccgggggaggcuugcuguugauauuguacuccuuuguuacacgccuuuuaguuucuccuagggguauucauucagcucuaaucucaagaccuuucugugaucugacgucccucagaugucagauccaugcugugacgcugucuuccuuuugaucagccugaggccugcaucaacucuacccacuggccuugcccuggguuuccuacccagggcccuaccccugagcucucugcuagugcacggguaugacaacaacacggcuguggacacugcugugcagggagcuuugccucaggaauauugagcuccagcagugcacugggguagaaggagcaggugggaugaaaguuucccaggaggguccucucccucucuaaggaagccucgguucccucuucaguaagacaggggcacaggguaugguggcucacgccuguaaucccagcacuuugggaggcugaggcagguggaucaugaggucaagaguucgagaccagucuggccaacauggugaaaccccaucucuacuaagaauacaaaaauuacccaggcaugguggcacaugccuguaaucucagcuacuugggaggcugaggcaggauaauugcuugaauccgggaggcggagguugcagugagccaagaucauaccacugcacuccagccugggccacacagcaggacuccauuuggaaaaaagaaaagaaaagacaguggcuugcauucccauaugauugcccaauggagugagauaaugucugugaaauggcuuauaaacuguaaaagugcugagcagacugagcuguuagccauccucccuccuacaccuccucacucgaaggugcuccuugugagcaccugaaucuugagugugagggaaggagacauaaaggagaauucccagcccaggcccuuuugggugaaagucaguccucccaggucagucuuuaguucuggugacacaucugucuccuaagugacugccagcugucucuucccaucccccaaucagcuuuucucccaagaguccuuuaagcaaauuccaucugagccuggugaccccugggccccggugcuuauuugagacagugggaaacuccuccaccuucagguucaggaguggaggcagcguggagcagugguuggagcucccacgcuugaagcaggaccagccucaccugggaaacuggccgcaucuccccacauggcacaacagcuuuguggcuaagggcuggacaggcagauggcauacaggagcugggacacccagaaacacccaggucucagccucccacuccuaugcagggagaguaauaacagcaugccgccacggggcuauugggugcuaaccccaggacuuggcacacaguagcacccaagugaggugagcugcuuucugcgguuagcauucccacugucaagccugcaucaucaguaaaagggagauuagaagagcaugugccccggaaguuuauuaaaaggauuaaaugagaagauucauguaaagugccuagcacagucucugacacuuaguaagugcucaauaaaugagcuuucuaauggcuuaaguuggagggaaacucccguccucuggcacacagcuuuuccaggaacccgggccgccagggaaggcaggggacagccucagcuggaagcagaagagucucuggccugugacuaaggcacagcgagucagaauccagccgcugggcagggccggcuugggccgaugccuggccuggcccccauucagggugaugcguuuuuaccguaaggucuggguaacuccacagccggcacugggccucccugucccuggguggggccugacacucacccaucaaccaugacagccgcuucguaaaagaggcggggacucuagagcagugagggcccagugagaaagggcagauucacggguuucagcgucaucugcuaaaugccacccccauugguuuaaccaugugagagguguuaguauagcacggcaggucugggugccaggcugagcuccaggacaggagccaaagucaauuaauaccagggaugggggguggggguggcugaauagggagaggaugcugaugggcaguggcagugaagggaggcugagcucccucccaaaaacaggagggaagaaaaggaagguaggggagagaggagagagagggagacagacagauacacacacacacacacacacacacacacacacacacacacacacagcuccuggaguucaaacauuccaaacucaaugcagcaaaugggagguucuggucacagggggcuggucuucaaugugucccauaggccaggcacuacugggugggcccuucaccuacauagucuuauuguaacaacagcugggacggcauagugaucuggugugugggcaccagaguacaacuacgaaguuccacauauggaccagccccuuccuugcugacuaacaugggacagguuaauuaacagcucugugcuccacucuccucaccuguaaaaugggaacaauaguaucuccccuccccagccaaaggcuacacaugaagaugaaguguguucagacauggaaaaggcuuaaacaggcccuggcucgcagugagccuccgaugaaagucggcuauuucugaugccucuuaccacagccugugaggcagaaauucucaggcuucuuuuuagagcugagaccaaggggguucagagagggugagugacuugcucauggucacuguauugauccgccagggcugcuacaacaaauuuucacaggcuggguugcucagacaacagagguuuauuuccucacaauucugaaagccagaaguccaggaucaagguguggucagaguuguuucuucugaggccucucuccugggcuuguagauggccaccuccucccugugucuacacguggucuucacuccuccuuugucaucuuaaucucuucuucugauaaggacacccaccagucugaccauauuggagccccgccacgugagcucaguuaacuguaccucucuagagacccuauuuccgaacacagucacguucugagguaugggugaguaggacuucaaccuaugguuuuaagggggacagaauucauccagucauagucaccaagcuucccugaagcucuacuagucuggcauagagaaaucagagugaaccaagaucaaaaucugagggcaaccuuggcuuuccccuucuacacagaauuggaugacagcuaggagauggaucuaugaauuuucuccccugagaaaccagacgggaccaccuagagucggucuccuucccccaaacgcccuggaccuaccaugggcacaagcuggggcucagggaauaccucugugcuccaccacucagcagcugcuuuucaagagaaggaaaacacuacuacacgccauccacagccaccgcacaauacuguaucccuuugucagggauaauaaaacagacgggaagucacucuggaacuuacuauggccuugggucaaaggcaggcugaccggggcuggcagaagaaagcuaaaacuuacuucucugggauucuaggaauuucaacaaaugagaccaacagcagauaguuucagauuaaagaaaggcaauguguucccaaacuuugaccccugugcacaggcucugcagaaaagcugucacuuugcacucaguuuccuuauagguaaaauggggauaauaauauugucugucugccuaauuuguacaaggcucuuacaagaggguauagcacaaaguaagugcuuaauaaaugugagcuuuucuuuguauuccuguuucauaguauuuguaacuauuucacaagauucagaaaccuugucccuggacugugaucaucgccuuuucuucagucuuccauucacagacccagccucuggugggcagucacaacacagcuggccauguccagagagguccaaaaaccugccccaggugucaaagcagcuaagaaacagggccgggugagacucugccugacucuuucauucugccaaaucuaagcuaagcagugauuccuaugcccaccugggaggggagaaaccugaggcccaccuuguaaaucccuacaggcucagugugccuggcauugggaugggcagaggagacagagggaaugccaaaaaaagagcaguuacaaaggacagaccacagguccaggaugaggggacuuucaacggcuuguucgugguuccguuuuugcccaaacucucucgauccaccuuugagcaacaguaauuaucucuuugccuccaucaacuccauuuaccaucccuguccaauucuuucccaauaagccagagaauaagagugcagacauuaaaggucagauuuucauggugcugaacccauuuaacccagcuguguggcuuugaguaagcuaccuaagcucucugagccuccauuuccucgugugcaaaccaaggaaaauacucaccuacuuauuagaaggaaagaaaagacugaguaccugccaugugacaggcuuucaacaagggaccaccucuugucauaaacaagaggcacaugaacaagugaccacggguuuaacuuguacacagguauuaugaaaacaacaagucugcauuucaauaaauauuuguuauauaaaugaacgggacuguucccagagccugcugcuuggaggaagcuagggaauaaggaacucaaaaacaagguaagaaugucagagcagggaagggaagggaggagggagggagucgugaccuugggucaaagguaggcugaccgaugcuggcagaagaaaacuuaaacuuacuuuucugggauucuaggaauuccaacaagugacaccaacaacagauacuuucaaauuaaagaaaggcauuguucccaaacuuuggccccugugcacaagcucugcagaaaagcuaucacuuuguacucaguuuccuuguagaucaaauggggauaauaauauugccugucugccuaauuuguaugaagcucuuacaagaggguccagcacauauaguaggugcucaauaaaugugagcucuucuuuguauuccuguuuaauagucuugcuaucauucauccguggucucuuuccuuuucuuggaaaucagcacuuucucagacacaaacuaguuaccagagcaauggagaugaccaccauuuccucgcuaucaugaauaaccagcuacuuggaaacauuugaaagauggaagaugcuuucuuaacaugggguucaccuuccuacaaauacuuaaccucuucccccuuccuccacuagacuauacagcccacaagggcagaaccaugucuguuuugcuugcucuuacaucccuagcaccuaagagugucugauauauuaggcacccaauacaaucgauugaauggcuugugcaugauaauaacccaacaagcuugggagaguaagcaugagcagaaaggccaaucgcccuaaguucccugccuuggauguguggcugguacccugacagaccagaagcaauuuggccugcaguguuuuuccugggucugcacuccagcgagcccugccuuggugcaauguuuugucugucucuaaaccccuucguacacauucacauguguuacacuaacucuuucuuuuuuccaacccgcagcgaggcugguagcuuuaguccuuuauuacagagaaacaaaaggaggcccagagagcucaugggucucucccuaggacacagagcugacuggggacggugagugucccaaaagccaggccuucgguuccacauccugugcugaguaaagugcugaauaauguugguuaguugaaggaaaaaaugaacgaaugggaacaacagugggaugugauuauuuuccaaagaacucaguccugucuauggcuacgugacagaaaaaacugcucagugggagguccaaaacugacacucaaggcaacaaaaggaacagggaaagggaaucguuucagauaagcaauggaccagaccagcguguccuccuagguugucagggcacaggcugggaacugugaggauucaugcugccuuuggagggccuucagcauggggcaguugagggcaggcugcucaucccccuggcaaucaggggaacuaccagaaauggcaucacccccaugagacuggcaaaaagcaaaauucugaccuaucaaaugugggugaccagaugggggaaaacagggcucuuguguacagucagugggaguguaaacuggcaugauuguucuggagggcaaugugaucgcgucuuaugaaacagaaaauguuccuuagccuccacggcagugaagucgccucaggguauaaauccuggaugagcucucacauaagugaccaagaaagcaugugcggauguuccucccagcaguguuuguaauaugggagaauaaaaaagaaagaaagaaaagaaaaaaaaugcaucaagcacagugucucaacaggggaaugguuaacuggcccuugaaaaacacucggccacuguucauuguucauucuccucugauccaacuucccacacacacacucaccccacccacuucagguucauuuuuauguuuuaucagccuauugccuugacccccaggggaaaguagaauucacauaugaaaaaagagggucagacuccccggaaagcuuuucuauguccuuugcccaggagagguucccauuacaaucgggccuggaccucagccaugagcacggggagggaaggaaccaauuucauuccacuuaaaccaauuugccgggcccagacagcagcuaaugagcagccugcgcccucggagucaucgauaccacuuuccaaaucaaguuaccaaauuggucuuaaaaccacuucaaaggggccgggcugacuguuaccagugaggcauccugccagccauauggccacgcuucuucccacuggcauccuccuccucgguaucagcugcagaggggaugagcuggcuggcugcuuuugucucugcuuuggaucccuccuuccccugaaugccugaucguccauaauggaacuugggucaccauuuaaaaaaaaaaaaaaugggacaacuguggcagagggauucaaauaaaggagggcccauucaggcagcacagccaguagcacaacagcccggugaggucaguacucuuauuguucccauuuuacagacaaagaaccugaaaguaugaaagcugggcaaggucucaccauggcuagcaaguggcagaaccagaaauugaaccuggggcuuccuuaaaucacaauccaugcucagccucuaagccacgcagguuuuauaguuuagaucuucaugacuuacauucccuucucuacaaucaagcagaaaaaauagucaaaugggccagguguaauggcucaugccuauaauacuagcacuuugggauguugaagcaggaggaucgauugagcccaggaguuugaggaugcagugaacuaggauggcaccacucuacuccagccugggccacccccaucucuuuaaaaauaaauggucaacugaaccuugaacaagggcccaaaauaauuuuccuuaagaggcuuuuuguuacuauucauaaauauaaccccuauuuuuuauugagugcgcauggaaugaaaagcacuagacuaucuugccucuuuaaucacacaaaaguccugaaguagaugggaugauuuuuuucucccacauguggaguaacaugcuccacauccuacagccaggaacggaacgcucaucuuccacauuggggaugaaauucacuuuaaacccucaacucaguuuucuuuucccuaaauccaacuguccaucaaccuaucugucuuuaaggagaaggcucuguggaagagcccacgucagcccuaauuagguggucucuagauuagugguucucaacaaagggagauuuuuacacacacauauguacgcaccaccaccaacaccaccacaaaagaacauguggcaaugucuggaaacacuuuagguugucccaacuggaagcugggguugcgacugacagagcuacuggcauccaguggguagaggccagagaugccgagcaacauccuacaauacauaggacagcccccacaacaaaucaucugacccaaaauaugaacagcgccaaggcugagaaacucugcuguagacccuaccuaugucuuugcaauuucuucauggucuugauaucauacaaagagagcuucuuuauuaaucaauucaauaaaguaauacuuagucauuugcauuaaaacugagcacgacuaauuuuugcagcuaauggacccaccagggcuggccagaauaaagggcugggcuggaauugauugcaugaaauggugcuaagaucacuugagaaauguguccuuuugcuuauuaagauuaccgggaggcuacuaugugucagacuucgcguuaggaucuggggagggcaucaacgggcaggaacacucugugcaggaccuccuucuguccccagaggacacacaucaucuuacugagucacgagaugguccaugggacauuuccaggcccccuacaacagcacauucucuucuuucaggaccucaggagagaggcucaagacagaacaaaaggagaccugggaagaugggucacucaacuuggagaggaggcccugaggcagguccugcucccuccucagauuuuauuucucaaauccuaaggaauaauaaucacaguuaaaaugacaguuuauacaaaucucagcauuggacaugacaguuucauuccaggguuuccaaagccacuucagaacagccacuaccuaaagaguacccaggacaggagagucgaugcgcagcuucaaggagggacugaaucucacagucuuucccacugaaagaaaauaaagcuggaggcuccaauacuuagagcaaaaugaggcaccagcuggucaggcaagucagaauugaacccagcucuacugaaugagaaccuucaacauugucaccagguggcuaucacucauccuggucaacaguacaugguggaccucagaaagcucuggacacucccugggccucaguuucagcagcuguagaauggguuaucauuuccccuauggcagccuucaggggcucuuccaggucaagggggagaggugagugacaucaguuucaaugcaugaagauguaaauuaggugcuuucccaccacuggcuguguaguugccugcaggagaagccuuaaugagagagguggcuaugggucaacaagaacagaaucacaccugauuucuuuccugucaucacaggcagaugaaccuggguugagaugccagcuugaugaccuuaggcaagccauggaaauucuccaugaucccuuccacauugcucaacgacccuaggcaagccguggaaauucuucauuaucccuuccacauucacacaguggggaugacacuucccaacuggcagaacugacaggcgaaagugucuggccaaggcaaacaugggcuugugagucuuaagagccacaugcagggaguuacagagcuggggacaugggaucacacucugagggcccaacaucugugggccuggggaccugggacucagggugcccuugggaagggagucguuuccugacaaaaaugggcccacagguguggugcccugcaggcugguucaaagagccaagggccccgaggaagccaaaggggauggucucaggaaggagaggcauggcccacuucccaaaagagaaaagucccaccccacacacauggcccagagcugagcuggugcuggaugaggggcucugcaagaaagaggggccccucaggccacagagacacuggcaccagagcaggagacugaguguggccuggaaagacaugcauugcccuaaaucagaauaaaauuugcaaaggcaugaugaucacgguguucacauauauacuauaauaacaaaauaauaacucuuuaaaaaguaaugcccaacaauagcaaacuggcuaaauaaagcaugacauuucuaccacuagaguaaugacagcaaacauuuacugaagauuuacuauagaccagauacuauuaaguugaccuuuuauaggucaacaauucaaugcugccaaauucacauggcucuacauaauauuuuaagcgcuuuacgugucuccauucacuucaucaucacagcaacccuucugagguacugugucagaauaccugccaccccucauuccaaucaaagagaugcccaugucggaauuuccuggaaccugugaauauguugccucccauggcaauagaacuuccuagaugugauuaaaccuaaggaccuugaaguagggauuauucuggauuaucaggguggccccaguccaaucacaugaauccuuaaaauuagauaaucuuuucuagcugagaucacagaggugaaaagaaagagggagaaaagauuuaaauccuaaaaggaacuggacccaccauugcuggacuugaaaauggagagaggaggccacaagccuagcgaggaggcuuccagaagcucaaugcaucuggacagccagcaagaaaacgggaucucagcccuacaaccucaaggaaacaaauucugccaacauccagaaugagcaaggaacagacucuccccugcagucuccagaauggaaggcagccuacagguuccuugauguuagccuggagagauccaugucugaccucugcccuagauaacuggacgugagccggacauaguggcucacaccuguaaucacagcacuuuagaaggccgaggugggaggaucgcuugaguccaggaguuccaggccugccugggcaagauagugagaccucgucucuacaaaaaauacaaaaaauuagccaggugugguagcucaugccugaagucccagcuacucuggaggcugaggugggaggaccccuugagcccuggaggucaagguucagugggccaggaucacaccaugcacuccagccugggugacagagcaagacucugucucaacacugccccuccaccgcccccccccacaaaaaaacuaugcauuaauauauuauguuauauaaaugcuaaauuuguguuaauauuuuauggcaaucauagaaauugauaagcaggauaaaaagcauucguaaccacacuugaaggcagaugagaauaugaaucacaaugcccaaggucacucagccagcaaggagcagaaccgggucugaccagcucgugggaccucuggcccugccguucugcucugcagucucauggaagaacaauuccaaauccaguucccagauggcaacacaaagacuguauuuugggcugacucuaccaaaaguugggcuuuaaaaaaaaugcaguuauuauuuucaguaauuaaaauuguuaaaagaucuuggccuguccaggccuggauuauggcaauaaaaauguggcucgagaugaacuaacauagggguugggugggggaaauaaugagucuagagacaccaggccugauauucagcaggaacucacucaccugcagugguuuugugaaagcggucccauaacagcgaguaaacagguaccuccccaugagggcaacuguugucccccgugucuaggcauguuccccaggggaacauucucccacccaccuccacaaaaugcaggguucaggccugacgcagagucucagaaccuagcaccauguaucccaaugccucagacuagaauauuugauuaucaccuccaagggaucagaaaguuaggaaaguuagaaaacagugggcccagcaggcaggugccuuuggacuuaccuagaagaaaggaaaagaucugcuuuggucaggccucuaaagauauggaaaguauguggaaaauguacagacccuuaggucuggucuuaggccuguuucaaucaucucuucaucuucucuguuagcacauggccucagguaagccacuuaccucuccaaaucucaguguccuggcaguaaaaggggaacaccaagggagccacgugccaagcagcucaaaggggagaugauucagccuccacuuaaaguaccaucaugauggcuguaugugccaaggucacccgcgcaccucgggagaaggcuccagggaguauggucagcugcagaagcaaaagguaugagugucagugcccugcagucaaaagcaguccucacagagcacagcacugccagggacucgaggcuuugagagaccccgcaccuggcucccgugcugccuaacgcggcuuuucuccagcaccuccaccugccggaccauacccuguccaccucugcuccaucugcggucguaggcccccauccaugaagccugugugccuuaaccaucccauaucaggguacagggccaaggugcugguugggaaagggccacagccccaccuuuguacauggagcccuuaaaauauguuggucaagugagaaggcaggugaggauaggggagaagagucacaggguugccaagacagaccccagcucuuucuuccuccauaacugcaaagccuuggccuagagaaagcggaagcaagaagaccccuugguccaauccccauaguccaauuuaacuucccaaauagagaagguacaugccacaaaagagaaugaggcuucugugauaucacccagaaguccuaaauugcagcaucccucucagccucaguuuccucaucuaugaaaugggcaugaugcccgccugugcaccucaccagaggaaggacugcucaaaggagacgcucaaccaacuucccugugugagcaugcauuccgccacacgaugacugcaccaucgaacgagacccacucgccugccacacagagacccuggggcagaggaacgcaaaggcaauaaaccuaagauuuuggacauuaguaaaaacagacuggaaucuucacucauuuucagggacacuucagccuuucucuuccauguccucuggugcugcagcuuugaaaacaaauggcauuucuuuuuaagggugucauuuuucuuuaaacaccuuaagaaaaaaaguuagaaucccaaagggaucuuacauuugcguucuuguguaaucuguuuugcuagaagcuuucaaauacauauauuuuugaagccacaggauacagccccagggugaggccuuggguuccuaucagcagccccucaaggcucugggagcaucucuucuuuucaucuggagcagcuguccuugaggaacaugccguggacacagcugucugagaugaguaagccucaucucuggccaaaaggaaacacacugugauuuggggucucucugucucaggauggggcuuccucggaggccugaagccaugugggacggcauccuuucccuggaaagugcugagauugucaaucucgcucacauuugaucagggcuugucgccucuuuguggcccccgcugauaaaagcagggcuggcgcuguuucuggaaugaugugagggauaccacccccaucccagcccuaggaaaaaacaguaucauucuccagauggcuaugcuccuugugaacaucccaaggaggucgccugaagagguuacaaggccagugauucccagcuggcuuccgcugagggaaagagacugaucuuggaagaaucagaccaggagccugaugaggaaaacugagggacuccagugucgaccuccacacaggcucugaacuagacggagcauguagcacgauuuagcgugacagagacuaaauucuagcucuguuacuuucgcagugagacuaaaaaaugucuucccucucugagacuuggguuugacuucuguaaaccauggguaauaaauaaugcccuuguucgaugcccauaaagauugaauugaauuggggccaggcucacuccuguaauccuagagucuuccuucagaaggaagaaagcauaaucuauaugcuggcuggcucuacgcagcagcagguaucacaagugguuuuugucugccuuugcuucugaagguuaacccacuaccuauuuagagaggccacguuggucucucucucucucucucucucucucucugugugugugugugugugugugugugugugugucuuuuucccuagggugggcauuuucuuucaggcagguggcacccugcccaaggaggguggaucacuuaaggccagacuucuagacuagccugaccuacauggcaaaacccugucucuacuaaaaauacaaaaauuagcugggcgugauggcacacaccuggaaucccagcuacucaggaggcuagaggcacaaaaaucacuugaacccaggaggcagagguugcagugagccaagaucgugccacugcacuccagccugucuaaaaaaaaaagaaaagaaaagaaaaaagaaaagaaaaacaaugaauuagauaaugugccaaagcaucucaagauuugcacccaagacucgucaguucccuugccccugcugucagauuaauugcaguuuacuuguagagguaaagagggugcccacagcaaagggacugaaccagauaacucaagguaaucacccaguggaugaugcgggcugcaagcccgagggguuaggugacuuggucuggacuuaaaacggggacaggaaauuagauaccagcauucauuuuucugauuuacaaauccuuuccuguauaaaacucuuccaaggcacauaugugaacauacacaguuaugcuucagccggucccucccaucuagagaauccaaccaaggacacacagugugucuagggagaagagguuauucuguggcacagguggcucugcagaggugggugccaugccaagucccacgggaggguauguucccagcgaagaguuuagagcaaagaccugcucaaguuacauuaggggugagguuccuuccuaaaggcacccucaagcaaccccucacuggaagcaggagaggaagcagcucagcccugaaggcugcaagagcucagcagugccuacugccuuuguugaccuuugaaggugaacaaucacggcgggagggaaaugauuucuccaaggccaggacauggaguggagcgguaggaugcacagauccaaccacaaaccagauucagaaagugucagaccagcauuggggcggccauaggaagccaaagccacacccagcaccaccuuucuccuuucugagaaaggccaucaaagcaauaugagagcagcuggcacaauggagugauccucauucaauagagaguucuagccugggcgcuucagggcuacaguucugcuuagagaagacacugucgaccaggugggguggcucacgccuauaaucccagcacuuugggaggccaaggcaggcagaacaccugaggucgggaguuggagaccagcccgaccaacauggagaaaccccaucucuccuaaaaauacaaaauuagccgggcguggguggugcaugucuguaaucccagcuacucgggaggcugaggcaagagaaucacuugaaccugggacgcggagguuguggugagccaagaucgcgccauugcacucuggccugggcaaaaagagcaaaacuccaucucaaaaaaaaguaaaaaaaaaaaaaaaaaaaaaaaagagagagagagagaagacacuguuuguccaacucuuaccucaagaccauuccucauucaaaccacuuccacccucacguggccaccccugacaagauucucaaucuuugggccacaccacccacugacaccucucagaucaggaagcuaccaguuacuccagcuuuuggccaaauccacccuaaccaggauggucauuacagccaagaucaucagagcacguacugcaugcuggacacuguucuccgcuccauacggaggagaaacugacuuugauaaauggucaaaauggcccuuugggauacauacugucccauuuuacagauaagaaaacugagguuucucaagauuaaguaaccucccacgauugugcaaccagagcucaugcucugugccaucgggccacgcauggcucaccuucuucuaggcuuuggaccagaccccugaauacauaugugauucugucaucuaucaguugugugacaucagacaaagcacuucaucucccuaaaacuucacugcuucuucuacaacaggggaucauaacaacaccuuccugaaugaaaauacccacccuagggaaaaagacacacacacacacacacacccugaccuggccucucuaaauagauaguggguucaccuucagaagcaaaagcagacaaaaaccccuugugaugccugcugcuguguagagccagccagcauauagauuauguuuucuuccuucuaaaggaagaggcuuaaaaaaagaagagaacuggcugggcaccgggauuacagggcucacgccuguaaucccagcacuuugggaggccgaggcgggcagaucaccugagguccggagcucgagaccagccugaccaacauggagaaaccccgucucuacuaaaaauacaaaauuagcugggugugguggugcaugccuguaaucccagcuacuacggcggcugaggcaggagaauggcuugaaccugggaggcagagguugcugugagauagcgccauuacacuccagccugggcaacaagagugaaacucugucucaaaaaaaaagaagagaacuuaggagagggccugguuggauaacagagcacccagguacagcaguuaaaaccaaacagaacuccccgauauuguuucuagcccaacgccaucuggccccaggagcaacaaaaguggaggcugccuaagcaauuaccaaauuugaucagucccagcccagcuccaggcccuccgaaaaaccauugauaagucaaagccaagaauuuagcagcuucucaacuuuuccccacacaccuggagguagacccuuaccccaaggaacaaagucuucauccuguuagaaaucuaugaagggaacauguaaacaaauguugcagagauaaggaagccugccaugaaggagucaguuuggaaucuccagcccagaaauugggagaaauguacccauucacucuuuccugaccuaagaccauucugggagucccuaaacaaaggcuggccaacucuuuccccucuaucuuuggcaaaccuauuucagcgaucacugaggcacuuucagaccaacuuccucccaucccgagagagcccagaccauccuggggaggaagacacccagagggaaggcuucaaggggcccaaugccucagcaguccccaccccagucaccaccaccagacugguggcuugaugaagaugaggaugaggcugucuuauuuaucaccuuuaccaagacagguaccuggggcaaaguaagcauucaauaaauuuuuguuaaacccuggaaugugcagcauccuucccccaaaaagaacugcauggagucaccucuacucaauaaaaugcccaaccaacuacugaaguuucuuugccccuuugaaaacaugaaaggcccuuuuucaaucaccuuagccgauggcccauacuagggaaaaggagacccaucaaaggauagugaaaagggcucaguguuguauccuauagcugaguugauggcuccagcaacuacaauguugacuuaugagcaaccuacagcucuguaaccaucacagcuaguugagaguuagcugugaggcuggaacccugcugaaggcuucaaaugcccaucucauuugacugucucacuuuagaggcucaaacaauaauucccauuucauggaugaagaacccaggauguagagaaacuguucaaacuuuccuaagguugcucaucuagaaagcuauggaggcaacauccccacacaguucugccuggcuccuaugcccaggcucuuacacugccuuggaagaaauggccacucccagagaaagcagcaagcaaguagaaacagcacauccuuggccucugggugaccacacacuaggcagaugucuccaaggucccaccaaacccagagaggcuucaucuugccccuuccagcauaagggcaucauccccucaccagucucucuccugcccacccuguacacagcacacaucucacgcacagggucuccacuuuacgauggugugcacauuaagaaacuauacccaccuauacccgcagguuugugccucucuccaugggaaagcagagaauaggaaugaguucuauuucuaaaugcaggacauaguagugcccaacacacaacaagcacuuuaaaaauauccaugauacuggccaggcacaauggcucgcgccuguaaccccagcacuuugggaggccaaggcagguggaucaccugagguugggaguucgagaccagccugaccaacauggagaaaccccaucucuacuaaacauauaaaauuagccagauaugguggcgcaugccuguaaucccagcuacuccaguggcugaggcaggagaaucgcuugaacccgggaggcagagguugcagugagccgagaucgugccauugcacuccagcuugggcaacaagagcgaaacuccaucucaaaagaaaaaaaaaaucaugaaacugaguuugcuaauaaauuaauucccaucuauaaaagggcaauaauaugcccuuuuauagccuccaagguuguuggaaggaaaaaauaagauaacccaugaaaagaacugcuaagauccaaauugcuauagauaaaucccuaaugccugacaauccuuaagaaugauaaauagaacagaaaaauuaaaugugaggaugaccuggcacaacacuccacaugcauuggagauagauacgcauauacaugcauguacguguguguguguuuguguauguauguacagucagagauguguauaucuacuauauaucagcuuauugagauaaaaauaagaaauguguauuauaagauagaaauauaacguguauuauguuuuuauuuuuuauuuuuuauuagcaaagaaagaaggggccuugaagcuguacguagcuugguguccaucagguaccaugucuacgaacagcgaaucugcacagaguucaaugggaguccagugaugcuuccauagcaggcugggacucagccacagcguggggaguuggauaaggcaggugcugggaggaauaaacggggcugauuuccguuacugcucaccugcgaaguccugcagacaggauagaaagaaaacucaugugacaauaguucucgcauguccucccauguucgagccuccuugggguaauccaucucagacuucccaaggaaggccuucauuauucaucccuuuaccaggagaggggcagaagggagggagaucaaaccuaaagcagacacccguuaguaaugggagaggagcagaaacauggacccccugccuccuugaggcuaaucccgcccugggagcaccuuauacccauggcugggccucaccugccucgagugcuggcauggggcaagugggcugggagugcacggcauucccagcaaagaggcaggccccacuccugacguucccacccagccacagacuguccaccgccaaaggccaggcccuccauggugguguucccaggaaucuggagaaaauucaacagaggaagccugaggauggggugggaggaggaaauggggcaaagaggcccugugaaguuuuccagaggaaaugaguaacccguuguuaugcagucacacagcgccaagcgaggaaguggcauugucuggggaccagccgcagggccuuacauaauaggcaccccucucacuuucuggcccuggccguauuuggggauuggcaaaaacaucugaugagcaccuccagccuguguaaacacuggcuuuauuagggugguggacagaggucuggacgggaguucugcuuggcucgcgcugagugaaaucaauucccauggccucauccugcaggcucccauccguuggguggcagugccgcucagugguuagcaccgacucugaggccaggcugccagcacccauccagauuccagcucuaccacuuuccagcugugugaucugggcaagcugcugagcugcucugugccucaguugccuugucuauaaaaugauacuauuugaccggacugcuaggguuacagaggaugaaguagaaucauacacacacagugcucagaacaaugcuuugcacaaaauaagcuuucaaugaugagccagucaggguccuagagauaaacauagugcccccaccuucaagacaggaaauggaauaaguaaaauacagagauggggccugcauucagcagagucugcacuggguuugguggcugggcaaaagagaugagggcaaucacuuccccccagcacccuggaaacauaaauggaaaaggggucucccugggagcaaauaacagaggagauaagcuuggaaauaagaaacaccaaguucuuggccaggugcaguggcucacaccugcaauuccagcacuuuaugaggcuaagguaggcagauggcuugagcccaggaguuugagaccagcgugggcaacauagugaaaccccaucacuacaaaaaaauucaaaaacuagcugggugugguggagcgcaccuguagucccagcuacuagggacgcugaaggggaggaucccuugagccugggagguugaggcugcagugacggcaccacugaacuccagccugggugacagagcaagacccugucucaaaaacaacagcaacaacaaaaaccccaucaauaucuugcuggagauauaggaagauucuagccaaguuuaacaaaaccuugaaauucauuccaauuaaacucccagggucacagcccaugauaucaucacgaaccugaaaauaugcuauaaggggguucucagcggagucuguaaauccacccacugcucuacacagacagaccugggcaugucagugaggggguacgaagggaaagaaaaaccuuugacgccccaggaacugguaccuuuacacacccugcuggggccccuacauuccuauucacaacaacucauagauggagaugcacacacacaccaucuuuguuuugaaaaaugaggaaacugaggcacagaaagguuauguucccuggcugaagucaaacccugaguaaauuuaaagggucagaauucaaacccggguuuauuuuauucuccacugaaaagauuacugccaggcaugaugacucacgccucuaaucucagcacuuugggaggccgaggugguuggaucaccugaggucaggaguuugagaccagccuggccaacauggcaaaacuucgucucuacuaaaaaugcaaaaaaauuagccagaccugguggcgcaugccuguaaucccagcuaauugggaggcugaggcacaagaaucgcuugaacucaggaguugaggguuguagugagcuaagaucaugccacugcccuccaaccugagcaacagagugagacucugucccaaaaaaaaauaauaauaauuccgcaccgccccaccagagguugguuuuuuuuaauuauuguuauuugugaaauaaucacaaacgugcugggaacacacagcaaauccuuuuccccuacagcaugugagagggaguaguggaccugaagcccuaucacuacagaguacuuccauguguauuuuucuaaagcaaagacauucucccuuaggaccauguucuauaggaagaucaggaagcugacacagauacguaacuaacaucuaacgcucccagccauccaagguuugacaauuguccagaaucaagcuuugcauuuaauucucacaucucuuuagucucuuucagucuggaaccauuucucagucuuucccugacacucaugaccuugacacuucuuuuuuuuuuuugagacggagucucgcucugucacccaggcuggaguccaguggugcgaucucggcucacugcaagcuccgccucccggguucacgccauucuccugccucagccucccgaguagcugggacuacaggcgcccgccaccaugcccggcuaauuuuuuuuguauuuuuaguagagacgggguuucaccguguuagccaggauggucucgaucuccugaccucgugauccgccugccucggccucccaaaguguuuuauuuucuuuuuaaaaaaauuuucccugggagcacagaacauauuaacauuuauuuuucuuuugccuaauugcaaagcaagaguugggaggaagauuuccuggaagaaaguaaaucaucuaagucaacugugaugacaacccacacccaaucauuuuuaauugggcgaggcaaaacgguguacuaguuuauggcuuagggaggguucuagcagucugccugucugaggagggacuacagcuuuuacacagccaaguagauccuggcaucauuugcucaugccagcuuugcuuacaaauaaaaaaaaaaaaaaaaaacagaaaaaugaaaaacugaaaacccucagaguucagcuuaaaaagaccuuucaugcaaugccaggacucucccuuucccacccgcuaaaccccccuugcuucugucccaaaguacaauacauauguuuaucuugcuucuaaguagggguauauuaaaauacuugaggauuuuccccuccuaauucuggcaugcuggcucccacuggcugugcagccgcauaucaugaagugcaaaagcaacaguaaauuauacccuuuacaaacacagcgaucuuuccugagguuggaagucgcaucacuugaaaggcugacuuucuucaaacuuccaggaacugaguggcccagagcccaucuauuuaaaggucaacccagcccugcuguauuuggagggcugccucggacacaggcuuauucucagccccucucugcagccaccgcagcaggacaggcugugagcagcacugugucccuuucaaagggagaagggaggccagagacagaggagggccagagagagaugggagauuggaaacaaccaguugccacccccuuacucaccgcaccccucugggggauaggguggggugauggugguuagcagaguaaacuccucugccaugauuaaaucucggaaucgagcuuaggucccaauuuucagggacaagaugguccauuuggucacacuuuuaacucagcugccugggcuuaagcucuggcagagcagagcagaugauaaagaagacaauucaggaccauccugauagguauagggaccacggcaaugggaauuugcaguguaggagaaagauagggcucaacucaauacagccugagcaaguggaaauucacagccaagaagcagggugggggucagaggauagaaaauuacuaacaggcaacaucaggaguaagggggauucugguuaaaucaaccuaucaagauucuugcuaaaggcaggccagggugaccagacaucaucuggagggugguagaagaugaggaacccuaucuaucagauauggaagauauugacggccggugguccuuaccaaacugacucagcagaguuuuuugcuaaaacuagauuuuacaggaaguacacagaugggccuaggaaaagacuuaagugucugauuaaauuggguaauugggucaagcaaagaaucuuugucaguagguagugggagauggccccucuaccagcuuggcaaggcagccagaggggacgacagcccuucucacccaccaaccgcacugagaauuuuuguaaaguauuuaacccuuagcuugguguuaacuuacacaggucuguguguauuuaauccuaugagcuuugcucaguauuugcucauucuucaaacugcucgugaauucagaggaugccagguagugagaagucacugcugacagagcaccugcagcgggcacaaguguccugugguuggggggucagcacggcuuacagaugacuuucaggaugguacagucaguugccuaaagucacccagcuaaggaggggguauggccagaaucccaguacugaucagucugacuccagaacauagccucuaauuucaucauacucuucauacacccccacauucaugaagugagcaaagugguaaagaagacaggccccacagauccuggaccaugcagcaagcagugcuaggauggaaagaacucaucccccuaagaggcauccaaaagggcuucauggaagagguagcauuuaaauguugcuuacaauggggcuuuuugacaggucagagagaaaaggaagagcaacccaggaggaaaguacaugaacaaaagcaaugagaccagaaacgggccuggaugggugaugacaacuaucuggcgaggcugagccccugcguggugagggagcccaggacuccuucuggaugucuuuccagccuguguggagaggguguccccucgaugcuagucacugcaccacaucauugacccagauuauuuccgauccccacaauaaugcaaggaguagagacgaauagucccauuuucauagaagaaguucccgguuagagaagccaccacaacugagugccuggcuccugagcaacagggcccggacuugaacccagagcuguuugcuaccaaguuccaugaguuucccaugcagccuucccacguccuuuuccccuuucugcugaggucauugucggcacagaaaaggauguucgggggaaugaacggaggagggaaggaaggggggaacagugccaaggcugugauucaaugcagaccuuuccucguguccgauuagccugaaaagacuuggaaaucaaaaccaaccaaacaaaacacucaacaggccagcccaggaagcuucuauucuccagaacagaacugaaaagagagccagcaggccaaggaucuccaagucagauacaucaucagaggggacucaggaaagggaacguguugccggauagugucugagggugggcacccggggacagauccugaggagggaaugucugucugugugauuuaacagggagcaaccucaggagaaaggaagggaagguggcagagccaggcaagggaaggagguggucucggcuggggaccaacucaggccauccacaggaugcccuggaacaugaaccgcaccauggaguuuaccccacauggaaacaaggaggagcagcccuuugcaccccugagucagccagggcuggugcagggugagcaacuucccggaugaagcagcuccaguuggaggaaggcuaaucuccagagaaguggugcuguggacauuagcagcaguggacauuagcagccgccgucucggcagcuggggugaguguaccgguccagggagggggaccuggggcagcccuucaacaacaaccacuacaauuagucacaacggagggacugugcgaugcucaggcaugauaacagcccccauuuuuuaacauuuccugcagucaccuucccuaggccagacacugccugggcugaaucagccucucaaaugggugcuggaaacaucugggucuuagagggacaccaggggcaggaaaagaaccacucuggggagaagagagccggccagagaccaugacuggagggaagugggcagaacaagaacaggacugcagagagucccaccuuuucuccacgccucucuccuaaagagagcugacaucugaaaucaaaugaaacgagcugagaacacaaacucaugcucccauucuuacaccccaaaaaagucuaaaacucaccugggcacgguggcucaugccuguaaucccagcacuuugggagcccgagguggguggcucaccugaggucaggaguucgagagcagcccggccaacauggugaaaccccaucucuacuaaaaauacaaaauuagccaggcauggugguguaugccuauagucccagcuacuugggaggcugaggcaggagaaucgcuugaacccaggaggcagagguugcggugagccgagauggcaccacugcacuccagccugggcaacaaaaguaaaacuccauuucaaaaaaaaaacaaaaacaaaaaaccucuaaaauucacagaacagccucugauaaaucuuuucacaagacuauauaaucucaauaauuauuuucaauaaauuaauuaaugaauccuaccauagugcccaccauaugguaagugcugaauaaaagcugaauggcguguccacugaacacauuguaacauccaccauaugcuuacagauaaccuucuagaucuuucccaaaauaguagaggcucucuuuugugaaguugaguuuggccuuaaucacaugaugcuggauuuuucaacuagauuuuuuugauuuuuucaacuauauuuuuuugauuuuucaucuugauuuuucaacuagagcuuugcuguccccaaauguucaucaacagaugaguagauuuuuaaaaaugcaauauacuugugcuagggaacaguauucagcccuaaggagaaaugacaugcugaucuaugcuacaacacagauaaaccuugaaaacauuacaccaagugaaagaagccaggcacaaaagaccauuccaggauagguauauuuguaguacaaguagcucaacaauuucuuagcacgcagagaauugugggaauaaagaggugacugcuaauaaaaacgauuucuuuuuggggugaucaaaaugcucucaaauugauuguggugaugguugcacaacuccaugaauauauuaagaacaauuguguuggccgagcaccguggcuccugccuauaaucccagcacuaagggaggccgagguggguggaucgcuuaaggccaggaguucaagaccagucugggcaacguggcaaaaccccaucucuacuaaaaauacaaaaguuggggucuggugcggugguucacaccuguaaucccagcacuuugggaggccgaggugggcggaucacgaggucaggagaucaagaccauccuggcuaacacggcgaaaccccaucuccacuaaaaauacaaaaaauuagucgggcgugguggugggcgccuguagucccagcuacucaggaggcugaggcaggagaauggcaugaacacgggaggcggagcuuacagugagccgacaucgagccacugcacuccagccugggcaacagagugagacucugucucaaaaaaaaaaaaaaaaaaaaauacaaaaguuagccagacaugguggugugugccuguagucucagcuacucgggaggcugaagcagaauagccugaacccgggaggcggagguugcagugagccaagauggcaccacugcacuccagccugggucacagagcaagacucugucucaaagaaacaaacaaacaaaaaaaauuguguuguauaccuuaaaugggugaguuucaggugaauuauaugugaauuauaucucaauaaagcugcuauauauaaaaaagaaaggaagaaguuugcucugaugugaaggaauaacaccagcaaugauggaucccagccacuguaugaaaacgcaaacugguggcuucuagaagaggcccuaacagcuccaugaacacacagacauguguccccaaacacaucccccuggaaaggaagaagagaauagcugcugcccaccacuccccaaaucucugacccccggccuccaacaccaugccagagggggcauggagcagacagccaggaacucuuauuuugucuccugccccgagcaauuccuaaacagugggaguuaaauauuuauaaagccgucacuguuuguuuaauguucaaucuguacuugggaaggcugaugcagggaaaugcugaagugacagcugauuauacaaccugggagaagcgcggcacaccaggaucugacacuucccagggcucuggcccucgccuucucucccuuuugcuccccagcaugggcugccuuccuccuucuccaugugccccuggguuagggggaggcuccuguguuuagucuccucuucccagcucccguggaacaagacaaaauagccguuuucaccaaaagccagagucucagcgcuuuuaaugugaugugaacagucccugagacugugaugcuguuggggagacaucuuccuucauggcacccacugcauugaacccucugccaauagaagauccugcucagaagcggggacccaaaccaaggcagugacagcagcacacucagaccaggaacgccuucugaggccucccccaaaucauccuccucguccuccucugagcaugucccacaccaggccccaaccugaacgcuucaucaaagaugaauguuggaauccaacucacaggcuucacaucuggcuuugucauuuaucagcugugugacaugaaccugcucugacucaguuucccacacugugaagcacaaaugaauggcccgucugcuucgcagaguugcuugugagcauuaacuaaaacaguacuuugaggcagccagcaucgcuaugaugaacucaacggugacuccgccaccugcuucggaguccuaacucuaaaccucacuugucugugaccuugggcaauuccagucacuugucccagcccuccucacuggucuacccagcaaaugagauuaccauauaaugagauaaaauaagauaccuaauaaaaugauacaaacgagauauacaguaagauaaaaugagauagggugagcacugcccaaaauaugggucagggcuuagcaguuuugcugauacagcaagguggggagauggccacuaaugcuccuucaugucugggacucccgugacucuuuugggggcccagauaccucugaaaguggcuaaugcacagggauuauccugccagcugcauccgguaagagguugccagaaucuucaaauugccagaaggcauuauggugacaccaguuggucuggaaguaaagagaugggccugggcuaaguaauggugacagauccuguccagccugcaggaccucgccuaagccugccgccuucccuuccuaccacuguguuggcaguagagugggggacacagauggaugagcaagaucucccucuucaaggaguccugggucccacagugagcuggacacauaaagaaaccccuaaugaaugcaaggauggagguaggaagguagcucagagaggugcagucaaggcaaagaagagugaacuaggcagaaggaacagcaggagcucugcagccauggaaaacugaggcagaagagaaccucauuaccccagaaaagaacccacuuaaaauagguccagauauuuaauguagcauaugggggagagggguugcagcaucuugaaaaaucaagcuucaucaccuacuucggauuccuagcucuacccauuuggcugugaucuggggugacuuuugucacuuguccuagcccuccuugguggggggggggguggguaucuuggaaaaagaaauaaagaauuauaaaaaugacuuuauuaguauacaauuuauaauuacacauaaacuauacauaaaauaagauugaucuuauacuuugaaaccugaacuggccaggugcaguggcucacaccuguaaucccugcauuuugggaggccaaggcgggcagaucacgaggucaagaguucaagaccagucugaccaauauggugaaacaccgucucuacuaaaaauacaaaaauuaaccgggcgugguggcacaugcuuguaguccuagcuacucgggaggcagaggcagguaaauugcuugaacccaggaggcagagguugcagugagcuaagaucacgccacugcacuccagccuagaugauagagcaagacucugccucaaaaaaaaaaaaaaaaaaaaaaaacaugaaccaaaaauuauaauuuuuuuaaauuuauuuauuuuccagacagagucucgcagucucacccaggcuggagugcagugacgugauguuggcucacugcaaccucugccuccugaguucaagugauucucaugcacagccucccaaguagacaggaagauaggcaugcaccacaaagcccagcuaauuuucuguauuuuuuaauagagaugggguuucgauauguuggccagacuggucucaaacuccuggccucaaaugauccucccuccucggccucccaaaguguugggauuacaggcaggagccacugugcccggccccugaaauuaucauuuuaaacuaugaucuaauuugcugaguuguguacagaaugaaucuaaugucgaggccuuccuuagcacacguuuucucacaaaauauaaacuuccuucacuccacuccuucaucauuaauccaaggaaucauuuugcaaaacaccuuucgaagaccucucuuaacuuuuuuuuuuuaacauuuuuaaaucacuuucccuugauuugcauagagagacaucaucuuuccuuucucuucuccacgguuaacaacccugauucugcuagugcuccccaauugcuauauccucagcacuacucagcgcucggcacacaggaggugucaguaagcgugugugguucaugcagccucucacaggccuuugcugauuccaggaaacccugcagcugguacaaaacgugcaauuucuggcagcugaucugccuuggagagaaaaaccccuguuccucaguucugccacugucauuucauugaaaauguaggcaaucauuaaggaccaacacuuaaauauuuuauuauaguugcauauuuauuaaccaaucaaaggguaggaucuuuuuuuggcacgcugacuagagaugcaaaucaucuuccaugcaaaauacacacucacaagucaacaucuacaauuccugguuucaguuucuuuaaagcagugccaaaguuaaucaccuguaaagcauauggaauacaaacuaugguuuuacaauuuuuuacagcuguuuugccuuuaaguuauuuggugacaauuuuuuuuuagcaaaucaauauuauccauucuauccaaaguacuaaacuuuucauaaaacaacucuuuauaaacucaauuuucauuaguuuaugucguacuuaauuaccaacacaacaacuuuuggcaagcacauaaaucaacuaguaguaacaagccuucugggcacaccaauaucaauagcuaacauuuauugaguguuuaucguaucauaaaacacuguucuaagccuuuaaacguacuaauucauuuaaugcucauaaucacuuuagaagguggguacuaguauuagucucauuuacagaugcaacaugcaggcacagagagguuaauuaacuugcccaagguaacacagcuaagaaauagaaaaaauauugaaucuggaaaguugggcuucuggguaacccacagagucuucaaugagccuggggccucacucaguuugcuuuuacaaagcgaaugaguaacaucacuuaauucagugaguaggccaaauggaggucagcuacgaguuucugcuguucuugcaguggacugacagauguuuacaacgucuggccaucaguaaaugacugauuaucauuggaugugggugggcugaauguuggcagugaguuuauucaugcauauuuuuauguuaggaugacuuuugcuguccuaggcaagcucugucugcaggaacacagauaacacaggacccccucaauuucuguguggcuagaacaugaaccacuguuggggacaagaggagaggcugggggagacuucaaggccaggugugucaggccaaguguuuuggauuuaacuccgccuauagaugcuucuucauguucagugacuggccagaaauugcaccugccuaccgcugcgaagggauaagauucaggagacccccaaacugcuggcacaaaauguagagcagaaggaaagggaagaaaaccugacaguggaauggugggccugcaugcgagggcuuggaggcuuuccuuccacuucugaccuuccccgaguccccaggacaccugcacugcuggauggugggccacagugagugaggccagaaaacgaagguagggacccugaucagaggccaggcagcucuuccaggcagagggaaggucagacaucugaucucugggcucucaguccagcguccuuuccaccacccuaugccacagucgccaauagagccggaguggguagcaggauggugacugcucaggggagggggcagaccccacucagacuggaugaagagugagaaaaaauauauaacauugcacaaaaguggggagaagccuucagucuccaaagcccugcuccugaagcccagauaaacagacugugucgcuaagucaauaacuuuccacaguagaggguuaagaagaggaaauggcuuuguuaccugaauccuuuccacuuguuaaaagaagucaccuuccugcuccuugaaguaauugacaucaaggaggaaugccgagaauuuucagcuucucagccagcugacaaggugcuguguuagaaugugcacacuccauaacagcccaaauacuacuuaaagugcagaggcaggugacauuagaaaauaaacaagccaacaaaaguaaaccgggcuucacugcucccugguuagcagaagcugagggcuggccaggcuccugguacccgacgugcaaucacaucucuagggagggaaggcccaacgcgcacugccuucaccaaccugacagcggucaucugaagaagggugucaggacagccccaacgaucagaacccagagaacuggaagaaagcccccacgaccccgcgagaggaagaacauuagaauucugcacaccaucuuucagugguagugagugccccgucaguggagguauuccagggcugacuaaacagacaaguggccagguugcuacgaguggggguucaacuuaucucuugggugguuagaaaagaaugcagcgacucaaggcuugugcauuugcucacugcauuacaaaugcauaucagaaagguugcacaaccuaaccugacccuuuguuccuucacauucuuucucucuagggcuuucucugcaaagcuagaggagcuguauggaugucaggagcaaagugucccuucuuacuuuauggagggccuacuaugugccagcauugucuggggaacucagaugaaucaugcaagccccuagugccaguucucuagagcuauggcacaauggcuucaguuuaucaaugagacuagaagccaguaaacauuccugagggccuagugguuccaguugugaaagccaucgucguugguaguaauguuauucuauuauucccacugacaaaugaggacacagaucagggaagagaaaggaugcccuccauucaccgagcaaguccguggaggagcugccuuuccaaucuagccagccauaccaagcuccaagauccacacucuuucccuggcugugcugcaugggccgauacacaguuccacacccccaggaacauccccuccaccaggaaagucaggacuugucuccacucccccauccacugccuucaggggucauuccaccauuuccucuauauuucaccacuggcccaacugaauuccgguggcgcaggccgcccccgagucauggcagagaugagcagggcuuugagagcagagaugaaaggcagcgcugcagagcgcaugaggucucagcacaaaugucaacuacuuucaucaggaaaacccaaaauuacccacucuuacacgcagucuuucaucugcuacggggcaagcagaggcugcuuauuagaaaugcugccuuguccguaaucuccuugugggggacaggguugaggggcgaacgccagcaucacccucagaaucacggcgcugccucacucugaggggcagcuggccugucggaaacacaggcuccacucugcccuuggccaccagacgcugacuaaccggacagagaggaggucugccugggccagcugccaccacugcagaggcagacucugccaaaagacggcuguccccagagcgggcuguaggcgcguuggggcggccaagccacugcugugcaccucccacacauacagccugcagcuccaggaaacagagguuugagaccgcaaacuaaauguacaggagggcugaccggccccucuauuucuuccuucucucuuucuccagcaaagccagcaauugagaacuccacaucauagauuacuguggcuaaaaggggccucuugaggucacugauaugguuccccuggaucaagaccagucuguccugggucaucacaggauccaggcuauaacccucaugaaagggaucucaagggagagcugguuuccuuuauugcuaccagagcagccugcaccuuucugaaucccagcacucaugacauuugacuuuugccuucuauuccaguaucuaucgccuccucaugaucugugaguccuuaagaccaggggcuguuuuagccuuuucugugucuucaggacuuaacacaaggccugguccagagagcuggcuaggaaauguggguggguggaugggugguugcguggauggauuagaugguagcgcaggcagaaaggggaagagacagaagagaguuguaacuaggggcuaucaaacacauuuacucuagacugccacagucauggaacuuuugggccaaagugggcuugagagaugcucuaagucucacugccacuccuuauuuugcagaggagaaaacuuaaacucuagcacucacugucuugugcaaggugagauaauccauccuaacaucuaaagcuuuugguagccuccaucagaaaggauacauaacaauccauccugcuaucagaaccgaaacgauacucacgcuccccuagcuugugcaagaagugcugccucuaacaugcaacccagaaagcuucagcucagugcugcuaaaaauacaauaaaaucaagaggaaguggggcucaggaaggaaggaacacaggucucccaccacuacaagccaagcuuaaggugauggcccacaacuucccaccaggaaggccaguucucccugcuucucaccuggaucacacgccucaccaggaugagaggaggacaaagcugagcauuuggaucuuccgggaauaauuccuacuaugagagaaaaugcagccaaaauccagagaccagaacgaaaucaucuaucuccugcuugguuauggcgaauacggacacaucaauccaugacuacuuccugacagccugcugugcauucaguccugggcugagcacacacaaagacaagaaaucuaaauccugaccaggcccacauugaggucauugaccuacuacucauucaugcacuuguucacacaacaaaucauuauugagcaccaaccacaugccacagcacuagauucgggaguuugggucuguucucugcugaguaugcaagaagcuugaacuugauuccaggagagaacaucuaacaauaaccaucaugcacaucacucaugucugcacagugcuuuuccauucucaaagcacuugccccuacaugguguguuuaauccucacaaaaccccagggaagacaucagauaaguguucucaugcucucccacugcacauuuagggaaacugagguacugaggguugaaggcacucauccaugaccacauaguggaacugugacucaaacccacaucuucuguuuucuuuuggcuauaaauauuugccccccuguaagugggauguggggagucccuauuggccuaguggccagggugggauugacugugaaggaugugaauauguggaaagcacagggcaagguugcaugaaaagacauagaucugggcucuucagggucaggugauguacccauggcacacagcacuuggcaugagccaagaaucugaagcaaagcgaaacaaaacaaaaccuguccacuguagaggaagaggaacauagaaaagugaucaaaagcagcauucuagagucagaccaauccugguuccacuucuacacugugugcucuaauggagccucuacuuucucaucuguagaauggggcuaaugaacccaucccaucucuauagaauccaccaguuuaagugccagacauaguguccacauauccucuuuuuuuuuuuuuuuuuuuuuuugagauggaguuucgcucuuguugcccaggcugaaaugcaaugaugcaaucucggcucaccacaaccucugccucccagauucaagcaauucuccugccucagccucccaaguagcugggauuacaggcacgugccaccacgccuggcuaauuucguauuuuuaguagggaaaggauuucuccauguuggucaggcuggucucaaacucccgacuucaggugaucugccgcccgccucggccucccaaagugcugggauuacaggugugagccacugagccuggcccacauguccucuuuuaaccugaugggaucugugaugucauaacuguuuuaauggagguaaaaucugcauaaaguaauauuaaccauuuuaaaguguacaaaaucagugacguuugucuaguacauucacaaugugguauaaucaccaugucuaucugguuccaaaacauuuucaucacccucaaauaaaacuuuguacucauuggccaggugugguggcucacaccuguaaucccaacacuuugggaggccgagguggguggaucaccugaagucaggaguuugagaccagccuggccaacauggugaaaccccaucucuaccaaaaauacaaaauuagccgggugugauggcacaugacuguaacccuaaccgcucaggaggcugaggcaggagaaucacuugaacacaggagguggagguugcagugagcugagauugcaccacugcacuccagcacuccagccugggaaacaagagggaaacucggucucaaaaaaaaaaaaaaaaaaaccaacaacaacuuuguacccauuaagcagcuacuccccauggcccccagcaaccauuaaucugcuuucugucuauauaauuuugcuuauucuugaaaauucauaaaaauggaaucagacaauaugugacuuuuugugccuagcuucugucaccuagaacagcauuuuugagguucauccauguuguaacauguaucaaugucucauuccauuuuacaguugaauacuguuugcuauucuuccgcggacagacauuggacaucuggguuguucccaccuucuggcuguugugaguagugcacaugccuguaaaagcuuuuuguggacauacgccuucaacucucuuggauauacaccuaggaguggaauugcugggucauauguaauucuauacuugacuuuuugaggaaccaccaaacugucuuccacagagacuguaucaucuuacauuccuaccagcaauguacaaggguuccaauuucucuacauccucaccaacacuugcuauuuucugccuuuuuuuuuuuuuuuuuuuuuuuuuuuuuuuuuuuuuuuugcuguuggugguggugguguuuaauuacagccauccuaguagguaugaagggguaucucaugguuuuaauuugcaucucccuaacaaccauggcuacugagcaucuuuucauguguuuauuggccauuuauauaacuucucuggagaaauguguguucaagucuucugcccauucugaaacuggguugucuuuuugguuuugaguccacuaauguuuugagcaaguguauagcaaacucguaugcugccucaagccuauucaucuggcagucccagccacuacugaaaagcaggugugaggccagggggcugcuggauucugcaugugggccuggagagaacagacagccauguguguggccccaaacccuucacuuagagaggcacuggagccccuggagauguccaggcgagagcaaagggcaugauuaaaauggggugggaaacggcacuuucgaggaagguuagaagagauuaagggagggaaagacugcggacgacuuaaucccacacagacccuggagugucugaguaggugauuucaaggaaucaguggucagcuguuuuccauuuccccagcagaagagaaggaaaugugcacagucggggagaggcugagcacagggaagugcuuccauacugaagagcucuaccuggcagaaccugccaacacuuggcauagaaugcagaccccacauggggcagacuggacccacccaagcagcagcgcccaacagaacccaggcuuaacugccccugucccccauggaaacacguucuucagcagagagaaagggacucaucacagucauguguggcccagcauuaaccuuaacaccccauggccucccaacaugggagggccuauacugggcccaggucaauggaucaggcuaggugcagugaauuccugguuugaaggccaagugccagggagcagauaugaagagcauguugcgccugacccugaggaaugcauggcugaugggaggaugcuguggaaaccgcucacuccaaaccagcagaaggcacaggcaccaugaaaacaccuggacagaaaggcucuuggacaaggagcugagcuucaaaguuagcaagaagggagggaagaggccaagcgugguggcucacaccaguaaucccagcacuuugggaggccgaggcaagcggaucacuugagaucaggaguucaagaccagccuggccaacacgguaaaaccccaucucuacuaaaaagaaaaaaacaagguggggugugaagggggugggugggcguggcucacgccuguaaucccaacacuuugggaggugaaggcagguggauuaccugaggucaggaguucaagaccagccuggccaacauggugaaaccccauuucuacuaaaaauccaaaaaauucgucuggccugguggcaggugucuguaaucccagcuacuuggaaggcugaggcagaagaauugcuugaacccgggagguggagguugcagugagccaagaucgugccauggcacuccagccugggugacagagugagacuagucuaaaaaaaaaaaaaagaagggagggaaagauauaaaaugacccaguauuuggggucaguggacauguguucaaugcgaaugucaccauuuauaauuucuggcaaauuccuucaccuuucuuccucuaucacaauagggauaauccaacuucuccacugggaugguguggaauaacucaagugagucagcucacaggaggcugcugcccuuccaucguggagggcuguaccuuggcagaaucuccuccuaggauuaugcucucucccuggguuccaauccccccuuagccacuuacuugccaagggaucuuuggcagauuacuuaauuccucugagccucaguuuccucaucuguagaguggguguguaaacauaguacuuauuauagggugguugccuguguuacaugagucaacacguagaaaucacuuggaagaugaauggcaagugcuccaaaauuuaaguagcuauuauucuauaacauucaacacaauaaacaaucccucuuccuaaacugucuacauguuuaguauagauuucugcacagugggcugagcugaaugccaggauguucaaacugcaggaucacagaacuuuaucacaugugggaucuggagaaacuaauguucugcuccaagaagugaagaaacagguacaaaggcucaccuaacucagggcacucaaauccaggucuccacuaaaagcugguuacucugcugcccucuccccauccaccaacuuccccacacugagccacacccauucuuuauccauuaugaaacgagcaccacccguaaaccuguggugagguucaguuaaaacaguuuacugaauguaaagcuguucuuuuggccaucgccuaagauaagggccugaggccaaagggagcagggaggucacccauagugcggaccccuagucacaacaaaagaaccaucaauuucucuaaacagcacuccaagaagcaaauaaaagcacagcagagggggcacgcaugcuauuagacacagcugguguaagcccuaguucuaugacugugccuuuggacaaguucccgaccuucccugggccacgguuuccucaacuguaaaacagggacuacgcaggggugguagcgaggaugagaaacagaggcuuauacaguuucugcgguuuggcagccuguuuuuauuagagcugccaucuccuccggagaccuccagucccguacuucacaguggccacggggaucaguuucagugauucaccggcuggggccuggcccugaagagccuuugcaaggccggccagguaaacagcuggcagccggggaccggcggccacuccgaccugcugugcaggucagagcaacugcacacaggagcacuccccuugcgguaucuucagggcuuugagucucaacccagcugcaucuggacgcacucaacugacacaggcccaggaaaacuauggccagaacaaaggaacacuacagcauaagcaaggggguggcucuauaagaggagcccgacauaggcugcaaguggcagaggaggucacuauucugggagucccaccugucugaccuccucugagucccuggacgguucagggcaggaggaagaggagguggaagucuauagguccagccugccucagguucugggagugacagauugucagaacugaguuaaagcccauagccccauccuucucacagcuucuauaaguaagccugacccaccaagacuguagcacaggaaugccuuauaaugauuucuauugcucuucaccguacaaugcacaaucucucucucucucucucucacacacacacacacacacaaacacacacacacacagcagacugauauaaugguuaauagcacaaacucuggagccagacuguuggggcuggaacaccagcaagccacuuucagcagugugacauuagacauuauacuuagccucucugauccuccaguuuucuuguuuguaaaauggggcuaauuauagcaccauccuccuaggauuauuacaggaauuaaauuauuuaacagaugagaccaaauucgcacugcccagaaguuaauaagcacuagauaaaugucagcuaugauuauuaguuacuaaucuaauuauuaucauuaggaagucauuuaauuuaacugauuugacugguagguucuucaugaguuaucaaucacacagagauuuaccaaggaaaggccauaaagaaaagaaggaagaaaauuagcauucuuugucagcuuccuacacaugugaucauuucaggucaggauuucacauucccugcaaaacugagauugugauccccaguuugcagaugaggacaccaaaguuuggagaagccaaggcaauagagucagauuccaaagcuaauaaauuuauuauggaacaaaaaccaccuucuaaaaugucacuuucuugugcauguuuccacgacccuguaccuuucgcacacaacugcccccgcuuccaucuccccaaucuucccaccagucccaucuuccccuugcguggccagcagagacccacguccaugauggacacugcuuaggcaccccgcuaauugcucuuccagcacauguacagagcugaccucauagcaggaugaggacggacguggugugcagaggcccuucccugcaccccacucccagcaccuugcaaccaauccccacacacccagccucugccccauguuggaaaaauugccucccacucuggugcuacagguaugaaucucagccacagugaugacuguggcagcuacaggccugaugaacaccccaccaagaaaaggagcaucaugugccugcuucucucugguuccuaaauccuuuggccaaacauuuuccccacaacccuccacuccaguuggcuggucacugccucucagaaagaagucccaggucccugucagccccagagcgccugcauggacucugcccacugucccuuuccaacacggaggcccccaauucuggggaccccuacacccuacccuguaccaccacauccccaugccugcuccagacagcacuaaccucccaugacagugggaccaaagcaguucuuaaagguccaauccacucaguucuuaaaugaaaaacaguugcccaugagucacccccaaagagcuccgcacauaugccaaacauucggugugcacuauuucaacugauccuugaaacaauccccugaagcaagcgcuauuaucacacucauuuugcagcugggaaaaacaaggcucagaagguaaagugacuagaaucacaggcugguaaggcacaaagccaugauucagacccaggcccucucucucucgagaugcaucacuuugaagacucuugccuacuguuuuccuguaguuucaccugauuuggggagagagagcucuguuuucccaguaaccacacugcgaacacagcagacagucacuuacauucacagaugaucugaauagcaaaaguagccaauaggcaaggacaaaaacgcggccugcgugacccauuucccuuuaauuuuuaaaagucucuuucaaccagaucuccucagaguucuucauccaucaguaaauacgaacuaacgccauauugagggccuucaaauauacagugggccaaaccuuguccuuccacuggaaauacacacaggaucacgagagacauggaccuaaauggcaggggccacguggggaaaaaacgggcagcgucuauaagcuaagaggacagagcaaccaacucugcuggguaagucagaacaggcuuugaagacccggcagcuggguucaaagcugaaauuggauggggacuggagagggagacagaggcggagggugaccguaccucuuaggacuggugaugauggcugccucaccucccuguggcagggacccuacugcuacgauaguucagacaccuuccgcagcccuuccucccgcacuccaaggaguuccuccauccgacucaaaguccaccaugaaaccagcagugcuacugcaucuaaucucaaggucccagacaauggggguguuuagccgggagucccaucaaggguuaagaaacugaacaggaggcuggaugugguggcucacgccuguaaucccaacacuuugggaggcugaggugggcggaucacaaggucaggaguuugagaccagccuggucaauauggugaaaccccgucuuuacuaaaaauacaaaaauuagccgggcgugguggcacaacccuguaaucccagcuacucaggaggcugaggcaggagaaucgcuugaacccaggaggcggagguugcagcgagucaauaucacgccacuguacuccagccugggugacagagcaagauuccaucucaaaaaaaaaaagaaagaaagaaaaaagaaaaaaaaagaaaagaaacugaagaggaagggaugaagggaugcacaugcaugcacagauaaugaagauccacccuccucacggccgaccaacgugaaaauacaaagccugggaugcccagaaaggacuguguacggaauacuaaaaugugguuguauuuuguggagcugugccauaugucuccuugacuuaucacccaacacacaaaaagaaggcgaauuccaaaaagaugaggcagccauaaaauuaagauagagaaugccaugggugaugcgcggccacagauuaacugaaauggaauuuccuccuuagucacuggaaggcauaggaacccaacuccaggcagggaggccacugagccacuugaaucagccucuuguucgcugcuuggagggaaacacaaucaggaagaagcuggguguggaaugugcuccuuucugcagcacuuucuuauuucuucagcuaccccccucccaucccaauccccaacccaaccauccccuccuuacaaccacuauaaaacgugccuuggaaauccaaaauccacaauuauuagggugauagcuuagaaaacagggucugaaacggugaggauuucguggaaaaauauaaagauuuaacacaaucuuucugccaucugggcuuccugacccaaaucugaucauuggcagcacugcauacuaauccaggaauucacugacaauacggucugaacuauuucagugguguuuuccucccuaccagcccuguccgcccgcucccuguccagcaugcaccccagccagcccacagagcugcagcagaauuuccugucauccuccggagugcuggccagcacggcugaugacuuccggagacccugcaggagaacaggcacuguaaacauagcaggcccgugucaguuccaucaggcauaaagauccagacuccugaaggccagagugucuucaaagggcccgggcuguccaucugggaccagagcccugucauuuacagcaccgcauuuugacaugucugggguaggaagcaggcggucuggaaacaugcucaagagugccagggaaggccgggcaugguggcucacaccuguaaucccagcacuuugggaggccgaggcuggcagauuaccugaggucaggaguucaagacuagccuggccaacauggugaaaccccgucucuaccaaaaaaaauuaaaaauaaaaauuagccgggugcgguggcacaugccugcaaauccagcuacucgggaggcugagacaggagaauugcuugagcccgggagagggagguugaagugagcugauauugugccacugcacuccagccuggcugacagagcaagacucugucucaaaacagaaaaaaaaaaaaaaaaaagagagagugccagggaaggcugggaaucccagcugaguccuuaauggcugggugucucagccucuccgagccuguuuucacaucuguaaaaugaaggugauaugacauuuacaucuuuggguugcugagagaaauauuuaaauccuggcacauaguaggcacucaauaaaggguaacaauuacauaagaauggugacauuaacgccugcacauugacaccucaaccauuaugcacaagaccuuaacaucugacagaacgcauggaaacaagacucaagcaugagaccccagaagcaucgggaaggcaauggauucuccggauggcaaaacagaguccaccccccaucccccucucaaccccuaggagcaggggacaucagauguguccuuuaagcaacuucucacccauucgucacaccaaagaguuacaaucugcucagccacagccugaacuacccccaguuucuccuuuuaccauuaucuucggugcuaucuaaacauuuaucauccucaggaagauguaaaaugcuggugcugucagaauucaaaaugcaaugucaacuggaaggcucaaagccauuuggaggauuuauuuuggugcuaacuagagagcaaaugaaaccccaggaaugguuuaauuaaccccgcaagcagcagccaggcauuuucuuccugucucguucuggcucucaagguucccuuagguuaucagcaaggacaaaggaauugacagggacaaaaacauaacccagguggucauuagggucuguccaugaaagcagaguggggaaaggagcucucauuaggaagaccaguccagcucugcccaagaucugccauacaccgauuaugugaccaucugcaaguuccuaacccucuccaaaccgcucugagguuauaaggauaaccaggcuucauggauacuuggugugugugggguuugugcaaaauguaucuuacugaaaccucagacccuuccuacacagagcaacuaguauagccccauuuuacagauggggaaaccgaggucaagagaaguuaaauaacuugccucagaccacagcugcaaauggcaaagccaggauucaauccaggccagccagcucaggccccgaaagccagugcacucuugcacaugccacaaaagacucagacugugaugucagguaaauccaagaugggagauugacucaaccucuauuuccucgccugagaaaugggggugacagcaacaaccucacaguguugcuacagcaaugaaaugaggugaaagucauguaaaaugacagaagaacacaauuauauauacucaaaaaaaaacccacagguccucaauuuuuuacuacacugcccugcacauaguaggugcucaacaaacauucauacaaacacauucaccugaguugaggugcucaacucagaaaugaccaauggaugugaaaaccuuacaaaguuguuguaaggauuaaaugaugccaaaaauaagaauugccagcaugcuaagaccacaagaaauacacaucccaaaggaaauucucuucuucaugugaggcuccccguggacauaacccccagggcaccacacagguggucuauaucccuguaaccaaucugugcccagaagagauagugaagcucagcacaaaagagcaggugagagcucccagcccauggcauuugcccauguuccugagugggagagagaaggcaugcuaaagcaucacccccaauguugcaucccccaaaaucacauuaagucaucaagucacagacagaagcugguccaguuggauucuuaaguauucaucugagcauuuguguauuuugaggcuggggaagggcaggggagagagaaacuuuucuccaaggaagccagguaccuuugagcaccacagggacuuaucagcagauagaccagagcucugcagacacacaaaacacagccuggacccaggaugcuuggucauggaagucaauacgaagccugaaccuuaguccugcccuaggaccagcuccuuggacauacagccugugcaggcacacagggcuccuggcucagaggggcccgagcuugguuuaaagcucugcugucagcaucuagaaauucuuccuaauuuuuacacaagagagcccauauuucauuuugcacugagccccacauauuauguagccagccuggccuaccacagacaagccaacaggcccaggugcuccccaucaccggccucagucugucagugguaaaauggaagcauaaugccugccucacaguugccaaagcuggccagggacccauacacucaacacuucaugagugugagaugccaucccccuaacggagggccacgguuugcugccuggcaagugggauuauuuucccagguauuggcuaccacaugaauguucugcagguauaacgaggccagagauagacacacaccucagaaugauggauguugacaucaucaucaucaucaucaacaucaucuucaucacuguaaaacacugagcuggccccagaaugggucacaucauuuaggggucugaaagugcugcacagcagggccaggggcagucaaauucagcauugguaccaaccugcaaaacuggauaacccaccagaacaaaaauauccuuaaauccuuaguacccaauaauaaaagaggguauugcccaggcuacaguaagacccccacucucacaagugaaaugccccuacugcauaccaaagacaaguuguaagcuccuuaaggauagaaaacagggcuucauacacacauaaauaaaauaucuaguaauacuuucuaaccaaggaggugaaagaucucuacaaggacuacaaaacauuguugaaagaaaucagacaugacacaaauaaauggaaaaacauuucaugcucauugauuggaagaaucaaaaucauuaaaauggccauacuguccaaagcaauuuauagauucaauguuauuucuuucaaacuaucaacaucauuuuucacagaaguagaaaaaacuauucuaaaauucacauggaaccaaaaaagagccugaaugaccaaagcaauucuaagaaauaagaacaaagcuagagaccucacauuaccugacuucaaauuauacuacaaggcuacaguaacccaaacagcaugguacuggugcaaaaacaaauacacagaccaacggaacagaauagagaauccagaaauaaagccacuuaucuacaaccaucugaucuucaacaaacuugacaaaaagaggcaauggggaaaagacuuccuauucaauaaauggugcugggauaaauggcuauccauaugcagaagaaaaugaaacagaaucccuauuuaucaccacacaaaaaauaacucaacauggauuaaagacuuaagacuucaaacuauaaaaauccuagaagaaaaccgaggaaauaccccucucaauauaggccuugacaggaauuuauggcuaaguccucaaaaacaacugcaacaaaaacaaaaauugacaauuggggccuaauuaaacuaaagaguuucugcagagcaaaagaaacuaucaagggaguacacagacaagcuacagaaugggagaaaauauucacaaaguaugcauuugacaaaguuccaauauccagaaucgauaaggaacuuaaaucaaaaagcaaagaagcaaauaaucccauuaaaaagugggcaaagcacaaggacggacacugcucaaaagaagacauucaugcagccaccaaacaugaaaaaaugcacaacaucacuagucauuggaaaaauucaaaucaaaaccacaaugagauacauuucaugccaaucagaaugguuuucauuaaaaagucaaaaaauaacagauguuggugggccuguguagaaaaggagacacugacacacuguuggugggaauguaaauuaguccagccacugugaggagcaguuuagagauuucucagaaaacuccaaguugaacuaccauuuaacccaccaaucucauaccuggguguauacucaaaggaaaauaaauuguucuaccaaaaguacacacgcacccauguguucauggcagcacuauucacaauagcaaagacauggaaucaacauaaaugcccgucagugguggacuggauaaagaaaauguggcacauauacaccaagaaauacuaugcaaccauauaaaagaauggaaucacgcucucugcagcaacauggaugcagcuggaggccauuaucauaagcaaacuaaugcugaaacagaaaacaaaauaccgcauguucucacuuauaagugggaacuaaacauuggguacacaugggcauaaagaugggaacaauagaugcugagggcuacuagaaaggggaggaaaagagggggacaaggauugaaaaacuacuggauacuaugcucaguaccugcgugaugaguucaaucauacuccaaacuucaaccgcaucccauauaccucuguaacaaaccugcauaugcaucucuugauucuaaaauaaaaagugaaaaaaaaaaaaaaagaaaauagaacuucagcucuggagcucugguguagcuccagaacaugcagccucgcacaaugccuugcacacagccggaaccaaguauacacaaugacagcacuagaaaugacuugugaacugucaaagugcuugaugcucagugguaucauucaauucacagguagggugaacgaccaucccaguuugcacaggacugaggagguucccagaguguuggacuuuccgugccaaaaccaggaaagucucuggcaaaccaggacaaguuggccauucuguucacagguauuauuucuaaggucaaacagagguuacuccucaguggaggguuauggggcucucuuucaaccaccaacacauuucuacgcauucuaaguuuucaccaaagaucuuguauuaguguuauuaucaugggaaguguugaagaaguaaaaagguuauuucauaguaugcacuauccauuaccaaauccaaauuuucuauuucuaacgauauuuuucuuaaaaaaaaaaaaaaguacccuuggccaggugcaguggcucaagccuguaaucccagcacuuugggagaacaaggcaggaggaucgcuugagcucaggacuuuaagacuagccugagcaacauagugagacuccaucucuauuaaauauaaaauuagaaauuuaaaaaaaaaaaaacucuucucaaacugucuauguuuaaucuucccuuguggcuguacaauggugguucaugccuauaauuccagcacuuugggaggccaaggugggaggaucacucaaguucaaaaguuugagaccagccuaggcaacauaucaagacugucucucuaaaaagaaaaauaaaaaaaagaaaagaaaaaaaucauuccuuguucauuuaugucagcuuuuucccacaacauucaacuuccuuccagaaguuucccccuccugaccuuuacagcccugcugcccugaaguguccuucugggccaccgagggcaucucaaucuugccuuuccuaaaaugugccugugcugugggcuuugcuagaagccccagauccuggcugagacagacucauaaagugguuacaguaacucugggucccccaccccucuuccugcaaugggucacuuggauaacccucagugagugagggccagagccagacuccagccagccccuccagcagcccucugcagcaagcccaacuuccuccucagcucuccacugugcauccaacuccccaaaagcccacagcaauggugccugggaccuccauguccagccucaugauauccagccaggcccagacaacgcuguuggcuucuucacaaguaucuucucaacagcaaugucuucauucacacccccacuccaggccccuauuucuuuguucuuucugcugcuucugcaaggggcccccauuauguugcuccuuccacacccagacucuggaccugcccuggcacuugccuuguccccuuccagaauucaccccauucaggcgugucaugagcugguacaugguguggggcaugcugacuggcagagguauauaguggugaacaccacccacuccugccuuccagaaguucccaggcucucagggaaggaaccuaggaaauagugccaacuggagagugauguggcaaccuccagucaggcugcaaaugugcaugcucugugcccuguacuccugggacacacccagacaugcaccugcagcccugugcuaggaugcucaugacagcauuguuuacaaaagcaaaauucuggaaacaacccaagacucuguggcccagggaaugaaugaacaagcauaguagcaucaucugcccagcauagcgccgggagaaaagaggaaagugcagacaucuuauacguuaugucaccuaccuaagaauuuaaaaacacacaaaauggugcuaccagugaucuucaaauagauuuguaaugaaauuguaagagcaugaccuguuauaccccaaguucaggagagguacuuguaugaagagaaggauggggaaugggagacaaggcucauagacuucccauuuaucuauuuuuuuuuuuaaauuucuuuaaagacaaugauccaggcugggugugguggcucaugccuguaaucccagcacuuugggaggccgagguggggggaucaugaggucagaagaucaagaccauccuggcuaacacagugaaaccccaucucuacuaaauauauaaaaaauuagccagguguggugguacgcgccugcagucccagcuacucaggaggcugaggcaggagaaucgcuugaaccugggaggcagaggcugcagugagcugagauugcaccacugcauuccagccugggcaacagagcgagacugcaucucaaaaaauaaauaauaaauaaauaaauaaacaaaauaaaauaaaauaaagacaaugauccaaagcaaagcaugccaccucaugagcaugugcuaauccuugggugggaauacggcuuuuguuacguugcccuuuguagcuuucucuuuuguguuucagagcuagauauucacacuauacagagaucccccugaaacuccauagcagauucuagaauacauggaggcuuugggaaagacaguggaaagccaaggaagccagagagcuccaggcacacacagcacaagagggaggcggaccaccagaucaugaggucuccaccggugccucagcagccaagcacugccuggccugaaaggaaugugcucuaugcccucacuuccaccagcuccaggcucccuccccaaauaaucaaaagucaggcucugcucugccuccuuuuccagaugucucuguggaugaaaugcaaucccacagaguggugucauccagcucucaggcaguuucccagaggugacucaucugucaucucaacaagcgcgugaggggcacaagacgaggacugucaccccauugagagacggggagccagagacucacagaagucccaagaacugccugagcugacucaacagccggaaacuaggacagucacaaagucagucugacuuccaaauuuaaaugagauucagggcuuacuaugcaucauguucagagaggggagauggacaacuggccaguuuuaccucccagaucaucucacuuucacaauaacaggcuucccaaaggagcaagcgaaagcccagagaggccaaguguccucccuuagcucacagagccagaaagccucagggauuuucuaacaugccucaacaaccuccccagagcauuucuccaucaggaaaacuauuuucauuauggguauccuuauuuucccugcagacgcaacaggaagcuucuggggccccccagugagcagaaagcugagagcugggggccagccaguguuuauuuguuuaugccaucaucucccacugaacccagucccaagcuacugagugacucagagaccugaccaccaacagcuguucuucgguuggagccagauaagucaacgggggguggggguguccauugcacuucccaguaaucaggugggacacacucuuucuguccaguacccccaccccuuguggagugauaaagggugacagacagaugagagggaaagacccccauccccagcaacugcacuggaaauccagcuaucagcguguggccacuauuuuaacaaggcuacaagacagagagagagggaagaagcccccacgccaccgccucacccccaccacagggaaauaaucugccuccugggaaggugagagggaagagagccaccagggccacuggaauacagguuccagccaaggccacccugaggcccagagucucagcaaugggccaugguuggcuccagucuaguguggcccaucaauuauggugacuucacugccucagucuggucuccagcaugauaagcaaaggcgcuucccugccuagcuuggucuccaaagccuuuucccugaagguucccugagccagaaacagaauguaucuugaggcuuuaccguccucaaaagccugaucucuggguucuacuccacucauuuuaacugaaaacaccacucagguccaaaggauaguaaugaaucuuucuuuccuuucuuuucuuucuuuacauuauuuucuuucuuuacauuauuuuauuucuuuacagccuuuuauuucuuuacacucuuucuuucuuccuuccuucguuucuuucuuucuuucuuucuuuucuuucuuuucucuucuuucuucacgcagguacaaaggacagaguauauuucuucacucagguucagaggacagaauaaugaaucuucuuucuuuccuucuuucuuccuuccuuccuucuuuccuuccuuccuucccuuuucuuucuuuucuuuucuuucuucacgcagguacaaaggacagaguauauuucuucacucagguucagaggacagaauaaugaaucuucuuucuuuccuucuuucuuccuuccuuccuucuuuccuuccuuccuucccuuuucuuucuuucuuuccuuucuuccuuccugucugucuuuuuuucuuucuuucuuucuuucuuucuuucuuuccuuucuuccuuccugucuuucuuuucuuucuuucuuucuuucuuuucuuuucuuuucuuuucucucuucacgcagguacaaaggacaggguauuuuucuucacucagguucagaggacagaauaaugaaucuuucuuuccuucuuucuuccuucuuccccuccuuccuucuuuccuuccuuccuuuuucuuucuuucuuuccuuucuuccuuccuuccugucuuucuuucuuugucugucuuucuuucuuucuuuccuuucuuccuuccuuccucucccucucuucuuucuuucuuuccuuccuucuuucuuuccuucuuucuuuccucuuucuuucuuuccucuuucuuuccuuccuuccuuccuuccuuccuuucuuucucucuuucucucuuucuuucuuacuuucuuucuucauuuuuggaacugggccaucuuccaaacuucucacauagccccuuacucugcucuuccuauggacagcugagaaucauuuucuaacuuuaucaaauaugcucccuccucuuaagauagccugcccuggcugcuuccuaugucucuugcagucugaccaggcgcuguagggaagaggcccaaaugcacccaccuggcccagauauccagaggccaaggccacgguccugcaccacagcgugagaguucuucuuugcagugccuacaaaccuaugcuugcccccaaacucgcucagggguaacgggguuggggaaagaguggaaggucaaacagagacccucuuggaaucuguucccuucauuaacuuuggaauuccacaggccaguguuuucucaaggcuuguuacacugaauacucccccaggaggagggggcugcaaucuucauacccacaggcucuagcugggaaagccaggagacagcuucauggggugaggucagccaccgcccgcccagcccccagguggaggaacuaacauuuagagagcaaacacuagauagcuagcauuagaguaacaaauagauucagagguguuaugguuugcagaugaagaaagugaggcucagagagauuaaaacacuugagcacauuggggccugugggucgggggcggggggggggaggaaaggcaucaggaaaaauagcuaaugcaugcugggcuuaauaucuaggugauggggugauagaugcagcaaaucacauggcacacgucuaccauguaacaaaccugcacauccugcacauguaccccagaacuuaaaauaaaauaaauacauacauaauaaaaauaaaauaaaaucccuuauacagaaaaaaauaaaaauaaaaacuugagcaagaucacacagcagguauaaaacagcagagcuucaaaacagauuuaguuuuguucuaaaaaccacacucuucaaauaauuguagcuaucagucaaagagggccaagauuucaugacacaaccacucuugaggcaggacgcugagugacugccccuggagcccaggccugcuggaccaaaagcccacucaaguuagcauugaggccuguguguaauucagggauggaacaguguguccaauacuguucuaaacugacuucccaaaacugucaccgagaccacuccuugucaaugcagcacccccugccaaaaugcacaugccuuuacguuuuaccauguauggauaucagagccuaggacauaguaagcccucaguaaaugucugcugaaugaacaguaaggaaacuagccaugugaaggccaucuucuaaguuuucuguaaaauccuaaugaaagcacugcgcauauacugcuuaacaagucucacagaaauauugcaucuuguaacaauuuuuuuuucaauguuuaugauccaggaggaguuucugccuuugaaagacaaacauguuuccuuuauuuaggccaaggacaaacuacagccuaaaggccuauugccaguucuuguaaauaaaguuuuauuggcacacagccacacccacucauuuacauauuaucuauggcuacuuuccagauacaaaggcagaacugacaagcaguacagagcuguguggccugcaaagcugaaaacauuugucaccuaacccuugauauaaaaaguuugccaaucuuuacuuuagauacaaauauaaccuacuuagcauguugugcuaauuaggaagcucagagcuaaacguaauguuaaauuuuaguaacucacucaucuucaauauuuuuuauaccuuuaugccuauaugcuuugaccuucuaaucccauuuuaaaauuuuauuuaaaaaaaacuaguauucccugaguacauauuauaugccuggcacugaaugaaaccuuuuaauauguucucuuauuuaauucucauaauaaacucaugggguagguaauauuaucuuuuauuuauuuauuuauuuauuugggagauggagucucaguuugucacgcaggcuggagugcaguggugcaaucucggcucacugcaaccuccgccucccagauucaaaugauucuccugccucagccuccugaguagcugggauuacaggcgcaugccaccacacccagcuaauuuuucuauuuuuaguagugaugggguuucgcuauguugguuaggcuggucuugaacuccugaccucaggugaucugcccaccucggccucccaaagugcugggauuacaugugugagccacugugcucagcccuuaucuucaauuuauugagacuaaaugaaugaaaugaauacaugaauaagucaccaauugauugcauaguggaaauauuuacuauuucauaauucaaucccagagaauaauuaacucaggaauugacugaaaaacuuugggugcucaaugaacauaacaggcagggcugagauaguaacugcaggcaauuugagccaaauuauaggauuguaaagugcuaucguucugggauccuuauuguuuucaaucuagcuucagaccaagccggccagucacuucaucaugaaucuucaggauuuggggagaaucagcagacaugacacagagcuacuacucaagucacaggcucagacacugccuccaguggcguggccagagccacacagccagaguaccgcaaauagaaacaauuaccggugccccaauguaguccucuucaggaggacuagguccacaugucacuaauaguauuuuugaaaaguugaccuuuucuuaaguaccaacauccuaagcaguaucaucugcaaaaccacaggucgcacauaccaauuguugccuuuuucuaauuugaguuaaacacaaaacaauuuuuuuauucuuaucuauaacaugaaaucaucuugcauugcucaucagcacgcuuuggaaaacacuggcuggacaggaguaggggugucaaggcugacagaugggacugcaaacaccagcuucucugcucucuccaucaguaaccguggcagcuuucuggaucucacugaaccucaguuuguucauaugcauaaggaggagacacauucuccuugccagauuagaaggugaacuggcacauuccagguauucauacacaccagcuguuaagcaaccuugggcuguucaccgaagaaccccuggagaugaucaagucacagccuuucccucauugccacccuggguagaccaucagaggcuccaggcaccccguggggaacagguccaagaugccaggccaucuccaggaaccuggccaggaugucaguguagguggcagggcagcccguacgacuagagagugugcugucaauaauuccaggagcccaucaagugaaaacaacacagguugggacugcuguagcggcagucagggauaacagggcucuucuaaguggcugaaagcaggcuugugacaugaaaucagaacagcaagcuccugcaccacgaguagaaaugcaaacuguucaggcaaaaguccagggaaaacugggagagccagccuuguaugcaugaugcaccagcagcaccagcacccaccaucuaacugaugagugugcgagccacuaggccuggcuugcccagcuacauccucguauacaccugucaucccagaguaagugauacagugccccuuucacucucaagucuccaggcugagaagagaaauuagccagcuucucuaugaaugaauguacuaaggcccaaaaagcagagguaguuugcccaaggucacagucaccaguggccaagaagggagaaugugcaucucucagcuccaggcaauguugugcaguggcuuuggagucagacagggcuguccaaaugcugcuuguauucucuagggacacuugauuucccucugggugcuccaguuacuucaacaguaaaacagaccgggcaaggugggucacgcuuguaaucgcagcucuuuaggaggccgaggcaggcagaucacuugaagucaggaguucaagaccagccuggccaacaaaaauuagccaggcaugguggcgcacgccuguagucccagcuacuugggaggcugacgcacaagaaucacuugaaccaaggagguggagguugcagugagccgagauugcgccacugcacuccagccuggaugauagaguaagacucagucucaaaaaaaacaacaaaaacaaaacaaaacaaaaaacaguaaaacagauaaucaucauaauggugcgcaucucauagcucuguuuugagguuugaauggaaaaacaugugcuaugugcccuguagacagcauggcuuaauaaauggagauuauuacuacaucagcauccuugcugacacagagaaggaaucuuauucauugccauaaccauucuguguccuuuggugucugagcccacucuggcccuacugugaagagugggagauaacccagaccaccacaauuggguuguucuaggcaguaacugauaaaaggggaaaaaacagagcuauggaccaugugauaagugaggcacagcugccaccacgauaggguguggggagagggcaggaaggggugagagaggacugggaaggcacaaaggaguggggaguaucugccucugucuuucccaacugauccccucccaucccagaaccucuuugcucaccacugugagccucucuccagacccucagcagccccccgaaauggcuccucugccugccccuacgugaccacagucaagcacagcccagcaccugcugcagcucaccgucacacacacccuucccaagaccgcaaggaaaagucuucagcugaaggggccuuguuugguauaaaacacgaggcaguucucagcuucuggcucugucuucuccuggauaaauaaccuuggggaagguacauggccccucagagccuccaggcgcucaacuguauaauggauaaaccauugcucuccuagugggauugcugggcuaagucauauauauacucaagaaaagaguguuucccuucugucugaccuuuucaaagaaaccaagagaaaaccacggagagucaccauauuugaucaaggcaacugugaugcaacaaauaaaaugccuacuauguaugugucuagccugugugcaaggcaaaugcauuuccucaacucagaaagauuacuuucuagugugagagaaagacaggaaacccaguaaauugcacauaugaauauacaauuagaacacaucuaagagcuaugggugagaacagcauguaacacccagagggacauuauuuaccuuaggaggucagggaagccugucugagaaagugcugucaggcaugagccgaacuaggaauccaaucaaaaucagacucaaggccccgccccaacuguggucuuggccgccacaugccagguggccucaaguggucugagagcuggaccacuugcuguuugagcugcaacucuccuucaggcaccuuggcaccacucaucgcucagagcuagcagccucccaggccaccaggccuggaccugagaggccaguccuuccacuugucagcugcagaacugcaacaggccuuuguggccaacccagcugcucccucccuccagcuggcaugagacuccauuuccucaucugccacugacuugucacucugccuucccaugggcugcagggaaacugugaccuuuaaucaacuguccacgccaaccagcugugcccaggucagaguccagcacugccucccuggcucugcucagaaagaucagggccaagaaauguccaccauccccaaaagcuacccccagccaacaucacccaccacaugcugagugucugucauguggucagcauuucaaugucuacuuggcgaucuucaauuccaguccugugacgugugauaauacuuaacccuucacugcagggaaaggaauccaucagucugccuggaggcaugcaguguguauguguuaaagagucauacccaggccugucugccuccacaugcaucugcccacauacaacccucacagcaccagccauauggccuuauguuguuccuagcucugagcacagagccaagaaauuauccccccaugcauaucuuuccauugaaucucccaugucuucauucauuaacaauccugucuuaauuuacccuuucugcagcaugagagacugugccaaaugccacacaaugucuuaaggacacagaaccaacagcagaggcacuuuauagggagguagauggugacagauacguaaacugggaacaucagaaaauggugacagguacaauaacacacgucagggcagggaacaguaacggcuuccaggaaggaccucuuuaguuccaucugucucccccaggcacccagcaucacgccaaccacacagagggugcucauuaaaugccaccucguugagaacaccagccacaucccagugaacccuccgugaccagccaggacagccucaccucaagcccagcugagcgccggauggaacgugcaucagaugcuucaccaggaagagucggggucuuacauuccauagggagacccaaaggaaguuggcagagaucuaaguaaacagagaucucaacccucucagccagcugcaguccuucgucccccauggacauccaagcuguaagaauccaugaggcauucagccacagccucccuuaaaaccacuuuuaguauccugaaaugugccgggcgugugucauuccagugcaugguuccaccagcguuauuccccagaccacugaagaucacuguaaauccaucaggcucagaaaauacuugaacgaagcuccaugcagcugacaggcacagccaucuugaggggcaucuuuuuaaucuccuucuggccaaaagaucaggccugcaacagggaagaagaaaaaaacagucuugucacagucacugacucagagcaguauucagucacucuuuccuccuuguguuuggcccuaacagaguguaacucacuaaaaauaauucuccauaacugguaacacacaaaguugagaccgguguccagggaggccuucaggugagagcugccucuccugcgguacgaaggaccucucagacagggaacugccagcugcucauagccucaggagcacccugagaggggagaggaggcuggggggcauccauuauaaaguugagaggagaauguuugugacuggcuuagaaagcugacagcaaggccaggccuggcacauagccugggcuccccugcagggcugagaggucccugcagggagcugagggguuuagggucagcugguaggaaguaguucuuuguuuuguuucuuuuuaaagacaaccacaaaacccuggccugacuccaggccuuguccugcacugugagccucuucagggcagggccuaggaccuguucuguucuuacucauucauucacuaacuacugagcaccugcuagguacccagcacucucccaucaggagggugauagcuuugucuucccaauccaguguauuuaaauuauuccaaagauaacugaagaacaaauugauccacaaugccuagggcuggaggcucaauauuccccauccacccaaugauaacaauaacuguccuuuggggaaugucuaugauguaucggcuaaaaacucuggccucuccaucugauaugaucucucaaacacccugggaugccugccccuguuuuccagaugaagcaguggaggaacaaacaaccauucuacuucagacuaguaagaagccuaaaucugaagcuagacagucugucucccaagucugugcccugauccgccgcucuaaguuaccuagugagggauuccugcccagaauggccacagcuaaaacuuacuuccaggcuuucugcauguaugaaacccucauuucauccucacaaaaaacuaugaguuguagauuauuguuaaccgacuuuagagaugagaaauuugaggcccagagaagugaagcaacuuccacaaggucacacagcuuuaaaaaaaaaaaaaaaaaaucacaggaaaaggguuugaggcugggcgcgguggcucacgccuguaauccuagcacuuugugaugccgaggcugguggaucccuugaggccaggaauucaagaccagccuggccaacauggugaaacccugucucuacuaaaaauacaaaaauuagcugggugugguggugcaugccuguaauuccagcuauuugggaggccgaggaaugagaaucgcuuaaaccaaggagacggagguugcagugagccaagaucacaccacugcauuccagccugggccacagaaugagacucuaucucaaaaaaaaaaagaagaaagaaagaaagagagagagggaaggaaggagggaaggaaggaaggaaggaaggaaggaaggaaggaaggaaggaaggaaggaaggaaggaagaaagaaagagagaaaggaaaagggguuugaaacaaggcggacuggcagacuggcuccaaagcccacgagcuugaccacugcuccaacuuccaucaaaagcaacgauuacugccaaagaaauguuuacaaacguagugguuuaaaacagaaaaagaaauaaaaaauaaaacagcacacacuuaugaucuuacauuucuggaagucugacaugggucucacugagcuaaaaucaggcuguugggagggcugcauuucuuucugguggcugagagggaauguguuuccuugcuuuuccaagcuucuaaaggcugcuucauaggccuuggcuguggcuucuuccuccaucuucaaauacaacaccaaggcaucucugacucugcuucuguggccauaucucugucucugaauaacucucugccucccucuuccacuccuaaggacgcaugugauuauauugggcucacccagaugauccaaaaucauccguccaccucaggguccuuagccuuacuagcaucugcaaagucccuuuugacaugcaacauauucgcagguucuagggauucggauguggacauuuagggggacguuauucugccugccauacaagaauaacagagggcacccaucuccuguuuuaagaagucuuccaugaggaggcaccacucauucccaaaauggaaaucaagcuagcugccucacccugcccacaaugcacagagccacacacacuugcagcggcuagugaagaaaucacgaaggaaacaguaagguacguuuucuucuuaaaaaacauauccagcccagugcgguggcucacgccuguaaucccagcacuuugggaggccgaggcggguggaucacgaggucaggagaucgagaucauccuggcuaacacggugaaaccccgucucuacuaaaauuacaaaaaaucagccaggcgugguggcacacaccuguaaucacagcuacucaggaggcuaaggcagaagaauggcuugaacccaggaggccgagguuguagugagccaagaucaugccacugcacucuagccuaggugacagagugagauucagucucaaaaaaaaaaaaaaaaaaaaaaaaaaacaagauagagugagauucugcauccaaguuggguuugacuccaaagcuguuuucuuuccauucugagagacacucuuucuuauuuaaauaagacaguguuucuaggccaagcgugguggcucaugccuguaaaucccagcacuuugggaggcugagauggguggaucgccugaagucaggaguuugagaccagacuggccaacguggugaaaccccgucucuacuaaaaauacaaacaauuagccaggugugguggcaggugccuguaaucccagcuaccugggaggcugaggaacgagaaucacuugaacucgggagguggagguugcagugaaccaagauuacaccacugcaccccagccuggguggcagagcacagaguaagauuuugucuaaaaaauaaaauaaaauaaauaagacaguguuucuagaaaguucaagaagguucuggcaaugguugaguaguuccuauugaagcaguucccugguagauagcaacuauaaacucugaacaaauauuucuaaaaauuagaacaaagauuucuaaaaaaucuaggcaccugaugaccaaaaguaggacauucuggagugugaucaagaccuggacauucagcaagccagugaguuccugcuuuuggucaauuuuagucugagaguaggcccgguucugcaacaugugaguggcuaacacucagaugguguugcugcacugaaacaucaggacagagaucaaggcaacacaauaggugaaagugaaagaagaaauccugguaaaaagagaguuuccaaaaaggggaguucaaauucuguguacaaauguucccuaagucacuaagugacuccugagccaaguuuguauggaguagcccaguuaaagccaaaagaacuaaacagcaauuuauauugcugcccaauacuagggagucagaauuugaagucuuagauuacugaauuaacuaccuacugaaacaaaaaagcacuacucuuuggaggaacaaaacagaaucaguccuuaccaaguaucacucacaaugucugugauauaauuuauaauagcucaauauaacaaacaacuaaaaagaaaacaaaaacaggaaauguaauccauucuuaagaaaaaagauaguuauggggaccguccccaugauccugagaugacccaguuucuggaauuagcagacaaggguuuuuuaagcagcuauuauaacuaugcucaaagacucaaaggaaaauguauucuuaguaaauaaaaagauaagaaagcuuagcaaagaaagagccaaauggaaauucuacaauuaaaaaaaaaaucugaaacaaucaauuggauccauuuaacggcagacugaagaggaaccaagagucaguacaauuugaggagaggccaauagaaauuauuuaaucugaauaacagaaaaaaauuugaaaaauugaagagagccucagagaccuguaggacaauaucaaaaagccuaacagacauguaauuuuagucccaaaaggagagaagagaauggagcaagaucaauaucgggggugggaagggaugaaaguguucuaaauucagugaaagacauuaauuuauagauauaagaauaucagcaaaucccaugcaggauauauauuuuuuuaaaucacaccuaaguauauaauaguugaacugcugaaaaccaacauuugaaaaaagucaugaaaagagccagagaaaaacagugguucuaauuucuuaaaaucauugaaaaagcagauaauuacaucugaacccaauaugugcucugcaggucacuuccucuugucccauuuauuuauuuauuuauuuuauuuauuuuuuccuugagacagagucuugcucuguugcccaggcuggagugcaauggugccaucucagcucacugcaacuuccaccucccagguucaagugauucuccugccucagccucccaaauagcugggauuagagguguuagccacugcaucuggccuucuugucccauuuaaaucuaccugaaagcuuuuagacccaagaggaagauggcuucaaaaggaagcucaaguaucuaaacagccccuaagagaaaagaagaaggaaguacaguaauuaaaaauuacaguuugaaguuagacucccaaauuuacuacguuucuuacucuggggaaauguuuuuaacccuuaauuuccucaucugaaaauggugguaaacaacaucuacucauuucauagaacuacugugagguuguaugauguuuugaauguuuguuaccuacacccccgaccccuaaauucauacguugaacucuuaacugccaaggugaugaucucaaaaggggaggccuuugaaaagugauucggucaugaggcuggagggcuuagugcccuuauaaaagagguauaaaauaccuuauuugauccuuucaccauauaaagacccaacaagaaggcaucauugcuaaaccaggaaacaggcccucaccagacaccaaauaugucugagccuuaaucuuggacuuccccaccuccagaaccaugacaaauaaaguucuguuguuuacaagcuaccagucuaaggugguuuguuauaccagccugaauggacugugacagguugcaauaaacaacauaaaggacuuagcauguugcugggcacauauuaagagcuugacggaucuaucauucucacaucaaauggaagaggcuccugcaagucaccccacagcagugacuccaggacugcacacacucacuccucggcuccuacaagugaccaccaagaccugccagcccugggaagcagcccaggagaggcacugcuccugaaugucaggacuggaguaccgucagcugagaggggccacuuacaacaggaaggggagcugugauuuaugguaccagccucagcuaaugacaggggagugaacaggggacacagucuguugaauauuuacugaggcccacaggcaagucugaagccaaguuuguucuguuggggucggauccauuaaagcucugucaccugaggaagaauuaugacauggucuguuggguauuacugcagucaagugguggucccugaccaauggcaaggacugcccugaugcucacaagaagguggcugcaccucgcccuccgccugcaaaaguacacaauguguggcauuguacaccgggauuucccguaucaugaaaucauaaugcuuucucagggagcauuuucuuuucucuccugauuacuugcuguuagauuccuuucauuugcucuuucuguaauggguuggcuaaaauuuaaaaaccacacaaugccaauaauuggcuuugauguggaacuggaauucauacgugcuggugaacagacacucugaaaaaggauaaacaaccacuuugggaaacuguucugcacuauuuacuaaugcugaauauacccaaacccuaugacccugcagcuccacuccgugguaucaaugcacagauaugugugcauauguucaccagaagacaagucuaaggauaucacagcagcucuauucauaacagccaaacacuggaaacuacucaaaugcccaucaacaguagaauggauuuuuuaaaauaugcacacaaucuagcgaccagugagaaugaucugaaaaugcacguaccacaugaauauaucccacaaacauaauuuugagugaaagaagcaagacacaggggagugugugaugauguuauuuagauuaaguacauaaacagguuaaacuaaucugugugguuagaagucaggacaaaguucuccugagugacugacugggagggggcuuccaaaaugcuggaaauguucuauugauccaggugcuggcuccacacucagguucaguuugagaacauucgucaagcuaucgauacacauaugacaugugcacuuuucuccaugcacauuauuucuauaaaaagggaguuuauauuuuuugaguuuuccugugaaaauauguuugcuggaaugucaaagacaucagaacaccccuucaaggccugggaaucggcagcuuccagguuucccuguuucaucguauucucacgccccacugccucacagcugacccuuccccagaggacacugaggggaagucuucacaauaagcaugcucuggcccagugacacggaauugccccacaagaaaacguggccccagccccauucucuuggcuccaucucucuccucucugccucccaggcugucaggaccaaaucugucauuuccuucuuuuuuucuuuuuuuccaaaguuaaaauaggaauucuuuuuuuauuuuauuuuuuuaauuuuauuuuuuuuuauuauacuuuaaguuuuaggguacaugugcacaacgugcagguuuguuacauauguauacaugugccaugcuugugugcuacacccauuaacucgucauuuaacauuagguauaucuccuaaugcuaucccuccccauuccccccacugucauuuccuucuugacccuccccaccagguauuuccacuagcugaggcccugccgaagacauuuggaagaaaaacgaaaaacaggcugcgucuauucccuacccaacaccaacagaccaccucugcgcauccacucccccucaauauaggacgggcagauggaugcuuugguaacugaagacuuaaaguauacaggguuggcacaggcugguaaaugggguaugagguacagaacacagaaagugagggaaggcgucccugguccuaaagcuuugaggggagcaccguuugcagggggagccauaauaagugucucccaguguguguguggcugugccuuccucucucucucucugucucugagccuucuggacuccgcaugugucugugugugugugugugugugugugaugugugugcaugcaugugugcgugcaagugugugugugcaggcaugugugugcguguaugugcacauguguguaucucuuucccucucuugcagaagggaccagucauguuguuaauuuuaguaccagcaagagucagaggauguuaauuauaacaccucugagacccggucaauggggcagcaguuguagcagcagaagugagaaaucagucucacaugcuaagugugccucaauuucucuuucucucaggauugugaaguaagauuucuucaaaacuggcugggugugguggcucacgccuguaaucccagcacuuugggaggccgaggagguggaucaccugaggucaugaguucgagaccagacuggccaacauggcgaaacccccucucuacuaaaaauacaaaaauuagcugggcgugguggcgggcaccuguaaucccagcuaccugggaggcugagucaggagaaucgcuugaaccugggaggcggagguugcagugagccgagauugugccauugcacuccaggcugggcaacaggagcgagacuccaucucaaaaaaaaaaaaagauuucuucaaaacugaugccaaaaagacgaugucuccuuuaucuucuucugaggaagggagagguggcaauuucucuggcugugcucacauuauuucucugugguaccccaggagcuggggcuuuccuaaccuggaagauaaaucggggagaucuguucccagagaaagcggcagcuguccccccgcugacaggcucuauuuuugcuucguuucacuuccucccuaacgugugcugggaugacauggaucagcugcuuuggaauucccaagccuucgagugccugcucccgucacacucacccgauuccucauucaggggaggggggaugggagccacaggaaccaaggugugaauccucaugcuguggucacaaccguguggccuugggcacaucccuuaagcucauugaaaguguuuccucaucuguucaauaaaacaaagaauaagccgggcacagcggcucaugccuguaauccuagcacuuuggaagguggaggcgggcagaucacuugaacccaggaguuugagaccagccuggacaacauggugaaaccauaucucuacaaaaaauacaaaaauuagcuggcagugguggcgcaccuguagucccagcuacucaggaggcugagguaagaggauuccuugaguccaggaagucaguggagguugcagugagccaacagccuaggugacaaaguaagacccugucucaaaaaauaauaauaauaggccgggugugguggcucacaccugugaucccagcacuuugggaggccaaggcaaguggaucaccuaaggucagaaguucgagaccggccuaacuaacauguugaaacuccaucgcuaccaaaaauacaaaaauuagcugagugugguggcgggcaccuguaaucucagcuacucgggaggcugaggcaggagaaucacuugaacccagaaggcggagguugcagugagcugagauugugauugugccacugcacuccaaccugggcgacaagagugaaacuccaucugaaauaauaauaauaauaauaauaauaauaauauaauaacaauaauauuaauaauaauauuauuauuauuaucucagaaaaacaaaugauaauaauaauaauaaggaauagaaacauguguccacuggaguucaucugcggacaagacugaauguauagagagugcuccggcacacagugggcucacaacacaagcagauagucaaagucacccucaacagcacagcgcugcuauuauggugguuacucccacgagucagacucgggagaugcaaaccgaacccaguccaguucccuaauguuauuaagggcuugauuuccuucugcacuuugccagacacaaugugggucuccacaaggaggaggcaagcagccaguauagaaccagccuucuaccagcaggcaccuucaugggcaugaugcagcagagcccugcuugagcucugcaagguacauugcuuagagccauucuucaggaauacugacauucggguucugccagccuccagcaacccaugcguguccggcacagugcuugggaacucaacaucgcuuaagaaaugacuggaaagcugagcgcaguggcucacgccuguaaucccagcacguugggaggcugaggcguguggaucacgaggucaggaguucaagaccagccuggccagcauggcaaaaccccgucucuacuaaaguacaaaaaauuagccagucaugguggugcacgccuauagucgcagcuacucgggaggcuaaggcaggauaauugcuugaacccagcaggcggaaguugcaaugagcagugaucaugccacugcacuccagccugggagacagagugagacuccaucucggaaaaaaaaaaaaaaaaaaaagggccgggggcgauggcucaugccuauaaucccagcacuuugggagaccgagacaggcggaucaugaggucaggagaucgagaccauccuggcuaacacagugaaaccccaccucuacuaaaaauacaaaaaaaaaaaaauuagccgggcgugguggcgagcgccuguagucccagcuacucaggaggcugaggcaggagaauggcgugaacccggaaguggagguugcagugagccaagaucaugccacugcacuccagccugggggacagagcaagacuccgucucaaagaaaaaaggaauuguugacuggaauagugggugauuaauuccagcuacacagacaguguucacgugcuagcuccuagcacagugcuagaagccagaaaucauaucaaacaugaaagacacaauccugacuucauggagcuuucaggcuguacuaagauuuccagagaagcaggacauguccauaagcgaggacauuuguugauaaccagguugcccuggcgggcuggcagaagcugaggaacaggaggaaagguuggaccacauagaaugugagaggccccaguacgucagcacacaagaaaccuuggaaauaaucucguucaauguccucacugaagagcugagaaguaaggccuggagaaguaaagugacuugcccaagaucacccagcgaagaccugcagaugcagagugagaagcaaaucuccaugagaagggugcgcugggcacaaugccuagaggaggaacugguccuuaaacuggugggugcuggcgcauuguccgucgaagguggcaugaccagaagcccagaagagcauguaauuaccacacuuccugagugcugguucugagagcauugguuguguuccuguaaucuccaacaaugcugugagauacgaacucacuaagaaacgagaacacuggugcacagcaaagcccaaguaugcccaagccaugcaggagucagcaagagacagagcuaggauacgagcccaggcacugccuccggagacuuuguucuuuuuuguuuguuuguuuuguuuuguuuuguuuaauugagauagagucuugcucugucacccaggcuggagugcaguggcgugaucucagcucacuacaaccuccaccuccuggguucaagugauucuccugccucagccucccaaguagcuaggauuacaggcaccugccaccacgcccggcuaauuuuuguauuuuuagcagagacaggguuucaccauguuggcaaagcuggccuccaacuccugaccucaacugauaccccggccuuggccucccgaagugcugggauuacaggcaggagccaccacgcccagcccugggucuuuguucuuaaccacuagucugccuugccuuugaagaauuaugugaugagaaagacuggaggcagagccauaggauaagaagcuucuaaaagaaagagaugggaauggcacuuugcugggaaaugcaaggaaaauagagauuuccaaagcaucaauaucaucuacugccaggaguugaccaaaacagccccaauagggcucacgccuugcucuuuuucccucaguaauuucuucacgucauccaugacauccuucuccagacuggcucccugucagaguagauaaugugucuaguuguggccugaagccauaauaucauucccccuaggcucagggaguggggaggcaggcguccccagaacagcccaccccuggccacuucuccccacccccuugcaggugagaaggcaaacacccucaucugcaagaugccugugggcagcauccagggaggcuguggguauuucucgcugaugggcacugucuuacagauccauuaggacucaggcaccuaaaaguuaugggaauaugacugugccaauaaggaucccaggguuaccucacgauagccuucuuuuuaauuaacuagaccagaccagaccaguaaggaauagcaacaguaauuuuaagacagaaagagaggcagacaggaagacaggcagacaguggcagggaagggaaagaggaagagagggaaaaaagagggagggaugcaaugucaagcaauaaccaacgcuucagagacaaacaggcuagggggagaauucuagcucugaggcuuccaaaucugcgaagcuuuaagcuucaguucuuugaaccugcauccauaucugugaaaugccuugcagaguugggggaaggcuagagauaacccaagugagguccuugcaccuaguagauccucaauauaggaaaagcucccauuuaaucaggcucaccuccacucuccuucaucuuuaggcucaagaugauuaagaugcugaaaugacgaagaagagucaugaacacuguucuucuccaagugacagaccuucaaaauuugugggguuuuuuuuuucaauuuccuuuuguuugacuaugcccacaaaaucccucagggaaaggucagcaaagguccaaaugucaaucaaucaugaacaaagggguaaagugccaaggaccugagccgucaaacaaugacucaaggugacaguucuuuacagaacagcaggaccugcacuugaagauuccaaauacagaagguucuacagugugcauguucuccaagaaaguucaguaagguuuuuugugggggagggggguuguuguuuuuuugagacagaguccgguucugucacccaggcuggagugcaguggcgugaucauggcucacugcagccucaaacucccaggcucaagcaauucucccaccucagccuccagaguagcugggacuacgggugcgagccaccaugcccugcuaauuuuuguauuuuuuuuguagagagagguuuucaucauguugcccaggcuggaaagaaaguucacuaaguuugacagagacucaagaguuuauacuggucccugucugcaaagagcuuaaaaucucauuuacaaaacaggacuaugagaaauaguccguuuaaggacuaagucaaaauguuauccuaaacaguaguagaugugcgguguggaguucagggaagcuccacgagagaucagagcugcuuuucuggguugucuauguguccccugagaggaaucuaaguugggaagagagagagagagacccucgggguagagguuggggcuaaugucaaaauaaggaggaugaaaggaaauggcauuuaucagucaccagucacaaagaaaacccuuuuaauuucccacuuaauccccauguauccucacaaccccacagacaggucucauaucugaaaguuacagaaacagcagcgugaaaagggcgggccccuugcccaguuuguguggcugaagaggguggccuugaacccagguccauaagacugcaaguccccucgggggccaucaucacaccacagccugcuucacuuuagaaucugggcacauucuaggcgcucugagcucccgcugucucaggcgcuggggaguuguccuccucggcgagaggaaacuuuccaccacgccacucugcuaaaccuguccucucccacaucccacagcuccauacaucccauaagcaccaccuuuguuccaacuccucuuuaaaaccuggauuagcugggcuuccggggaggucacgcuccugacuuuggaaugcacuucugacuuucucagaagcaggucucuacucaagucacgcaggcacaucucgcuaaguaaacuuuggcagccaucuagcuugcccaaggauucuggguaaguccaaauuggggggauggggcaaaugaaagcgaugacagcacgaacagcccaugaccaggagcaggcacaucggcucugcucugcugucacccaagcgccacggaggacaggaguuguggaaaacuggcagcaggugcucugggggcaccuaggagcugacaugguucccuccuccgccugcuuagaggacagaucccacuuaguccccaucccuucagaacuggaggggccaggagaugggaagaguguacggguaaugcuaauaucauccagggaaagguaaaggacgaaagcgggaggagaugagaggaaagggagagaaggggaaagaagggagcagcuaaaauaaauacacaggagacauacaaauucacuguauuaaaaaccugucagauauaauaauacuaauaaaauaaaaauaaaauaaaauaauuaaaaaaauaaaaauaaaaaccugucagaauagcacuccagaaaagaacccugacuuggggaaccugaguccccagagcucugugggaacuggguggcauuacagcauucauagcaaaccaagugugaaaccacacauacacacacacacacacacacacacacacacugcuguuuggggcgugugugugaaucacuguauguuuuccaggugucuccauggugcaagucacaguacuggucucuuaaaaggcuucucccagucuuccccucuaggucaguggcucucaaaccugagugugccuaagcaccaccuguggacuugcuccaaugcagauccggaggcccaaccccguaacucuguucaguaaaccuggcugagggugaggggggguggagggugccucuuugccaggucccccagguaaggcaggggugccacagaacuccccagagaaacccuguuucagaggacuuacugcucagagagcaaucaaucucuuuccagcaugaggccuuggagauaaaaaagaauacgagugaugguugcugaaagggagaagaaggagcccacgaccugcccuuacugagcuccauucugugcugagcacaggcgggguccaaacacucagggucucccuuccuccccacccuucccuuggaagcaguugcuagaagcuugugcauaugagcagcuaaggcuccccagggugccuuguccaaggucacugaacuaggaaauagcagaacuaggaacuucccuuugucucagagaaaagaaaaugaggaaaggaguacacgcuauaucacggagauguggagcgccuuagaggagaagaaggaaauggaaaagaaaacaaggaaaauaaauuauugagcacauaugacuuugcacacuuggccacaucccuuuaaauccuucaguccuuuacuaugcuuauuucauagaugaggaacggaggcucgaaauaugucuaaugaugaaguauuccucuuauaaucagaaaacaacaugugaaaaagggagagggagaaagaagagagagagagagagagagacagagacagagacagacagagucagagacagagacagagacagagacagagaggacacacaccucucccuucuugcuauggcuccagaaaucaggccaccucuguguacccuccuggcucucacaaaccguaacacccggaggaagaacagaccccagcugugaggaaggggacgaugugcaacuuuccacagucacugguuaaggugggaaagaguuaaaaccaaaauccagcaccccaauuucucccccaaacaccauagaaaacugagugcaacuagcaaugacacuucucaucauuauaguggaggacguuccuccacucuaaauacacaggcacccaaggggucacauccaaagaagcacgcauggugaaagggcaacugcaccugcuccagcaggcacagugcagcccagggccacacacccacacacacacacacacacacacacacacacaccuggaggccaaccaagacugcagagcgagggaagggccagguggcaggccaaaacucaaagaucaguaggcuuccugcaggugggaaggguacccaccagggaugugaaggaagggaagggugggcaaaagccuuaaggaggaugaaaaccuucuuuuggggaagaagaagaucacacaacaaauugaacugcuucacuucugucucaaacccgcuucacaaucaggccaaagguaauacccacugcuaacauucacggugcacauuucagaucagagacacugcacaccaagaauuugaguguggcucagacucucaacaccccuccuaggaagguaccagucucauacuuguguuacaggugacaaaaccauagcaccagccauaugggugggaauaagaugaacugggauugaagauccacaguccaagcucuuacacuuuuagcuucagcugcaaccaucccugaucucuggacaugguggaugugucauucacugauucuccucugggcuucuguaccugcuguuccucuaacuguuacccacccuuggugaaccucuacucauccuacaaagcccuucuccuccucugugcagccuuucccaaucuucucauuaaccccuugcgacucucagcugaauccacugcugccccuucuccagugcucccauggcaucaugacauuaucaaauuuaaauccuaagccugucaccucuacugugucauucacucuagcacugcaccccaagaugcagaacugcauguacuaaaagcaugcagacuguauuuucuccauaacccucgccccaaauugagcugcccugagcuuugcauguucccuugagugucuuacacaaagcugugagcagcuugaggacagugacuacacagccuuaaauucuacaucucccagauauagggugcuuggcugcuuggcagcuaguggugcucaauuaauguucacacuggguauucauccacuagacauuuacugcacaccuauuguauguuagucacugugcuuggccagaaugauggagaccauuuuuaaugaagagauggcaaaagauugcaaaggaaaaauggacaacacagaaucauugauucauagaggcagcaaaguggagaaauggagcaaagauucuguggggcaaaggccuccucugggaagcccaggcucugaaaucuccauagcacauuugcacccugccuccauugcauacuguguacaccaagagggguauuuaacauuccuaaguuucaccuuccuucucagaaauuaacaacucccuuuacucccucccagcucuuuuaccugcugggaggauaaaaugagacaauccaugcaaauugcacgccgggucccuccuacacaaaaaaacaugaaauagauauuagcuacuauugauaccaccuacuagcucaauacgugaaagugaaagcuagccaugaugauuuuucagcagccaagaaugcuccugaaggauaaacacacuuuugugcuuccagaaguuagaaggggucuccuuccuauucauuuuccaaauaagguuaagaaaguguuacccuucaguuaauuccagaugccaaguaauccagggcugugcuuacccagcaaguaaaagagcugaagguaaaucaggugugugucaugggaaucuucagaaggcugcaaggagaagcaggcauucagucugagccugcccagauuucucuaaaacucgcaggaggacacacccagaggccagaggcaggcccuugucuugggacaccauaggcgcuccaggcuggaagccuucugccccauauccucaccuaaccccaagcagaacagccagagcaggccaacaccagcaagugagagggcaggaaaacaggaggaaccaugcggggcucaguaggagagagcagcucagugguacagucagcaacagaucaggaaauggacagggcugucccgucacuuugcuuuaauguaucuggauuccuagaagaucugaagcaaggggcaggcguggggacaaagaauauaucucaaaccacaaaggaccagggaccacuguggacauaauuucaucaaaagucugcuguaacucucaugauggccuuugacaguggcaagacugucccccaugugagaccugaaacacugaaauaaucaagcucagauuccgagccaggguuuucuggaugcuuccauugaaauucucugccaaaguacaggcaugacauucuacggaaaggucacuucuacuuuuaacauuucuguaguguuugaaguuauuuuuaaugaacuuuuuauuuaauuuuuaauuuuuguggguacacaggcauauauauuuauaggguacaugagauauuuugauagaggcacacaaugcauaauaaucccuucaggguaaauggggcauccaucaccucaaacauuuacccuuucuuuguguuacgaacaauccaauuaaacucuuauuuacuuauuuauuuauuugagacggauacucucucugccacccaggcuggagugcaguggcgcaaucucagcucacugcaaucuccaccuccuggguucaagcgauucucccaccucagccuccagaguagcuugggucacaggcacccaccaccaagcccggcuauuuuuguauuuuuaguggagauaagguuucaccauguuacccaggcuggucuugaacuccugaccucagugaucugccugccucggccucuccaagugcugggauuacaggcaugagccaccacacccggccucuuuuaguuuuuugaggguucuuuuguuuuuguuuuuuugagacggagucucacucuugucccccaggcuggagugcaauggcaugaucucagcucacugcaaccuccgccucccggcuucaagugauucuccugccucagccuccagaauagcugggauuacaggugcccaucaccacgucuggcuaauuuuuuuuguauuuuuaguggagacgggguuuugccauguuggccagguuggucuccaacuccugaccucaggggauccgccugccuuggccucccaaaaugcugggauuacaggcgugagccacugcgcucagccaguuauuuuuaaauguacaauauauuauuguggacuguacuucuaauacaaucagaaaaaaaaguacagaugcuucgcuggguuuuguuuuugaaucaacaucuggcaccagaacuugcagauauuccucucugggugugggaacaguuccuggauaugggucaaaaaacaccaccaaagagcuguaucuugaucucuucuccucacaguugacgucaugcccuacacuaagaggcagucacauacuuuacccgauucugguggacucugccuaaggacagacaagcagagggccccuggacacugggaguccagcgcaucccuuccucagcagcaaaauuugcaaagaccucaucagcugugccgacaucacacaaaccuaggaugugaagcaucccucuccucgcuaaugucuauuugauacaaaaguuuucauauccauuccccugcauuccaugaguaaaaaacacauuuauucugagauuugccauccccugagagggcuccugggcaucgcgucagcaaaaaggcaguuguaugugcuaacuccaggccaaaauguggaggagugucacuuauacgcagugucccugucccacacagccccuccuggugcucccuggagaggcacacagcaggcaguaaccauuccucugcauugcguguuuuagauuugcucucugucuuuauuuuuuccuugcagaggagguagacagggcaugguuuucaacccacccacagggugaucuggaauauagaccaggaggacaggaauuaauucagcauuucacccucugaacuuccugcccucccuagucacuggacagagaggaggaggaggaggaggcagaaaggagacgugacuguggccgucacagaguuaauaggacacacggcauauucagcaacacuacucaccacuuuggcaaacaguauaaauaauaagggcucacauuuucaggcugcaugcuggggcuuuacaugcaucaucgcauuuaaucauugccuugacccagacaacuuugcaaguaaggucacugaggcccagaaauguuaagccaucugcccaagaucucauagcuaguaagugggagaaggagcuuccucuagcugaagaggauguuugucuagacauuucaagagcucccagagcucuaaaugcagaaugaaauggccaguucuacagauacuucagcuuuccuucauucaguaaauauuuaccaaguaguccuauguaaagggagggagugccgcucauucucccgcuccacuucccucaauccccaaaggguauuugguucuguguuggcuacugucuuaguuucugagggcagccauaacaaauugcuacaaacuggguggcuuacaucagcagaugcacucucucacaguucuggggacuagauguccaagaucaaggugucagcgggacugugcucccucugaaggcuccaugaaagauccuuccuugccucuuucuggcaucugguggcuuccugcaauccuuggagcuccuuggcuuguagcugugucacucuaaucucugccucuguggucacauggccuucucccuguaucucuacaaauccuucuuuccuaugucccucucuucuccucugaggacaugggucauuggcuuuagcccccacccuaauccaauaugauaucaucuuaaguaaugacaucuaaaaagacccaauguccaccaggcacaguggcucgugccuguaaccccaacacuuugggaagccgagacaggaggaucacugaaggucaggaguucgagaccagccuggccaacauggugacacccugucucuacuaaaaguacaaaaaauagccaagccugguggcgggugccuguaaucucagcuacucggacggcugaggcaggagaauagcuugaacccaggaggcagagguugcaguaagccgagaucacgccacugcacuccuuccugagugacagagcgagacuccaucucaaaacaaaaacaaaaacaaaaacccuauguccaaauaaugccauguucugaaguucauacaggcaugaauuuuggggggacacuacucaaucugguacaauuauuuacuauguucuucuacuauaagguaaaauuuguaaaugacaaacauucucaagcuugcagguuaugaaguagcagggaacaguagaaacaaccaggcccuuaaggucucagaaaaacaagaggagggaaagagccuaaugggaaacaguugguauugucuaccaucuucuuugucccuucgacuugugauauuaguccaacacugcaaagcucaauacuaaguaauaagacugcaauacauauuugaaagcaucagcaucauuuuguuuuuuaauaauaaaaaauaggccaagcgugguggcucacaccuguaaucccagcacuuugagaggaggaggugggugcaucaccugaggucaggaguucgagaccagccugggcaacaugaugaaacuccaucucuacuaaaaauacaaaaauuagccgggugugguggugcaugccuguaaucccagcuacucaggaggcugaggcaggagaaucacuggaaccugggagguggagguugcagugagccgaacucaugccauugcgcuucagccugggcaacagagcgagacuccaucucaaaauaaauaaauaaauaaagaauaauaaugccaacuucaugauuuacuaacaacugcuuauaaauaauucauuguaauuuuaacaauauagaacuugcaaaauuguugaguccacccugaaccagaccccuaagccuccagucaauauuaucucugccaucuacagcuucuuaagcuacuuguuauugacuuugguccagcagaagcaacuccugaauaccaaagugugccugaagaucacagcagugccuguggguuuguuuugggaaauuuuaaguaauucuuaaagucugagaaacuuuuaaaaaguaaagagauaauacauacauauauauauauauguacauauauauguauauauauauauauauauauauguuaaaaggaaggagaaauaauaggaugcaaaauuauacacacaggacuauuaaaaaaaaccugugggccaggugcagugacucacaccuguaaucccagcacugugggagguguaggaggguggauaaucugaggguggauaaccugaggucaggaguuggagaccagccuggccaacauggcgaaaacccaucucuacuaaaaauacaaaaaaauuagcugggugugguggcaugcacccguaaccccagcuacucuggaagccgaggcacgaaaauugcuugaacccaggaggucgggguuguagugagccaaguucauaccauuguacuccaaccugggcaauagagugagacuccaucucaaacaaaaacaaacaaacaaaaaaaacugugauucaagugacaggaaauugguaaaaucaaccauaugccuggauucuggaaaugaacacuguuucauuucugggugguggaacucauguuuuaaauucccuucuuuucagugaguagggaaugccacagacccugaggccuuauagcucagagagcuagugcuaagguggacccuaaccucucuaggucuucccaccaccucgcagaacugcucuaggauuaaauuaaaugacuuaauauuugcaaaggacuuagaagaguuaccuagcuucuagaaggacuacagaauucuuuguuaagcaaaauaaauaucuauuucauaauaagaaaaagauuauuuuaaaagucaaggaaaaaaacacuggcagacaaggacagagggaucacagaggaaggagccucaugccccgggggcugugcuguugccucuuguuauguuuuccuuugauaauaguugagauggacguccugcccucagugaaggcauacuucagauucagcaggaggcagcaacagugauuuuauuagggggcagagggugagugaccuagggccucugggacauuuucauccggagaugcuccauaaaggaugacaucucagaucuuagcuucaggucucagauuucccaguccccuucuccccaccccacccgccaccaugucucugcaucccccaacauaucugcauaaaaaaugagacugcacagccacaggggcuauccucgaaguucauuuuuuaccuucaaucaaggccagcccagagggcauuaccaucccaacagcccggccuuugucagacaggaaggcagagugaggaucgaaaagcagggaguaagugcugguucagcagagcccuccccagcggagcauccuccagaagcaucgcucauuguuauuccagccaggugucagcaagcuggccaagcccgggauacugccgaggaaugugcacaucaagaucagagauaauuccccucacaaaauuccucaccucccaccccucuaacugcggaggaguaaauggggguguuccaggcagaggagcugaugggucuccuuugcacaaaaaaggacugccaggcuguggcggcuuggaccccuccuccuccacccucccaggcaagugugccccucccccuucuuccuuccugacagccugaccuuggcugaggccaaacacaugcccaggcaguaucccuggccauuccuagcauucugggcaagcaagcccgaggaaggccgcaggcaggucuugagcagaacugagaagggcaucugaggccagcuaagccaggcccuagguggaaaccacuugguagagcuucaccauucaggcgagcagcccaugcacugcccagcugaugacuuggguuucaagucauccucuacagugaaucagugaaugcaagccuuacacacaaacacacauagcauuagugcaaacuccucacaggcacaaggagccuuccucuaacacggcccaaggcuccuugauaauguguuuaccuggcauaauguguagcaucugcggagggucggcagaugggaggcaagaucugccuaggucucggagcccaagaucuucccuguguacuaauaugaaugcacagacaauacauaacagucuggucuccugcagugaugucugccuucaccagugauuaacugaaccuccagcacaaacuaaggucucugcacugcuucugccacugucugucaccauccuggaacccaccagauagcagguuccucucuccaucuccuauccccuucccccugcgaccaccccaugcucacccagcccacuccugucucuauuagauaggggcuacuccuccaggccuccuucauuccucugaugcugaaggagagggagugggaggggacacugaaggaaggcaggaugucccagugccuaugauccaagagcaggacaagccaccagcaggucagcagugggccucagcucagagagcaccagcaucucugucaucuggcccccacucugccacauccuauuccugugggucaggggcaggaaagcagacccaggggcagccaugcucccuacacagacagcucacgagggucccaucagcaggaguugggauacguguuauggaaaaccaugagggugcugggcccagagcagggacacagccagcagauaugaucagcuugaggaguaggucgucuggggccuaaggguacugguaaagggcuccugagaacgccaacagaccaacaauuuaaacagcagggcaggagaggaaggggucccuaaugcaccaacacgccauccuggccaggcagccggaggcagggcugcgcugucagagggagaagccaugggcaugugaauuuaugcaagccccuuuaucucgcugaucugcaaacccugccuacuuaagccaucccugccaggucaccaggcagcuucaguggcccaacucacugaugaucacacccaaacaaggguuugccugccggugccacacucaaaggacauuucccuuggacugcccucagcucccacuccccacaggcuggaugccaggcuggccaucaaaugcugcgcccauugcauucacuuccuagggcugccggaacaaacuaguacaaacucagaggcuuaaauccacccacauuuauuaugauacaguucugaacauacaaaguucaaagugggucucacugaguguuagcaggacuguguuccuuccuggaggcucugggggaguuccuauuuccuugccuuuuccaacuucuagggacgguuauuccuugucucauggcuccuuccuccauccucaaagccagcaauguuacuugucaccucacauguuucugaacccuucuucugccucucucgcccacuuguaaggacucugugaugagacugggcccucuggauaaucuaaaaggaucucccucuuuuaaggucagcuuuaauuccaccugugacuuuaauuucccuucucuguauggcauaugacauccccauguuccagagaucaggaugugaaccucuuugggggaagcauaauucugucugccacacccagguuuauccccauccucaggcugccguucaauaucugcaaagcccccagauuggcaccuaccaccuuguccuucugaaaaagccaggaccauccugauuccagugaccccuggaugauuucaaccaccuccccauccugagaauccucguccaaauugaggugcaguaauguggugcccacuucaggaugaagaaauaguggcaagagacucgcccagggccacacagcucuaagaaugagaugugggauuggaacacugguguucaagcaggccugccgucuacagccccauaugaaucccaagcacucagacuaguucuggucuuagauccucuuagccaggucccucuaggacaagauggccucugucaccuccaucuggugcuuugguaggcaagaggaccucuaucucuaguucccgcggccuccacugagaauuucucuguguuagaaauauccuggcugggcgcagugacucaugccuggaaucccagcacuuugggaggcugaggcgggcggaucacgaggucaggagaucgagaccauccuggcuaacauggugaaaccccauauguacuaaaaauacaaaaaaaauagccgggcgugguggugggcgccuguagucccagcuacucagggggcugaggcaggagaauggcgugaacccgggaggcggagcuggcagugagccgagaucgcgccacugcacuccagccugggugacagagcaagacucugucucaaaaaaaaaagaaagaaauauccugccacauucaacacauguccgugugaaaagcaacaggaaaagaauaagagaaggagcgaggggugggagagaaaucaacauuuauugaaugcuugccaagggccaggagcaggcauccaguuacugaaucuugcccacaaacccugacggcaggccucauuagcuccauuuuacagacaggaggcugaggcucccagagauuggaagcaugcccagacucaugcagcgggggacuggcagggccccaguuccagccggcaggcucucuccccuccccagguguccuucaucccugcucacccaggaccccagcauuccaacccacacugaauugaccugaccccuucaccccacguaaccuuucuuuccugccccacccccacugcaaaccacaccccaccugcagcuucucuggccuggagcuugauugguuucaagcuucagcuugugaggaaagaggcuucuuuccccuuggauggcaggcccaggaaagccaugcaggguuuagggcagggaugugccaaucaccuggaagccggucccaaccuuuccccuacaucucgcuccauccgcgcugagccaaaauaaccuggaaucagugaugccagcgggcaugggggcaaaggccuggcaccucagcaacucuuaccacucucauccaggcaccaaagcaaagcccuggccacagguacacaggguccugagggauccagcuugaaggugggcccagacaccgggucccagaucugccagguccaagcugaggggccucaagcaagucauucuaccccucugggcuuuggcuuccaagcuaagcacugugcuaagugcugcagcaacacauaccaaaugauaaaagagacaugaucgcuguccuuagcagagaagcugauauuacaaaaauguucccacaagcacacaccuaaguaagaaauugcaauuggugcaacaaaggagaaguccacccccgacgccaacagcugauuuagggguuuaagguggggcucccagaagagaugacuuuuaaacugacaccugaaguuaguaggauuuuuuguuuaugaagacagaagggaagagagaaguuccuuggcaaaugccacucaccugagaacauuaaaaacuggcaacuggccaggcacgguggcucaugccugucaucccagcauuuugggaggcugaggcagaaagaucaugagaucaggaguucgagaccagccuggccaacauagugaaaccccaucucuacuaaaaaugcaaaaaauuagcuggcgcaguggcggacaccuguaaucccagcaacucgggaggcugaagcaggauaauugcuugaacccaagaggcggagguugcagugagccgagaucaugccacugcacuccagccugggugacagagcaagacacggucucggaaaaauaaauaaauaaauaaauaaauaaauaaauaaauaaauaaauaaaacuagcaacugcccagauuaaugggguagauccuuguauucacuugcaaagcaugguuugguaucacaaucagaugcagauuuguaaagaaaugucccccauagaaauggaggugucgaauccagggacaggaugccuaacaaaggggacuuacuguggggcaccccgguuccaccaucugcaaaauucacaaguuaaucaagacagaucuuacaaaucaaugagaaaaaaauugcuaacaccccaaaggaaaugaccaguuaacaaacacaaauaagccauaaacaugaaaagcuggccaaccacaccaguagucaaagaaaagcaacuuuauaacaagauaguuccccucauguuuuaagaguuugcugcaggcuauggcucaacccauaauuccagcaucuggggaguccaggauugcccgaggccaggaguuugagaccagccugguaacauagugagaccucauguguacaaaaaauauuuuaaaauuagcugggcauaguggugugcaccugugggaggcugagguggaagaaucucuugagcuugggaggucuaagcuaugaacuaugaacugagcuaugaacguaucauugcaauccagccugggugaaaaagcgagacccugucucuaaaaaauaaaaauuaaaaguuaauuuuuuuuuuuugagauggagucucacucugucuuucaggcuggagugcagugguaugaucucagcuuacugcaaccucugccuccuggguucaagcaauucuccugucucagccuccugaauagcugggauuauaggcaccugccaccacgccuggcuaaucuuuguauauuuaauaaagaugggguuucaccauguuggccaggcuggucucgaacuccugaccucaagugauccacccaccucgaccucccaaagugcugggauuacaggcgugagccaacgcgcccagccagaaaaguuaaaauuuuuuuaaaagaguuugcugcaguaauuagaaugcucacacuauuggaggcugccucagcaaccccuaauauugccuguggaguggugacugguuaaauacuccucaacagcaagcugggaaugcaucaagacccuauuaaauuccugggguguggguggcucugccaagaaaacaaucagagacacaugaaaagguuuauaccuugcaacagguaaaagcagaggaaaucugaaagccccgcaggacugacuuggcugaugauuagcaaugacaaugacaauaauaccaguagcaggcaacaugcgcccaguaccugcucugugccugguacuagcgaggggcuuugacaacuuucuucaccucauccucgcaacaaccccauguagaagggguucuuauuuuccccauuuuacagagaagaaaaaccuacuuauggaguaccuuuccuguacaggugcauaaugaaauauggaaaagauauucaaaacaaguuuuuaaaacuuuaaaagacauagaggagauggucauaauauaaguuaaaaaaaaaaacaugucaaaaacaaaaccaucugaaagcaagacaacaagauguuaagggugacuauugcuaagugucagaaugaugggugauaauuacgggugaucuauauuugaucaauuuuuaguagaggcaggguuuugccauguuggccaggcuggucucaaacuccugaccucaggugauccacccgccuuggccucccaaagugcugggauuacaggugugagccacggcgcccagccugcacccaugcuuuuguccaaaguccuagucaucgaccuguuugagaaguggcucccaucagaaacaaguggcccaacugugccacuugaaacucugucucaauaaaaaaggauaguuaguuggaagccuagcuagguggaaggcugguuagaugaaaggguggcuggguggaauaaaauacagaagaaugguugggagaaaaaaacauggaaggguagaaggaaaaacagaagcauaggagaaaggggauauugaggugaaaucaccaggaagaggugagguaauagguccaaggcaacacgauaucaguacaccaaugaggagggaggcuggggacacguccacaguggcaucccaaguucacgccucuaccaugggucauaagccaccauucugugcauguuucaaugugaaagacacucuucaaggagccccuugcccuugagaaggucaccgaguaggagggagagaaauggccaccugaccaagugcuaaacuccacaggagacagaaagcucacaguugucgccuugucuucuccuuuuuuuuuuuuuuuuuuuugagauugggucuugcucugucacccaggcuggagugcaguggcgugaucucgacuuacuacaaccuccaccuccuggguucaagcaauucuucugccucagccuuccgaguagcugggauuacaggcacgugccaccacgcccagcuaauuuuuuuguauuuuuaguagagacgggguuucaccauguugaccaggcuagucuugaacuccugaccuugugauccgcccaccuuggccucccgaagugcugggauuacaggccugagccaccaugcccagcugccuugucuucucuacagggcugccuaucagcaaagcaucaaccuagugaaucucccccauaguacucccugagcuccgaagcuccgagaaaaaguuuucccccaaaggcuccucuccggagugcucagcccugugcuugccuucugaagaugccuucgagaagacuuugguucuggcgguuccuggcagaggagcagccuguugcuggucccacaccgcaccccagugcccagagcuggaagccgauucugccaggagccggccuccugcgccagcaccuccgccaccaggaccugcuccucgucuccuggagcucacugggagccgguucucuucacagagcagccccaugguucuaggaaguggcccugcccagaggcacacacaccguuccugguagcccuggagugucaucaguucucaucaccgcuggcagccgcagccagucacgggguccgugugaaaggagguguucacggggcuugaugucacagcauuauuccuggggcucaccacacccagguggagaugacacacgaaaggagggaagagaaagugaucuccccucaggaucuguaugacucagccucucugcuuguagagacaaagaaacaaaugacggccaagggccuccgugcaugagaaucuccugcaacuaccuucgaccuagaugguaucauccccaugguacagauaaggcgauugaggcuaggacagguucaauaaauagcaggcccgagauucaaccccaggugacucuaaagcccaaaucugacuccugcacagauuucuccaaguucagcauggcccugagccugcuccguuuagacagaagccaugacgggauuccacaggaccagggcagccaggacucuggcggggagucagaccugugugaauaguucgcaggccagcaguggauauuucuguccuaaccucauagcuucuuaugugagguuacugucugugccauguuugccacuuaauuauuuaggaggagcagucuagggucguaggaaggaagcaagcuccaaaaacagagaccagaguucaaguuuggagucagccacggcguaauaugagaaagcugcuucaucuaccugcuguuccucaauagaaggucauggccgguaugaggugggcacccaaauacauuguuccuagucuuucuucaccugccucgcaagauaagaagcccagaccugguuguucuguguguucuaagaauacaacaacacaggcaguugaagagccaagccgacaaucaaaauuguccaaaaugagacagccaacuacagacaagcauaagaagguugugaggaagaaaauacucaauuuaucucacuuaagagugccauuacaaacgagccuucaggccaggugugguggcuuaugcugguaaucccagcacuuugggaagcuaagacgggagaaucacucgagcucuggaguugaagaccagccugggcaacauagcaagacccugucucuacaaaaaguaaacaaauuagucaagcgugguggcacacacccaaagucccagcuauucaggaggcugaggcaggagaaucauuugaacccagaagcucaagguuacaaugagcuaugauagcaccacugcucuccggccuaagcaagacccugucucaaaaaaaaaaaaaaaaaaaaaaaaaaaagaaucuucaaguguaguccacaagagaaaaagaaaaaaaaagaaaccaaguggugacugaaagucacagaacugcuugcuguacauuaguagauuucauaggaaacuacuauaauggccaccaucuaugggccaguugcaguuccagaaauccuuguacaauaaucauuccuuuacagaaaacaggcuugaaauuuuccaucaaaaauagaaaguccacuuugacaucuggccuuuuggccaauauuuaagaugucuguuuucaaaaagugcccauguuaaaacuugucuccauaucacucacaugcauucugcagaagguaaccuaugcccaaaccgaaaccucaagaccaucuuuuauuuauuuauuuauuuauuuauuuauuuauuuauuuauuuugagacagagucucacucugucacccaggcuggagugcaauggcacaauauccgcucacugcaaccuccgccucccagguucaagugauucuccugccucagccucccugguagcugggauuacaggcacccgccaccaugcccggcuaauuuuuguauuuccaauagagacacaaaauacaccauguuguauuucaccauguuggaccggcuggucuuaaacuccugaccucaaaugauccagccgccuuggccucccaaagugccgugauuauaggcaugagccaccacacccagccuaagaccaccuuucuggugacaaguuugaaucuuuggggauuucucacaccaaagaugauaacugaauucagaaucauggaucccugacagcacuccaaagauucugaacauucaacuccauucucuuuauuuccuuaacucacauuuccucucuucucaacccagaguuuaacuucaucacacuccaccauacgaaucagagcacuuugaagacucauuugaagacgguuucaacucacaaaagaaaacacaaaugauuuaauauccauucauucauucgaccaauauuuaugaaacuucucccaagugccaggcaaugccaggagaggggagaacaugaggguaaaaaagcaauaaacaaugucagaaaauguggaugcuccucccuuucuguaccuaauuguuuuugcuuuguuuuguuuuguuuuuugaggcagucucacucuguggccuagacugagugcaguggugugaucacugcacacugcagcuuccaacuccagagcucaaccaauucucccaucuccuccucuuucaccuacugaguagcugggacuauaggcacacaccaccaugcccagcuaauuuuuuauuuuuuguagagaugggaccucacuaugcuguccaggcuagucucaaacuccuggacauacuccauccuccugccucagccucuaaaagugcugggauuacaggcaggagccaccaugccccagccugucccuaacuguugagagucccugggggaaccgagcugccucuucuuauaaccaagucaucaagagcccaaaagaggucuuauucaucucaguaucccagaacaauguaggcacaugguaagcacucucggauuauuauuauauuacuauuauuauuauuuuuuaggcagaguccugcuccguaucccaggguggaguacaguggcacaauguuggcucacugcaacuucuuccucccauguucaagcaauucuccugccucagcaucucgaguagcugggauuacaggugccugccaccacgcucagcuaauuuuugcauuuuuagcagagacaggguuucgccauguuggccaggcuggucucgaacuucugaccucaagcaauccaccugccucggccucccaaagugcuggaauuacaggcaugagccaccucgcccagcccucggauuauuuuagcuucagcuucaguaacuaauauaucaaaugggaugacacaaggauggaagguuucccuccucaccccaggcauagcgguuaggagagcacucuaggccuaaauguuagccuugcuccugacuggcuguguagccaggaccaguuacugugacucucuaaaccuuaauuuccuuaucuauugaauggggauaaugacaauacuccacugucauuuacuuauuuagucuucaacaaaaacuccauuuuaguccucaacaagaauuccauugaguuaauauagcuggcuggggcugggcgugguagcucacgccuguaaucccagcacuuuggaaggccgaggcaggaggaucaccugaggucgggaguucgagaccagccugaccaacauggagaaaccccgucucuaucaaaaauacaaaauuagcugggcgugguggcaggugccuguaaucccagcuacuugggaggcugagacaggagaaucacuugaaccugggaggcggagguuacagugagccaaguucaugccauugcacuccagagcaagacuccgucucaaaaaaaaaaaagaaaaaaaaauauauacguauguacagcuggcuggaagcacuuagaguccuaggccugccacgcagugucuauaaaagccuucccaggacacccaaccaccuuucccagccaccccagcauacccccuaagcccuacacaucacaugccccaucaaagcucuccacacaccaaaaggacacucauccuuucgucuacacauuggguagagggcagguauggaaauucuuccuuucagagaagagggaugcccacucucauuuuucuagaaacagaguccucaaguuucuugcucuacuuuugauaaagauguaggcacaagaaauauuucucaucucucuuuucuaaaagaauaacaacggaaugaacuugaauauaaauggcaacgucagguggccuggucagggaggggcgagauuauggagaagggaguggggcaugaccaggggacgcugcuugugggcucuggccagggcggcugcacagguguggggcccccaccccuaccggccacaccuuucaugccuccgcuccucagaagggaagccagacauuuucauuuucacacgaggucuauccauuuucacagguuagugauuaguucaaaggauacuuguuccaaacacaggcccaagagaaacgcuguccugagcaaccucgcugguggggguucccgcucagucugcugaggccugacaugacgggaguucaccgggaaaggugcucuccagucucuccuggggaguguguuaugaaugcagauuccaauccccucacccacuugucucccuucccgggagagagaaggggcuacacuuuagaaacacugcucuaguccagugucugccagggccagcagaaaugucccccccaaagccaccugacuaaaggagggugaagcuggaaccugaacccuagaggguuucucuaaggccagaagacacuuuacagcgucaacaaggguuuccccuuggggucagcgagccauccaauuuccgcacaccgggacccauucccaucccccaagcuccagacacuaacccuuagggguccuuacagccaaggcccccagcugcuucuccauccaccucagcgaugaaaucccucagggcuucaccggcucaauccacagugacagcaggacuccuaagaacacuuuuguuuccccuuaauaguuggcuuccugcacugcagacagcuaugguccuuagggaagauuccagcagccacgugggagaaagagagacagagagagaggagagaaacuuaacuugaaucggguaguuuaaaauaguaaacugagucagacaggucuggggucaaaucccagacaugcugcuuucuaacucugugccucugagucaguaucuucuccuacuacaccuucaguuucuucaaccgugaaauggguauaaggacagcaucagcaucuuugggucaggacaagaauucacaaccucagugcacacugagcaugcuacccugugccaauggauaaaugguauuccugcuccugcuucuucaugguauugcguagauucucaaggucauuucaagacacucacaaaauacgaagacgcaggagauguguaugcucuuccuguggcccugccaggacacgcgacccagcccucuccucccgaaaucuugccugguucacuccugccuggacuugcugaaucauugcccuggcugcuuuccuguaacucggcugcugacuugaacugaacucuucgaugcuggauccuguaaggcggaccgagauugaggaauguaucucugaaugccuggcauccagccacaguucuguaaaaugaccagggcgcgaaagaccuagagugucucucuggcaucagagagggucacaugacaauuugggaccccuuuaaaugcucugagggacaggaaagcccaggagggucccacaaggcacucacuguccaguccagggcugcacugugacucagaggccucacugcugagcgaugacucagcggcccagcgcagagccagggcagccaugagcaagccccugagcugccuccaggagcagggggucuugugccaggcaggccgggcucgagucagcccagaggaaugcccccugcccuccgccugugcccacugccggagacuuacgcagcuggcaucccagcagugcuacaugaucuaccugucccugcgccaggguaaacaggcaaaacaggagcccugcuucccggcugccgcaggggugaggccugccuacggagggcaaggccaugcuagaucggaggagggugggcggccuuggggcaggaaauggcugggauaccagcaggccuccuugccaggcugaaacaaguuggcacguggggcugggggcagaggagccgggaagagaaaacgccguacagaaagggcaggacagagcaagggccacgggaugggggcggggguaaaggaagggucagugaaaagcugggauguaaacaaugcuauaagaugcucguagacuuaaaaagcaucgugccccgccuuucuucucucuuuauucacuuuuuuuuuuugagacaguguuuuuuuguuuuguuuuguuuuuguuucuuguuuuuuguuuugagacaggcuagaguagagcagcacaaucuuggcucauuacagucucugccucccagguuggagcgauucuccugccucagccuccugaguagcugggauuacaggcacccaccaccacacccaacugauuuuuguauuuuuaguacagacaggguuucaccauguugcccagguuggucucgaacuccugaccucaggugaucccccagcuuugaucucccaaagugcugggauuacaggcucgagccaucacgcauggcuccucucauucacuuuuaaagcucaguuacgaccacgugcccaacauucaggucacaccacaccccuauggaaaggcucugcugccucaacuggacugagcuaaagaggccccucaaacucacucguggggggccuccacugcugccagcccuuaggucaaccugaaccuccaccagcagaaucucccucagcccauuccauuucuucucucaaaauccuaugcugcucacguuccaccucuuccaggaagccuuccuagaguugcaggagucacuuuccccggccuccugcuggguaugguucuuucacgauugcauuauaggaauucucugggaggcuauaucuugucuccucacuugaagcccuggccugggaagacucgcuguccuucuaccauguacuucaaggcuccacccacagcugaucuuguccaugggagaugcucgauaaacuuaugccagcugggacuuucccugaucugaaaucuguaugucgugagagagaaccuugucuguucucucagcaaccacuaugccagccaaagucacacucagccacuguuuccugagucucucuccacgucagcuggacccagugcaaggcgccacagaggcagugaggaccaaguccucugggccuaccucgagggccccacugucuaagccagaucaucagaacaugucauaacguguguccagaaccuagagaacagcggguaccaggcugcuguguggauggagagggaggagggcugggcaggcuucuugaauaguaauaaaggaccaauaacaucagcucacauuuauugagcucuuagugugugccaagggcuuaaccugccuuaauccugauagcaaucuugccaggaagccaggcacuguaccauucacuuuacauauguuaacucauucaaacaccaacccuacgaaauagauacuguuaaaaucuccuauuucacacaagaggaugcugagagccagaaaggucaauaucauacaacaucacacagguggauucaaaccccagcaggcuagaggcagagucgacgcacugaccacuucaccucacugccucucugccucaaggcauccaagcaggagaaugacuugcccagaagaguuuggaugacuugcccaagguccuaagcuuacucaugacaaggagagucaccagcucgcuaaacauccaagugucucuccaacaggcucccacaggcuucagcauuagcgcaaugcagcuuucugacgccaggcucugccuuggaagcugcugaucaugcugucuuccagcuguagucacugcugcuacaguuuggaaucccacacaaaguaaacacaauucaucacagcaauuacugcagugacucaguuccaggaauucuguaaccagaaaucgaggcagcuccccaacugcugcugagccuggguaugggcuacccagagucaccuauggucagccaacaggccaguuuggcuccagaucacccuuguaaagugcuggcugagcugcagcccuuggagaucuagagaugaguccucacuucagggucaucacucacuucccaccuaggaaggcaagaacagagacugugagcauggcguggcaaccggucuagagaaugugacagguuucuccaaugaaccaguccggagcagcaggggccacagagcacagagcccccagaaagaccccuuaucccaaccucacuccugcauggagaaaccauggcuagagucuccacagccugcaucaugaugaaucagcgccuggcucacgucucaucucugagacucuggaccccaggugcagauucacccuccugaaaggcugggaugaaaugacucccgcugcuugccaaggagagguuacuccugcagugacucagucucugaccucacaguggaggcagaagaggccacauccagagaauggcuguguccgugcagcauggauuacagaccaauuggugcuaggcucugggcuggguguuuugcuacaucaucucacuugcucaccaaaagccugcaaagcccacacuauuauccucaggguacagaugagggccaugggcggggguggcucaaaggaguuaaacaaccaggucacacugcuuggaacugaauuugcauuagaaacucaagauucucuaauuccauggcccuuguucuuaccaugcacacacagugcaccccaaagaaagggggaaacaaaaaccucagaagagcacccacuccaaacgaauacaucaauuagggugacacuuauagagcaggccaugugacaaacaagccagcaaaugacucacaacacccggauucaccacccaccugccaaaguuuauauuuaaaauugaguuuccuucauccccaguuuuauuguuucguuuugauuuguucugaauuccuguuuuaauauaaaaugcuuaaaaaugcuuagaaaucuuuucauaacuacauuuuaucuuuuuuuauuuuuuuuuaauuuuuuuuuuugagacagagucucccucuaucacccaaaguggagugcuauggcacgaucuuggcucauugcaaucuccagcuccuggguucaagugauucuccugccucagccuccccaguagcuggaauuacaggcgcccaccuacuuuuuguauuuuuaguagaggcgggguuuugccauguuggccaggcuggucuugaacuccugaccucaggugauccacccacuucagccucccaaacugcugggauuacaggcgugagccaccgcuccugaucacaacuacauguucuuaacuuaaaaaggcacugugacauuauuuccacaguuacccaaucagugagucuacauaaaaaaugaaagaauaaaauucacaucaaucuuacuuguuuaaucccaugugcagacaccaauuaugucaggcaaagucgcuauucuuaacaucugcaaagcuggcugugcauggguccacaccaucacugugucuuacuauacaaaccacagugcucugugguaugaaaucuacaccaaucauuuucaucauuaauuaucuucuuuaggauaccugaaccagggccguggcaucauaaccaaaagugcaaacaugugcccccaacagaugcugguggccugaguuuccagucagguuuccaauguguaucaaacaagccacagagauuacaaaucuuuuccaaaauaaagguuccuuuuccaggccaaaguacuacucccugauaaccuauguuguaaaccagaccgaccgcuagguccucuuaaagggaggcacaccuuugccuaacugcccuagggugggugguauagaaagcagcacucucucaaauggccuuuaaggaaguuucuagucccucagggucccucacuccccucacauacccacaggcucacacacauguaguuacaggcuguguacccaugcauaugcaagcaggagcacacauacacauauguacaggcugugcacccaugcacgugcacacaggagcacaaauacacauauguacaggcugugcacccacgcacgugcacgcaggagcacacacacacauauguacaggcugugcacccacgcacgugcacgcaggagcacacacacacauauguacaggcugugcacccacgcacgugcacgcaggagcacacacacacauauguacaggcugugcacccacgcacgugcacgcaggggcacacacacacauauguacaggcugugcacccacgcacgugcacgcaggggcacacacacacauauguacaggcugugcacccacgcacgugcacgcaggggcacacacacacauauguacaggcugugcacccaugcacgugcacgcaggggcacacacacacauauguacaggcugugcacccaugcacaugcacgcagucuuucucuuuucuuauuuucaagugucccugauucuuauuccaccucuuuuuaccucgauggcauaacuaggagugugaaugauagcuaccacuucauaggaacggcaaggcccuaggaguuuuucauaggauccuaccuuuaucugauugaaaaccagucuuuccaccuccugggaacaccuuguuucgaaagcugggccaagcugcaaguucugccuaauccucaauaaguggaagccuaugaggguccccagagcuguuuuucacccaugguuuacuuccacuuugucaccaaacugcucugacccugucuuagaggcacugaaaagguaaaggucucccaaggccuaaggaaaagaacagaaaacagccucagccagggucugccagccuaaaaccuccaggauccccaggccggcauuaucugccaccuacucucuaacccccuucccuugucuuuggcaaacucacuaaaugaacacacacucuuccuacugagccagggcaccauaaggcucucagcagccacccaaccaaucaggguuggcacagagaaagagacuagcuggcauccccuucccagcaauucagcaucacacaggagagccccugggaucugacucccagcugugucuccaaccccaccucccuucagcgugguccacaccaugcccuggggagggcuucaguccucucuaggccuggaccuccuccccuaaggcccagcaauaucucagagggccuuuccacacuaugcaagcaucauguccucugccaggcuguaccaguaccacccugagcacaacuguucccacagcccuuuauuggagcacuaggggugguggucaccagcuuuuccaguuuugaggaguauuggucaaauuuguuggccuuuuuuguuuguuuguuuguuuuuuaucugagacggaguuucggucuuguugcccaggcuggagugcaauggcgcgaucucagcucacugcaaccucugccucccggguucaagcgauucuccugccucagccucccaaguagcugggauuacaggcaugugccaccacgcccggcuaauuuuguauuuuuaguagggaugggguuucuccauguuggucaggcuggucuugaacucccgaccucaggugauccgcccaccucagccucccaaagugcugggauuacaggcgugagccacugcgcccagccaaauuugugguuuuggagagaugaggucuugcuauguugcccaggcuggccucgaauuccugggcucaagcaacccccugccucagccuccccaguagcugagacuacaggcacaugccaccacaccuggcuuuggucagguguauuauagggauaugcaaccgggauuuauaucagucgcgugaauagaacauaaccuugacaugugauaagaacugacguuuuaccucuggggucucccuccuaaaaaugcauaaccccagccuaaucaugacaagguuauaaacuuuuuaaauuaaauguaugauagauaauauacucaauguuugagcugcucccgauuucaauauauucaugcuucaaaauucaaaugauacccaaagauacgcaaucaagagucuccuucauagucugagguugcagcaagcuaugaucacaccacugcacuccagccugggccacagagugaaaccuuaucucugaaaagaaaaaaaaaaucuucuucaugcaucuuccucccuaacccagucuccccucccugcaucucccuccucccaccacgcacaggccaccacuuguguugguuuccugugcauccuaacagaguuugugcaaagacacauuuuuacauccccucuacacccaugcuuuuuuuuuacagaaaagauggcaugccauacuccccgcuccacauugugcuuuuugugucaacaauacauccugagaucuccccguguuugugcacacagcacuuccuuauuccuuuccgcaucuugccuagcacaaugugucaucauuugccagucuucaacucacagauguuugaguuacucccagucuuuugcuuuuauaaaaauguuccaugaauaaccuugggcacuguucuuuuccuacaaauaucuauagguuaucucuguaggggaaauaucccaaugucccaacaugagauggccaggucaaagggcacaugcuuuuguaguuuggauagagaaugccaaaaggccauaauucuucccaaagggccacauccacuugcauuccguccagcaacacagcuuuugccaacaacagagcgcaucaacaacauguguauuauacaacguugguauuuuuuaucuguauuuccuuuuuuaggauuggguagagcaacuuaucaaagugucauuuggggccaagaguucgacuauccuggccaacauggugaaacccugucucuacuaaaaguacaaaaauuagccaggugugguggugggcgccuauaauccuagccacuccagaggcugaggcaggagaauugcuugaaccugggaagcggagguugcagugagcugagaucucaccacugcacuccagccugggcaacaaagcaauacuccaucucaacaacaacaacaacaacaaaaaaaaaaaaaaaaaaaaaaggccaugugcaauggcucacgcuuguaaucccagcacuuugggaggccgaggugggcggaucaccugaggacaggaguucaagaccagccugucccaaauggcgaaaccccaucucuaccaaaaauacaaaaaaaaaaaaaauuugcugggugugguggcaggcaccuguaaucccagcuacuugggagggugaggcaggagaaucgcuugaauccggaaggcagagguugcagugagccgagauugcgccacugcacuccagccugggcaacaucucaaaaaaaaagagaguaccauuuggggccccuuuccugugagcugucuuuauauugugcagacccauuucccacacagcuaucagcuacaccagcugccacucggccaugagcuagucuccguggguggugggugcaacuuggaaacacacggcacaggcuccagucaucagggaguugauccaggagaaugcucacauguaaaggaaggcuucagccugagggaacaugcaguaggaaugcaaggguaagagcaaggaucauucuagaaaggaaaagcucacuuaggaaaugugauuaaccacggccuccaaguacuaccugcuccuuggagagagaggagaccaggaaaggugccccacacagguaauccuguuuaguagggagauaaggccaaagacaccauggacacccaccagggacucaacaaaagccaaguaaccgggucuuaccgugaaaaaauggagaacucucccaccuguucuuucuuuccauucuacugacauuuccagacugguuacuuuguucacuuuuauuaccacuuaguucaguagcucuuaaagcuccagucaccugaagagcccuuacaaagcacaugugcagcccuggagggguccacgaugugugcuugggaaaggcuccagggugagugauucucauggguaucucugauaaaggacuaccacccagcucagggcugacagggccagcacagccuuccugggaccccgcuaagaacagaccuuucaaagugugggugggaugugacagagaagcuaagacaaauaggagugaccuuuccgccgaguuuuguucaagugagagagaaaaaucgccagugucagagagauguccaccuuggaaaucucuuuugaacacaaaauccucgccaggccuggaggcuguggaugggaaaacaggacacucuguucugcaauuaucucaggucuacuaagaauucuucccaagaccagagacacccugggcaguucaucugcauaucuaauguauuauuuaugccccugccggcuuccagaaugcucugggucauaucacuugcauaaucccauccgguagguggaagacaauaauguugagucugcuauauaaguauguuuggggucaaggacuagcauucuuaaguuccuagacucacacaguauuuuuggcuagccauucuucucuguuucagcguacgaugggucuaggcuuucaaaugcuucaaauacuguuaaacuuccuccuccuccccacuuucacccucuccccucugucccagccaguccaccagagagccauuccuguaucuugggcaugacuccuugaaagccaugaggaucucccucuucuauagggacuugagaaaacacucuucauuuaggccauucaugcaacaauaaucuagauccaagcucaguccccagcuccucacucugaccauuagcuccaaggaaacaagccaccucagcccccacaaugaagccagugcuuuaggcaggcccccagugccaucccucgucacaacacacaccuuauuucucagauuuuauacccugcaaagggcuaaauucuaaacacaccucauuuaagaaaccuuuccccacuacuacaaccaacaccccccacacauaaaacaccugcuagguuccaggcgcugucccaggcagugagaugcauguaaaacacaccuccggccgggcgugguagcucacgccuguaaucccagcacuuugggaggccgaggcagguggaucacgaggucaggagaucgagaccauccuggcuaacacagugaaaccccgucucuacuaaaaauacagaaaauuaaccaggcgugguggugggcgccuguaguuccagcuacucgggaggcugaggcaggagaauggcaugaacccaggaggcggagcuugcagugagccgagaucgugccacugcacuccagccugggcaacagagugagacuccaucuuaaaaacaaacaaaaaaacaaaaacaaaacaaaaaaaaaacacaccuccauuccuacccaagaaguucagucgaguggaugagacaggaauucugaugcaagaggaugaaaagggcucuguucacaguuaacacagggaucucuggcagccuauucuaaagauuggaagucagggagaacuuccugggggagguggcaugaguugcaucuuuaggaagcaaagaagauuaaaagguuacaaguuguuguguggguuguagaggaauggguggagacaagcugaguuucuaaggccucaugggcaagggacagaaggacaacaaacugugugaaacauacccacccaagagcacggaugcacaaauaaagguggucuuggcucugcccacugcuucacacuugucauuucagacccauuaugaggcugcaaucaggacugggcggcuuuucucauucacgagagggcacuacauucugcuaacucaugcaaagagacccuuuuaauaauguagacaugccaggagaucaagaccauccuggcuaacacggugaaaccccaacucuacuaaaaauacaaaaaaaauuagccgggcaugguggugggcgccuguagucccagcuacucaggaggcugaggcaggagaacggcaugaacccgggaggcagagcuugcagugagccgagauugcgccacugcacuacagccugggugacagagcaagacuccgucucaaaaaaaaaauaauaauaauguagacaugcaucaauaauucagaggcuaggaggcuccccagagaaaccaugaagaauaucaacaauccccugccacaggacuuagcagcuuuggaaggcaucguccaagcagccacucuggaaagaaaggugcuucucucaagcaaucuguacaaagcucccugugaacacaucacaucuagucugcccaggaagacaagggauucccaccuccuauuaaaaaaacagccaaacaggccaggcgugguggcucacgccuguaaucccagcacuuugggaggccggagaggguggaucacaaggucaggagaucgagacccuccuggcuaacauggugaaaccgcgucuccacuaaaaauacaaaaaaaaauuagccggucgugguggcgggcgccuguagucccagcuacucaagaggcugaggcaggagaauggcgugaacccgggaagcggagcuuacagugagccgagaccgcgccacugcacuccagccugggcaacugagcaagacuccaucucuaaaaaaauaaaaacagccaaacaggcaucucucaagagcuguuugauuuacaaaaacuuggcaaggauaaaccucuuccaaccauauuaccuguuuuguuguuuguuuguuuuuugagacagagucucgcucuguugcgcaagcuggagugcaguggcaugaucccagcucaccgcaaccuccaccucccggguucaagcaguucccuccugaguagcugggauuacaggcaugcaccaucacacucagcuaauuuuuguauuuuuaguagaaaugggguuuugccauguugcccagguuggucucgaacuccugaccucaagugauccacccgccucagccucccaaagugcugagauuacaggcacgagccaccgugcccagcccauaucacuauuuuuauccucagaaccugugugguagguagggucccaucugucacuucuguagaccaggaaacuggggcucuugccuauuggucauacauucagaagacuccagagaggguauugugaccuggccuucuagcccuaugcuacuugcucucuacuauacgaacucuaggaaguuggguacuaggcaaucuguuaaggccaccucauucaacccccuuugagagccggcacaggagcugagggccucugugacuuggugacccaucucacucagaugcuaucucuugaaauugauuaauuggcucagggaugaaaaggucucuucugaagcaagagggaggguuggugcacagugaucacuucauuauuggcccugucucacccucuuuggaggaguggacagaugacccuccaagacggcugggucuuggagagacucggccuuucuguggaguccagaguugcuacuugggaauggggagacaaaaaauucaacacaggccaugcacaguggcucacaccuuuaaucucaacucgcugggaggcugaggugguaggauugcuugaagccaggaguucaagaccagccugagcaacaaagagagacccuaucucuacaaaaaaaauuuaaauuaaaaaaaaaauagccuggugcgguagcgcacaccuguauucccagcuauucaggaagcugaggcaagaggaucacuggaucccaggaguugaaaccugcagugagauaugauuguacuucugcacuccagccugggugauggagcaaaauucuuucuuaaaaaaaaaaaaaaaauccagagcaguuccacaaaagagcaaagccguuuuccaguuuuugucuuaaaaacucuaaauugacuuaaaaaaaauuuaaagaggaaagcauuaaauccauggauucaaaaaacuauuucugcaaaaguuuaaaugggccauacaacuuuuaaaaauaagauaacaaaauauauauaaauaaaaaauauaauaacaaauauaaauaaauaauaauuuuaaaauaacaacuuuagccaggcgcaguggcucacgccuguaauccaagcacuuugggaggccgaggaggguggaucacaaggucaggaguucaagaccagccuggccaacacggugaaaccccgucucuacuaaaaagacagaaauuagcuggggguaguggcgcacaccuguggucccagcuacuugggaggcugaggcaugagaaucacuugaaccugggaggcagagguugcagugagccaagauugugccacugcacuccagccugggugacagagugagacugucucagaaagaagaaaaaaaaaagcagauguguagcuccugggucagaugaugaggcacaaaauugcaucugugaugagaaguacaccaagucuggggucaagacuuggaugcuaccacagaucuuaccucagccauggcauuuagccucuugcugucuaauuucaccuccuauaaaauggagcuaauaagccacaugugguggcucacgccuauaaucucgcugaagugggcagaucacuugaggucaggaguucaagaccagacuggccaacauggcaaaacccccucucuacuaaaaauacaaaaauuagccaagcgugguggugcaugccuguaaucccagcuacuugagaggcugaggcgggaagaucacuugaaccugggaggugaagguugcagugagccaagauggcacuacugcacuccagccugggugauagagcaagacugucucaagaaaaauaaaaaaauaaaauaaaauaaauggggcuaauaguaccuaccuccccuuccuucaggccaacaagagguggaugaagaucuaacccugagcugaaagggaaucugcugaacagguacuaugugccaggcacaugccaagcgcuucuugccuuacucucaaaugcccucugauguauacuuuccccauuuuacaggacugaggacucaaagacagcaagcauuguuucccaaaccaucgauucccggagcaagcuuuggggcacacaaaggugaaaaagagguugcugccugcaguggguuuccagaugacuuggugccuuggucacagcagcagaaccugacagaacuggaagcugucugaacagccgcuuccuucuucauucgccaucccacucaaguguguucucccuccccugggcauccuaagagaaccagcucauuaaaagagacuuggcuguagcguggccugagaagauacuggccaacuuuucauucccugguuggacaggaccagcuuccugcaugggcaggaccaguucggugccacccucuuaggggaacaaauccagacaagaaagcuuuuguguguccagcucugcggaagcacagcuaggagaguggcaggguccccaaggccaggagccggucccaccaagguguggccagggcugccagcacaggucuccucccuuuuggagccagucucccggcaucccacacuauuuuaaggccuuuggagauccaaacaggauucaagccuugcccaggacggccuguaaaaguuuuccacuggaacaaagauuuaaaugcuguaacucaaaacaugacuuuacaaugggcucugauuaucaaacguuccagaauauccucuuuugagacacugcuccuuucucuuuccugucauuuacaggcuggcuggcaugaggcacguagucuggacugggcagacgucuccucugaagacauuggaggaaagggccuuuuccuccucagcacucauccugagaaagggagaggaaggggugacuguucacaccuagcauagagaaagacguucuccugauggcaguggccgugaugcacacaucugcucaaacccuccacuggcuuccugcuccuuccgaagaaagccaaaggcccuguguaguguggaccccggccucucugacuucaccuucuacccccuuuaccugcucacuccucuccagccauugggacuuggguauucucuaguuccccucccucccgacucaauccauugucugcucugugccaagaagcagaugccugugggcuccaagaacagcuccccagugcacuggccaucaacuguguuuagccaaugggaggcaccagcaggaggucagagggcagaagaagggagaguucacagcaggagugacaggucccucuccacauggcagcggcuggguaccccacacugcagccaauccuccccagcccuggcaacacuguaccacccccaugauccauguuggcuccuuaaccuucucugacaccuucccuaacaccucuguccacagucucuuccuuaaaccucccuuccucagcugagccauuagacccugacugaugcacgggcucaugacccaucuggguguuucguaugcccucugccugccuuauuaucuggcuucaagucccagcucuuuuuuuaauuauuuuauuuauuuuuuuuuauuuuuuuuuucauuuuuuuuuuauuuuuuauuuuugagauaggaucucacucucucacccaggcuggagugcaguggcacaaucacggcucacugcaggcuugaccucccaggcucaagccauccuuccacuucagccuucugggcagcugggaccacaagucuaugccaccaugcccggcuaauuuuuuuauaauuuugguagagguagggucucccucuguugcccaggcuggucucaaacuccucuccugaagugauccuauuccccuuggacucccaaagugcuggaauuacaggcacgagccacugcacccagcccgccuuuuauuauaugggugaccuugggccaaguuagucaauuucuugccacagcuccuucaucuguaaaauggggugaugauaauaggacagucacacguugcuuaaggguagagauacauucugagaaaugcggcguuaggcaauuucguugugcgaacauuacagagggaguuuguacaaaacuagaugacagccuacucacuacacaucuggacuauaugguacagccuacugcuucuaggcugcaguccugaauggcauguuacuguacugaacaucggagucaacuuaauacaauggugagcauuuguguaucuaaucauaucuaaacauagaagaaguacaguaaaaauacuguauuauaaucucauagggccaccguuguauauacgguccauugcugauccacacaucauuaugugguacaugacuguacuuagaacauaggguuauaacgaagaugaaaugagcuaauugaugaaaagcaccuagaauagugucuggcacauaguaguaaacaauaaauagaagcuaccauuauuauuuauuacuaucaucagagucaggcucacucuguugaccagguuggaguccaguggcaccaucucgacucacugaaacuuccaccucccgaguucaagugauucuccuguuucagcuuccugaguagcugggauuacaggugccugccagcacacccagcuaaguuuuguauuuuuaguagaaacgggguuucaccauguuggccaggcuggucuugaacuccugaccucagguaauccacucgccucagccucccaaaaugcuggaauuacaggcaugaaccaccgcaccuggcuagaccuuguuuuugaccccauaggguuuacuugauauuccuccaaaugacaaaccuuuaaacuacagauucccaacaauucugagcacagguuccauuaccaguaucuguccauagccuugcaagacaaguacuuuaggaaggacaaccucacucugcagcaaauugugaugugauauauaaucagauauuacauauacacauauauuuuuaaaauucauaaaugagaccaggugcagugguucaugccuguaauuccagcacuuugggaggccgagguggguggaucaccugagguugggaguucgagaccagccugacuaacacagagaaaccccaucccuacuaaaaauacaaaauuagccgggcaugguggcgcaugccuguaaucccagcuauucaggaggcugaggcaggagaaucacuugaacccaggagguggagguugcagugagccgagauugcaccacugcacuccggccugggcaacaagagugaaacuccgccucaaaaaaaaaaaaaaaaucauaaauaaucacaccccuuuagagcuacaacugauauucucuaccccacaaaaaucuaagucaaggaagcaguacauaggcugaucauaccugacaacacaaaagaguaugaacacugggacagaauuccaaauccuagccaugagcuggggcaaguuccuccccuggcuccguuuccccaucgcuaaacaauacucaucuucucugcuucauagggucacuuuguaacuaacaacugaaagggaugaccauuuagccuggcacacaggagggccucaaucaauauuaguuccuuuuuucucuuuaauaaaacaaaguaauugacauagaaaacucaggaaauuauauaggaauaauauacucuaauguuaucuacagccuccgaaaaacaauaaaucaagggaauuuuucaaaaguacauuuuccaagugcaaugguucaugaagccauuaugagguuuccgaauuuccccuuaauuuccgguauucaaaaaaaaaaaaacaacaacaaaaaacgcuucagugauacaaugccaguggcagcagcugaggcccacccccggccuucuuuuuuccuuuuacagguugaaagguguugcaugaagccugcagcccggccagaaagacuucagcuggauggaaggcgagcccauggccucuucucuugcaugugguguucccagccagagacccaagcgucuaucucuacagucagcccacccauggcccuucucuggggacuaggugauaauuauggcugaaggggcguggggguguuugucagucaugaacaagauuccaaagagcgcugccacuucccagacaaauaacagacccucagggggccuggcuuauggucccaugggcuagaauccauauccucaggugugggacaggccagugaaguccaacuguaaccagaaccacucauguccacugcccaucaccuagaggauuucaucacaccuggcaugggugugaaauggggaguuugaaaacagagagcaggugggggacucccggcccagcagccccucucggugcagugcaggcgccaagcguguggacucugaagccauaugcccagguaugaaucuaggcuuucuugcucgcugacugugggccaaguuucuuauuguaauacucugugccucaguccucuccucuguaacauggagacaacuguggaaacuaaaugacguaaugcacuuaaagcagugccuguaacacacuguaagcacucuuuuacguucuuauuuuauuauuagcagucagaguuauugccauuaccuccagccucuggaucugcccaguucuggccagcuccaacaaggacauuccauuuucuuccaccauggaggggcuucacugcagucacuccaaaauuuagacuacaugguucagccuugaccuaacccucugcagccuguauacaagcauuugcucaccuuucauagaaaaaauagcuaaugcaugcugggcuuaauaacuaggugauggguugauaggugcagcaaaccaccauggcacacguuuaccuaugcaacaaaucugcacauccugcacauguaccucggaauguaaaauaaaaauuaaaauuaauuuuaaaaaaagaauauguaugaaccacccacugagugucagacaacacagaguucaaggacaaagucaguuucuuuucucuaggggaggagucacaccaaaaucaaagagccaaauaauuuaauaaauuuuuuuuacagacuaugacuggugccacagugaaauucagcagcauccagugaugagaaauggagguuagggaaugagucuauuagaagggguggucugaggaggugauauugaaguuaggaugagaaucagcuuuucaacaagcuggggaaaaagcauucuaggaucugggaccagcaagugcaaagguccuguggugcccagggaagggugucagggaacugaucaaagaccaggauguggggcuacagagggagggaccacuugaugaggcuggaagacacuaguguucacaaaauaacuccgugaauacuaaacaaucuuaggccugcauagucuaucuaacaaaugaauucuauuuaccucauccaauugugugugauuccaaccucuucuugacuaccucuagugauggagaacucacucacugcaauuucagagaaugcucauucacucgaucaacaggaacaggcugcucaggauuucaaaaaagucaggagauacaaugggaagccuggagauaggguuuuuguggagguuuuuuguuuguuuguuuguacuuuaaguucugggauacauguacagaacacgcagguuuguuacauagauaugcgugugccauggugguuugcugcacccaucaacccaucuucuagguuuuaagccccgcaugcacuggguauuucuccuaaugccaucccuccccuugccccccaucccccaacaggccccagugugugauguuccccucccuguguccauauguucucauuguucaacucccacuucugaaugagaacaugcuguguuugguuuuucguuccuguguuaauuugcugagaaugaugguuuccagcuucauccaagucccugcaaaggacaugaaugcauucuuuuuuauggcugcauaguauuccaugguguauaugugccacauuuucuuuauccagucuaucagugaugggcauuuggguugguuccaggucuuugcuauuguaaaaagugcugcuauaaacauauaugugcaugugucuuuauaguagaaugauuuauaaucuuuuggguauauacccaguaauuggauugcugggucaaaugguauuucugguucuagauccuugaggaaucaccccacugucuuccacaaugguugaacuaauuuacauucccaccaacaguguaaaagcgucccuauuucuccacauccucuccagcaucuguuguucccugacuuuuuaaugaucaccauucuaacuggcaugagaugguaucucauugugguuuugauugcauuucucuaaugaccaguaaugaugaguuguuuuuuguuuucuguuuuucauuuguuuguuggccauauaaaugucuucuuuugagaagugucuguucacauccuuugcccacuuuuugaugggguuuuuguuuguuuguuuguuuguuuuuuccccuguaaauuuaaguucuuuguagauucugaauauuagccauuggucagauggauagauugcaaaaauuuucucccauucuguagguuccuuguugacucugauaguaguuucuuuugcugugcagaagcccuuuaguuuaauuagaucccauuugucaauucuggcuuuuguugccauugcuuuugguguuuuagucaugaagucuuugcccaugccuauguccugaaugguguugccuagguuuucaucuaggguuuuuaugguuuuaggucuuauguuuaagccuuuaauccaucuugaguuaauuuuuguauaagguauaaggaagggguccaguuucaguuuucuacauauggcuagccgguuuuccugacaccauuauuaaauagggaauucuuuccccauugcuuguuuuugucagguuugucaaaguucagaugguuguagaugugugguauuauuucugaggccuccauucuguuccauuggucuauaucucuguuuugguacuaguaucaugcuguuuuggcuacuguagccuugugguauaguuugaaguuuaagguuuuaagcagacucagugaacucugcuaguuaauaaguguaggugagguuguaagcaggccacaguggaagcagagggcccaaguagaagauauuaccuaugggcagggaggaacaaugguuccuaugggaagacuuugcuuaaagugagauacaaggucgucaacuucagugucaccugugagcuuguuagauccaauucucaggccucauccuaagucucuagggagggguccagcugucuggguuucaacaagcccuucuggugauucugacuacacuaaaauuugaaaaucacuggacuacaggacugauaauauuaacuagaaaacaauggugucccccaggaauggcuucauaucccucuggagccaggcagagccaaugcccucgggccaagacauuaagauccauaaggcaggcuuguaaucccagcacuuugggaggcugaggcagguagaucgcuugaguccaggaguucaagaccagccugggcaacauggugaaaccuugucucuacuaaagauacaaaaauuagcugggcaucauagcaugcaccuguagucccaacuacucggguggcugaggugggaggauuacuuaagcccaggaagcugagguugcagugagauugugccacugcacuccagccugggcgacagagcaagacccugucugggaaaaaaaaaaaaauccauaaagcaguuuucagagaagacucuguccaugggauugauguucacuuaccccggcuaggaccgggcgaggccaagauagagggcaggagagaggagcagcuucaacaucucugcagacaccaucacugcagccacauuccaguuccacagaggaaugcagacaauccucacaauccccagggcagggcaggagguagagaggauuaugaaaugccugcuuguugaccaaaaccuaccuagggaaucucaccgaaucccucaacaacccagaacaguacuauucuguuuacucccuuuggcuccauagggcccaacagauuauggcaauccagaaaggcugagaccagagccccaaguggccaagacaacaagaaaggagccauaauaguguugcccacuguccccuccuauauaucuggggagguggggggagauuccucucaaagguuucuuguuuuguuccagaaugguaagagauacuacuguucauuaaauaacuccaugaauaucagauaaucucagaguuggauaaccuuuuacccaauaccugaauucuauuuaccuuauccaauugugcaagaauuuuuuuuuuuucuuuugaaacagagucucacucugucgcccaggcuggaguggaguggugcgaucucagcucacugcaagcuccgccucccggguucacaccauucuccugccucagccucccaaguagcugggacuacaggcacccgccaccacgcccggcuaauuuuuuguauuuuuaguagagaugggguuucaccauguuagccaggauggucucuaucuccugaccucgugauccgcccgccuuggccucccaaagugcugggauuacaggcgugagccaccacacccggccaugugcaugaauuugaucucuucuugauuaccucuagugacauagaacucacucacuguguuuucagagaaugcuuauuugcuaaaucagucacaaaaccacuugcugaaccaggcaugacauuaaguacuacaguaaaaaugccuguugaugauaccuuaucugucagcagguugacaggcuaucuggaaugcuggguagaauucuaagcugagucugggcucaaaggaagagaaggucaugaucagcuagugaugccugccauggguacccaagagaaaguaacaaguguggcaagcauuugcuaucucugcgugggaauauagagaugucauucagauccucccuucacuggguucacaaucuagcuaagaaaaccaagaaauguagcaaaccacaaaacacugggauguaugccgagauggggguggaggaggggugccugacacauaacucuuacuuuuaagaaacagccugaaaaaaaaacacuugacguuuuuaaguuguggcuuucucaucuguaaaaugggaauaauaccugccugcccugcccagccuuuucugcaaagauguuguuuugagaaucaaaugagcuaauggguagguaaauacuaauggugacauuagccuucaaggaaccuacugaagacacugauuugccuaagcaaagagcaaaaggcaaugaagagagagcagaacgcaagagcagucaccuucauuggucacuggcuuccucuugauugcucccaugaggcgcucuugccaaguuagucaacaaccuccuugaugccaaaucuaacagucacuucugugugacucauucuacccgaccucuuagcaacauugcaagugaugacucuccuccuuccuuaagaaggucuuccuucucuaggcucccggcauguuuuucugccucaccaguggcuccuuguaaucaccuuuuccagcuccccaacuucuaccccuaccacuaguggccaugucuaguccuauguccacuuuucuaucuauacuccacucccauggauuuggaucccaccucugccaaaaucuuccaaaugcuaucuccuaccaugauggucucaauucccagacucacuuugccaaguaccuaguuggcaucuccuguggccauuaaugggcaucugcaauuuaacaugccugcacagaacucucugcgcccacaaucuacugcccaucuuccccguguccauugaagacaccagcaucugccagguugcugaugccaaaaaccuaggagucauucuuuuuuuuuuuuaauuuuuuguagagacaaggucucucuaaguuguccagacuggucuugaacuccugaccucaaacggcccuccugccucagccucuguauuagucaggguucccuggagggacagaacuaauaggagauauauauauauauagagagagagagagagauagauauagauauagauauauacauacacacacacacguauguauauaaagaggaguuuuaucuauauauauauacacacacacacacacacacacguauguauauaaagaggaguuuauuaaauauuaacuuauacgaucacaaggucccacaauagucugucugcaaguuugaggggcaaggagagccaguccaagccucaaaacugaagaacuuggaguccgaugucugagggcaggaagcauccaguaugggagaaagauguaggcuaagaggcuaggccagucuugcauuuucauguuuuucugccugcuuuauauucacuggcagcugauuagauugugcccaccagcuuaagggugggucugccuuccccagcccacugacucaaauguuaaucuccuuuggcaacacccucacagacacaccuggaaacaacacuuugcauccuucaauccaaucaaguugacacucaguauuaaccaucacagccccgcaacgugcuaggacuauaguaggcaugaaccacccagccugacucguaggagucauucuugauucccuuauuuucucaccuccauauccaauccgugugcaaguccuauuggcacaauugcccagauaaauguaaaaucuacguuuuucucuccgcuuucuuugcuaccaccaagacacaggccacaucacucucuccugaaauaaagcaauaugguuuccccaaccccacucccacacccccacauagcaagcuccuugcuuccaucccugccccucuccaccugccaagccaaccacaccucucccuccacuucugcuaucuggcccucguguuccucaaauaaucaggcuugcuccuaucuucuucaagaaaugucuauccauaccucugguaagugacaaucauaaaaauaccagaugcugucaucugcccagauguugucugcaauaaaaugccagacaucuguacuggguugauugcucccaagaauucaugucuauucagaaccucagaauguagccuuauuuggaaauagggucuuugcagguaauuaguuaaguaaagaagagguucugcuggaucagggugggcccuggaucuaaugacuggcauuauuacaagaagagagaauucagagacacacagagggaagaaggcuauguaaagauggaggcagauugcugcagccacaagccagagauugccagcaaccaccaaaaccaagaggaggcaagaagagauuauuuuucggagccuucauguggagcauggcccuccugacacccugaauuuggauuucuagccuccagaacugcaagagaauaaauaucuguuguugaaaggagcccauugcuaauuuguaaugugagcccuaggaaaugaacacagcaucuuaccaauauugucuccaguccaugugccaacccgcaaagguaaaauuguggaucucacuuuacagaugggaaauuaagugucagagaggggaugucucuuucucaaguucauacugccacacuggcagagcugaaauguaaaacucauucaacuucagaaagcgcuuucuuuacauugggcugagcagccacccucuuuuuauagaauagaugugaaagagggaggccagagaagcaacaccugaaagucuugcuuacuuaaaguaccucugacgcucuuggguuggaaaggauuucugggaagccaaggagagaagaacuggcuaccaaccauuucaagaacaaacuuaaaggcacuggggccuuaaaaccauagcugucauguacaggaccaccccaucucauauauacacaugugugugaauauauauaagguuuuauuuuaugcaauaugcauuuuuuuuccccugagauggagucucacucuuauugcccaggcuggagugcaauggcgugaucuuggcucacugcaaccucugccucccagguucaagugauucuccugccucgaccucccuaguagcugggauuacaggcaccugccaccacguccagcuaauuuuuuguauuuuuaguagaaacagcauuucacuauguuggccaggcuggucucgaacuccugaccucagcuucccaaagugcugggauuacagacgugagccaccgcgccaggcucaaucauuauuuuuugcucaucacagaguccuuuguagcuccugaccugaaucauuauuauuaugcuugucucagaugcuaacaaguuuaccucugaacaagcauucucagcaaaagauccaaaaaucuuuaacugguggaggcacagaacuuggaacgagcaucuggcauguaauuauuuuuaaggggaaaaaaauaguccaucucgucagcuuuccaucccgugcaaagacaaauuggccacgaggacacacauggaaggaugagucugggggggcggaccugcaccauccuuucacggauucacugaguuuaaucaagaugaaugcaaucauucacucucugaggauggacuguccucaacaucccucuccccacguuuauagaaaaaccuggccucgcuuggcucccaaaaccaccgugaagagguuucaugcaaguuuucuaaagcgucagugaaaacaggacuuguuugcuuuaucauuuaaauuucaaaauacaucucuggccaaagagaaauauaaacaacacagggcuugugcuuccaagaagagaaaaggagaggccacuaagcuucaccauccagcugaaaaauaaaagccccaugauuuagggcagaagaugcuucuucuucuaauuauuguuguuguuauuugcagcuaauaauaagucucaccuacucagaacuuuacagagccucuccuucggaaacgucacauccacucugggccucaguuucccucaccuguacaacaaggaacuagacacucaguaagaagcccuuagcaagagaucuacuuugagaaugaaaugaggagagagccagcucggcuugacugaaauguacccagguguaaccugccagaaagcacauagccuucuguccaacaaaguagaacaucccagcagcaagaagauacacacccugcccaccccucaccaugggaucaauaaagcuauuuucauuuugaauggagaaacaaaaaguaggcucauaaacacuuugauguuuccagaauuggucgcuggguagaaaaaaaugcucacauugaacuagaugcccuccaaagagcaggcacuuggcccuaacagccuggcucaccagauguuacaacggugcugagggaaauacggcacaggggcuucgggccagaaugaagaucaaaggcuuucaggacagaggaggacuucaggcuuuccaccccugccccugcugaagccacccagcaagaugcuccugcagaacucaacucaagacucauggucuggggccaugcagggaauccaucguauuugccagaaagaaagggggaaggaaauuuuuccagggagcugccaacuccgugcauggggccugggggagcagcucaacccugacgugcaagcagagaggcccuggaguucuuggaacaggccuugguucaaaggaggauaaggaacaagcugcacagauucucccuucugugcugggaggcuccuggaccgugaagggggcugguuaggaggaagccaaaaacuccagccucagggcugcucagucaggcugauggcuccccuauacagggagccccagggggugaaccagaggagcaguuggcugccaggggaccagaggcuaagugucuaggacucagucuaacauauucuggagacagacugggaggccagcaagagacagcagacaguccaugugaguguuagaaagcccuggggcuaggucgggugugguggcucacgccuguaaucccagcacuuuuggaggcuugaggcaggcagaucaccugaggucggggguucgagaccagccugaccaacauggagaaaccccgucccuacuaaaaacacaaaauuagcugggcaugguggcacaugccuauaaucccagcuacuugggagacugaggcaggagaaucgcucgaacccaggaggcggagauuacggugagccaagauggugccacugcacuccagccugggcaacaagagcaaaacuccaucucaaaaaaaaaaaaaaaaaagagaaaaagaaagaaagaaaaagaaagcccuguggccaggauccagggcacgugaguucagauagacagcuacaaaaccaacagagauuuugcauacucccagggauucuuuccuugcauuaagaagcaggauuggcuuucaaagaucuuuuacuaccuggugaauuuuaagaacucauugcuuauuaauugaagaacuaaaagauacacaugguaaaauuuuccaacaggacuguaaaaaagucauacagucaaggcuaaguuucucuccuggccccagaaagcucccggguggccucuuagcaacagccacuaugaccauuuucuuugugcacccuuccaaauccagccuaugcaaauaugcuuguguguauauguaagucuguguguguuauccuccuuuacacacaaauggaaacaguuaugaaauuccaaaauagacacucaccaucuggagccuuacuuugucauccauugagugacaaacuuggaugggucccuucugacucugaagauuccaaacgaugaaucuagccagccauauacaaccagccugaagaacuaaagugcagguuggcugaacucaacgcuggggaaucaucaggucugguggacuccacuagugagaacaacugauuuuuacgagaaaucaccaggauuaggcaccaggucaagcaaucuagcggaagcacuuuguucaaccuucccaauccccuuaggaauuagggacuauuauuauuauuauuauucccauuuuacagaaaacaaaaccaagauccugaggccaagcaauuugcccaagguuacuggcaaguuguagguaaacaggauaggcuggguguagcgguagcucaugccuauaaucccagcacuuugggaggcagaggagggggaauuguuugagccaaggaguucgaaacuggccugggcaacauaacaagaccucaucucuacuaucaaaaaaaaaaaaaaaaaaaaaagcugggcaugguggcacacuccuguagucccagcaacugaggaggcuaagacaagagaauccauugagcccaggaauuugaggcugcaaugaaccaugauugugcgacugcacuccagcuugggcaacagaguaagaccccaucucaaaaaauaaauaaauaauaaauaaauaaagaggauacaaaugcacuuuucuuaugcucagcauuuucgaggacacccauauagcugaggaagagaugcacgccauaugaagaagguauguacugagcaagguugagugacgcggcuaggaacauacagcuagccacauaugucagaugcagaaccuaagcccuuugguuuugcauucgcaucccaugcuuuugauuuccacuaaagcauccugaaaaugcaacauggucguaccccacguagcagccagaguucugaaguagaugucaucaucuacugugugcccuucaaagcugugccccuucaaagcuacucucauuuuccacgcagcaaacugugcuauuuaaaucaaacucaaaaugauagugaaaaauagugacaaaugcugaagaauuauccccuucaccucaacaagacccaagucuuccuggccucagaaacccaauuucaugagaaagcaacuccauggaggaaaaaauauuugguguaauuuugugacuguaacuugguguaaccaaauggggaaacaacugaacaacaugcauugagagccuuaaaaaugucuagaaccuuugacuugauaauucuugcagaaaucuauccuauagguuucugcacacauaugugcacacaugcacagacauauacaccaaaacacucaucucaacauuauuuaaaagaggaaaauacacaauguucuuuuuuuuuuuuuuuuuuuuuuuagcuaguguuuggcucuguuacccaggcugaagugcagugcaugaucucgacucacugcaaccuccaccuccuggguucaaaugauuuuccagccuuagccuuccgaguagcugggauuagaggcaugcaucaccacacccagcuaauuuuuguauuuugaguggagaugcgguuucaccauguugcccaagcuggucucgaacuccugaccucaaguguuccacccaccucggccucccaaagugcugggauuacaggcaggagccuucaugcccggccacauuaaauauucuuaauaccuaauagugcagauaaaauugggagaaagacaagcugucauugcaauaggauguuacaacauuauauugcauuaaaaaugauaccuaaaagcuugcucuuuacaacacauggaaauacuaauacuacauuaggagaaaaauccaauaaacuuguugacauuacaugaucucaaguuuaaaagaaauaugcaaagaaaaaaagaaaaaugcagcaauugcguuaacacgacuuauuuucuuccuuauacucuuaacauuucccacauuuucuacaaagaaaaaucucauaaauagaagcauuauuugaaagaaaugaugacccacgcuccuggauaaaaagguaaaauuuaauagcaaccuggcugggagugguggcucgugucuguaaucccaacacuucgggaggccaaaguaggcagaucacuugagcccaggaguuugagauuagccugggacacauggggcugaaggggccccaagggaggggccugaggaacaggcaucaccuguucagccuucauaaucacuuuaggaauuuagacuguuaauuauuauucccauuuuacaguaaaagaagcugacugagaguuuaaaaugcaacuacucuuaggaugaagccagauaguuccuuuuuuuugagauagggucucacucugucacccaggcuggaaugcaguggugcaauuacagcucacugcagccucaaacuccugggcucgagcaauccucucaccucagcuaggaccacaggcgcacuccaccauguauggcuaauuuuuuaauguuuuguagagacaggcucucgcuuuguugcccagguuaguguugaacuccugggcucaagagauccucccgccucagccuccugaacugcugggauuacaggcgugagccaccucacccagccucagauagccccuuaaagggcgauuagaaagcugagggcaaagagagagcugaacacaaaggacaugugaucaaagccgacugcuucgacgggcagugaaggccauugacaagccucuuaauguaaacacuguucauccauuuaucaauuguuggaauuaaccuugcagauaaagcacaggagucuuaagugugggcgugggaguauaaauguuccacaccuugccagggggaaaaugggaaguacaaguggcaagagggggcaugcuggucucccugccucccccagugugagucccgggacauugcugaggguccagaagucuaagucaacagacaaggagcaacaugagcuuauucuuuagagguacugaccugucccugauucacucugggaaacagggcuaaggacaggcagaaaaagggcaggggaaucuggauuuuccauaaaagccuuacccauuugauguuaaauauaugcaugugcuauuucaauuaaaaaccuaauucuuucaaaaagauaucagacccagaauuuaagcauaucaaaagcaggaguuucauauuuuaagcuccuauccuucucuuugauaugguuaaaaagcucugcauccauaugaaguuggcugucagugggaugggcuggcagccacagccuaaagccuccccaacaaccugacacaagaauccacauccccauugagcagaaaccaccuuuagauaugcaccauuccaagcgcuuuucucaugcagauaaacugggaagggauuacaggugugagaucauagcauacgugccacuuucaauauaaagacuuuugaacuuuaacaacaacaaugaaaaauacacuacuugagcuuuggaaauagcaaucuuucuucucuugaucuucuugccaaagacucuugcuuuccuuccaagacaaccuccucaaagcaguuagaaugaucugaucaugaaauccaaucaugucacucccuggcucaaaauccuucuuggcucuccauggguuacaggacaaaauuuacacccagcugcuguccucuuuuagcuuggguucauuucccacuugccacauugcaguuugcucaggcaaacugaguuucugcaguucccagacugaacugagcuuucauccaucucagcccuguaggugcuguuucucccgcccacaauguccuucuuaucucuggccagcccaacaagcucagcauuucugcuuccgagauucaucucaaguccugccucagugggaaugcccccugauuugucccgauggacuuaccccucuaauaaucacugcauugaauuuauuuuuucuuucuuucuuuucugagacagaguccugcucugucgcccaggcuggagugcaguagcgugaucucagcucacugcaaccuccaccucccagguucaagcaauucuugugccucagucucccgaguagcugggacuacaggcacucgccacuacgucuggcuaauuuuuguauuuuuaguagauaugggauuucaccaugcuggccaggcuggucaagaacuucugaucucaacuauccgcucgucuuggccucccaaagugcugggauuacaagugugacccacugcacccagccugcauugaauuguuuaaucuuuccuuucgugguuugccacagacagacugagucuuuccauccuuguguccucagguucuaaaaaacaaccacuaaaguaacaacuacaacaaccaagacucacugagcucuuaaaacgggccagacacuauucuaggcacuuuauaugcacuaauucauuuaauccuuacaacagcucuaugaagcaugcacuauugcaauacucauuuuacagauagaacaacugaagcucugagaguuuaaacaauuuagucaauaccacacaacugauuacugguagagccaggauucgaacccagacagccucauccacaccugguaggccugccacauauggccgugcagauuguacccugcacaacucuaaaguccaccguuugugucacaguuuagcauagcacugcccaguggaaauauaaugcaaacuacacauguaauuguuaauuuucuuucuuuuuuuuuuuugagacagagacccucugucgcccaggcuggaguucaguggugcgaucucagcucacugcaagcuccgccucccggauucacgccauucuccugccucagccuccccaguagcugggacuacaggcgcccaccaccaugcccagcuaauuuuuuguguauuuuuaguagagaugagguuucaccguguuagccaggauggucucgaucuucugaccucgugaucagcccaccucagccucccaaagugcugggauuacaggcgugagccaccgcacccggcaguaauuuuuaauuuucuaguugcuacauuaaaaaauacuaagcagaaaccaaaggugaaauucauuuuuaauguuuuauuuaacuuaguauaucgaaaucuuaucaucucaacauguaaucaauauuucaaaaguuguuaugaauuuuuucuuuuuuuuaaacugagucuuauaauccauugugcaauuuacauauacaacauauuuuaauuugaauuuucgcacauuucgacugcucaauagccacaugcggcuaguggcuagcggcuaccauaugggacagcacaggccuagcuacuacuugaagaagccccaaguuuccugggccucaguguccccacguuaaaaaugcggacgggcuugaucucuguaucuucuuucaccaucagauugaguuugauaaccuuucauugaucuuagcuaguauccgcacagcuuuuuucauguuacacaagacaacaauacuuucucuagcucucaaaacaugcucccaguugcaaguaucagaaacugaggcucaggcucggcgcaguggcucaugucuguaaucccaacacuuugggagaccaaggcgggcggaucacuugaggccaggacuuuaagaccagccuggccaacaugguaaaaccccaacucuacuaaaaauacaaaaauuaguuaggcaugguggugcaugucuguaauccagcuacucgggaggcugaagcaugagaaccacuugaaccugggaggcagagguugcagugagccaagaucgcgccacugcauuccagccugggcgacaaagcgagacucuaucucaaaaacacaaaagaaaaaaaaaaaacaaaaccuaagacucagagaggccaacugcucagcccaaagucacacagucagcaggggccagaacuugggcuucccugccugaccaguaacuggucuucaguuacugcuugcuaauucuucacccaagcacccuaggaaauguguaccuccuucccucgagggagaugcuacaccuccccuuggcauuccaggcacauuguugaaauuuaaugaaccauucuguucaucaacuuuuaaagagaucccaucaugcauccugcucugauuacugagcagaggaacaucuggaaguuuaaaccacucaacagcugggcaacauuuuuauccuuaaaaagcauaauuuauuacuccaacaaugaaaaccauauuugucaauuuggggagaagggugugcaacuuugcagcuaucaguuucugggcugggagggguguauguuugcccuuggccccgugaccuacuggaguaaacagaaugagccugcugcuaauccacucuugcugauuaaacucccaacccacacagaggcaacccuucccuauuacagaucaggucugugggagugcuggaccgcuggccuugaacccauacuucucuuccaggcucagcagaugcaucccaagcaagcugaacugggugcagggcaagucccacgggagcaucucuacaaaaggcagaguuccaaacuccaaaugcuugaccucacccuuagaaucaucucaaucuagugacauuccaugaagaugaaagaaugcggaugauccuugaagcugccagaugagacucgauagaaucuguggugcaaaagaaagagacacgcaccuucuaauuccaccucugcauuucuuagagguuaaugaugagggcgaauuacuuggcaaagaaauccuuuccaauguuaagagucuaggauuccaggaaaaugcaaaguaguauuggguccuaccuauuuaauauguaccccaggaacucuggcacagguaaccuugcaaggcauccccaacugcucugcugugagcucccgagggcuggguagccugagggugucauuagccgacuuaucccgaggcucuuccgcauugcacaucucaaccaaucuaccuggaacccuggaggaagagaucaccucuagacaggagagcauaccaguuaggacacauagagagucuuucaaaucccagcgugcccugcuacugguuagcuguuaaccuugggaagacacuuaucucucugccucaguuucuccguuuguacaacgagaaauuacuauggaucaaccaccucaacuguugugaagauuaaguauacagguugaauacagaugcagagugcucagagcaaagccuggugacagucagagcuaucuacaagcucacuaacagaugaggaaagcaagauccaagaggauucaagugacuagccucauuuugcagacauggggcucacacuuggaucccaggacuccagagcugggaagagaaaaaccaaaguaacguguacuaugagauucuacaacuguaaagcacccuugcuccuucaaugaugauuuaccgagcacggauuuugcuauagccccaguaccagugugccuaccccggggcucgcagccaguuagagagcaaccagcacuccagcagggaccacauagcaagaccccaucuguacuaagaauaaaacaaauuagcuaggagcgguagcacuugccugcaagucccagcuacucaggaggcugaggcaggaguaucccuugagccuggcagacagaggcuguugugagcuaugaucacgccacugcacuccagccuaggcaacagagugagagagagagagagaauaaccagcguuuauugagcaccuaccacaugccagcucugggaaagcucuacaugcacgucauucuacucucacaacaagguaaggaucuagugaguaccacuuauuuucuaguuuuauagaugaggacguggaggcucuagaggguaagcaacucgcugagaucucagaguuuugaagcggcagagggggaauucaaaucaaugcugcuggaacugcagagugcacccuuauccauuaugcaugauugccuuccaacagaugucagcaauuuuuuguggcuucugguggucucucaccgaauaucugaauaacacagaacgccagcagagcccucauuuauaaaaagcccaggcgcugagccugacguaauacaugaaugaauaaauccugcugaugaaccgggucccucuccuggaagagagaccugccugcucucccuucuuacaaucugggccucaaguguggauggaaugucaggcagggggcagcacaggaauuaacagcuauugauuccucacugagacuuccggagcagggugggaccccuugggagccccuucuauucaguugcgauaaguuuaucuguuuuugaaaggcguaucuuggcagggggguauccaagcucaagggcacacaucuacuggaggaggccccaacaggccuacauuucaagucuaaaaugggaagccuggaaggaagugggggugaaaucccaccugggcaagucaagaucaccuugaggaaagccacaauccagccggacuaugauccugccuggcguccuuggcccacguugaggggaaguaaacuggacccgggcuguuucccuucugcuaguuacugccccucuccugggcaucaguucugccucugcaaguguaagugaucuuuaaacaccaacaggaacaaggcgaacagcagggagcacuuacucuguguuuauuauuuccaggcuccgaguuaaucucuacacaugccggaucuuucucucucuauuuuuucugagacaaggugucacucuguugcagcucacugcagcaucgaccucccaggcucaagcaauucucccaucucagccucuaguagcugggacugcaggcacaugccaccacacccagcuaauuuuuuuuuuuuuauuuuucauuuuuguagagacaggguccaacuauguugcccaggcugguuucccacuccugagcucaagugacucuccugccucagccucccaaagugcuggaauuacaggcaugagccaccauaccaggucucuaucuuauuuaacccuuagggaaauauauauauauauguguguguguguguauauauauauauauauauuuaaauagauauaucuauuuaaauauauauguauauacacacacacacacacauauauauauauauauuucccuaaggguuaaauugagucuguaauauauauauaucuauuuaaauauauauuauuuaauauauauuaaauagauauauauauuuaaauagauauauauauauguaacagacucaauucacagacagggaaacuacugagguagacagauguuaaguucauugcauaaugaacuaaguaauaaaaugaggcaaaggcccagcaggucugugucucuccuauuccagaacagcgcucucaaccaucacaccaagagcauuucuuuugagaugauugcugaaggugaacuacuuggccauagaaguccauuccaaauuugagagucuacaaucccaggaaaauccaacagcaguacugcguccuagcuguauacccuggaaauucugacauaggcaaccagauguaugaaauguccacagcagcacuguuuguaucgggaggggguggggggacaccugcgaacaacucacauguccuuggagaacagaucaaucaacuguggucaguucacacaauggaacagauuaucacagugaaaaauaagcuacagcagcaggcaucagcagagacuuaccaacaugaugcagagcggcaaaggaagcugaaggcagcauggaauuucuguaaagcucuaaaggaaguaaaggaaacaauacacuauuuaagaauacaaacgggaggccgaggcggguggaucaccugaggucagguguucaagaccagccuggccaacauggugaaaccucaucucuacuaaaaauacaaaaauuagccaggcaugguggcgagugcccguaaucccagcuacucaggagacugaggcaggagaaucgcuugaacccaggagguggagguuacaguuagccgagaucaugcuauugcacuccauccccauccugggugacaagagcgaaacaccaucucaaaaaaaaaagaaaaaaaaaagaauacgcauggguuuuuuuuuuuucauccaugacaugauaaacaucaacauucaagauaagaguuggccuggcauagcggcucacgccuguaaucucaacacuuugagaggccgagauaagaggaucucucgagcccaggaguuugggaccagccugggcaacauagugagauccuaucucaacaaaaagaaaaucagggccaccaaugagggagaaugcucgggggcaggggguaggcaugggagaaaacugaaaagaauauggaguuagagucaaccaucaguguucauaguuuggauccuaggcaggguggagaggucauggguauuuacuuaccaauaugccucccaacuggccuguaggugacaucuauaauuuuguuuguguugagacggagucucacucuguugccuaggcuggagugcaguggcgugaucucagcucaccauaaccuccgccucccggguucaagagauucuccucccucagccugcugaguagcugggacuacaggcaugugccaccaagcccagcuaauuuuuguauuuuuaguagagacgggguuucacuauguuggccaggcuggucucgaacuccugaacucauuaucugcccaccuuggccucccaaagugcuggaauuacaggcaugagccaccacacccagccuuacaucuauaauuuuguagguauuaauaguguauaauggucuucagguugaagcuacauuaaauucauucaccaauucugucgcauccaaauuauuugcuagccauuuauguugugggcagcauaacauaaaugaugcuauagauuauuggaaggugauucaauauguugggauuuuuuggguggguacccugugccuccuccgccccugaugaauuucugccaugcccaagagagcugggugcucccuuccauauuugcaaaguggaaaagcagcaucuaccugaucaagcugccgaaagcacugacaagaacucauguaaaagcagaagucagccccagcacagggucaagacucugggagcagcaaagccauguggucaagauccaggcucugccacuucugguugaauggccuuggcuaaguuucuuaaaaugucugugccucacaccaaaagcacaggcaacaaaacaaagaguuaaaugggaaugaauuuaaaaacucauucagucuuaaaagggcauaaaauugugacacaggcuacaacggagauauaccuuugaaagauuacacuaagguggggcacgguggcucaugccuguaaucccagcacuuagggaggccgaggaggguggaucaccugaggucaggaguuugagaccagccuggccaacauggcgaagccccgucucuacuaaaaaauacaaaaauuagccacgcgugguggugcacgacuauaaucccagcuacuagggaggcugaggcaggagaaucucuugaauugggaggcagagguuguggugagcugaaauugugccacugcacuccagccugggcaacagaacaagauucugucucaaaaaaaaauaaaaaauaaaaaaaaguuuacaccaaguguaaugagccagucacaaaaggaugaauacuaugauuccaccuauacggaugcuuaggguaguuagauucauagaaacuguggauaccaggggaugaggggagggggagaggagaguaaguguuuaaugagugcagaguuucaguuuggaaugaugaaaaauguuccggagaugguuagauuagcggugaugguuacacaacaauaccaauggccuuaaugccacugaauuguacaguuagaaaugguuacaauggcaaauuuuauuauguaaauuuuaccacaguaaaaacauuuuacacauaaaaauuaaaaauaaacugucugugccucaaucccaacaucuguaaaaugaggauggucauccugucaguccccucaaaggguuugcuagggagauuaaauuagccaaaaccugcagagcacuuagagcauugcccagcaugcagcaggagcuaaauaaaugagaguaaauuaggagaugcccagcgugcagcuggaacugcucauuaagacacaacucagccccuccugagcuggggaagaaauaaagacaaggaugcaugaaaggcuggcucacucaagccgacuucacacagaaacccuccccggcugacgcgucaggcaggcuccuggauucuggagagacccagauauggcccaggugucuccaccugcucagccucucccagaaacccagaagcucuuuucuugggaauaaugaggaaggggcuggagaaggaggauggaggucuuccccaccaggaaaucucucuauucucacguccacuuucaccagcugucuggauaaaggaaaacucuagauuuaggacaacugaaagugcaaaaauaauuucccaucugcggccgggggcggugguucaugccuguaaucccagcacuuugggaggucaaggcggguggaucaccugagaucaggaguucgagaccagccuggccaacauagcgaaaccccgucucuauuaaaaauacaaaaauuagccagacuuggcagcaggugccuguaaucccagcuacucagaaggcugaggcagaagaauugcuugaaccuggaaggcagagggugcagugagccgagaucgugcaauugcacuccagccugggucugccucucguuuccaugugguuugcgucaccacccuccuguucacguuugguuugagggugaccauguuuuuguugaaggagccagaggugaggugugcagcaacucacuuaauuuucuugaauacccaaacacacagggaccauuuguauucccauuuuacagaugagggaacugaggcaccaggcucugaagcucacacagcuacuuggcagcagggcugagguucaagccacacggucuguuauuagagugggaggagacaaaagcggacaugggucagggacaguaggagaaucccugacugauguggucacugucacucacguggccuaaaguagagcugggucuaggggaggcauuuacaaauacaaccaggagagcagaugauguuugcacacuuuucuuaguucagaaaucagagccagagagcaggagaagacacuggguaagagaccuacaaguuuccucuccaugggauccugggauuaaacugcuccucuccucccccagucuucccaucaccaugacaucuauauauuauauauauauauuuguauauauuauauauauuuguauauuauauauuuguauauauuauauauauauauuuguauauuauauauauuuguauauauuauauauauuuguauauauuauauacauauauuuuuuuugagacagagucucaaaauugauucacaugaauuaauacaggaaaaguucaaaccggcacgaagucagggcuuaauaucuauauaaugccauuuuaauaucgcuauuaguaguacuagauaacauuacuccagauuguaccuauauuaaugcuauauuaucauugucaaugcucuuucucucacucugugccuccuaaaugcauggacugggcucuugcagacuauaaaaaucuauaguuccucuuguuuguucccugugagagccugacacaguuacaagugcauauuaagcuucuauaauucccagccagagacuuacugaguuuuuccagaaagauaacaagacgggaaaugcugcacaaaauggaguggacugagacuuuuuucgucaagauagccgaccgguuuuuuccuuccuucuuucuuuucuucccuccuucccucccuuccuuccauuuuccuaccuuccucccuucccucccuuccuucccuucccuucccuuccuuccuuccuuccucucucccuuuccuucuuuuuuuucuuccuuccuucccucccucucuccuuuucuuucuuuucuuuuuuugacaaggucuuguucugugacucuggcuggaguacaguggugggaacauaggucacugcagccucaacuucccauccucaagcaauccuccagcuuuggccuccugggaccacaggugcaugccacuggcuaauuaaaaaaaaauuuguuuuguagagaugaagucucauuauguugcccaggcugguuuccaauuccucccaucucagccucccaaagugccaggacuacaacaggcaagagcuaccacgcccagccuuucauucucuuccuuccuuccuuccuuccuuccugccuuccugccuuccugccuuccuuccuuccugccuuccugccuuccugccuuuccuccuuccuccgucccucccucccucccucucucccucuuccccuccccuccccucuccuccccuccuuuucuuuucuuuucuuuuccuuucuuuucuuuugagacgaugucucacccugucacccaggcuggagugcaguggugcaacuacagcuuacugcagccuagagaccuccugggcucaagugauccucccgccucggccucccaaagugcugggauuacaggcacgagccgccacaccugaagguucauuucuuuaagcaauuuugcuauaauuguucacugcaaaugaagguaaaucugaaaaucaugcuuguuacccugauggaaaucagcaauggcuuaccagcagagagggcaaagucagugagcuaccggaaaccacuguugcuuaauaacagccgaccccauguuaugaagcccuguguuaaccggccagauacaaaagaacuggcaaaaaacaaaaaacaaaaacauauguugaggggacggagagagaaaggaaaaaggaaaagaacagaagaacagaguugucuagaaucuaaggaaugaugacuuuuccaggcacauacagacuaucacuaaaguauguaaggaacugaagcaauucagaauagcauuacauacaaacaguucugagggaaaaauguuaacacccugugagcagggaggugcuugcucagucuagcauucaagucaauaaccaauaauuagggagcacccacugugacaugccagcucccugcuaggcccagggggaauggaaaggaaagacaugaaaugccugagggagcuugugcaauggguuagaggcaccuauaaccaaggagcugcaaacugcuggccccgggggccacauacggcccacagguauuugguuuggccuaugaauguuccuuuaaaaacuuaacugaaaacauuuaaaaaucaggagaguuuauauuuuaaaaggcuucucuuuuaaaaguggaagcucuggcaacacugggucuaucuuuuggcaugaggagagaaaagggaccaggggaggagggagcuggaaucuaacagcagccucuauuaacaucuagcaaccucucucuaacaguaucucucugauaacaucuagaagagggacccgcugguuugccaauccggacacuucuuacuguauuugaucaggcccgccuggugugguuguacaaucuacucauccuccuaaacagcuaaguuuggaaccccugacaggaacccacuguagaaacaacauaguaauacuauggggugugagcugugagaacucacacacauggugcugggaggggaucaagcaggaacgacacacucagaaccagcguaaggagaugagggaaugcuuccuggaggaggugaccccuuaaugcagucauaaagcauagguaggaguucauuagaagaggaaauggggaaagagacaaaauccugucccauuucccuggcuggcugauucucucacuaugugagacacaaaccuuagagaagaaucugcagacacaaauccucuaaagucuggaagaaucauuucauuccaagccuucaaaaauauucacaccccacauucaccugcugccucugaucccaugaucacuauuucuaaccccaggcaauccugccaauccuuauuucugaccccaaggcagugcuuuccuccacagggcaaaggcacucagccuugggacagugagggccagauuccucgcccagggccaccaugcauucagcaauucaauacacgcucacugagagccucugacgcaccaggcacucaagcuaauaaugggaagccauuaaaagcuuuuaagugguugccuuucaggaucuaguuuaccauuugcaaagcucgcuuacaggagggaggugcaggaugcuccuuggcuuuuccuuuuuaacgagaucagcaugcagagaaugucuuccuaaugcagaaaguauguauggaauuuccagagucaugaaaaggaagagauauggccuuugcaaggccuggggagaggaaagaagagggcucagaccagccaggaacuuagcaaaggccaggggguggccccccaggcccagcaugccugaagcccccuccugcuccucucccuuuccagagggcaugcuucuggggggcaucugucccagguguucucagggaaggcagccuuauaaauggggagggacugcaaugaccauaggaagcccagccugccagaggaagcuacuggucuccaccggcugggucuggccagggcuuuucaccgacaaaaugaacucuuuuguuuugugaaaagcaauguaccacauggauaggagauaucucucuucaaaaucucuaagugcgaagauuggcugacgugaucccaaugcugcugcuggcccagugggaugaaucaugaccuaagugggacuaaaacuauggaacaaacucagucacaauaaaugccggaagggaacucugucuucguuagccacucuccuauaaauuccuggggacuuuccauacagaggaccuuuuccuuuucccauuuccuuuugaaaaaaugggaaaagccaagcaucccaccagaggguaacugacacaaucucugcuacauuaccuagaacauuccaaagagacuccaggcuggucacccuuccucuggacaaaucucucuggcaaaggcacaucacucuaaucucaucccugccccaccucaaaaccuuccauagagccgagcaugauggcucauuccuguaauuccaacacuuugggaggucaagaugggaggaucgcuuaaagccaggaguuuuaagccuggacaacaaagugagacccuaucuuuauaaaaaauuaaaaacaaaacauuagcuggggguggugccaugcaccuguagucccagcuacucuggaggcugaggugggaggauugcuugagcacaggggguccaggcugcaaugagccacuauggcucacugcacuccugccugaagcaacagagcaagacucugucuccaaaaagaaaaaaaugaaaacuuucaauaguucccuaucacccacaggguaaaauccaaaugccugagcacaguuuggaaggucucuagcuagcuaacucuucccucaaacuuugcccuccaagaaguccuuuucuuuuucuuuuuuuucuuucuuuuuuuuuuuuuuuuuuuuuuuuuugagauggaaucucacuuuguugcccaggcuggaauacaauggcucaaucucagcucacugcaaccuccgccucccggguucaagcuauuuuccugccucagcuucccaaguagcucggauuacaggcaccugccaccacuccuggcuaauuuuuguauuuuuaguagagaugggguuucaccauguuggccaggcugguccugaacuccugaccucaagugaucugcccgccucagccugccaaagugcugggauuacaggcaugagccaccacgccuggucccaagaaguccuuucugucuccaaaauaaauaccaaacucauccucuucucuuccucuccacugcuagagccgaguccagcucucucuuggauugcuguaauucaguccccaaaugggccaccugcuuccguugauccaccaucuacccaacaaaaaggucaaucaaaucaggaaccacccagcuuagccacccccaaagacuuaaaaaagcacuuaaggcccuccaugaccaaacaccuguucaucuggacccuggacguucacuccuuuccagccacacgaaucuuuugacacucugaacacaccaaaaguuuugcagccucagggccuucacacaugcuauuaucuuuaccuaggauaucccuucccuaaacuguuuugaaagaaauuuaaagaacaggcuggacgccguggcucacgccuguaaucccagcacuuugggaggcugaggcagguagaucaccagaggucaggaguuugagaccagccuggccaacauggugaaacccugucucuacuaaaaaaaauacaaaaauuagccagacggggguugugccugaagucccaaauacucgggaggcugaggaaccagaauugcuugaacccaggagguggagguugcagugaaccgagauugcuucacuacauuccagccugggugacagagcaagacugucucagccgggcccgguggcucacgucuguaauccuaacacugugggaggcugaggcggguggcucaugaggucaggagaucgagaccauccuggcuaacacagugaaaccccgucucuacuaaaaauacaaaacaauuaaccgggcgugguagcaggcaucuguagucccagcuacucgggaggcugaggcaggagaauggcgugaaccugggaggcggagcuugcggugagccgagauggcgccacugcacucccagccugggugacagagcgagacuccgucucaaaaaaaaaaagaaaaaaagaaaaauucaaagaaccuagaauugacaaccaugaacaucuugucauauguauuuucaaacuuuuuuucuuuucuacauauuuucaaacuguguaagugauauguguagguauccaccuucuuuucaaaaaaagcauuaaagauaggccagacacuggguccucccuguaaucccagcacuuugggagaacugggcaggaggauggcuugaggccaggaguucaagaccagccugggcaauauagugagaucucaucucuacaaaaaauacaggcaugguggcucacaccuguagucccagcuacuccggaggcugaggcaggagaaucacuugagccuggaaaguagaggcugcagugagccacgaucacaccacucacacuccagcaaccuugacagagugagauucuguccccacaaguaaauuaauuaauugaauuuaaaaaaagcaauaaaggcaaaguuaaaguaggcuuugaccuucacaaucagcccacuccccuucucuccccagaugaugacagugaguuugauauagaucuuuccagcccauuuuuuaaaccuucacuuucaucucuaaauauccuuaaguaacauacagcacgaacugugaauucucaaucuuaccuaggaacggggcugcacauguuuccaauuucacuaccugcuggcaagguggucucuaaagugaccucacacacucacuagcggagcugcugaacacccugugccuugucaacacuugagucagacauccuauuucuggcacguuguaaagcaugaaacauguaucuuguggaaacacccagaugcucuucaaauggagaacagauaaacaaacagugguauauccauacaacagagucccagucagcaauaaaaacuaccaaaccccugaugcauagaacaacauggaagggucccgaaugcauuaugccaggugaaagaagacaaauccgagagacuacacacuguaugaauccauuuauaggacacucugaaaaaggcaacacuguaaggucagcaaacaacucagggguugguuaaagcuggggguggagaaggagacuggcugugaagggacaggagggaaucugggugaacgauggaaauguucuaagccaugauugugguaauuacacaacaguguaacacaguucuaugcauuuaucaaaacucuuagcauuguauccuagaaaggaugaauuuuacugacuagaaauuagaucuccaaaaccugacuuuguuagcaaaauucagaaucuuuucacauuuaucauccacuuugcuuuuuuuuuuaauuuuuuagacggagucguucucuguguccaggcuggcaugcaguggcaagaucuggguucacugcaaccuaugccucccagguucaagcgauucuccugccucagccucccaaguagcugggacuacaggcacacgccaccacacccagcuaauuuuuguauuuuuaguagaaaugagguuuuaccauguuggccaggauggucucgaacgccugaccuugugauccgcccgccucagccuuccaaagugcugggauuauaggcaugagccacggugcccagccaucuacuuugcuuucuaugagcacugcaugguccuaucuuucacccacuuugcuauaaggcuguuugucuuuuuguuguugacuuuugggaauucugcauacauucuagauauuaguguuuuguaauguguuauaaauauugcaaauaucuucuaagucuuguauuuggcuuuuaauaccauugcaguuuuuguugcuuagaugugccuuuuucuuuaauauguagucauauugaucaaucuugucuuuucugcuaacacuuuguucuucugguuaacuucuacugagucuucgugucucacucaaauccugauuccucagacaguauuucaguaugaacccccuuaccucacaauaaccaucccuucauauuauucuaguacauauuauuucauauuccuuacaauaauguuauuuuuucuuugucuauuugcuuguuucccccacuuaacaauaagccucuuaagaacugguacuaguugaucuacuuugaucacuacugaauacccaaggccucaagcagaacuuggcacaccacaggcauuccacaaauaccugccaauaaaugagagugaagaaaaauccaauacaggugcauaggcugcacauaaacaugugcgagcauauaacacuguacauacauguuaaugacauguuagugcaucacggacagcaaaaaacaucacgugccucaccagaaagcagcaaauucagcuucugugcaaaucucaugaaccacaauauuuaccugaaauucuaaaaaauucagacauuaugcacaauaauccuaggacugagaauuuguuuuuuuuuuaauuaacugaaaaauagaaaacauaaucuauauaaacaggcuguuaugaagcuaagcauccaaaucaaaggaaugauaaaguaagcaacgaaacagucacugaacagaaauaucuacccaauaaaaaugacauggacggcugggcacaguggcucacuccuguaaucccagcacuuugggaggccaaggcggguggaucaccugaggucaggaguucgagaccagccugaccaacguggagaaaccccgucucuacuaaaaacacaaaauuagccgggcgugguggugagcgccuguaaugccagcuacccaggaggcugaggcaggagaaucacuugaacccgggaggcagagguugcagugagccgagaucgcgccauugcccuccagccugggcaacaagagugaaacuccgucucaaaaaaaaaaaaaaaaaaaagacauggacaaagugcauauaauauucaaaaaugccuguguccuaauagcaacuaagaaaaaaaucaggauguguccagaugugguggcucacgcuguaaucccagcacuuugggaagccgaggugggaucacuugaggucaggaguucaagaccagccuggccaacauggugaaacccugucugaacuaaaaauacaaaaaaaaaaagaaaaagaaagaaagaaaaaaaauuuagccgggcacgguggcaucccagcuacucggaggccaaggcagaagaaucgcuugaaccugggagguagagguugcagugagcugagauugugccacugcacuccagccuggauaacagaaugagaugcugucucaaaaaaaaaaaaaaaaaaaaucaggaugcaacauauacacuaugauuauaauacaaaaaaauaaaaaauuaaaaaauaaaaaaccacagccugggcacaguggcucacaccuguaaucucaacacuuugggaggccaaagugggagggucacuugaagccgggaguuaaagaccagccuaggagugaggcccaaugucugcaaaaauaaauaaauaaguaaaaauaaaacaaggcaaagaaaaaacagugauuguauuguuuguauucaacucaagaaauauuauuuuuuaugaauuuaccaaccccaccucccagcuuuuaaaaauuuauuuauuuauuuuagagacagggucucauucugucacccagacuggaguacagugguguaaucauaacucacugcagccucaaacuucuggguucgagcaagcuuccugccucagccucccaaguagaugggaauacaggugcgugccaccaaagauggaacuacagguacaugccaccaagcccaguuaauuaaaaauaagaauuuuugaggccaggugcaguggcucaugccuguaaucccagcacuuugggaggccgaggcaggcagaucacaaggucaggaguucgagaucagccugaccaacauggugaaaccccgucucugcuaaaaauacaaaaauuagccaagcaugguggcacaaggcuguaacuccagcuacucggaaggcugaggcaggagaaucgcuugaacccaggaggcggagguugcagugagcugagaucucaccacugcacuccagccuugaugacagagcaagauuccgucucaaaaaaaaaaaaaaacuguagagacaggaucucacuauguugcccaggcuggucucagaugggcucaacuaauccucccaccucuaucucccaaagugaugggauuacaggcauaagccacagugccuggcccauauuuccuucuuccaccaaaauccuggaauucuuaagucaaguaccuuccuccuuaaauccacauuccacaugaguuugucaucuuuuuagauguauauuugggaaguugcuccuugcugacaauccuugaaaagugcccaguucucaggacccaguugaaauaauuuccgccuggggcugggcgcggcggcucacgccuguaaucccagcacuuugggaggccaaggcgggcggaucacgaggucaggagaucgaaaccauccuggcuaacauggugaaaccucgucucuacuaaaaauacaaaaacuuagccgggcguggugggcgggugccuguagucccagcuacucgggaggcugaggcaggagaauggcgugaacccgggaggcggagcuugcagugagccgagaucucgccacugcacuccagccugggcgacagaaggagacuccgucuuaaaaaaaaaaaaaaaaaaaaagaaagaaagaaagaaaaagaaaucacuuauaccugguuauucaggcucuccaggauguccugccccucacccucgccccaccugccuuuuccaccuccacccacaccaccagccaccuuaguggacuugcaguccaaggccuugaaccucugcacugccagcccacugcugucaccaagacccagacugagacccaacaccccagugucuuccuucccuccugggcgagucucuuccagcuucugggcuacagcaggccugguuggcuguggucccauuucaaccugccuucuuucucuccuagcaguuacaucugcagugugccucccucccacacuggaaacuucccgaagauggcaacgguuucucauucacggcagaacaccugugccucacccacacauuugauucacuaaaugcugaccucguccaaggcauuguuccauccagcgaaaauaugauucaacccacauguaauuuuagauuuucuaguagccauaaaguuagaaaaaacagaugaaauuaauuuuaauaauuuaacccaauauauccaaaacauuaucaguucaauauguaauuaacaucaaagaauugguucaugagauaacuuggcagggugcaguggcucacgccuguaacccuagaacuauaggaggcugaggaaggcagauugcuggagcccaggagcucaagaccagccugggcaacacagggagaccccagcuuuaccaaaaauacaaaaaaauuagcugggcguggugacacagaccuguggucccagcugcccaggaggcugaggugggaggaucaccugagccugggaggucgaggcuauaaugaucuaugaacacaucacugcauuccagccugggugacagagugagaccgugucucauauaaauaaacaaauaggccuggugcaguggcucacaccuguaauuccagcacuuuggaaagcugagugggauggaucaccugaggucagaaguucaagaccagccuggccaacauagugaaaccccauaucuacuaaaaauacaaaauuagccaggugugguggugggcaccuguaaucccagcuacuugggaggcugaggcaggagaaucgcuugaacccgggaggcggaaguugcaaugagccgagaucaugccacugcacuccaggcugggcaacaggugagacucugucucaguaaauaaauaaauaaauaaauaaauaaauaaauaaauaaauaaugagauaucuuacucuucucacuaagucucugaaauccaauguguguuuaacacacaguacauaucaauuuccuuucaagugcucaauacccacauagggcucacagcuaccauauggagagcacaguuuaagaugcuggggauacaacagugaacagccuagaaguccauuccuguggccccauccaccacugccagccuggaccuggcacuuaacgcucugugcauguuuguccuggugcucuagcuccugacccugauuuaguuucuucucaacacagcagccagacugaccguuucaaaagccaagucagaucaaauuacuuuccuuuuuagaacacugcaaggaagccagucacagugguucacaccuguaaucccaacacuuugggaggcugagguggguggaucacuugaguucaggaguuugagaccugccuggccaacauggugaaaccccaucucuacaaaaauaaaaacauuagccaggcgugguggcacgcaccuguaaucccagcuacucaggaggcugagguguaaggauugcuuaaacccaggaggcagagguugcagugaaccaagaucuccccacugcacuccagccugggcaacagagcaagacucugccucauaacaaacaaaaaacaaaaacaaaaaacaccgcaagggcuccccauuuuacagaguaaaagacagaaucuuuggaaugcccugcaggcucucugugaggcugcacacugcaugcugcucggguucuccuaccucccuugcucacgccauucucaucucacgcuucuccuggcugcuccucacccccacaggcucacuucugccuccaccucuguccuagcucuucccagagccugaaacgccuguccuuccccuacuucagguggagguuaacgucagcuccuccauggagccugcccugacucugaccggacaacuuaaccacacagcaccacgccccagcccuccagacacugacccugcuaggccuguucccacagcacuucauaaucuugaauacacaauucauguccuucuuuauuaugucugcuguuccuuaucugucuaacccagcuguaaccuaagcucuagcauggaaaucuguccuuuuucuuccuuucugcauccccaacaucuacagcaaugccaggcacagaguagacacccaacaaauauauccuggaaaaaugaauggguuacaauuuagugggagaagagagacauaugguauacuaggaagauaagcccuaucgagaaaaaauaacucaggaaggggaauggaagaaagggaggcugccauuuuaugagggaggagaauaauauaauaauaauaaacauagcaacuaccacuacauaguaacuacuaugugugggagccucugcuaagcacuuuacuguuaacacaguggggccggggagacuuugcacaggaguuagcuuuugccugcacugccuccaucugucccccagcugucucuggggaccagccugccccacuacugugugacauccacuaggacagaagcuucaggagggcagggauuuuugucucuucugcucccugcuggaucgccagcagcuaaaacggugccaggcauacagcaacugcucaggaaaugaaugcauccaucacucuugaaccaaguagucaauguuagggcuaaugcaccagaaaaaaaaagagcccugaagaauaauaaauaauaauugcuuuacucaaauguuuuacugaagggcuuauuccucugugcuaagugcucugcuaagugcucugcaccaucccagggagggagaagugauucuccuccccugcucagcagcugaggaaauggaggcacagugaccugaaguaacuugcaaaggcagucugacauccgagggacagcccuuugauuccuguccuuccugagacccacuucugcagcuuuauuuacuuucucaucuguuucuaacuuacauaagccagggcuuguuucugaugcuugcagagaacuacagugaagucacugccaucuuaagaucuaggcaacuagaauguugccuuucuauucagaaaccacuacuucaugcagccacaggaaguaauaaagcucaauaauuggaacaguaaugauauuagcuaccuuuuacugugugcucacuuaugagcccagguccucugccagacacauucuguucaucaucucuuucgucaucacagcaaaccauuuuauagaugaggaaacugaagcuuagagaaguaacuugcccaaaaguaaccagaucuacacuccucagcucccugacacauccccacugccuccugcuacugucuguuuuccuucuuuuucaucagcauacuuucccuacaggcaagccccccacuuccacaccaugucaagcugucucauaucuaaaaagauaaugacuguugacuguguaucuuguuuccuugaagacaaagcaguucuuucuuuauuuuuuaauuuuuauuuuauuauuuuuuacagagacagagucucacucugcugcccaggcuggucucaaacuucucagcucaagcaauccuccugccucagccucucaaagugcaaaaauuauaggcauaagccaccaugccgggcugaagcagcagcucuugacagccaccugauucaacaaaguaccagggcuguguugggcacuuagacgccccuguucucaagaauuucacagucagugauaauaaagaggcagauaaacaaaacaauaugccauaccuccccccccaccuaacuccacacacacacaaaaaggaaaagauaaaggaaaaaaaaaacagauaguucggaauuucgcaauuaaaaaaugaauaagaccauuuccacaucauguauaugucuuguguuuuaugaccugacauuguuuuuguuuuuaauuaaauccugaaaccuaguuuuggucacaaaauccagugcuauaccugauugcagccucuugcaaaugauuauagauuuugcacaaagaccgaggcgguuguuuguuuuuugagacaaagucuuacucuaucucccaggcaggagugcacuggcaaucucagcucacugcaaacuccgucucccggguucaagagaucuuccuaccucagccucccgaguagcuaggacuacaggcgugugccaccacgccgggcuaauuuuuuuuuuuuuuuuuuuuuuguauuuuuaguagagacaggguuucaccaugcuggccaggcuggucuugaacuccugaccucagguaaucuaccggccucagccucccaaagugcugggauuacgggugugagcuacugcacccagccaagacuaaggguucugaccucuacccaugacuccugcccacacccacagcccaaacuuuccagcauggcagcccucaccuaaggccucuuggccccuuugucucugacugcuccguggcugcagaaaaggucggcaggcagagcaugagguaucuucaugcaagauguucagcuuucuguuugugccuaaggugcacggugagggugggggacacacuguguucuccugcucaaggccaagggguauacccuuuucuuguuguuuuuuuuuugagacugaguuuugcucuuguugcccaggcuggaauacaauggugcgaucucggcucccggcaaccuccgccucccggguucaagcaauucuccugccucagacucccaaguagcuggaauuacaagugugcgccaccaugcccggcuaauuuuuuguauuuguaguagagaccggguuucaccauguuggccaggcuggucucgaacuccugaccucaggugauccaccugccucagccucccaaagugcugggauuacaggugugagccaccgcgcccggcccuuugcuuguucuuaaccucauuauccucuaacuucugagagucacacuaagaagucgaagacugugguccaaaucucuacagcucugccucucccaagcugugugaccugggaggauauuuuuaaccucucugggcuguggguuccucaucugcaaaaccacaacaauaaucauccuauuuuauaggaaaguuaaaugagaucauauaauuugaaguguuagaaccaacccugccccacaacaagaagucuaccauugcuagacauuucauuauaaaugccucauggaguuguagggaguagaaggugaagaacaugcuuugcgugauaaacaauguccauguuauacaugcacuauuauuguucuuauuauuaauuguuauuuauuaccguuauuaguuccuuagauuauuugaggucagaaaacagaagagacaaagggggcuccugccaaaggacccauuuuggcagcauuccaaaaggccuugaauuucugagacucucuagggaugauauugaagugacuguccacaggacucaaugguccaaaugauuccagauuguugcucuguucccauccucagucagggucccaccauggacacugggaauauaaauugggguggggggugugguccugaucccucaaagagaucacaaaccugcaucaggaaacaauaaaaagcaaaacaaggccggguacuguggcaccuguaaucccaguacuuugggaggccgaggagggcagaucaccugaggucagauguucgagaccagcuugaccaaucuggagaaacuccgucucuacuaaaaauacaaaauuagccaggcauggugguccaugccuguaaucccagcaacuugggaggccucccagcauuuugggaggccaaggcgggcggaucaccugaggcugggaguucaagaccagccugaccaaucuggagaaacuccgucucuacuaaaaauacaaaauuagcuggguguggugaugcaugccuguaauccuagcuacuugggaggcugaggcaggagaaucgcuugaaccugggaggcggaaguugcagugagcugaaauccagccauuuuacuccagccugggcaacaagagugaaacucugucucaaaaaaaaaaaaaaaaaagcaaaacaagagaaaaagaagaaucuuaugucugcagccaacuaugaaaggaaaugcaaaauaaaaaggccacacauccagaagggccaccugauauaaaacaaauagcaaaggggcagccaucagcaggccugccacugccucuccagacgaccuggaccggcaacuauccaaagucuuccacuucccccagauauucugccaauacucugcccaaaugcagggccacucacacaaacaggaggaaagaacagggugucuuauaguccaggagaucucuugacaaagcugccagagaaacguguccaucuugggcaggcagaaggcccaggcauggcaaacacaggcuccagaauccagccagagugccugccuaccgcucaggaggcggaaaaaaaaaacaacuaaagaacagggaauugauuugaugugggcagugagaauucaccagguuuucagaccagcaaucauauaaacuaguggggaucagauaugucagaacagaggggagaacuccuccuuuccagugcagaaaagcuccagccacagaaacacagcauggagguggcgaggggcgggggaagguguuuaagacagaggaaaaggaaaguuaaucagaaaaaaaacaaaacaaaacaaaaacggacuucuauuuuucaagagaagccguuuaugcaaaaauucugcacucaagauagaugaggcaacaagaauaagccacucuuaaccaggcaaaacagcaacacaaccacuuaacaaaucccucugggaauucaauggguacagcauauaccccacagucauacccguaaguggaauuccaguugggcccuugugccgaagcuuuagaccacgaggcacguccucaccuccaagauguaacucaucucaaauaauggagaccaggccacgagguuucucccagacacggauucuguauuuguccuucugcagcuuccgggaagguuuuucuccuaauaaauccuguagaaaguuccacucaggguucugaggauugauacaacccccuucuugacugaucagagcuuuagaaagauucgcuaugaccacaggacugugucaaguugaacaagucucaacuugucgcugccaguaugcaaaauaggucugaaacaucuuauaacagacaacacagcagacacagucccugcauccucagggcccccgcccacccaccacacacaaacacauuucucuagaguuuuuuuuuccuagcaaggaacuagccccaguagccaggauucacagugguggagugggcgagagacaggcuaacagccucucucuggaaaaccuaauaccagaaaggaaacaccaaaaccucauccucuugucccuaaauccuugcacgugauuucuucuccucucuaauguucuagaagggccuaaagucaggagcuuagaugaacagaagaaucuuccaugccugcaaaccaccaggaaaaggcaugaggcauccacacacagacgcaugcagcuucauggcugugcuuccugaaagucuacacccagaaccacaaacacuggcauaaauaagagcacguuagcaagagaaggcaaaccuaauuaaaucaacagcccagccaagaagaaugaccaugaugaggguuuaggagcacccaacaaacccucacaugcgaugcaaaaacugagaaagucucaaaacacggaguuacugaguuuuuggaaaucaccuucgcccagcccugagggggugugagaggaagcggggagugauggucaaaggauggagggaggaucacacauucacagaccucuaguuucgccagaggggccuccaaaccacaucauggcuccaaaucuguucugacugcagaggggucuauuuuuagaaauuaguuaauaugccuuugaucaaguucauaaauccagaauugccucuaugcaccggccauucggugucaucccccuccccucacccuccccaaacgcccaaacucgccaccagucuugaggcuggugaugaggacagugcacgccuagcacacacauauuggauuccgaaagccccuuuccuccguccgacuacucacagcgcaucccuacucagggccaagucucgagaguuuccagaaacgcaggggacaaaauuggaacuuacuggagggcagaucuggccgugucuccacaggucacagggaccgccaacauccuuuccgcaaggaaauccacuggaaggugccgggggucccggggcacaucuuugcucgcagcucgucgucgccccuccucgucccggccgccccgagcccgcccggcccgcgggcccaugugcucggccgccacacgcgcucugcccggag

SEQ ID NO: 192971 - RNA, 62420 nt, Homo sapiens
uggccagcuuaaaaaaguuuaauugcugaaaacauccaaggcaggugcgggccagucccugcggggcucacaccccccuuauuggaccaucagcucugugaugcccccuucuccuggcuacaaaccugggaaguagggcagcuggucccagggcccugagacuggugcugcucuagaaggccugguggggggccagcccccaaggcccuugaccagaacuggaacagcaggcaagauggggcagcguggggugaccaaagauccuggaugaggccaauccaggcugggaccagcccaggucagcagugagaccaggggagacagggugcccagggccugcccagggacaugcugcugaccccccgccacccugcaccccuggccacaugcuagcgggcagcugaugagcagcagcugaccccagagacagcagaggugaaaacagucccugggaacugccagaggcccagaggauguggaagugcccacgggaaggcaggagugcaggggugacaugugccggggccagagagguaucuuccagcuugaggaugagccgugaggugugcacuaggaaguggcagcacaggugagguggaggugacgggggcgcaggcuaguccuggggcgaaacaccaagaggugggagggagucaggagggccugggaagggaggaggcaugcaccguggcaugugcgagggaccgcgcugccugccgggaagugaggccacucacuacucacccacucguccucguccacgccuucaaaggaguccugggggaguggguccucccgguuccccaguuuugccaccauggcauucagcagcugggagagagggcagaagaaggguagguaagggaauaggacucccuguucccucucccacuccaagaacaacccugacaaggcugugaaaagaacuuuuuuuuuuuuuuuagacggagucuugcucugucgcccaggcuggauggagugcaguggcgcgaucucggcucacugcaagcucugccucccggguuuacaccacuguccugccucagccucccaaggagcugggauuacaggcgcccaccaccaugcccggcuaauuuuuuguauuuuuaguagagacggggguuucaccguguuagccaggauggucucgaucuccugaccucgugauccgcccgccucggccucccacggugcugggauuacaggcgugagccacagcgcccggccuuuuuguuuguuuguuuguuuuagagagagacaaggucuugcucugucaccaaggcuggagugcaguggugcaaucauggcucacugcagccuugacuuucugggugcaagcaauucuccugccucagccucccaaguagcugggacuacaaguguguaacaccacaccugguuaauuuuuauuuuauuuauuuauuuuuuugagacagaguuuuguucuuguugccuaggcuggagugcaauggcacaaucucggcucaccacaaccucugccuccuggguucaagcgauucuccugccucagccucccaaguagcugggauuacagguaugcgccaccaugcccggcuaauuuuguguuuuuaguagagacgagguuucaucauguuggucaggcuggugucgaacucccaaccucaggugauccgcccuccucggccucccaaagugcugggauuacaggcgugagccaccaugccuggccacaccugguuaauuuaaaaaauuuuuuuguagagaugggguuucacuggucucaggcugggucucaaacuccaucacuuauauccucuugcuuuggucucccaaagugcugggauuacaggugugaaccaccaugccuggccaaaagagccacuauauuuuauuuuuauuuuuauuuuuauuuauuuauuuauuuauugagacggagucucgcucugucacccaggcuggaguacaguggcacgauuucggcucacugcaaucuccaccuccuggguucaagugauucuccugccucagucucccgaguagcugggaucacaggcgcccgccaccaugcccggcuaaauuuuuguauuuuaguacagacgggguuucaccguguugcccaggguggucucaaacuccugagcucaagcaauccgccugccuugggcucccaaaguguuaggauuacagacaugaaccaccgugcccggccucaaaagagccauuuuaauuacagcccugacaaaaucgauggguuucuauugaaaaagacacaaagaagagacagggggaguaagagacugagaggcugcggcauguggcaccagauacaagggcuacuaucucugcacauggccucaagugcucaaaauauacuccaaggucccaaaagcacuugggcccagaacugccggcuuaggcuggguuuggccuggccagggcagggcucccacugcccucccccacuucccgggccccauggucagugguagggcucuggaaggucuccccaccaggcucuggugugaaggggacgugacauguggcugcugucccagucuggguuggggauggagaacuaaggggccguggccaggugcagccaggacucugucaccuccgcacagcugcucucucccaugccuaccuccuccuucuuuugcuggucagacuuuucuuccagguacugcgcugaggauggggcccgacgagcaggggccucucggggggcuuggcucacugggacagagcaaggacacgugucagagaguccccuucguuagggcucuuuggugccaagcccucggggauuucuuucuuucuuuucuuucuuucuuuuuuuuuuuuuuuuuuugagauggaguuuugcucuuguugcccaggcuggagugcaaugaugugaccuaggcugacugcaaccuccgccuccucuggguucaagcgauucuccugcuucagccucuggaguaguugggauugcaggcgcccaccacgccaggcuaauuuuguauuuuuaguagagaugggguuucaccauguuggccaggcuggucucaaacccccgaccucaggugauccacucgccucagccuccuaaagugcugggauuacaggcaugagccaccgcgccuggccgaccuaggggauuucuauggcgcagaucuaagaggugguauuaacagucaauggagccucacuguauaagcccugcccuagacaccacagugugugcguguguguguguguuagggguggggaccugugaugaaaacacagaccacgagcccugcccuccacuggcucagagacugauugacacagccacuccacccucccaaaggccagaggauucugcgugccaacaggaauggaacuucaaccugggccuucugucccuuucuccaacccccaucccgcuuccuccccacacccagucccucggugcaccugggcucaugucaggaggcugcaggcugagaagccagggcugcccauuagcgccuugcagccaggccucggcacugagcacaggcucccagaucacagccgugucugggaacacgucauccuggaagaacucuuucugcagagggagaaacgggcuguccugagacauugaccaggugcccagggcacacgggcaucuguuggggagggacagggcaagaccugggacccucccaccagccuggggcuuccaugaguuucagcaucucagcagaaggggguagguguccccaugaacaauggguagggaaguuuggaagcugggucagacgggacccaaacuccccucuaggcaccgagaaggcggugggcaugggagucccagguccccacccucacccggacucggggcagccggaaggccacaggcuccagggaggacugacgcagccgcaggcaccgcaucagcuccacuucccgcacgucgcacuccgucuuaggcaggaggacgaggcccugggggagcaagggagucggagcugccgcugggaccuagagcucauggcugggcacguagucuccccagggugccggcaccccucacuuaggaccaccaugccuagggccugucccuggacaguaacguguugaucauguugaacaaccugcucucuggagggaaagcccugauuugugguguuuuccuauuuccacaguuuacaaacucccaccaugggcagcuucuacgugccaccuccacucccugaaugugguguugggaagagauguaaauagcacaucauccugcauuuccuccaugcacuccaacacagaaacaugugaccucagcacaaauaauaguaaaauuggauaaauuaauuagaagugauaaacugaguguuuauuacuuugguuuuuaauauuauuuuuagguucauauuguagguucauauaguuuaaccuuaucuagugcaauuuuuuguuuguuuuguagagauggggucuugcuauguugcccaggcuggucuugaacuccugggcucaagcaauucuccugccucagccuuccgaaguguugggauuccaggccaccguacccggccuacaguaugauuuuuaauaaugguugaguaugacaauggcucucaaaauuccuaaauaauuccagcagcaacucuucuugccagucacugggcacagccccaggcccagccccagcccaggacucugacccccgacccacaggcuccuguacuugcccacauggccaccagggggcagggcagccuuguggucccaucggggacgaggcgccaggguggccucaccuugugggggucaggcgacgugaagcuguugcacuccaggaagaaaggggacucggggagcagcucguacaggaauacacgggugucgcccugcggggaagaaggcaggcugggaacccuccggcaacacuggccuuccccccaccaccucucaccugccaucccgcccuccagcccagcccaccuugccggucaggagcaccaggccagugucugggucguagcugggcagcaggguugagggagccacguccaggcccaacacugccaaggguccgccggccagggccucagcuucauauaggagcagcuggcgcucacuuuggcugcaaggggguuugggggcugaagcagguguuucagagcugaaggggccuggggcagggagaaggcgcccacguagccccugcucuguucuggguuguaggcgaggccuaguguggcccggcaccgcagccacauccuaaccugccccuccaccucuggguuccccauugacucuuucuccuccacuaaucacucacccauccaucuaccccugacugccucaccgccccugcuuccaucucccccagagccccuugugcaccccugcaucuaucuccccccaaccccucacccaccccucuauccaucuccccacuacccccaaaacaucccuccaucuccccuaccccccucacccuccccugcauccaucucccccuuacccccaacucauccaucgaucucucccuacccccucauucauccauccagccauccgcccaucuauccccacauucauucauccacccauccauccauucacccaccuauccauccacccaucuacccacucauccaaucaucuacccacccacccaaccauccagugaggggcaggaaugguuucugaaagccugacaaauguaugugacuguggagaagggggacacagguggcuucugaagccuggggauggggaugccugaguccucaccugucaaagccagacaccagcagacagcgaccaucacauacccagacaaugcgagcuccgcguccucccuugggcccugggccuuccuguugagauacaucgcgugacacccagccagcaccccugaaccaggucugaggccacuccccagccccugugugcucaccugcaggggcucagggccacuccggggccuguagacccgcacacgcccauccuugcagacaguggccagcugcugcccaucaggacuccaggccaggcugaagaucugggggcaggaagggauaugagagacagccuugcuucacugcuggccccaccucuccccacugcuccugccccuccucacugcuggcgccgccccuccucacugcuguucccgccucuccucacugcuggucuugccucuccucacugcuggccccccucuccucacugcuggccccccuucuccucaaugcuagcccggccccuccucaccgcuggcccugccccuccucaccacuggccccccucuccucacugcuggccccaccccuccucgcugcugguccugccucuccucacugcuggccccgccacuccucacugcuggccccaccucuccacacugcuggccccgccucuccacacugcuggccccaccucugcagccguccuaccuggucuugguggcccugcagcuucagccgaucagcuccagccugaaggucccagaugcgaacagugaggucauaggaggacgaggccagcacauuggcugccaguggguggaagcgcagggagcagaucuucuccguguggccuggaggaaggcaggggugaucaggagcccuugggagacacuggccaccccagccccauuccugagccugccugaccugugagcacagucucuggcguggugagcaccucuuccaggcccucugcggguacccgccacagucggauccuggcguccucaccagcugcagaggacagacaggggcucaucauugcugagcccaagaccucugggcuccccagccccuauccgggacccaggacccucccucaagcccaggcacccagccuccuuacccacagcgaggcgaugggggucaaaggggucccaggccagaucagucacagcugccccauucugcagcgugggcagugccgugucgggcaggcggccaggcuuccguagcugugggaggugcccccaccccgaggcccaucaguaccaggcagaaaagccaguccccaggggcugcgggcaagcagcaugucugggagcccacccucugcagcagaggcucccaccgcugggugacccaagcucucugcccugaccaccuugcgcucugagccccaagugccaaccacaaggccccagagagugagggggcagcagcgugaacuggcgggaaaagcuccggcuuagggcucagguggccgggcuucggaucccagcuccaccacuuacacagcugugugacccgggcaggucacuaaaccucucugugccucuucucccucaucuguaaaauggggauaaaaguggcaggccccauggcagguggcugggaggaucacaggacaggcgggcaggagccugacacaagguuugugcucccuguguuguguggguagcuaaggcccuccgcgucuuugccacaggcagggaacugaggggcagcccuggugggguggggcccucaccucaagcacagccaccugucccccgcugcugagcagcggcacggccacacgcagcuuguuggcacagaagccgucacucucaccagguguggugagguugagccccuugagguuggugauguggcugucucggugcaggacagugcccugagcauggcggaacuuggaacuggggccuggcagguggcagggacauggaaccacgugugaggaugccguccccgcccgcccugcacucuuugagucccggcugcccacuccccucaccccagguggauguacagcauggaccuaggcccaggccuuugcuaauccaguggaugcaacucgcccaggaauaaugucuggaaugauauacccuguuccaugguggcucggggaaucuugguggagcccagggcuuuggcugcucagaagcugguggccccagccgcccuccuauuuugcaggugagacucagccaccacaccccagcccccaggacaaaugacccugccagugagucugggugaggggggugcccugcaugaggccugugcucagcaguaggguacacaggaggaugacggggaguggggcagacagggcuccugcgguaggggugagcuccccguccugccuccuuacccagcaggcucugcagcgaccucaaacuggggcuggucccgaugccacuggugcuggagagugagggccccaggcuggagggcguggagggcgaggucagcgaacugggaggggaagagaaacccuccuggggaggggcauggggucagccagccugcuccuagguguacuggccaaaaggagggggugccagcggacuccagggucaccacucugggcccccugcggacuggaggagcccccacugugggcaugcgacaggagcggcggggggcacgggcauaaacgcagacacacagggaagcagccgagcuucagaccgcggggacagcaaguggcagcugcuggcucccagcccugcaggagggugugcccaguggguuagaucugccaguauuuuaagagaagccagaaaucuagaucuguaugaaaauucuugcuuuuuaaguguuugcccaauuuagaaagcacugugcaaguuccuucuuuaugcuccacguguuucucugucucuguuacacuugacaaagaagguuggggccaggcgugguggcucaaggcuguaaucccagcaguuugggaggccgaggagggcagaucacgaggucaggaguucaaggccagcauggccaacauggugaagccugacucuacuaaaaaaaauauaaaaauuggccaggcgcgguggcucacgccuguaaucccagcacuuugggaggcccaggcggguggaucaugagguuaggaguucaagaccagccuggccaacauggugaaaacccgucucuacuaaagauacuaaagauaccaauuagccaggcgugguggugcgcgccuguaaucccagcacuuugggaggcccaggcagguggaucaugagguuaggaguuuaagaccagccuggccaacauggugaaaacccaucucuacuaaagauacuaaagauacaaauuagccaggcgugguggcgcacgccuguaaucccagcuacucaggaggcucaggcaggagaauugcuugaaacugggaggcggagguugcagugagccgagaucgcaccauugcacuccagccuagacgacagggcgagacucaucucaaaaacaaaaacaaaaacaaaaauuaggccaggugcaguggcucaugauuguaaucccagcacuuugggaggccgaggcggguggaucaccugaggucaggaguucgagaccagccugaccaacauggugaaaccccaugucuacuaaaaauacaaaaauuagccaggcaugguggcgggugccuguaaucucaccuacucgggaggcugaggcaggagaaucacuugaacccaagaggcggagauugcagugagccgagaucacaccauuguacucuagccugggcaauaagagcgaaacucugucucaaaaaauaaauuaaaauauagucggccaugguggcacaugccuguaaucccagcuacucgggaggcugaggcaggagaaucgcuugaaccuaggaagaggagguugcagugagccgagguugcgccacugcacucuagcuugggugacagagugagacacugucucaaaaaaaaaaaaaggccguucagccggugaacacucagggcagccacugcagugucgcugagggaggaugggggcggcccugguacuuacgcuugcgucugcaucacccacgggugucuccaucaccgcaggcugggcugugucagggaggggcuccgcagggggcaccagacaggaagugaagcucggguggggccggcaggcgggguugaggcugaccuucugcaccugcauggaggccggcaguggggagaugggggcaugggcugcccggucaggagggcccccaugggagggucaacuggguagggauggggggcacccagcaggccagacugaguuggcacacagccacacggggcuaccagggacucggggaggcugggagaggugagccagcccugguccuaccugcugguuguccccagcccaccagcuaugggggucgguggcaggcacacagccggcaguguccgggaacagguccucguggaacuccacagccuggccgcagacaagcaggcagcuagugaggcccaggccccccgacuccccagcccccgcagucccucgcccaagucccccucaccuugcggggcacaugguagccgaugggcacgauggcugugucgcucagcuguaggacgcggaguaccucgcagcucaugacggccagcgccugccggggcacaagggcagccccacgcagcacgcucuccaggacacacugggucacuguugaggacaccauaggggaacaggcaggaugggcaggggaggggaggguaggggaugggggcgaggaagcaaggcuuaccugggcucagcgccggcugcugcgggaccaccucguaacaguacagcugccucucgcccugaaaugagucugaacugagccccguuugcugacugaaccccuggggagggcccaggacuggcaucagcucccccacagguccccaaggaccugagccacagaaccacaguggcuggagauggggcuccccaacaugcugggcgcugagcugagcccuaggcugacuaccucacuugcucagccucguugcacauggggugagcaccggggguguacgucaguauuuauggagugcugacugugugcugacacugcucuauucucggccuuguucucaggaaggccaguguucuaggagagcuacagucaccuuggcugcacaggggaagacacagaggcccuguucgaguuccuccucucucuuggggaaggccaggggcuggacuccaggcuguggaugugggugggagccccagcuucucacucaccuuuccugccaggaccaggagcccagagucaggguccagcagaggcacgagacaccuggggaagagagggcaagauggcgggucagggcagugggagggcugccagacucguaaccccauguaggagcccaggacaggcaccacagugacugggagccgcuuggccauccagccauguucagccugguccccaggaacccccuccucuuccugagcuucccacaugcccaacacacgcccacaccccagcugcuccuccccagggccuccaccugcacaccugcgucacuccaggacuggagugggcacaggggaacucgggcccgaucucagccacagcucuuccuccaagaagaccccacaugcauucugugccccucccaccuucgacagccuagacaucaggccagcauugccagggaagguggagaggugaggccggaggcgaggagccucccguccccacucggcacugccuguggacaggcagcauccgggagcagugcaggcagcccugccguuccgaaucugcacuaagguuuggggcccucuacucaguuaccccacguuuccugugccucagugauaucuuggaagcucagagacccccccaugcugaguuaaaguuccuguguccaaaucugagccacgugcccgggagaaggggcuccuccggccgcugggcuucccugcacaccccaggccugcugccccggccgagccugccagcagcaugcucccaggccuucucuggucucgaggcaggagcagggcgggguggcagcugggaauagagugggcgggccggaagcccccagagccccugccacucuauguccagcucagccuuggccaacugccugucacuggccgggcuuuaugccucccucccggggccccucagagaccccugcacagccccucagcccugugagagcugccuucccacuccagggccuuuugaggggaauggggaccuggaaggacucugacagaugcccagaugcccaguugccuuccuguguuucuugcuccugaucuuugcuuuuuuuuuuuuuuuuuuuuuuaagagacacggucucccucugucacccaggcuggagugcaguggcacaaucauugcucacugcagccucaaccuccugggcucaagcaaucuucccacucagccuccagaguagcugggacuacaggugugcaccaccauggcuggcuauuuuuacuucuauuuuuguagaaacaaggucucacuaugcuuccgaggccggucucaaacuccuggccucaagugauacucccaccuuagccucccaaagugcuaggauuauaggcaugagccacugcacuuggucuugguuucuuguuucugggaccugcaggccuggacccucccaacccagacacugacacccuuaaacaggaccccguccccacuguguugccagggucagaggucacccagcuguggcagcugccucuaucccucacugcggugacaaagggcccagccgcccuccacuguccacccauccccuccugccagccgaccacuaagcaguccugcccaccuccccuccccacacuuccaggagccacagaguggcugggaagcuggguggggcccugggugucuccaugacuuccuggagugccuugggcuggucaccugugaguaacacaggccccuacuuacugagggcccagcagggugagccgggcucagcaaugcccuuugcaucccggccugaccacugcuuguagagguggaggcggaggcggaggguaggggaccaagguggugcgugaccuggagugcccuccacacugacacuggcuccacuggggcuggaagcaagucccuucagcagcuuugacagggcuuucacucauucauucguucacaaucauucacuccuuugaugagcuggucugugccugguccucggcucgaccugcauguagguaugcccagagaugagugcaacagacccugccucuguccucaaggugcucacagccuagcacaagaggcagacagacacaaucccauagacaaacaugugaagggaagguucaccgaggacacacagugacagagcagggggacugggccucagcagugggggaaggggugaucccugcgaucccaaggucaugcagaaaucaaacaccucacaggaagagaguuucagagagaacacaaccugugcaaagguccuguggcagguggguucauggccuguuugaggaacaagauggacaaugugccugacagccuggacagugugggugagggcugaggcucaggaugggcagguggaggcuagacgggaaggggccuggugcauguggggagggggaguucugccuccaguggacgagcaaugaaaaggugacggugcguuucaagcaaaagaggcuaggccaggccuagugacucaugucugugaucccagccagcacuuugggaggcugaggugggagaaucacuugagcccaguaggucaacacugugaccagccugggcaacaucaugagaccauggcucuucaaaaaauuaaaaauuaaaaaauuagcgagguaugcuggcucacgccuguaaucccagcacuuugggaggccgagguggguggaucacuggaggucagcaguuugagaccagccaggccaacaugaugaaacccugucucuacuaaaaauacaaaaauuggccaagugugguggugugcaucuguaaucccagcuaauugggaggcugaggcaggagaaccacuugaacccggcagguggaguuugcagugagccgagauggcaccaaugcauuccagccugggugacagagugagacuccaucucaaaaaauaaaauuaaaaauuagccugcugugguagugcacaccugugguccagcuacucggcuggcugaggcaggagggucacuugagcccaggaguuugaggcugcagugagucaagaucgcaucgccagcugggcaugguggcucacaucuguaaucccagcacuuugggaggccgaucacuuugggucaggaguuugagaccagccuggccaacauggugaaaacucgucucuacuaaaaaugcaaaaaugagcugagcaugguggcgugcaccuggaaucccagcuacucaggaggcugaggcaggagaaucacuugaacccgggaggcggagguugcagugggccaagauugcaccacugcauuccagccuuggcaacagagugagacuccaucucaaaaaaaaaaaaaaaaaaaaucacaucagccuggguaacacagcaagacccuaucucaaaaaaauaaaaauagaaagaggauaggaccagacuggcacagaguagggaucacacuggcugcugggggcacaggcugggaggaguggaaacaggugccaggacagaagcugagggcaaguaggauaggcaggucuccuguggccccucugcugcccuuaugagaggugggaaacaggccuggggccaccucauggcaucagaggcucaccugugcgcugagccaacugccugaggaggccuggugcucagccucccucacccccguuccaucgucccagccagccagccacugacucaggagcugaggccgagugggcaggaagucagggagggcagggcuggcuccucugacaggucaggccagucuuccuugccucaggcagagccaucuggacaacucugccaggcaggggcauccugucugccguggcacgggccaagaaauggggucauggcacccagccccaaagguuggccaaguguuggcaugggccugaccccaggcugugugaagagagccaagcugggucugggucuggaacaugguacaugagccccagccaggcagagggccagaggugguaagagguauugccggcaccucuccugcuggaaucugggccugccacugggaagggcucugacccugacccagguccaggggucugucccaggcauaaaguuauagaaggucuaaagcccagaucugcccccgccccucagccaggucccaggagcuagaagacaaccucaguaccaacugggaggcacgagcaguuucagccuccggauaagccccgccagcucucccaggacuccugugauuagcaccgaggggaagcaccaagggugugcuugcuacaaggagcagcugcaaggcuccuccucuguccuccccuccagcccaucccucccgcucaggccccuucccaccaacccagacauucugccauugcgccaguucaaagcaggcugggucccuuggaucugucccuaucacccaggcuggagaguuaguuaggauccuuugaccccccuccacccccacagccccuagcucccccgcugugugcagacugcugguaaccagguucuaaaggcggguggcaccuugaaaccauacaaggcaauguuggauaaacugagaggggucuccuaaaagcuucccuugagccucuggguaaguggggaccuguguaaggccagggcacaggauuggggcagggggugaacaccaggcagauggggucucuccgucuacaagaaccugccacagaggugagaagcuucaaggacaucaggagguccuguuccuugaggaaagccaggcuggaggcucuuggagcccucuuuaccccugacccugggcaucuguggaugcuucugagggcuucagaggacacagggccaagggaagaggcagggaaacaguccgacaagaggcugcacagcacugauuggaaacucagaugguucuggggccgggcaggaaacucaagugaguggacagcuuggcaggaggcagcagggagugguggggacuggggugacccaugagcccacauuuuggcagagggagcaaccgccacucagccccagcugagaguuccuguucaaugcaagcugggaagccccauuuuaauaugaaaccaccugauuuuucaauguuagcagugccuucaaaguuguaaaaacucccauaaagccugcacuaaaugcacccaaaggccagccccaacccaggaacagagguccgcaagccaugcccuaauccauguagaccgagaaacguauggguuguggagcccugccagcccuggaaaggggcccuguggggagagggcccuguggacgggagguccagaaggugacugucccagccaggcccugcuuagcccuugacggcuagacacagaggccauccugccuucuggagauaacugaguccuccagagacuaggaaacccuccagcugguguggcccagccucccagggauaagccuucaggccccccaaagacuagagcuagcccagccaagggccuuggcuacaggccgggcuggagggggugugggugucccaaggcucuccggaagucaggagcugagcugggcccccaaaggcucugaggcaugacugaccacaaacgcggagggggaggagggcagaguguuuuccuggaauccuccaaggcaggggauuuuucuggacuaguccggccccuggcacccgccccuccugcccaaucaagggccacugucaacugcagcccaggccccacccaccgacggugaccaccccuaugccuccacagcucaggcuugaagcugccaguaacuguggggccgugggcagaccaccacugcccucccugacacagccccuucaucucauaauaugguggggaagagaguccagggcugcucacaacucuuaaggcugucguggcuaagaggacccugagcucagauuuggcauuggaguuuauacuuaggaggcucuugaaagggcuuugugugggcugccaggaguuuuuugaaauugggauuagcuaccaacaauaacacauugagagauuucaccuaaaaaucuggauuuccaguuucucuucaaaaauccaaagcucuagcuggcccgggcuggucaugaggacucagcccuuaccagccccacucccgccauccugccucuccagggccgcagaggcccugggguggacuucuggcauuugucaccugccuggugccucauaggcaucugggcugugacgcuuaggauuccuaaauagucucucgcuuuuuacacaaaaagcagaaaccugcccagugucauccggcaaacccacgacgggcaaggucuccccgcgcaggucagguggccgcagggugagggccagggcaacccggcccacgagccccucgguggggaaggggcgugucuccacgcggcuccgccccggccaauggggagaggccccgccccugccgcggcgggcccgccccccgggacucuuaaggcgcgaccugccuccagcgagccgacuccggagcccgagcccggggcggguggacgcggacucgaacgcaguugcuucgggacccaggacccccucgggcccgacccgccaggaaagacugaggccgcggccugccccgcccggcucccugcgccgccgccgccucccggugaguuucuguggggcuggggggcugcgggcggggaagggggcgccacggccaggcugugcacacgcgcggggaccgccgccgcgcgcacacacgcacucucgggcgggaccgcggccccagccccacacggucaccugggccgcccggcgggcaggcccuguacgcucccucccccgccguccuggggcgccgacagccccgcggccggccagggugcgcgccugagugugcggugagcccgcgaggcugcaagcagacaaaauaaacaccccgucccaugcuuccuccucccacggcugggccuccggcaugaccaguuuuaugaaucaaaccccuuugagggggauagccaagccacaggcuugggucacuuuucccuccugggguccggcaguaggugcugcugugcagaagggcugcccgggguccucuggacccuugucacucaaagcacagcugggggcuacagauaugcagcccuagggaggggcggggaguggcuggugggcguccgaugcccaucccuccaggugggggauggaccuguacuggccagggcccuuagagcuucggguaucaggcagggugccgggucucugccucugccagggaaggggcuuugcuugggcugcaaacccaguggccuggagccagccuaguccuuugugucccugggcuggcagugcuggggccugaggacugcugagguccccuguggucacuggcaggccagccgauuggugccaaccauucugccucucccccauucguuaacgauugccacaccagggucacugaccgccuccccugcuguggcccagggguggagugugcaggguggaaggaagagguccugggggucuagguguccccaugccugccuuuugcaccaaggacaggugaggcucuggagagaggcagcgggaccuagagcccccuuccccaggcugagagccuccagggcuggggauuggauaaaaucuccaaggucccuucacacuagacuguacuuuggguguugagggcauagagggguggccgggcugggaccuuccaagcaggguccauuagggccaguccagggggcagcaaaguccaggaugggcccagcuauugacaaaaacccaacagagcuggggcaggcgggugggggauggggagcaguccccugaguuuacucucuucucccaggggaguuggccuggagcuucuguaaacagagugucagaggcaggaagaggcucuggugaugagcagcccagcuggauccccuccagaccauuaucuagccuccccugggccuggggagggaggaugcgcacacacaugccagccugggggccgggcacugccuguccccaccccgccccugucuccugcacguuggaacagcuguccugcuaccuguggguccggagggucagauggggauggggcugggggcuggggucccagggcauuuguccagauggcaccucucucuccauauucugggaaugggagaaugggauucagcauaaggagccucucagacacugcccagaccugugcuuacccgaggaaggccccucuggcacgcagcccaggggccagggagauggcaagggagaugccccgggcaggagauggguccgcggcuccuagcucccauuacugucacccccacugacagccccgggggagcugggacaagucccaaguacagaaaauuaaguccuugccugggcuuauaagugggucccaacacaacacugggcagccucugggaacaagaaagcagggcccugcugagcccaggagggagcucccaccucagcaggccagacagccaguccugccagugagcagagguguguagaggggaggcugcccacagggauggcuaucccugaccacuggccagcccugagcucaugggagggcagcaaggccaccuaacucuguuagugaccucuccuggaccccccaucagcugcccuuagaguccccucccugggcuggggagcccaaggcucugugcugccaagaaaaccagcuccccucacugcuguggaauuugcgugaguucuuggagaagggggagggugcacgugugugugugugugugugucugcaggagcacugcccagugggcgugugucuggcgugggcgugucugugugcgcgugacuggagcagggcuguguauuuggggguggguggggguguuugggggagccugcuugcaccaggaggggcagggccucagccuccuuccuuuuaucgguuuccacauuccagagucagccggaucgcuuucccuccgcgcugggccgccggccucccccgcuuuuccucauuccagccucccugggugugaggaggcuggaggaggcucccucaggccaccucgguuuugggcagggggugggggcaggcgaggggccaguuauucuucaggguucgggacggcccccaccagacucuucguggggaaugcaauaagguucugacauuccucaggggcugccugagagauuuaauuaaggagggaggagggagccggccuacaccgggaaggggcuggggcggccgcuggggccccugcuggcccugggccccgagcccggcugggcauugagagcagugcgggggcaggguugugguucaguggccagguccuguucugccucccugaauccaucccgccugcccauugaucagcucacagaccccaggggcgccauuucugccacggguuggccaagaacccugggugauugugggggguucggcauggggagcuugagaagggcaagaccccuuccagggccacuuccuucucagacccccaggcccaggaagcuuagggcuggcggccuuccuuggugacuaagguguucuucuggcaaguucaggguuaauugcagguuagggccuuacuagaugggugcuugccccuggguggggacagggcagugaggaggccccgugugagggcccagcccugguggcaucacaccugccgcgugccgaaaguggcaucuggacuggcccauuucuaguugggcugcagccacugcacagcucccagggccacagguguccucccugacagguugcaccucuugugacuacgauggcacgucccaccgccccaggggcucacuugagcuggggccuggccuuagucacuggucucccugcccugggcuaacaggucuggcagcugccaagucacccacggugcuacugaaggcacccaccuggggccgggccagccuccuggguggagggaggagggaagacccugugccugccccucucccagcccugccagcugguccacaccugcuccaggauacagagccuccucccugcacaggaagacgagcugacauccugacuguccccuuugcaacccucuguccugguguucugaacccuggcugugcggaggacucgcucaaggagcuucuccaaaauacagcucugccugggucucacuccuagacauucuuuuuguuuuugagauggaguauugcucugucacccaggcuggagugcaguggcgcaauauuggcucacugcaagcuccgccucccagguucacaccauucuccugccucagccucccaaguagcugggacuacaggcgccugccaccaggccuggcuaauuuuuuuguauuuuuaguagagacgggguuucaccauguuagccaggauggucucgaucuccugaccucgugaucguccuaccucggccucccaaaguacugggauuacaggcgugagccaccaugcccggcagaauuucuuguuuaauuggccuggggguggggccccagcauggagguuuuuuuuagaaagcuuccuggaugauucugaugugcagcccggcgggcaaagcccuggcgucacaggugggagacggaagcccagagaggggagcuugcuuggaugaggucacaaagcgugugagugccugacugagcuccuggcuguggcauuaucuguggaaugaagagcgccagcuuggggugguggauggaguaagaaagaggcugacacccauggggacccccgcucaaucaccagccagggguccccgcgccuauagggagggucuaccugccgcagucccugaggaacucgaggcccagcccucucugccccuucugugagggcccacgaccccugaccucucugcccugcccuugggacugcugugucccaaggaaggggagacggggcggacccagccgggcccugagccuccucggacacgucagcgaaacuggagccagccguccuggccgccggcacagucccgccugccuggagggguuggcagacucccggggcugggcugcugccaggccugaccggccacacagagccuuggcgggccagcaugaggagcgggggcccggagucucagggucagaccugcagcgccuguccugcacccacgcugaagcauacggcacaggaggggcguacuggccucagacugucuaucugucuguccaagccuguccccuacucagcaggcacaccgccugccccagaaucagugagauguucucgccaggggcugauguggucaccagaugccugggucccaccccagccaugcuauccccuggcccguccccgccugacccugggcgugugugguguaccccagaggugggugggcgucccccugggaguugagaugacgagugccuuguccuccuuacucauagggccccucccugaaguccugugcugaaggggccgccaagggacagcucacccaccacgugcccccuuccagaaccagagauaccccacccccgcuccccagcccccagggugaagggcagccuugguguggggaugucugaucuguguaaagcuggccugaaacccucucccuuaguaguacccacgcccagggggcaggcagaguucugcguuuaugagugacgcccuccgcagugaauguuuaccgaccacuuggcaagugcuccgagcacagaccaagucaccccagacacaggcaccacgagcaccacgagcagcgcccacugcacaaugggggcugagguaggggucguggccgggcuguggacccugucgcccuaugccaguuacugugccagggagggagcaaggccggcagcagcacucagcaaggcugaggaacuuggguggaggacggaggccccagacccuugcgucaucuucccaccccccgacguccccgaaucccaggaaucccagggcugccuccggaacaccuccugcaccaggcagaggaaaaggucucaccucccugccugacuagugaucaaauaucaaagcccagguccugggaucaccgggugggagggugggugggcggcggcaaccaccgugugaccuguagacagcccccagccccacgcacacaccaagcacacgcccagaccccaggcgggcgggacagcucccagaacuuguuaaaagaacuuccccauuugaaaacaaacagaacaacagaaaacuacaacuccagagggugagggggcagggcugcuugcaccaacuccagaggugagaaacugaggcccacaguugagaaaggaacucuggccucuguccccugccaccguccccuccacagucagccuucccucgcuggguuccucucggggcuggcugauggguucucagugccaggagucccuggcggugcccucagagcugccagccuguagcuuacaaacucugggguuuuccaaagcuccagcgcugccuccucccuccucccuuugauguggggguagaauuggggcucaggcaaaagagcucaccgcacauuuuacggggcugggaagcaggcuggcugccgccugcuggauggucagcccaggaccccagcccacaguccugaccuagaccccuguccugcuaacaggaacgcacauuccacagcucacuaccugucagccggaaagccacccuguggccagauggacccacagcauccccucucccuucacaaccuugcugauuaaagacccaacagauuacggagcccagagcuauggcuggucccccuccccagugcagggugaagagcaccccccagcacgugccccuaagagcuggccugcacaccuggccuugcagggcugaggacuccacaugcaucccccacugcagcccugaagugucccagauacucagaugaagaaaccgaggugugagagcaaagucacugucugcggccucacagcuuggacaccucugagcacagggccgccugccuggagugagcgcucuuaacugugaccuuaaacgaggcccaaggggagcugcggccacagugguggccaggcuggccaggcuggccacguggaggauccccucccacucuggaaccuggcugcauccuuccugacccuggucuggcccugcugggagggcuaauucaggcagagguggccucaccccccauauggacauggggugggugggggucacucacagcccacaucuggaggccaggccgcacccgccguccucugagucagugaggguggagcgggucccaugggggaagagaaggcuagggguguggccccagggccuuaggucaucagacacgagccccccuggggugggcuggccgggccagggacgcgugccugggguuuggggugcuaacuucuuccagugcucagugccaggcccuccugggcuguucacucagcagaccugagcuaagugggccuggagacaccuauggcaaaggcaggcugggucucaccuuagggaggugagggggcacacgacagcaagggggacaccgcuagguuggggaggcuuagccugcuggccucugaagggugcuuguugucgcuaacuggcuaggggcucagggucgguagcuccuaggggagacgacucuggcagugcgauacuacacgugggcagggccugcgugggcccaaccccggggacaagggcuucuuccuucaccucgagcuacccgcagaccccaguggucaccucaccagugacuugucuaaucuguccugggaccaccugcuccuccucacauuccaggaacccacguaccugggggagagggagcccuauggacggguccccccagccuggggcggagugcaggcugggucggggucguguucccuggacuaccugcacagccugugugggggaaggggaagcccggacuccagcacaaagggcucuugugugagcugcaggcgccacugggcaggaugcuuccuggggaugggcuggcaccccguaugaggcucagggacuucuaggggugccaaaguggggagggcucuuccuggggacggccccagcggucuccccaggagucuaggugaugggggccagccacagaccugccugacuugggcagugcagcuaagaucuggagccuggagcggcuggugggagcccccgcccccagggccaucuggagggcacgcacccuucacagguggcugcugcacaccugggcucuagcucggacuugcuggcaccgcaauggcagcgagucccugcaccuccaugagcccugcuuucuucugucugcccugacguggcugcuggggggcuaccugaggugacgguaaacacuuaguguuccuucguccuucccacuucgcuggcacaugggaaggacuugcaccaucacugccaaggggauggcugcugcucaucuuucuuggugcccagcucagggcagaccccaagaaacaguagacgaagccgggcacgguggcucaugccuguaaucccagcacuuuuggaggcugaggcgggcagaucaccugaggucaggaguuccagaccaaccugaccaacauggugaaacccugucucuacuaaaaaaaaaaaaaaaaaaaauacaaaaauuagccaugcaugguggcuggcaccuguagucccagcuacaugggaggcugaggcaggagaauugcuugaaccugggaggcagagguugcagugagccgagaucucgccacugcacuccagcuugggugacagagcaagacuccgucucaaaaaaaaaaaaaaaaaaguagaugaaugacucugcagaguuuucccaggccuggcacugccccuggggcugccauguagccaguguccccaccugagcccuguggccccccagcuccagcucugucaccagccucagcuccccgccucccucccucacaggggacaccugccaaugccuguggccucugccccuccuccaggaaccuucccgccggccacuuccuggcggcccgcagcccccagccuaagcaggucugacugcccaaguggaaaaacauggaucccauaguuuccaugugaagucuucccgcugcauucccuccuccaaggagggcgggacacggagcguggcagcaggagccggcggccaaggcagccagcuucucugcuuacacacccacccagcugccugccugcccccucuuccagacccuguagggaggagcugccgcuccaagucccaccauucucuccuuccugguccaucucugaggcaggggaugggggaaccuaccuaggcagaggcaggagggccugggguucaggaggaagcagugcauggucacugcacguucaguggaugucaugccccaugaugaccucugugugcauugacaaggucacacagugagggagugacggggcugggacagaaccugggucggggcacuggcgaccugacucauaaccauuggguucucuugcauuugggggcagaagcagugaauucccucuggcucuuccuggcgugucugccuucuaggccccugacucacagucuucugucucugccuccucucugcucccagggacagaagaugugcuccagggucccucugcugcugccgcugcuccugcuacuggcccuggggccuggggugcagggcugcccauccggcugccagugcagccagccacagacagucuucugcacugcccgccaggggaccacggugccccgagacgugccacccgacacgguggggcuguacgucuuugagaacggcaucaccaugcucgacgcaggcagcuuugccggccugccgggccugcagcuccuggaccugucacagaaccagaucgccagccugcccagcggggucuuccagccacucgccaaccucagcaaccuggaccugacagccaacaggcugcaugaaaucaccaaugagaccuuccguggccugcggcgccucgagcgccucuaccugggcaagaaccgcauccgccacauccagccuggugccuucgacacgcucgaccgccuccuggagcucaagcugcaggacaacgagcugcgggcacugcccccgcugcgccugccccgccugcugcugcuggaccucagccacaacagccuccuggcccuggagcccggcauccuggacacugccaacguggaggcgcugcggcuggcuggucuggggcugcagcagcuggacgaggggcucuucagccgcuugcgcaaccuccacgaccuggauguguccgacaaccagcuggagcgagugccaccugugauccgaggccuccggggccugacgcgccugcggcuggccggcaacacccgcauugcccagcugcggcccgaggaccuggccggccuggcugcccugcaggagcuggaugugagcaaccuaagccugcaggcccugccuggcgaccucucgggccucuucccccgccugcggcugcuggcagcugcccgcaaccccuucaacugcgugugcccccugagcugguuuggccccugggugcgcgagagccacgucacacuggccagcccugaggagacgcgcugccacuucccgcccaagaacgcuggccggcugcuccuggagcuugacuacgccgacuuuggcugcccagccaccaccaccacagccacagugcccaccacgaggcccguggugcgggagcccacagccuugucuucuagcuuggcuccuaccuggcuuagccccacagagccggccacugaggcccccagcccgcccuccacugccccaccgacuguagggccugucccccagccccaggacugcccaccguccaccugccucaaugggggcacaugccaccuggggacacggcaccaccuggcgugcuugugccccgaaggcuucacgggccuguacugugagagccagauggggcaggggacacggcccagcccuacaccagucacgccgaggccaccacggucccugacccugggcaucgagccggugagccccaccucccugcgcguggggcugcagcgcuaccuccaggggagcuccgugcagcucaggagccuccgucucaccuaucgcaaccuaucgggcccugauaagcggcuggugacgcugcgacugccugccucgcucgcugaguacacggucacccagcugcggcccaacgccacuuacuccgucugugucaugccuuuggggcccgggcgggugccggagggcgaggaggccugcggggaggcccauacacccccagccguccacuccaaccacgccccagucacccaggcccgcgagggcaaccugccgcuccucauugcgcccgcccuggccgcggugcuccuggccgcgcuggcugcggugggggcagccuacugugugcggcgggggcgggccauggcagcagcggcucaggacaaagggcagguggggccaggggcugggccccuggaacuggagggagugaagguccccuuggagccaggcccgaaggcaacagagggcgguggagaggcccugcccagcgggucugagugugaggugccacucaugggcuucccagggccuggccuccagucaccccuccacgcaaagcccuacaucuaagccagagagagacagggcagcuggggccgggcucucagccagugagauggccagcccccuccugcugccacaccacguaaguucucagucccaaccucggggaugugugcagacagggcugugugaccacagcugggcccuguucccucuggaccucggucuccucaucugugagaugcuguggcccagcugacgagcccuaacguccccagaaccgagugccuaugaggacaguguccgcccugcccuccgcaacgugcagucccugggcacggcgggcccugccaugugcugguaacgcaugccugggcccugcugggcucucccacuccaggcggacccugggggccagugaaggaagcucccggaaagagcagagggagagcggguaggcggcugugugacucuagucuuggccccaggaagcgaaggaacaaaagaaacuggaaaggaagaugcuuuaggaacauguuuugcuuuuuuaaaauauauauauauuuauaagagauccuuucccauuuauucugggaagauguuuuucaaacucagagacaaggacuuugguuuuuguaagacaaacgaugauaugaaggccuuuuguaagaaaaaauaaaagaugaaguguguuucuugggcucagccccaggguagaagggcuggguggagggagaugaagaaggaguggcccucgcucuggggagccagggccccucagcagccccugggcuugggcagcccucccagguguccugaccugggugccauccacccuaggcuugaaugaggugaggcugggcccaggugggagcagggcugccucuggccucggacaagaacgggucagggagccucaccuuccccaggcccugucuucugccagcaggggcucuggcccaugugcggcugggagaggcuuguggcacauguggggccaggugagucccuuguggguuggucugaugggcaguucacugccugcuuuccuccagggacagggcccugggcucucucauuccaggccucauggauggucccgggagcaaguggccuccgggaccuucucuacagcgucccgggagagccaagcgguuugcauggccccagccccaugccacuccacugcccaccaugggcgcagcaggaaauccugcucccugccuccugccccuggcuacagcgagggcucuggugggaggggaagugugaaucaucaaaggcagggaccccauggguggggagaaaggggccgagccccagugagcaggacaagcugggggacaggaacaaagggcccagguuggcuugcagacggugccaggauugguggccuugggaugcccccucagccccugcauuagggaugugcccaggcuuucuggaaacccuagaagugggagcauuuuccaggaaggcugcaugcugaggugggggcagugaugcugagugcagcuguggccuggacugggugcagggggcuuggggacagugauggacacacagcaccuuuuccuguuacccucagugggauggaggggaggggacccacugggcugccgcugcaggggcacccagaacaugcuggagugagccuccugcagaccccaugccacugucccacaggucauggccccggcccccagcacucaggcucaccccuggugggacagagucagcccagccagacccagggagcaggccccguggcgcggguguugaugucagugccgagucaggcccagccacgcgaggcucuggauucaauuagcggcugcugagggcucuggcacgaggagggaggaggcgggccgugggucauggcgggcagugggugguggcagugggccuggguggggccccuucuuccugaggcagcggcggcagcccagguggauuuccuguaggccugggucccauuaggggaguggcugcggccaggccugccucccccggcccguggcugcaucgucaaaggggccuuugugggccugaggcugcugcugaacacggcggcugcugaagaaauguuuucacugcaaagcaaaccuggccgagugggaugguggcagggggcaguggcggggggguggcagggcccaaaaaaaggaagccuucccuggaacagugucuggagugugccaucagaucagggcuucggggaaggggagaacccagccagggggcgaccaagcugagaugcagccucgacccgggacaagccccccgacucuaggccagggaccaggggcagacgugggggugugcgagcccccaucaccaggugcugacugcagcaggcccugggccaugugggugacacaugcucuuguuucaugcccggcgaccucgucuauugaaaaggaguggccacagggagggaagacaacaugcucacaguaaguggagacaggaccccagcaccugcuccccagccacggguggggcugccggccacgcgggagggcuuagggccacugugagcuacagaagcaauacacccuacuucuauggggguagggggugauacaguucacccagcccccucacaggcauucacacacucauccccgcucaauucacacccagaagcguggcacccaagacagguguaucucugcaucuccaagaccaaagcaugagcuguuccuucagugcaggcugccagucccucucguuauccccccaccuccacccugcgccaagcaugguaccaagcacacaaagugcugggcagcccuccguggaggcugccugagcacagacaggaccuugguguucgaggcuggccuggcucccagccccugcuccucucacuguggcuggcuuccccuuagauacuccacaaaugucaggggaagggcauaggugggaccacagcggaggccccugggugaggaugaggaggggacggggugugugcacgaacccuggccuccucuagcucucauaagggcacacacuguucugcccaagccaagauggaaaaucuguaaaacagaagaacucgagggugguggaguggaugcaguugccaaccuccccauuagccgugcccacagaugacacuccagacuuuccaugcucagccuagauuugcucagaggccccggcaccccagggaguuaguggggggcuccagcuuccaggacgccugggggugcaggggaccugccaccucucagaacagcuggggggcuggcacacauccuuggcauccaccagcuucaugggggcuggcagagcaggggccagggcucgggggcagaggggagaggacccuagccuggccacccaucugggagugauuugagaaauuccaguccucacugguccuucgaggcuauucuuaacugugguaauuacagggucagccuuggccaguggcaccgugaggucugggcaucauuaacuccuccagaggccacacuggggccgggcaggagacgcuuucaggggauggggacccugucacugggggcagagccuggaaggcaggaagugguggguggaagugacuggugccaggucccuucacacaaaugccuccacugggggcccugcagggaaggggcugucugaccuagaaaggucuagaagacaagaugccaggcagcuccgggccugggaugggggacauggggccagauccuagacguggagucugaaggcccgggagcuccgacuccucaaggcggggcgggucccacugacuccucccugaaucuccaaugcccagagcaggcaggaggcugagggcagcccugacucugccucuuacccuccauauggcuucagggaaggugccgaaucuugcucaccuuugccucccucaucuguaaaaugggccuugccagcuucucagccccucccugggugugacagggugggaaagggcgucacugucacccugaccccuaccccuccucugggcggcucucagcccggggaagcccuuggcaggagcucucgcugguacucaggugggagcucuucuggggacuccccggaagaucccgcagccuuccuuacccccagacacauacccuugcugcucccagagccuggacaggucacuguugccugugacucaguuuccucaguuaugcaauggaagaaugaauaagcuugccaaguaccaccccuuuccuggcucugacauucucggaucccccugccugugaagauuccagcaaggcccuuauaagucacgguugaaguuucagaaggcggauggagucccugucucuccaccccggcccugccuggcuacgucucugaacaccccccccagccucagucuccccagcuguguuguggguggucugaacagaugagucacucauaaaugcuugcccugggccuccuggugucuggcuccugagccgcagugggccaaggccaucucggcacacagcugacugugccuggccaggaccccgccaggcacugccaaaagcccucuccacacacuucugggggcagauggaaggaugaggugcaccuggagccccccaggcugccugggcaccagccccaccuggggacauaccucaggauagaacaggacagccauguggcugguguggaguaggccgcauaaaccucagugggccgcauaagccaaggcccaccuccaccuccaccuccaccuccacccccacccccacccugccaggcuguccaacaaugcccacguccacccuccuaucauagccuggagccucccugggccucagcccugccagaacauccacagaaaaaugaagcguauucuugcacuucuggaucacacccucucccugaaugccaagcauaccugugucaacccccagccaugaaaccucuggugaccaagggcccacucugcuaccaggggccagaggggcaccugagcaccugcugcucgugacaucuggaagcuccggggguacagggccaggugucuguugcaaggccuugcagcccagaucagguaccccagaacaccccggagaucagcccgccucacugacaggccggaucaggugcccucaccugcggcgccuugggucaucagccccccagcccaccugcgugccgcagcuccuacccaagcgagguguccaaggugagggaggccagggcgcuggagaagaaccgcgugucccacagcuucacuucgcgcucacgcaucugcagggagggcgagagaggggcucagaggggccugucccucagccccacccggggggcucccagggaaaccagcgccugagggugcagccugacacggggcaccugccccagagcagggcuuggagugggggugggagucaccccagggaaagagaaucuggguuuucauguucugccccuuuaagaacccuuaggugacaaaggaugaggggcgguucccucuguguucucgggucccuguagggccacuauggcuccuggggucaggcugagcuauuacaaauggaaucugccaguuuucagcagccgucaguccccugaggcucugagacccggcagcacagccaggccguauauggacaggccuggaacuggcccucagucccccgccucccauugguuucguccccgcccaaagggcuggacauguccccaccuggccgugcccugcuccuccaggaggaacccccuaccugguugaauccaguagacacaaggugcucccaggugcccauccaugccagccggcuaucccugcuguucucaugggccugcgugcucugcaggaggcaagagguggaccugagcccccagggcccugcuggugggcggggcccccuggaaugggccugagcuggggaacuucugcugcccaccugccugaaagccucacagagggugggaagggcuggguccuucuccacguccccacugggaccaaggguggucuccgaagcaccccggggaucagccccgccuccgccccaguugagggcagcucugcacccagaggccaaccuggcugcuccucccgagugucccuccuaccaaggagagggcugccucacuccccagcuccaggccccuucccugcugcgccaggggcuaaaggcacuggcacuuucuugccccuaagagcugugugauccuggggaugucacacucugucaaugccucauuucucucgcuuguguaaggggcucacgaugcggugccacccgcuucccagggcugucaccauguggaagggcagggcuuguggcaaagcaccguguaaacugggggauuucgaggaucacuguggcugccccaggcaagaggcagggccugggacccaccucugggcaacguccagagagcgccaaguagugccucuccuggcccucccgaggugcuggagcugccagcaggaaggcucccggccccugggaggagagggaagcucacaugguggguggggcccuguccuccugggcccuggcaguggggagcugagggggccagaggaaaugcaaacagcuccucccagucacccuggccccuggagccugagacgaaggacccuguuaccaaaaauagcucaccccaaaccauggccagcuuccuccgaacuucccacgaucuccuugggaaugaaugagggagggaagcagccugcgaggagcuggccuggggcccccuccccagcccguggaggcugacuccagcgugggagaccaucggaaacggcuccaggucccguccuucgaggggcuuuucucacuguucccuucccaccaggcuguggccggcacaggaaguuggggcuggagccugagaaccaaggccccacugcccucucuccacguaagaggggauaucgggucaggacaagggucgagccauuggccagcccugcccucaacacccggagagggucacagugucauucaggcuccugcccucucguugguguuuguugugcaaauaucugcgugugugcagcccaccagguggcucuuagcuuguccaaaagucacucauucauucaagaaacacacaaggccucccaggggccagaacugugcuaggagcuggcaguggggccggaugguucucagauagagggcaggugcuggggggaagcagugccccucacucaucuguucucucgucauauggguauuugagccacacacuauucgagaugacauggugaauaaaauggggaaagucccugugcccguggaauaaacacaucggggagguagauguaggccaaagagaaaucagugugucauucccugugacuaugcaugccaugggggagccgcacgguguuaggggaggaagcucuggagguggacccaggagagccccagccuggccaccucccuuggugggucagucacuagcucugugccucaguuuccaugucuguaaaaagcacuguaacagaauuuacuuuuuuuuuuuaaccuuuccuauggugcugaaggaccuacuuuugaagacggccacaaggaguaagagggaacacuuguagaaggcucaggauugugucugacacgugucaagugugcaugucucacagcugauagcaggguaccgccagacuguaagugagggaagaccuagcgucauuccugcuaggcugggaggguugauaggcgugagccagguaugggaacuggcaucugcaaagaguuggaaacuggaagcagagagacccgcucagccagcagguggggacgagggaggcggaggcugggccaagccugcagggucccccaggggcugccacugagcacuuuucaccuaggggcacaggcuaaggcuaggggugggacgcccuuggccuguagcucccaccuuccuaauucacaugugggaagccuaaaggcacagagagacgaagccauggugcaaaguggcuuggccccagcugucuccuccaccugcacaagauggacgugaggcucagaguggugaugaggcuugcacaaagucgcagcuaggaggcagcagggaagggaggaggagccgcccaggaccacagcugccccagaaacgcucugcuuccagcaaacauccugggccagcucuugcucccuggagcauucagcccagccuucagagguccagguaagagcuuuguccgugcccagccacuccccaauguggguacacccagcucaguuugcccagagaccacaggaagcccccaggugagggagggggucaguggcccaccccuuacccuguaacuccucaucaauggagugaucaccaguaucaaaaaugagaggugggcugggcgcaaugguaccugccguaaucccaacacuuugggaggcuguggugggaggacggcuugagcccaggaguuccagagcagccugggccacaaacugaaaacuucucucuuaaaaaaacaaacacuaggccggcacaguggcucacaccuguaaucuuggcauuuugggaggccgaggcggguggaucaccugaggucaggaguucaagaccagccuggccaacauggugaaaccccaucucuaccaaaaauacaaaaauuagcugggcaugguggcaggcgccuguaaucccagcuacucgggaggcugaggcgggagaaucgcuugaaccugggagguggagcucgcagugagccgagacugugccccugugcuccagccugggugacagagcaagacucuaucucaaaaaacaaacaaacaaacaacccaacuagcuugacgugguggugcgugccuguagucccagcuaccagggaggcugacgcaggaggauugcuugagcccaggaggucaaagcuacagugagccguguuggcgccacugcacucccgccugggcgacagagcgagacccguuugccagccucagcaagccucagagaagagccgucuccccagcuccucauucuccugcauagggggcaagaacaggggcugcagcugggacccaggcauccugcuacccugcagccccaagagggcccccaccaccuagcucugagaauaggaggggcuguggcagggcaggagcagugucagccccgcagggggugcaggaggggaggcgcgugcccgccccuucaucaccauggcgacacuuccugugcagggcaggaugguuccaggagcagcccuggcuccuugcuggggugaggggaccugcuucaauaguaagaccccccacuuacccccuucccuccucugagguucaccaccccccacuggccugucugaugcacugagauuccuagagggcucaauccggggcccccucccgcccagacaaggguucugaggccucgacacucauuuggggcugccacuuucccagaacagccugggcuccagggccucacccagccccagcugggccgguuguaaagggaaggggcggcaguggggguccuggggguucugcauccagaggggcgagccugccucugucacccugaggugggaccauggagaagccacagaaccauccgacucucggggucugcaccuccgaggaaguggaauaugccaagugccuggcgcauaacaaagggucauacaugcaguauaagaaccaagcaugggugugaggaggagccuccccaggguccccugcucaaagcucacgccugaggcagggcuccaacaagacaguggagggcggacucccuggcccacucugggcuccgggauagcaccagggcucagguggggugggacccacagaggacagagguuggauggagggcaggcggccccgcucccugacccccagccacaccccacuaggcaggaaggaggauugccagagaaggagcucccagaaggccucucccucgagccggccccucggcucacaccggcccuggcugccagcagcgguuuuccuaauagaagccaggugugggccagaugcccugggcggaaguggggggcagggccacacggagagcggcauuccaggccugcugcccccgcaccagggcccgagcacaggccccagccagcagcuggaaggggugggagccacccacgcucuucccaggucuccucgccccaaagccccgcaggggggcucccuccagaaccagauccucucccucucucuucgaggagcugggagccccuuggauagcagccacucuauccccaccucggcaucagucaccgccccagcccugcuggaagaggaggggagaggaggaggaaggcuggaaagagggggcggaggaggggagaauaggaagaaucacgugggcccagugagcuggcucagagccaugcccgguaggucgggggcagaagcauaggugccccagcagugcccugggcucuggagaggagagugcaaccugagaaagugaagggggccgggggaagccucuguggcaccuucaagcugagccugggccccgcuuucugggcaaaggcuuggaggucaaagaaagcuaccuagugaggauaccguacacacccacacugccuugagaugcagacagccaccaucuaccaggcccaggucccacaugacgaagaggucagccagccucaccagcaaguacgaccaggguguggccaaaaccacccugccuggcuaguuucacugcuuaaaugggaguccucucggucuucagcuggacaaaaguggaacugacuguaccguuuggacuaaaaagcugcaaucuuccaugugacuggguuucucuccugagucuuguguguguagggggcucuggggcuccgggcuaccacuaguuugguuugggcuggugguuugcccuugaccccggguggggaaaacguccuagaaauggggaggggguaucuaugaugggccuaggucuuugcuggggagcuccucuccugagcuaacaguaggacccuaaacuucaccuuccucagggaauaagccuccucagcuucuagaaaguucuuuuuagaaauguaaauccauggccaggagcgguagcucacgucuguaaucccagcacuuuggcaggccgaggaggguggaucacaaggucaggaguucgagaccagccugaccaacauggugaaaccccgucuccacuaaaaauacaaaaaaauuagccgggcaugguggcgggcaccuguaguuccagcuacacaggaggcugaggcaguaaaaucacuugagccuaggaggcggaguuuccagcgagccgagauugcgccacugcccuccagccugggugaaagagcaagacuccaucuccccacccaaaaaaagaaauguaaaucuacucaucgcacuuccugcuuaaaacucccuaaugguggccggacacgguggcucaggccuguaaucccagcacuuuaggaggccaaggcgggaggaucacgaggucaggagaucgagaccauccuggcuaacauggugaaacccagucucuacuaaaaauacaaaaacaaaaauagccgggcgugguggcggucgccuguagucccagcuacucgggaggcugaggugagagaauggugugaacccaggaggcggaacuugcagugagccgagaucacaacgcuacacuccagccugggcgacagagcgagacuccgucucaaaaaaaaaaaaaaaaaaacucucuaauggcuucccacagcccagguaaccaugggcccguaucccccagcgccccucgcgcagaccccucagacaagcccguccuccuucaggccaucuaugucugcccccuuggcauuacucaggccucugcucccgggccaguuacucagggaagcacuaaaccagcccagcaagagaagcccccagcaacuaccugccuagcacaggcaauguuuacggagccagacacagggcccugucccaggguuguugcuccugccuacaaggucucuguagggcaaaugaacggugucccaguggcuggaugccugcagcaugagccaggucccagcuuccccgcuuggaacugaaauggccacgcacacuccaugcacagacacaaaccagaacacgcucagucccuggacccuguacguuuugacaggucccacccagggucuuccugcagaggacagggguuguuucuuuuuggcuccucugcagcuggucucugcugaccgugccagggugaaggucucaaaggaaggaagugggaaucccagaucgcugccugaagccacacgauggccuccguggagagccugggggaagcuuagcuucugccacccggugaucaaagccaggcccucccaggacccacaacacacuucacaggaagagcucccagcaguggugguccaccuccuggggaccccuggugcugcagaacaugucugccaggaccccaggccugccccuaccuccaccugcuagaaccacuggguccucagccucaguggaggcuucaacccaccccagcuugcccacacaacucaccugagaggcccgcggcuuuguucuggggucaaagauccgcagcugcuuguccuggaaaagcagagaggaggaaacaacuugcgauuagggcuggagggucccuggaagccagccugcuccccucaccucccaacccccagcucugagcagcccauccccagcacgcagggcugccaucacacaccagggcaucccuccucagcccuguuccuccuccucagcacagcagcaaccaccacccagucccccagguuucugugaggaguguucagcugccugagaccuacucagugaggaguguucagcuuccugagaccugcuccacgucaggcaucccagacacucgaccccuccuacucuuccaacuacccuaugaagugguacuaucaccaugaucccucacagacagacaaacggagguccagaaccaaacucuaggcugucagcgccccacacaugcucagcccuguacuaggcccagccuggagaggcucauaugacgaccucauuucugcacuuacagaauuuagcacuaaccaggaagacgagcuuacacuuccgaaccauccauucggcaguuauugauucagauuauccaaagggaggauggaaacagacaaaaagcagaaaaaaauguacugaaauaaagcacucaugcuuuguauagaccuucuuucuguggaacaaugugugugugcaugcacacguuguguguguguguguacacaaacauucaugcauaaagaaccagggcacaaucuguauccacuacuacaggcugggccauaauaauuuuuuuuuucuuuuuugagacagaguuuugcucugucacccaugcuggagugcaauggugcaaucuuggcucacugcaaccucugccucccugguucaagcgauucuccugccuuagccucccgaguagcugggauuacaggcgcccaccaccacaucuggcuaauuuuuguauuuuugguagagacgggguuucaccauguuggcaggccggucucaaacuccugaccucaggugauccgcccgccucggccucccaaaaugcugggauuacaggcguaagccaccauguuuggccauaauaaauuaagugcaaaaaggaaguuguagaauaacauggcauagugugauucuacugugguaaaaaucaacaaaaaucuccauuugugugaccacgauccuguuuguuuuuauugauacccaacuaucauacagcccauacauuuuacaaguuugcugagcaaggagaaaggucuggacuaacacaggccugugugcuaaugcuagguaucaaggguggggaagaugggggcugguuaacuuuuccuuuuuacgucuuagcacaggucuauuuuguuucauucagcacagauuccuguuuucauauuuugaaaaacaguaaacaacuggaauuugaaaugaaaaacaccaccagccaggcaugguggcucacgccuguaaucccagcacuuugcgaggcugagguggguggaucaccugaggucaggaguuugagacuagucuggucaacauggugaaaccccguuucuacugaaaauaaaaaaauuagccgggcaugguggcaggcaccuguaaucccagcuacucagggggcggaggcaggagaaucguuugaaccugggagacagugguugcagugagcugagauugcaccacugcacuccagccugggcaacagagugagacucaaucucaaaaaaaaaaaaaaagaaagaaagaaagaaaaacaacaucauuugcaccaguacagauaaaaaaaacuugaaauacucaugcuccucaacauacaauggaguuacaucccaauaaacccgucuuaaauugaaaauauaguaaguauggccaggagaggugguucaugcugguaaucccagcacucagggaggcugaagcggcagaucacuugaggucaggaguucgagaccagucuggccaauaaggugaaaccucgucucuaccaaaaauacaaaaauuaaccgggcaugguggcacgcaccuguaaucccagcuacucgggaggcugagucaggagaaucacuugaaccugggagacggagguugcaaugagcuugcagugaaccgagaucgugccacuacacuccagccugggaaacagacugagacuccgucuaaaaaaaaaacaaaaaagcugccguaggccaggcacaguggguccugccuguaaucccaacacuuugggaggccaaaguggaagaaucacuugagccccggaauuugagaccagccugagcaauacggcaaaguccaucaauggacauuucucucuuuuuguauuuguuuuuguuuuugagauggaguuucauucuugucacccaggcuggagugcaguggcgcgaucucggcucacugcaaccucugccucccggguucaagcgauucuccugccucagccucccgaguagcugggauuacaggugcacgccaccacgccaggcuaauuuuuuguauuuuuacuagagucgggguuuugccauguuggacaggcuggugucgaauuccugaccucagguaaucugccugccuuggccucccaaagugcugggauuacaggugugagucacugugccuagccuuuuuuguuuguuuguuuuugagacagagucucgcucuguugcccaggcccaagcgcagcagugcaaucacagcucacugcaaaucaaccuccuggacuaaagcaauccucccaccucagcuucccaaguaugugggaccacaggcacaagccaccaggcccugcuaauguuuuaauauuucuuucguagagaugaggucucacuaucuugagcaggcugguuuugaacuccuggccucgaguaauccuucugccucagccucccaaagugcugggauuacaggugugagccaccaggccugguuugaauauacauuuuaaaaauauauauauagaaauggccaaaaagcguaugaaaauauguucaauaucacuaaccauuagagaaacacaaauccaaaccacaguaagauauccccugacacccauuaggaugccuauuacauuuuuaaaaauagcaaguaucaggccgggcgcgguggcucacgccuguaaucccagcacuuugcgaagccaaggcuggggggaaucacuugcgguaaggagcucgagacgagccuggccaacauggugaaaccccgucucuacuaaaaauacaaaaauuagccgggcgugguggcgugcaccuguaauaccagcuacucgggaggcugaggaaggagaauugcuugaacucaggagguggagguugcagugaaccgagaucaugccauugcacuccagccugggcaacagagcaagacuccaucugaaaaaaaaaaaaaaaauugcaaggcugggcgugguggcucacaccuguaaucccagcacuuggggaggccaaggcgggcggaucacaaggucaggaguucaagaccaguguggccaacauagugaaacuccgucucuacuaaaaauacaaaaauuagcuggguuugguggugugagacuguguucccagcuacuggggaggcugaggcaggagaaucgcaugaacccaggaggcggggguugcagugagcugagauggcaccauugcacuccagcccaggugacagugcgagacuccgucucaaaaaaaaaaaaaaaacaaaaccaacuguugguggguacgugaaguuagaacccuugcacacuguugaugggauuguaaaauggugcaacugcuauggaaaacaguauggcaguuccucaaaaaauuaaaaauagaccuagcaugucuuccagcaaccccacuucuggguacauauccaaaagaacugaaagcaggccaugaagagauauuugcacacccauguucauagcagcacuacucgcaauagccaagaaguggaaacaacccaagaucuacugauggauaaauggauaaacaaaauguggucugcgcauacuaugcagucuucaaaggcaaggaaauccuacugcacgccacgaguaacccuugacgaugcagcauuucauuaugcucagagaaauaagucagccccaaaagagcaaauaguauaugauuccacuuauguggggcaucuaaaguagucaaauuauagacacagaaaauuauagacacagaaaguggaaugccaauuccuaggggccgggagguagggcaaaggggaacugcuguuuaauggguauagaguuucaguucugcaagaugagaaaauucucaaaucuguuucacaacaguguaaauauacuuaacacuacugaacuguacacuuaaaaaugguuaagauggugaauuuuggcacuuugggaggucaaggcgggaggaucauuugagcccaggaguuugagaccagccuaggcaacacagugagaucccugucgcuacagaaaauuuaaaaaguagcugggcgugguggcacgugcuaguagucccagcuacucaggagucugaggugggaggacugcuugagccuuagaguuugaggcugcagcaagcuaaaaaaaaaagaagaagguaaauuuuaugauauguguuuucuuaccacaauuuaaaaaaauagcuauuagcccacaaaaauacauugcuaaguuaaagaagccaaucugaaaagcuacauacuacauaccauauaauuccaacuauaugacauucuggaaaaguccaacauacagacaaugaaaagaucagugcuuggcagugaucugggaggagggcggaagggaugaacagguggaacccaggggauguuaagagcagugaaacuacuccguauagugguuacauuaugucaugcauuuaucacaacccauagaacauacaacacagacugaccccucauguaaacugugagcuuuaguuaauaauaauguaucaggcuggguaugguggcucaggccuauaaucccagcacuucgggaggcugagguggguggaucacuugaggucagaaguuugagaccagccuggucaacaaggugaaaccccaucucuaaaaauacaaaaaaauuaggccaggcaugguggcucacaccuguaaucccagcacuuugggaggccgagguggguggaucaccugaugucaggaguucgagaucagccugaccaacauggagaaaccccgucucuacuaaaaauacaaaauuagcugggugugguggcacaugccuguaaucccagcuacucgggacggggaggcaggagaaucacuugaaucugggaggcagagguugcggugagcugagaucgugccauugcgcuccagccugggcaacaagagugagacucugucucaaaaacaaaaacaaaaacaaaaacaaaaaaacaaaaaguagccgggugugguggcacgugccuguaguccuaacuacacaggaggcugaggcaugagaaucacuugaacccagaaggcggagauugcagugagcugagaucgugccaaugcacuccagcagugcaauaauaauaauaauaauaauaauaauaauaauaauguuuaccauugguuccucaauugaaacaacguaccacacucacgcaggauauucaucacagacacugggggaggagguaaggaauauggaaaauccuuauacaacuugcucacuuuuucuguaaacuuaaaacuguucucgaaaauaguccaucaacuaaaacaacccaaaaagaaaugcaggggaaaaccaagugaauucccgcuccaugugcagccccucccugagagaugaguagccucccugcuacuaccaaguuccaggcuaagugcuggacucuggggccuggagguugucacgggaaaccgcggggaagaacuuagaccuggucauggaaggacaaacagagcuugugcugggaaggcaaaggcauucgaggaagguaaaauagcaugagcaaagagguggagaaaggaacuugcugguguguggcguugggggaggagaggccacgugaggaggcagauggugggaaccaagggggccgugggcacacgcauggcuggcagaggcgggggccugucuggagagggccucaaaagccaggucucccuggucugccucagcagggcccugguuuuaugccgcuccuggcaaagcccugccagcugcaguuuaccaagcaccugcugcgugccaggcgggcaccagguacaguccagggacuggcucuuaaaacuccacuacuccacaccucggauucagagggauggcgagggacagagagaggaggaugagagacagaagacagagaccagagagagaacagcgagggacagcaagggaugagagaggacagagugggacagaaacagagcacaaugacagagcgggccagagagagcaaguagagaucaaggacagauacaggggacagcaggagacaggcaggacacgagcgacagcaagcgacagaggcucucaggagaugaagggcaggacacgacauccagcagucagggcugcuccugccccacagaggugcagagaccgacagcccgaguccagaugccaacaccaccacugaccagcuaugacgugggcaagcccccgagcccccuaugguuucuuuuuuuccuuuuuuuuuuuuuuugagguuuuaguuuguuuguuuguuuguuuugagacagagucuugcucugucgcccaggcuggagugcaauggugugaucucggcucaccgcaaccuccaccucccagguucaaguuauucucuugccacagccucccaaguagcugggauuacaggugcaugccaacaugccuggcuaauuuuuguauuuuuaguagaggagggguuucacuauguuggccaggcuggucuugagcuccuuaccucaggugauccgccugcuuggccucccaaagugcugggauuacaggcgugagccacugcacccggccaguuuuguuguuguuguuguuguuguuguuuuuuaagagagagggucuugcuccaucgcccaggcuggagugaaguggcucaauccgagcucacuucagccucgaacuccugggcucaagcaaucuuccugccucagccugggaccacaggcgcgugccaccaugccugucuaauguuugcauuuuuuuuguagacaugggguuucaccauguugcccgggcugaucuugaacuccugggcucaagugauccucccaccucguccucccaaagugcugggaugacaggcgugagccagcgaccggccacccgcccagcccugugaacugugaggaugcggacagcgccaccccugggcagggcugggcgcuggggcuaagggcggaacucacagcacacacuccaugagggcagcugggccacccucauggaggagcuuaacgcgggguccaaaccaggguucagagugggcacugaggcugcucuggcucagcggagaggaacugggcugcagaggccgcguccuccccggcucaucaggcucaaccaugccgggagucaggagcgcagcaggccggaaugggccauccgugaggagagcgcgcccccuagcggccuccugccccuucucucccagcucgggaggccccuucacccagugggaguagcugagagggagcaggagggggcuuuggugguccugggaggcagaccugcucacacagaggcaggacaggaguggaagccaggggcacggaggcuuccccgccaggaaggagauggggcgggggugggggcacacucugguggaaagucccaugaccccccacccccauccccaucaggcagcccguggcaugagcagcuccagugcauaaacccagagccaggugcggcugcaaagaggggcucacgcucgcuccugguguggggugggcccauccagcagcuccagccacagcucaggacaagcccucgcucucugcacacucaugggcaucacuggcugcccuaccacagucaggccgccccccacucccggcuccauacugccaggguuuccaguguaggaugcccccaccaggaccccgauguacucccuuuacagcaaaagaagguggcagccgacccagggcugagguacccauuggcccuagacugugcugacaggugcggcuuggaggcaaugcugcguccccgcaggcggaauuccuagguccaggaaccagggaaggagggggagucguuccacuaagcaucacucccacgacccacuuaggaaaugugugcuucucgucccugcaacuuuaagcucuggguuuagcgggggaaaacacauccacuggggaagcagcaggagcuccuccgucugugacuccuaugacucuuccugcaagacaccaguaagcaaggagaagaguggccaagccgguggcccauggggcugcucacuguccuucccuacacaacugugauaguaaauagggcucggacccccaggaggagggccuggaccaccacaccugugacagaggggcagagacaguuucucaaagaaagaugucacggucccaaggcagccaucccugaguccugcugagacuacccaggccauccccucugccugggacgcccguccccuccuucucagccagggcucaucccucaaggaccggccucgagcucacucugccugggaagccguccccagcaggguuaggucaaagcacgcauaccaggucuccccagaaggggcucccugggggccuuauuggcccccagagcuuaggccagucucucaggacucucugcucaacgcacaccacagaggaaaaacugaucaagacugggagaugcggcuuccacaaaagcagaguacagaaaagaaaguuagacuagggucccuccaaguaugcagagcccuggggcggaaugcucaggucugguaggccucccugcccugcuagcuccuguucggcuccauucccaggccucucagccauucuucaugugucuucaggcucggcacaccuccagaagggcccugaugggugcccucauucccagcaaccccgacaggucuucagagacccuuggugguacccacggccgccucccuggggaagcccuuuggcccugguuucaggcuccagccugguccuggcuuuccuccucccaccuccuccccugcaggcucuucucauccccuccugggggcagcacuauguggucagcaaaucaaacaaacgggaccuuuucaccugcagccggauucugcucagagccccucugggcccagacuccacugacaccuccagguaccgccggcagcucagcaaggcugcagccacccuggagcggcucugccuagaacauucacaccaggugcuccucuagcgcccccucucugccacagcacauccccgucccagugacaggccucuccuacugccucaggaccgccacgccucccacccaauccuucuccaacacuuggcuuccuccucccaaaggucuccgccacucccggcagagaacagcucucaccuccccgcaggcugccacgcaucccccuguagacacugccccuccugccacacacuguccaugugguuccaaaugcgaauccgcuccccucacugcaccaccugcccuacucuggccuuuaacacuucauugccuucccauuaccccuacggcaacaggcacaacccuuacucaccacccagcacccgccugccccgcaccugccuguccuggccccgaucccugccugaggccacgcgucccuggccuguccaaccagcucaaagcaccaugucccucuugcagagcccaggucacggguccucuugucuguacuguccucgacggaagucaccuccccagcaacuggggccuggcccagcaccugcggccgaaugcugcuuaacaagagucuugcagaaaggcuggcgguucagacagaccagacaggcggccagaggaggcugccugaggguggcgacauuagggcgcaaaccagggaccagcgugggcucucaucugacaggggccuaggcaagguaggggcuuccagauguaggugagcgggggugugaggagcagcuagggggcagggcacacagaugaccauccugaccucagugcuccacugccuccuaaacaacaagccuggaaggcccagcccagggggucccagcccaggaggccugcacagagccccacagggcauccccaccugccugcucaccuugcacgccgugcccaccagggcuccaucucggcuccagacggcgcucugcaccagguccccaugggcugccagcucugcagagaagcagucacagucaggucccgggcagugagggcaccagggaagugggugggggcgggccuugcuggggggaacucccagagcaaaggcagcagcuacgaggguccuuuucagccaagggggcaagggcagcagcuucucccagacaggcuuccccugcaccacaggcugcuuccuucaccccaccuuugugcagccguacaucacucaacuaccuuccgaggcuucccgcuccuggccuggcucucucaucccucccaggcucacuuccaacauagcuccccaccaacagggucacuccugcccuaagccucuauuccugccaucuauacucucccucgcuagugugaggucuuaaaauacuucucuacauucucugcaacuccuguuccagguuaaauugugcuccccuaaaaagauggugaaguccuaacccccacuacuuuucggaggcuugcucugucacccaggcuggagugcaguggugcaaucucagcucacugcaaucuccgccuccuggguuccagcaauucuccugccucggcuucccagguagcugggauuauaggcaccugccaccaugcccagcuaauuuuuguauuuuuagcagggacggaauuucaccauguuggccaggcuggucucgaacuccuaaccucaagugauccgcccaccucggccucccaaagugcugggaucacaggcaugagccaccgugcccggccuauuauuauuuuuugagacagcaucucacucuguugcccaggcuggaaugcaguggugugaucauagcuaacugcagcuuucaccuccuggguucaaguaauccucccaccucagccucuugaguaccugggacacagacaggcacacgccaccacgccuggcugauuuuuuaauuuuuuguagagauugugucucacuauguugcucagacuaauucucaaaauauugggcucaagcgauccucccauuuuggcaucccaaagugcugggauuacaggugugcgccacgacgcccauccaagaagguuuuuuuuugguuuuuuuguuuuuuguuuuuuguuuugagauggagucuugcucuugucccccaggguggagugcaauggcacgaucucucuucgcucuccauagccacugcaaccucugccuccuggguucaggcaauucuccugccucagccuccugaguagcugggauuacaggcacccgccaccacacccagcuaaguuuuuguauuuuuaguagagacgcgguuucacuauguuggccaggcuagucucgaacuccugaccucgugauccacccgccuuggccucccaaagugcugggauuacaggcgugagccaccgcgcccggccaaaguuauuuuuuauuuuuauuuuuuugagacggcaucucacucugucacccaggcuggagcgcaguggugcaaucucggcucacugcaaccucugccuccuggguuggagcaauacucuugccgcagccuucugaguagcugggauuacaggugugugccaccacgcccggcuaauuuuuguauauuuaguagagacgggguuuugccauguuggccaggcuggucuugaacuccugaccucaggugauccaccuaccucggccucccagaguguugggauuacaggcaugagccaccgcgcccggccauuauuuuuuuaaauggagaaaaacaacagaaaaaaaaaaaaacagguaagaggaugaaacugauggcuacggagagcaaagagagaugggguguuuauuacagccucauagaaucuuaagacuuuuauacuauguaaguguaaaacuuugauaucuguuuuuaaauuuaugugacuaaacaugccaacaaagaaacggagugcuguccagaguggggcugcccugggaagggcaggccaggguggccuguaccugucaggggcugcugcuuggcugcgucccagaccuucacaguggugccugcugcgcucaccagaaugccgucagaggugggguggaacugcaguaccuccacugggagguccucggggcccagcaccaccccgggugcugagggcagggccuggccaggcccuggcagucgccagaguuuuaccugcaagaaagaccaaguccgugagcacagggcugagggccucacugccuugagucagcugccgugaccccagugaggucccguguuggaacuaggcugcuccaggagaccacacaccuuggccuugggaggagcgcccacccgccucagcuugcuugggccaggggcugcauaccccacauccgagaaaggagggagggaaucucagcuccuagaccacacgguguggucccagaguuggggaaguggcucuacuguuucuggcagcauccccaccugcuguccucgggcuccaggucaggucagagccacggcuccaagcaagcccuugggagccagugugggaccaggaauucagaccagccccgcagcccuggggagugggguggggcuggacugggaggcagcagagcccuguggggauggcgcuggggcucagaaggcccuggacuacgggcugggacauagagcagcucuuccaacuggcuccacucaccguccugucagccgagccuguggccaggaggaagucaucaaagggcgagaaguccaagucggugacuaggucugugggagaggaauggcugaacccaccggaauguccuguuuccaacccaguaugaagcaaagcccagggcuuccgaggugacacuuuugugugcacacagaaacaggcuacaagucuacaagggcccucuggacaccaugggggcaaaugccacaggccccuccugcgacauacguccccgagggcccugcugacccaggguggccaagggcucuggcaucaggagguuggcaggaaaugggcaggaagccgcuugagucaccaggcaccugcaggaacgcagcugcccagcccgaccccuccuagggcagcacagcccacugcuccuucagucguggaagguccccaggacucaacuaagaaauugcuuuuugguuaagcaagccggaguuggcuuuaguucuuugcaaccaaagaaccugaaugguggccgggcaugguggcucaugccuguaauaccaauacuuugggaagccaaggugggcagaucacuugggcucaagaguucaagaccagccugggcaacacggugaaaccccgucucuacaaaaaauauaaaaauuaguugggugugguggcgggcgccuauagucccagcuacucaggaggcugaggcaggagaauugcuugaacucaggaggcagaaguuggagugagcagagaucacaccacugcauuccagccugggcagcagagccagaccuugucucaaaaauuaaauacuaagaacuugaacggcucagcuccagagguggggagggguagguggggugcacagagugagccagaccccagagggaaaugcggugggugguuggggagguagagacuaggcauggaggguggcgggguuucggggugugaacaggacgagagguaucaccagagcugggagcacagcgaccaccugcugcugucugccucccaacagggcugagcaggacugucuuccucccggccucaggagacagggaaaagauaggacggacgugcacaggcacaucuugggauagcccuggccuggaaucccagcuggcaggaccacaacauuccugggccuaaagccacagaaccccugcugcccucacucuggggugugcuugcugggcccugcagggcaaagcaggucccugggcagguguagcagcuggcacaggcgggcuggcaucucaggcgugaaugagaugugaugacauaagcaaucugagugcucagcaugugcuggcaccacagaugcccagggguugacacgcagggaccucacugaauccucauaaggaugcagcagguggcacugcagcagcauccccuacuggaggaugaggacgccaaaacccagagagggugaguaacugccccaagucacgcggcuaagagacagggccagcuucagaaccugugcugcucagcaugacaugcugcugccuuuucccacuggagcgggccccagcugccgccccacagccuggacaucagaaacgcacccagaaguugcucacccucugcuccccuggcugcugggcggaagggcaagaguggcccugagcugagaggcugaaggggccucugaaggcagggcaacagccagagccccaccuggccauuucucccgacaccggcaccucugaggcagaagggcaccuggugccucuagggcagguuccaggggugcuggagcucaccuucccaugagcaguuucccggcagggcugcucaugcaggcaaggcucugaacaguugcagccacagugaggcuauggacuugccuacaggacccugguccagcuucuacuugaagagcccuaguagcagagggcucaccaccuugcaagcaucaccaacuugggcuagcucccucauagauaaaaagcaucaaaaagucaaacaugaagccagguacauuggcucaugccuauaaucucagcacuuugggaggccaaggugggaagaucacuugaggcuaggaguucaggaccagccugggcaacacagcaaaaccccaucuccacaaaacauaaaaaaaucagcugggcaugguggugugugccuauagucccagcuacuagggaggcugaggauagacgaucccuugagcccaggaguucaagacugcagugaacuaugauugcaccaccacacuccagccuggaugacagagacagagacccugucucuaaaaagacaaacccaaacacaggcuccuauagaccuggguucugauucuggcccugccauaacaauggguaaguuccuaaccuugcaggagucucaguuuucauagcuauaaaauggguuguuuuaaaaccuacuucaaagagaucugagauuagaugagaacagacuuguuauacaagcugccacacacauguaucucuaaaacaacaugcuacgugaaagaugccagauuccaaagaccguguauugugcgauuccauuugcgugagaugcgcaaaagaggccccucuauagaggagaggccaguaaacgucuccugcgaagggcaaggcgguaaauauucuaggauuucagggcucaacagucucggucacaacucaacucugcaguuguugcaagaaagcaaccacagacuauacaucaaugaaugggcguggcagcguuccaauaaaacuauuuacaaaaacaggcagccagcuggaucuggccgugacaguaguuugcagaccucugccacagaggcaggaagcagaucagcuguugccugaggcugugguauuggagguggaaauggauuaacugcaaaggggcaugcgggaucuuuuggggaugauggaaacguuccaaaacuggauggcagugcacaugacucggucacuuuaauaagaaucaucaggcucuuuacuuaaaacagguaaucugacggggccccaaaacuuugggaggccaaggcgggaggauagcucgaggccaggaguucaagaccaggcugggcaacauaacaagaccccauuuuacaaaaaauuuuuaaaaauuagcuggaggggugguggcauaaaccugugguccugacaacuugggaggcugagguggaagaauugcuugagcccaggaggucaaggcuacagugagccaugauuaugccacugcacuccagccugagugacagagcaagacccugucacaaaaacaaacaaaaaacagguaacguuggcugggccugguggaucacaccuguaaugccaguacuuugggagguugacuugggaggauugcuugagcccagaaguuugagaccagcccgggcaauauagcaagaccucgucucuauauacuuuuuaaaaauuuuuuaaaaaaguuuagaugagaaaacucagcuaacguacuuaguacagagagcaaucuccauaaaucuuuacuauuguuauuaaccaccaucauuaucauaucagaaccccuccacgacccugcacacccagccugaggaccaggcaucaacugccuucccucacccgaaggccuccaaacaagcagccagaaaugcaggccagagagacugggcccgcggccgcugcagcuggacagugagaggcgaggccagcugggcugcucugccuccaucugaggcgagcaaacuguucccucgaggcggacagccugccaggcaggcugcuggacgcccccagaagcagcugcggcacacaaaaggucucuuugugagggcccaucuccaccccugcagcccaacacagcgaccuccuuggagggccccgagcggcugggcuggggaggaugccugguggagaggggacuccagcagaagacggagggcucagagccauccaacguggaguccucggcagggacagggagccagcaucagccuggagccuggggcggccacugcacaccccgcuccauccagcucacaaccggagcacacagcuucccuccucacugcccaggccggaauucuacaccaggaggaagccuucugagccccacugucucucagagagugcacagacagggcgacaggagggaccuggcaagccaugcggcagugggaccaggugaggaugaauuucuggcccuggagagggaggugcaaguuucaggcuucacccacuagucagacacccacucaccugaauggcagcccaggugggccacgcgucgcuuguccucuccuuggccuugcagaggcacaaugcccaguacaccuguuaaacaaacacggggacucugacuucaggccccacagggccacccaccuccuugcccagggaucccagagaugaaauccagcagcucagccucggaccuucccagagccucuaccaaucacaagaucauauccucugcacguagcaauggccuguggguagguucuggccccaugcaugagccauccaugccucagauggauacagaagacauuaggcgagagguccucucuuuuuaacacgggucauacgaaaggggcguggggcuuucguauggggcuugcagcuaccgucagccacuuuucgcacuuuuacuugagaaagaagccaacacccaagguggcagagcugagagacccagagaggucagggccgacaguacaugugagccuuugggcaccgaucugccugaagccccugaucucuuaguuaggcugaaacauuauccauuuuuugcuuaagccagcuugagggucugaguuaccacuagcaaucaagagagugccaaccaacacacgggcuuuucaagccuuucuguuccuacuguccccagccauccagggcccaaagaugaggagcagggagcacagagggacagcuggaaauacaagcgucaguccccucccagcccuccuggccaugcucuugccugugguuuguacacacauauguccuaaucaaaagcaaucagauuacugcgccuggaccaguuugugggggucuaaggucuggcauggggcucaccucugagccccccaaagcaguuccguuccaagucuccaaauacaccaagccugccccugcuccccaccccaucuauggugacgaugaccgaauaugugagcaaauauccacacucauggccauucccuaccaggacggucggaguugaaggcgaucaagcugcagcuugauuugaugugguuccugcaugaaggggcgguuccugcucgaaugucacugauccaggacugaaaaucaagaguaaagaaguauguggugagagccaggguuccaccuccaugcaugccuaaagcaagagguggggcauaaucuggggaacucuagcucacagcugcaccauucgagaugcauucuuuuauuuacuuuuuuuuucuuuuugagacagggucucacucugucacccaggcuagagugcaguggcgcgaucuuggaucacugcaaucucugccucuuggguucaagugauccuccugccucagccuccugaguagcugggauuacaggcgcccaacaccaagcccagcuaauuuuuguauuguuaguagagaugggguuucaccauguuggccaggcuggucucgaacuccuggccucaagugaucugccugccuuggucucccaaagugcugggauuacaggcaugagccuccgcccccagccguguuguguuacuucaaaucaaacucuguccccacucacgaagucccuuaggaaauguaaaaugugggccaggugcggugguucaugccuguaaucccagcacuuugggaggcugaggcagacagaucauccugaggucagaaguucgaaaccagccuggccaacauggugaaaccuuaucucuacuaaaaauacaaaaauuauccaggcaugguggcgggcaccuacauacaauuccagcuacucaggaggcugagggaggagaaucacuugaaccugggaggcggaaguugcagugagccgagaucaugccacugcacuccugccugggcaacagagcgagacuccaucucaaaaaaaaaaaaaaaaagaaaaugcaaaauguggccaggccuccuccaaguacccggagaaaaacacccaagcucagagaggggaaccaccaaggccuggccucaucaggacacaccuuuccacaaagucucauaagucaguaaaagaaacacccccacccaaggggaggcagaggagcacguuucugaaacuaagaucugcaagguccacacauuuucucuguugucaaagcaccgcucagcacuccuuccugcccucgaugacaggacacccauguuucccacuccacccacccauagcaccccggaaaccaccuccaccaccugaaguuucuauaucaguguucaccugccaugguuacagcaucagucccacccuauuauuucucccuccugauucauguuuacuguauaaacacagugacugcaaauaucucugaaaagaacagaucaccuguucucccgccucccuaacauaaacuguuuuaagcucucccuacagucuguaguuccaugccuaucuguuuauguugcuggacuaaggcccacccaggagcaagaauuagggccccucaaguauucuccagaccccuccaagcaguacuuaacugcacucagagccaccggcugucuugaugcaaaccuagguaccuccuccuaacuuuucuuguuuguuuuuuucuuuuuuugagacagugucucacucuauugcccaggcugguguguaguggcacaaucucggcucacugcaaccuccacuuccucggcucaagagauccuccaaccucagccucccaaguagcugggaccacgggagugagucaccacaccuggcuaauuuuuuuuucuuuaacuuguuguucagagggguuucgcaauguugcccaggcuggucucgaacuccugagcucaaagcaguccacccaaaguacugggauuaccgugagucaugguauccagccccucccccuaacuuuucaauggcucugcacugcaaucagaauaaaacccaacuucuuccgguggcccuuggguucugcaggaccacucuggacucaucugucaccauacugcuccggccauccccuccauccacucaugcucacuuuccauuucuccaccaggcucuuucucaauucucacccuucuggccucagcuaaaaugccaucuacuccaggcagccuuuccugaccacgcuacugagacuggcccccuccauucuccaucccagucccucauguguguucuucaaugucguuaugaaaaccuccaaugcucuuguuugucugcuugcugucucccucaugaggcuacaagugccacaggggaaggaaaaugccguuguguucaccgggaugucuccagcagcuuagcacagcauaaaguggaagcagaggaaauauaguccacacuacaaaaacggaaccucuacccagacugcccugacuugcucugggacccugauggggucacuugaggucaacuccuaggcccaguuaucggaggacacucccaggccuuacaaauaacacggaaagcggaagagcagagcugacaucguuuccaaggcgcaccccucaucaguccuccugccguuucggggguccgaagggucucccggcaccuggcucagcaauucuuuggggcuccaccugcucaggcuuccccaggccccacccagccguggcagcaucaccgagauaaagaaagagcuugcgccagcggcgagaggaggaagcaccggcggaaacccgagggaggggcgcgugcggccgaggggcucccuccccaccacugacacacuugggcucgccggggccagaggagagaggggcgucuccccacagcccagccaggggcaggggcgacccggggcggcagggaggaggagccaggcgccggcagcgccccgagccccggcucccggcgaggccgaccggaagcugggaaggcaggcggccucgcaggccugggccccggcuaggagggcugcgccgccucgggggucccggggcgaggugggcgaggcgggcagaccgccagggucaccgagcgccagagcgagucacgggagugccggacucugcccuccggcggcgacgaaacggcccggacgccggggcccuggccugaagggggguuccccggggauggaggucucgggguuccagacggcccuggagggcaccccugugggguccgggcagggggaggggcagccggacggggcccgaggcgacagcgcccgguccucgggccggacucaccucgcggcggggcggccgagccucggugugccggaacuuggacacccugaagcgguucauggcgacgggcacggcggcggacgcgucuucgaggaccccgggcgucgggucucaggugcacgcugagcaaccgcgacucccgcugccucggccccacccgggacccaaugccgcggucacgcccccggcgcgccccacugccaaucgcagccgucuccggcccccugggccacgcccccaagccccucuccuuucgcgcgcgcaccaccggucccgccucccggccaauccagguacggccgccccgcgaggccacgcccugauaccgaggggacggacuggcgcgggugggaggucacguggggcgcagcugucagcccacgucuccugcggugcuugcuugcguggggucucggcugcagcauucgcgauuuugugugcaggauuugcuguggagucuuugcgguguaccuagcacgccuuccagcacuaucuaccucuuc

SEQ ID NO: 192972 - RNA, 62420 nt, Homo sapiens
gaagagguagauagugcuggaaggcgugcuagguacaccgcaaagacuccacagcaaauccugcacacaaaaucgcgaaugcugcagccgagaccccacgcaagcaagcaccgcaggagacgugggcugacagcugcgccccacgugaccucccacccgcgccaguccguccccucgguaucagggcguggccucgcggggcggccguaccuggauuggccgggaggcgggaccgguggugcgcgcgcgaaaggagaggggcuugggggcguggcccagggggccggagacggcugcgauuggcaguggggcgcgccgggggcgugaccgcggcauugggucccggguggggccgaggcagcgggagucgcgguugcucagcgugcaccugagacccgacgcccgggguccucgaagacgcguccgccgccgugcccgucgccaugaaccgcuucaggguguccaaguuccggcacaccgaggcucggccgccccgccgcgaggugaguccggcccgaggaccgggcgcugucgccucgggccccguccggcugccccucccccugcccggaccccacaggggugcccuccagggccgucuggaaccccgagaccuccauccccggggaaccccccuucaggccagggccccggcguccgggccguuucgucgccgccggagggcagaguccggcacucccgugacucgcucuggcgcucggugacccuggcggucugcccgccucgcccaccucgccccgggacccccgaggcggcgcagcccuccuagccggggcccaggccugcgaggccgccugccuucccagcuuccggucggccucgccgggagccggggcucggggcgcugccggcgccuggcuccuccucccugccgccccgggucgccccugccccuggcugggcuguggggagacgccccucucuccucuggccccggcgagcccaagugugucagugguggggagggagccccucggccgcacgcgccccucccucggguuuccgccggugcuuccuccucucgccgcuggcgcaagcucuuucuuuaucucggugaugcugccacggcuggguggggccuggggaagccugagcagguggagccccaaagaauugcugagccaggugccgggagacccuucggacccccgaaacggcaggaggacugaugaggggugcgccuuggaaacgaugucagcucugcucuuccgcuuuccguguuauuuguaaggccugggaguguccuccgauaacugggccuaggaguugaccucaagugaccccaucagggucccagagcaagucagggcagucuggguagagguuccguuuuuguaguguggacuauauuuccucugcuuccacuuuaugcugugcuaagcugcuggagacaucccggugaacacaacggcauuuuccuuccccuguggcacuuguagccucaugagggagacagcaagcagacaaacaagagcauuggagguuuucauaacgacauugaagaacacacaugagggacugggauggagaauggagggggccagucucaguagcguggucaggaaaggcugccuggaguagauggcauuuuagcugaggccagaagggugagaauugagaaagagccugguggagaaauggaaagugagcaugaguggauggaggggauggccggagcaguauggugacagaugaguccagagugguccugcagaacccaagggccaccggaagaaguuggguuuuauucugauugcagugcagagccauugaaaaguuagggggaggggcuggauaccaugacucacgguaaucccaguacuuuggguggacugcuuugagcucaggaguucgagaccagccugggcaacauugcgaaaccccucugaacaacaaguuaaagaaaaaaaaauuagccagguguggugacucacucccguggucccagcuacuugggaggcugagguuggaggaucucuugagccgaggaaguggagguugcagugagccgagauugugccacuacacaccagccugggcaauagagugagacacugucucaaaaaaagaaaaaaacaaacaagaaaaguuaggaggagguaccuagguuugcaucaagacagccgguggcucugagugcaguuaaguacugcuuggaggggucuggagaauacuugaggggcccuaauucuugcuccugggugggccuuaguccagcaacauaaacagauaggcauggaacuacagacuguagggagagcuuaaaacaguuuauguuagggaggcgggagaacaggugaucuguucuuuucagagauauuugcagucacuguguuuauacaguaaacaugaaucaggagggagaaauaauagggugggacugaugcuguaaccauggcaggugaacacugauauagaaacuucaggugguggaggugguuuccggggugcuauggguggguggagugggaaacauggguguccugucaucgagggcaggaaggagugcugagcggugcuuugacaacagagaaaauguguggaccuugcagaucuuaguuucagaaacgugcuccucugccuccccuuggguggggguguuucuuuuacugacuuaugagacuuuguggaaagguguguccugaugaggccaggccuuggugguuccccucucugagcuuggguguuuuucuccggguacuuggaggaggccuggccacauuuugcauuuucuuuuuuuuuuuuuuuuugagauggagucucgcucuguugcccaggcaggagugcaguggcaugaucucggcucacugcaacuuccgccucccagguucaagugauucuccucccucagccuccugaguagcuggaauuguauguaggugcccgccaccaugccuggauaauuuuuguauuuuuaguagagauaagguuucaccauguuggccaggcugguuucgaacuucugaccucaggaugaucugucugccucagccucccaaagugcugggauuacaggcaugaaccaccgcaccuggcccacauuuuacauuuccuaagggacuucgugaguggggacagaguuugauuugaaguaacacaacacggcugggggcggaggcucaugccuguaaucccagcacuuugggagaccaaggcaggcagaucacuugaggccaggaguucgagaccagccuggccaacauggugaaaccccaucucuacuaacaauacaaaaauuagcugggcuugguguugggcgccuguaaucccagcuacucaggaggcugaggcaggaggaucacuugaacccaagaggcagagauugcagugauccaagaucgcgccacugcacucuagccugggugacagagugagacccugucucaaaaagaaaaaaaaaguaaauaaaagaaugcaucucgaauggugcagcugugagcuagaguuccccagauuaugccccaccucuugcuuuaggcaugcauggagguggaacccuggcucucaccacauacuucuuuacucuugauuuucaguccuggaucagugacauucgagcaggaaccgccccuucaugcaggaaccacaucaaaucaagcugcagcuugaucgccuucaacuccgaccguccugguagggaauggccaugaguguggauauuugcucacauauucggucaucgucaccauagaugggguggggagcaggggcaggcuugguguauuuggagacuuggaacggaacugcuuuggggggcucagaggugagccccaugccagaccuuagacccccacaaacugguccaggcgcaguaaucugauugcuuuugauuaggacauauguguguacaaaccacaggcaagagcauggccaggagggcugggaggggacugacgcuuguauuuccagcugucccucugugcucccugcuccucaucuuugggcccuggauggcuggggacaguaggaacagaaaggcuugaaaagcccguguguugguuggcacucucuugauugcuagugguaacucagacccucaagcuggcuuaagcaaaaaauggauaauguuucagccuaacuaagagaucaggggcuucaggcagaucggugcccaaaggcucacauguacugucggcccugaccucucugggucucucagcucugccaccuuggguguuggcuucuuucucaaguaaaagugcgaaaaguggcugacgguagcugcaagccccauacgaaagccccacgccccuuucguaugacccguguuaaaaagagaggaccucucgccuaaugucuucuguauccaucugaggcauggauggcucaugcauggggccagaaccuacccacaggccauugcuacgugcagaggauaugaucuugugauugguagaggcucugggaagguccgaggcugagcugcuggauuucaucucugggaucccugggcaaggagguggguggcccuguggggccugaagucagaguccccguguuuguuuaacagguguacugggcauugugccucugcaaggccaaggagaggacaagcgacgcguggcccaccugggcugccauucaggugagugggugucugacuagugggugaagccugaaacuugcaccucccucuccagggccagaaauucauccucaccuggucccacugccgcauggcuugccaggucccuccugucgcccugucugugcacucucugagagacaguggggcucagaaggcuuccuccugguguagaauuccggccugggcagugaggagggaagcugugugcuccgguugugagcuggauggagcggggugugcaguggccgccccaggcuccaggcugaugcuggcucccugucccugccgaggacuccacguuggauggcucugagcccuccgucuucugcuggaguccccucuccaccaggcauccuccccagcccagccgcucggggcccuccaaggaggucgcuguguugggcugcagggguggagaugggcccucacaaagagaccuuuugugugccgcagcugcuucugggggcguccagcagccugccuggcaggcuguccgccucgagggaacaguuugcucgccucagauggaggcagagcagcccagcuggccucgccucucacuguccagcugcagcggccgcgggcccagucucucuggccugcauuucuggcugcuuguuuggaggccuucgggugagggaaggcaguugaugccugguccucaggcugggugugcagggucguggagggguucugauaugauaaugauggugguuaauaacaauaguaaagauuuauggagauugcucucuguacuaaguacguuagcugaguuuucucaucuaaacuuuuuuaaaaaauuuuuaaaaaguauauagagacgaggucuugcuauauugcccgggcuggucucaaacuucugggcucaagcaauccucccaagucaaccucccaaaguacuggcauuacaggugugauccaccaggcccagccaacguuaccuguuuuuuguuuguuuuugugacagggucuugcucugucacucaggcuggagugcaguggcauaaucauggcucacuguagccuugaccuccugggcucaagcaauucuuccaccucagccucccaaguugucaggaccacagguuuaugccaccaccccuccagcuaauuuuuaaaaauuuuuuguaaaauggggucuuguuauguugcccagccuggucuugaacuccuggccucgagcuauccucccgccuuggccucccaaaguuuuggggccccgucagauuaccuguuuuaaguaaagagccugaugauucuuauuaaagugaccgagucaugugcacugccauccaguuuuggaacguuuccaucauccccaaaagaucccgcaugccccuuugcaguuaauccauuuccaccuccaauaccacagccucaggcaacagcugaucugcuuccugccucuguggcagaggucugcaaacuacugucacggccagauccagcuggcugccuguuuuuguaaauaguuuuauuggaacgcugccacgcccauucauugauguauagucugugguugcuuucuugcaacaacugcagaguugaguugugaccgagacuguugagcccugaaauccuagaauauuuaccgccuugcccuucgcaggagacguuuacuggccucuccucuauagaggggccucuuuugcgcaucucacgcaaauggaaucgcacaauacacggucuuuggaaucuggcaucuuucacguagcauguuguuuuagagauacauguguguggcagcuuguauaacaagucuguucucaucuaaucucagaucucuuugaaguagguuuuaaaacaacccauuuuauagcuaugaaaacugagacuccugcaagguuaggaacuuacccauuguuauggcagggccagaaucagaacccaggucuauaggagccuguguuuggguuugucuuuuuagagacagggucucugucucugucauccaggcuggagugugguggugcaaucauaguucacugcagucuugaacuccugggcucaagggaucgucuauccucagccucccuaguagcugggacuauaggcacacaccaccaugcccagcugauuuuuuuauguuuuguggagaugggguuuugcuguguugcccaggcugguccugaacuccuagccucaagugaucuucccaccuuggccucccaaagugcugagauuauaggcaugagccaauguaccuggcuucauguuugacuuuuugaugcuuuuuaucuaugagggagcuagcccaaguuggugaugcuugcaagguggugagcccucugcuacuagggcucuucaaguagaagcuggaccaggguccuguaggcaaguccauagccucacuguggcugcaacuguucagagccuugccugcaugagcagcccugccgggaaacugcucaugggaaggugagcuccagcaccccuggaaccugcccuagaggcaccaggugcccuucugccucagaggugccggugucgggagaaauggccagguggggcucuggcuguugcccugccuucagaggccccuucagccucucagcucagggccacucuugcccuuccgcccagcagccaggggagcagagggugagcaacuucugggugcguuucugauguccaggcuguggggcggcagcuggggcccgcuccagugggaaaaggcagcagcaugucaugcugagcagcacagguucugaagcuggcccugucucuuagccgcgugacuuggggcaguuacucacccucucuggguuuuggcguccucauccuccaguaggggaugcugcugcagugccaccugcugcauccuuaugaggauucagugaggucccugcgugucaaccccugggcaucuguggugccagcacaugcugagcacucagauugcuuaugucaucacaucucauucacgccugagaugccagcccgccugugccagcugcuacaccugcccagggaccugcuuugcccugcagggcccagcaagcacaccccagagugagggcagcagggguucuguggcuuuaggcccaggaauguugugguccugccagcugggauuccaggccagggcuaucccaagaugugccugugcacguccguccuaucuuuucccugucuccugaggccgggaggaagacaguccugcucagcccuguugggaggcagacagcagcagguggucgcugugcucccagcucuggugauaccucucguccuguucacaccccgaaaccccgccacccuccaugccuagucucuaccuccccaaccacccaccgcauuucccucuggggucuggcucacucugugcaccccaccuaccccuccccaccucuggagcugagccguucaaguucuuaguauuuaauuuuugagacaaggucuggcucugcugcccaggcuggaaugcaguggugugaucucugcucacuccaacuucugccuccugaguucaagcaauucuccugccucagccuccugaguagcugggacuauaggcgcccgccaccacacccaacuaauuuuuauauuuuuuguagagacgggguuucaccguguugcccaggcuggucuugaacucuugagcccaagugaucugcccaccuuggcuucccaaaguauugguauuacaggcaugagccaccaugcccggccaccauucagguucuuugguugcaaagaacuaaagccaacuccggcuugcuuaaccaaaaagcaauuucuuaguugaguccuggggaccuuccacgacugaaggagcagugggcugugcugcccuaggaggggucgggcugggcagcugcguuccugcaggugccuggugacucaagcggcuuccugcccauuuccugccaaccuccugaugccagagcccuuggccacccugggucagcagggcccucggggacguaugucgcaggaggggccuguggcauuugcccccaugguguccagagggcccuuguagacuuguagccuguuucugugugcacacaaaagugucaccucggaagcccugggcuuugcuucauacuggguuggaaacaggacauuccgguggguucagccauuccucucccacagaccuagucaccgacuuggacuucucgcccuuugaugacuuccuccuggccacaggcucggcugacaggacggugaguggagccaguuggaagagcugcucuaugucccagcccguaguccagggccuucugagccccagcgccauccccacagggcucugcugccucccaguccagccccaccccacuccccagggcugcggggcuggucugaauuccuggucccacacuggcucccaagggcuugcuuggagccguggcucugaccugaccuggagcccgaggacagcagguggggaugcugccagaaacaguagagccacuuccccaacucugggaccacaccguguggucuaggagcugagauucccucccuccuuucucggaugugggguaugcagccccuggcccaagcaagcugaggcgggugggcgcuccucccaaggccaagguguguggucuccuggagcagccuaguuccaacacgggaccucacuggggucacggcagcugacucaaggcagugaggcccucagcccugugcucacggacuuggucuuucuugcagguaaaacucuggcgacugccagggccuggccaggcccugcccucagcacccgggguggugcugggccccgaggaccucccaguggagguacugcaguuccaccccaccucugacggcauucuggugagcgcagcaggcaccacugugaaggucugggacgcagccaagcagcagccccugacagguacaggccacccuggccugcccuucccagggcagccccacucuggacagcacuccguuucuuuguuggcauguuuagucacauaaauuuaaaaacagauaucaaaguuuuacacuuacauaguauaaaagucuuaagauucuaugaggcuguaauaaacaccccaucucucuuugcucuccguagccaucaguuucauccucuuaccuguuuuuuuuuuuuucuguuguuuuucuccauuuaaaaaaauaauggccgggcgcgguggcucaugccuguaaucccaacacucugggaggccgagguagguggaucaccugaggucaggaguucaagaccagccuggccaacauggcaaaaccccgucucuacuaaauauacaaaaauuagccgggcgugguggcacacaccuguaaucccagcuacucagaaggcugcggcaagaguauugcuccaacccaggaggcagagguugcagugagccgagauugcaccacugcgcuccagccugggugacagagugagaugccgucucaaaaaaauaaaaauaaaaaauaacuuuggccgggcgcgguggcucacgccuguaaucccagcacuuugggaggccaaggcggguggaucacgaggucaggaguucgagacuagccuggccaacauagugaaaccgcgucucuacuaaaaauacaaaaacuuagcugggugugguggcgggugccuguaaucccagcuacucaggaggcugaggcaggagaauugccugaacccaggaggcagagguugcaguggcuauggagagcgaagagagaucgugccauugcacuccacccugggggacaagagcaagacuccaucucaaaacaaaaaacaaaaaacaaaaaaaccaaaaaaaaaccuucuuggaugggcgucguggcgcacaccuguaaucccagcacuuugggaugccaaaaugggaggaucgcuugagcccaauauuuugagaauuagucugagcaacauagugagacacaaucucuacaaaaaauuaaaaaaucagccaggcgugguggcgugugccugucugugucccagguacucaagaggcugaggugggaggauuacuugaacccaggaggugaaagcugcaguuagcuaugaucacaccacugcauuccagccugggcaacagagugagaugcugucucaaaaaauaauaauaggccgggcacgguggcucaugccugugaucccagcacuuugggaggccgaggugggcggaucacuugagguuaggaguucgagaccagccuggccaacauggugaaauuccgucccugcuaaaaauacaaaaauuagcugggcaugguggcaggugccuauaaucccagcuaccugggaagccgaggcaggagaauugcuggaacccaggaggcggagauugcagugagcugagauugcaccacugcacuccagccugggugacagagcaagccuccgaaaaguaguggggguuaggacuucaccaucuuuuuaggggagcacaauuuaaccuggaacaggaguugcagagaauguagagaaguauuuuaagaccucacacuagcgagggagaguauagauggcaggaauagaggcuuagggcaggagugacccuguugguggggagcuauguuggaagugagccugggagggaugagagagccaggccaggagcgggaagccucggaagguaguugagugauguacggcugcacaaagguggggugaaggaagcagccuguggugcaggggaagccugucugggagaagcugcugcccuugcccccuuggcugaaaaggacccucguagcugcugccuuugcucugggaguuccccccagcaaggcccgcccccacccacuucccuggugcccucacugcccgggaccugacugugacugcuucucugcagagcuggcagcccauggggaccuggugcagagcgccgucuggagccgagauggagcccuggugggcacggcgugcaaggugagcaggcagguggggaugcccuguggggcucugugcaggccuccugggcugggacccccugggcugggccuuccaggcuuguuguuuaggaggcaguggagcacugaggucaggauggucaucugugugcccugcccccuagcugcuccucacacccccgcucaccuacaucuggaagccccuaccuugccuaggccccugucagaugagagcccacgcuggucccugguuugcgcccuaaugucgccacccucaggcagccuccucuggccgccugucuggucugucugaaccgccagccuuucugcaagacucuuguuaagcagcauucggccgcaggugcugggccaggccccaguugcuggggaggugacuuccgucgaggacaguacagacaagaggacccgugaccugggcucugcaagagggacauggugcuuugagcugguuggacaggccagggacgcguggccucaggcagggaucggggccaggacaggcaggugcggggcaggcgggugcuggguggugaguaaggguugugccuguugccguagggguaaugggaaggcaaugaaguguuaaaggccagaguagggcagguggugcagugaggggagcggauucgcauuuggaaccacauggacaguguguggcaggaggggcagugucuacagggggaugcguggcagccugcggggaggugagagcuguucucugccgggaguggcggagaccuuugggaggaggaagccaaguguuggagaaggauugggugggaggcguggcgguccugaggcaguaggagaggccugucacugggacggggaugugcuguggcagagagggggcgcuagaggagcaccuggugugaauguucuaggcagagccgcuccaggguggcugcagccuugcugagcugccggcgguaccuggaggugucaguggagucugggcccagaggggcucugagcagaauccggcugcaggugaaaaggucccguuuguuugauuugcugaccacauagugcugcccccaggaggggaugagaagagccugcaggggaggaggugggaggaggaaagccaggaccaggcuggagccugaaaccagggccaaagggcuuccccagggaggcggccguggguaccaccaagggucucugaagaccugucgggguugcugggaaugagggcacccaucagggcccuucuggaggugugccgagccugaagacacaugaagaauggcugagaggccugggaauggagccgaacaggagcuagcagggcagggaggccuaccagaccugagcauuccgccccagggcucugcauacuuggagggacccuagucuaacuuucuuuucuguacucugcuuuuguggaagccgcaucucccagucuugaucaguuuuuccucuguggugugcguugagcagagaguccugagagacuggccuaagcucugggggccaauaaggcccccagggagccccuucuggggagaccugguaugcgugcuuugaccuaacccugcuggggacggcuucccaggcagagugagcucgaggccgguccuugagggaugagcccuggcugagaaggaggggacgggcgucccaggcagaggggauggccuggguagucucagcaggacucagggauggcugccuugggaccgugacaucuuucuuugagaaacugucucugccccucugucacagguguggugguccaggcccuccuccuggggguccgagcccuauuuacuaucacaguuguguagggaaggacagugagcagccccaugggccaccggcuuggccacucuucuccuugcuuacuggugucuugcaggaagagucauaggagucacagacggaggagcuccugcugcuuccccaguggauguguuuucccccgcuaaacccagagcuuaaaguugcagggacgagaagcacacauuuccuaagugggucgugggagugaugcuuaguggaacgacucccccuccuucccugguuccuggaccuaggaauuccgccugcggggacgcagcauugccuccaagccgcaccugucagcacagucuagggccaauggguaccucagcccugggucggcugccaccuucuuuugcuguaaagggaguacaucgggguccuggugggggcauccuacacuggaaacccuggcaguauggagccgggaguggggggcggccugacugugguagggcagccagugaugcccaugagugugcagagagcgagggcuuguccugagcuguggcuggagcugcuggaugggcccaccccacaccaggagcgagcgugagccccucuuugcagccgcaccuggcucuggguuuaugcacuggagcugcucaugccacgggcugccugauggggauggggguggggggucaugggacuuuccaccagagugugcccccacccccgccccaucuccuuccuggcggggaagccuccgugccccuggcuuccacuccuguccugccucugugugagcaggucugccucccaggaccaccaaagcccccuccugcucccucucagcuacucccacugggugaaggggccucccgagcugggagagaaggggcaggaggccgcuagggggcgcgcucuccucacggauggcccauuccggccugcugcgcuccugacucccggcaugguugagccugaugagccggggaggacgcggccucugcagcccaguuccucuccgcugagccagagcagccucagugcccacucugaacccugguuuggaccccgcguuaagcuccuccaugaggguggcccagcugcccucauggagugugugcugugaguuccgcccuuagccccagcgcccagcccugcccagggguggcgcuguccgcauccucacaguucacagggcugggcggguggccggucgcuggcucacgccugucaucccagcacuuugggaggacgaggugggaggaucacuugagcccaggaguucaagaucagcccgggcaacauggugaaaccccaugucuacaaaaaaaaugcaaacauuagacaggcaugguggcacgcgccuguggucccaggcugaggcaggaagauugcuugagcccaggaguucgaggcugaagugagcucggauugagccacuucacuccagccugggcgauggagcaagacccucucucuuaaaaaacaacaacaacaacaacaacaacaaaacuggccgggugcaguggcucacgccuguaaucccagcacuuugggaggccaagcaggcggaucaccugagguaaggagcucaagaccagccuggccaacauagugaaaccccuccucuacuaaaaauacaaaaauuagccaggcauguuggcaugcaccuguaaucccagcuacuugggaggcuguggcaagagaauaacuugaaccugggagguggagguugcggugagccgagaucacaccauugcacuccagccugggcgacagagcaagacucugucucaaaacaaacaaacaaacaaacuaaaaccucaaaaaaaaaaaaaaaggaaaaaaagaaaccauagggggcucgggggcuugcccacgucauagcuggucaguggugguguuggcaucuggacucgggcugucggucucugcaccucuguggggcaggagcagcccugacugcuggaugucguguccugcccuucaucuccugagagccucugucgcuugcugucgcucguguccugccugucuccugcuguccccuguaucuguccuugaucucuacuugcucucucuggcccgcucugucauugugcucuguuucugucccacucuguccucucucaucccuugcugucccucgcuguucucucucuggucucugucuucugucucucauccuccucucucugucccucgccaucccucugaauccgagguguggaguaguggaguuuuaagagccagucccuggacuguaccuggugcccgccuggcacgcagcaggugcuugguaaacugcagcuggcagggcuuugccaggagcggcauaaaaccagggcccugcugaggcagaccagggagaccuggcuuuugaggcccucuccagacaggcccccgccucugccagccaugcgugugcccacggcccccuugguucccaccaucugccuccucacguggccucuccucccccaacgccacacaccagcaaguuccuuucuccaccucuuugcucaugcuauuuuaccuuccucgaaugccuuugccuucccagcacaagcucuguuuguccuuccaugaccaggucuaaguucuuccccgcgguuucccgugacaaccuccaggccccagaguccagcacuuagccuggaacuugguaguagcagggaggcuacucaucucucagggaggggcugcacauggagcgggaauucacuugguuuuccccugcauuucuuuuuggguuguuuuaguugauggacuauuuucgagaacaguuuuaaguuuacagaaaaagugagcaaguuguauaaggauuuuccauauuccuuaccuccucccccagugucugugaugaauauccugcgugagugugguacguuguuucaauugaggaaccaaugguaaacauuauuauuauuauuauuauuauuauuauuauuauugcacugcuggagugcauuggcacgaucucagcucacugcaaucuccgccuucuggguucaagugauucucaugccucagccuccuguguaguuaggacuacaggcacgugccaccacacccggcuacuuuuuguuuuuuuguuuuuguuuuuguuuuuguuuuugagacagagucucacucuuguugcccaggcuggagcgcaauggcacgaucucagcucaccgcaaccucugccucccagauucaagugauucuccugccuccccgucccgaguagcugggauuacaggcaugugccaccacacccagcuaauuuuguauuuuuaguagagacgggguuucuccauguuggucaggcugaucucgaacuccugacaucaggugauccacccaccucggccucccaaagugcugggauuacaggugugagccaccaugccuggccuaauuuuuuuguauuuuuagagaugggguuucaccuuguugaccaggcuggucucaaacuucugaccucaagugauccacccaccucagccucccgaagugcugggauuauaggccugagccaccauacccagccugauacauuauuauuaacuaaagcucacaguuuacaugaggggucagucuguguuguauguucuauggguugugauaaaugcaugacauaauguaaccacuauacggaguaguuucacugcucuuaacauccccuggguuccaccuguucaucccuuccgcccuccucccagaucacugccaagcacugaucuuuucauugucuguauguuggacuuuuccagaaugucauauaguuggaauuauaugguauguaguauguagcuuuucagauuggcuucuuuaacuuagcaauguauuuuugugggcuaauagcuauuuuuuuaaauugugguaagaaaacacauaucauaaaauuuaccuucuucuuuuuuuuuuagcuugcugcagccucaaacucuaaggcucaagcaguccucccaccucagacuccugaguagcugggacuacuagcacgugccaccacgcccagcuacuuuuuaaauuuucuguagcgacagggaucucacuguguugccuaggcuggucucaaacuccugggcucaaaugauccucccgccuugaccucccaaagugccaaaauucaccaucuuaaccauuuuuaaguguacaguucaguaguguuaaguauauuuacacuguugugaaacagauuugagaauuuucucaucuugcagaacugaaacucuauacccauuaaacagcaguuccccuuugcccuaccucccggccccuaggaauuggcauuccacuuucugugucuauaauuuucugugucuauaauuugacuacuuuagaugccccacauaaguggaaucauauacuauuugcucuuuuggggcugacuuauuucucugagcauaaugaaaugcugcaucgucaaggguuacucguggcgugcaguaggauuuccuugccuuugaagacugcauaguaugcgcagaccacauuuuguuuauccauuuauccaucaguagaucuuggguuguuuccacuucuuggcuauugcgaguagugcugcuaugaacaugggugugcaaauaucucuucauggccugcuuucaguucuuuuggauauguacccagaagugggguugcuggaagacaugcuaggucuauuuuuaauuuuuugaggaacugccauacuguuuuccauagcaguugcaccauuuuacaaucccaucaacagugugcaaggguucuaacuucacguacccaccaacaguugguuuuguuuuuuuuuuuuuuuugagacggagucucgcacugucaccugggcuggagugcaauggugccaucucagcucacugcaacccccgccuccuggguucaugcgauucuccugccucagccuccccaguagcugggaacacagucucacaccaccaaacccagcuaauuuuuguauuuuuaguagagacggaguuucacuauguuggccacacuggucuugaacuccugaccuugugauccgcccgccuuggccuccccaagugcugggauuacaggugugagccaccacgcccagccuugcaauuuuuuuuuuuuuuuucagauggagucuugcucuguugcccaggcuggagugcaauggcaugaucucgguucacugcaaccuccaccuccugaguucaagcaauucuccuuccucagccucccgaguagcugguauuacaggugcacgccaccacgcccggcuaauuuuuguauuuuuaguagagacgggguuucaccauguuggccaggcucgucucgagcuccuuaccgcaagugauuccccccagccuuggcuucgcaaagugcugggauuacaggcgugagccaccgcgcccggccugauacuugcuauuuuuaaaaauguaauaggcauccuaaugggugucaggggauaucuuacugugguuuggauuuguguuucucuaaugguuagugauauugaacauauuuucauacgcuuuuuggccauuucuauauauauauuuuuaaaauguauauucaaaccaggccugguggcucacaccuguaaucccagcacuuugggaggcugaggcagaaggauuacucgaggccaggaguucaaaaccagccugcucaagauagugagaccucaucucuacgaaagaaauauuaaaacauuagcagggccugguggcuugugccuguggucccacauacuugggaagcugaggugggaggauugcuuuaguccaggagguugauuugcagugagcugugauugcacugcugcgcuugggccugggcaacagagcgagacucugucucaaaaacaaacaaacaaaaaaggcuaggcacagugacucacaccuguaaucccagcacuuugggaggccaaggcaggcagauuaccugaggucaggaauucgacaccagccuguccaacauggcaaaaccccgacucuaguaaaaauacaaaaaauuagccuggcgugguggcgugcaccuguaaucccagcuacucgggaggcugaggcaggagaaucgcuugaacccgggaggcagagguugcagugagccgagaucgcgccacugcacuccagccugggugacaagaaugaaacuccaucucaaaaacaaaaacaaauacaaaaagagagaaauguccauugauggacuuugccguauugcucaggcuggucucaaauuccggggcucaagugauucuuccacuuuggccucccaaaguguugggauuacaggcaggacccacugugccuggccuacggcagcuuuuuuguuuuuuuuuuagacggagucucagucuguuucccaggcuggaguguaguggcacgaucucgguucacugcaagcucauugcaaccuccgucucccagguucaagugauucuccugacucagccucccgaguagcugggauuacaggugcgugccaccaugcccgguuaauuuuuguauuuuugguagagacgagguuucaccuuauuggccagacuggucucgaacuccugaccucaagugaucugccgcuucagccucccugagugcugggauuaccagcaugaaccaccucuccuggccauacuuacuauauuuucaauuuaagacggguuuauugggauguaacuccauuguauguugaggagcaugaguauuucaaguuuuuuuuaucuguacuggugcaaaugauguuguuuuucuuucuuucuuucuuuuuuuuuuuuuuugagauugagucucacucuguugcccaggcuggagugcaguggugcaaucucagcucacugcaaccacugucucccagguucaaacgauucuccugccuccgcccccugaguagcugggauuacaggugccugccaccaugcccggcuaauuuuuuuauuuucaguagaaacgggguuucaccauguugaccagacuagucucaaacuccugaccucaggugauccacccaccucagccucgcaaagugcugggauuacaggcgugagccaccaugccuggcuggugguguuuuucauuucaaauuccaguuguuuacuguuuuucaaaauaugaaaacaggaaucugugcugaaugaaacaaaauagaccugugcuaagacguaaaaaggaaaaguuaaccagcccccaucuuccccacccuugauaccuagcauuagcacacaggccuguguuaguccagaccuuucuccuugcucagcaaacuuguaaaauguaugggcuguaugauaguuggguaucaauaaaaacaaacaggaucguggucacacaaauggagauuuuuguugauuuuuaccacaguagaaucacacuaugccauguuauucuacaacuuccuuuuugcacuuaauuuauuauggccaaacaugguggcuuacgccuguaaucccagcauuuugggaggccgaggcgggcggaucaccugaggucaggaguuugagaccggccugccaacauggugaaaccccgucucuaccaaaaauacaaaaauuagccagaugugguggugggcgccuguaaucccagcuacucgggaggcuaaggcaggagaaucgcuugaaccagggaggcagagguugcagugagccaagauugcaccauugcacuccagcaugggugacagagcaaaacucugucucaaaaaagaaaaaaaaaauuauuauggcccagccuguaguaguggauacagauugugcccugguucuuuaugcaugaauguuuguguacacacacacacacaacgugugcaugcacacacacauuguuccacagaaagaaggucuauacaaagcaugagugcuuuauuucaguacauuuuuuucugcuuuuugucuguuuccauccucccuuuggauaaucugaaucaauaacugccgaauggaugguucggaaguguaagcucgucuuccugguuagugcuaaauucuguaagugcagaaaugaggucgucauaugagccucuccaggcugggccuaguacagggcugagcauguguggggcgcugacagccuagaguuugguucuggaccuccguuugucugucugugagggaucauggugauaguaccacuucauaggguaguuggaagaguaggaggggucgagugucugggaugccugacguggagcaggucucaggaagcugaacacuccucacugaguaggucucaggcagcugaacacuccucacagaaaccugggggacuggguggugguugcugcugugcugaggaggaggaacagggcugaggagggaugcccuggugugugauggcagcccugcgugcuggggaugggcugcucagagcuggggguugggaggugaggggagcaggcuggcuuccagggacccuccagcccuaaucgcaaguuguuuccuccucucugcuuuuccaggacaagcagcugcggaucuuugaccccagaacaaagccgcgggccucucaggugaguugugugggcaagcugggguggguugaagccuccacugaggcugaggacccagugguucuagcagguggagguaggggcaggccugggguccuggcagacauguucugcagcaccagggguccccaggagguggaccaccacugcugggagcucuuccugugaaguguguuguggguccugggagggccuggcuuugaucaccggguggcagaagcuaagcuucccccaggcucuccacggaggccaucguguggcuucaggcagcgaucugggauucccacuuccuuccuuugagaccuucacccuggcacggucagcagagaccagcugcagaggagccaaaaagaaacaaccccuguccucugcaggaagacccugggugggaccugucaaaacguacaggguccagggacugagcguguucugguuugugucugugcauggagugugcguggccauuucaguuccaagcggggaagcugggaccuggcucaugcugcaggcauccagccacugggacaccguucauuugcccuacagagaccuuguaggcaggagcaacaacccugggacagggcccugugucuggcuccguaaacauugccugugcuaggcagguaguugcugggggcuucucuugcugggcugguuuagugcuucccugaguaacuggcccgggagcagaggccugaguaaugccaagggggcagacauagauggccugaaggaggacgggcuugucugaggggucugcgcgaggggcgcugggggauacgggcccaugguuaccugggcugugggaagccauuagagaguuuuuuuuuuuuuuuuuuugagacggagucucgcucugucgcccaggcuggaguguagcguugugaucucggcucacugcaaguuccgccuccuggguucacaccauucucucaccucagccucccgaguagcugggacuacaggcgaccgccaccacgcccggcuauuuuuguuuuuguauuuuuaguagagacuggguuucaccauguuagccaggauggucucgaucuccugaccucgugauccucccgccuuggccuccuaaagugcugggauuacaggccugagccaccguguccggccaccauuagggaguuuuaagcaggaagugcgaugaguagauuuacauuucuuuuuuuggguggggagauggagucuugcucuuucacccaggcuggagggcaguggcgcaaucucggcucgcuggaaacuccgccuccuaggcucaagugauuuuacugccucagccuccuguguagcuggaacuacaggugcccgccaccaugcccggcuaauuuuuuuguauuuuuaguggagacgggguuucaccauguuggucaggcuggucucgaacuccugaccuugugauccacccuccucggccugccaaagugcugggauuacagacgugagcuaccgcuccuggccauggauuuacauuucuaaaaagaacuuucuagaagcugaggaggcuuauucccugaggaaggugaaguuuaggguccuacuguuagcucaggagaggagcuccccagcaaagaccuaggcccaucauagauacccccuccccauuucuaggacguuuuccccacccggggucaagggcaaaccaccagcccaaaccaaacuagugguagcccggagccccagagcccccuacacacacaagacucaggagagaaacccagucacauggaagauugcagcuuuuuaguccaaacgguacagucaguuccacuuuuguccagcugaagaccgagaggacucccauuuaagcagugaaacuagccaggcagggugguuuuggccacacccuggucguacuugcuggugaggcuggcugaccucuucgucaugugggaccugggccugguagaugguggcugucugcaucucaaggcaguguggguguguacgguauccucacuagguagcuuucuuugaccuccaagccuuugcccagaaagcggggcccaggcucagcuugaaggugccacagaggcuucccccggcccccuucacuuucucagguugcacucuccucuccagagcccagggcacugcuggggcaccuaugcuucugcccccgaccuaccgggcauggcucugagccagcucacugggcccacgugauucuuccuauucuccccuccuccgcccccucuuuccagccuuccuccuccucuccccuccucuuccagcagggcuggggcggugacugaugccgagguggggauagaguggcugcuauccaaggggcucccagcuccucgaagagagagggagaggaucugguucuggagggagccccccugcggggcuuuggggcgaggagaccugggaagagcguggguggcucccaccccuuccagcugcuggcuggggccugugcucgggcccuggugcgggggcagcaggccuggaaugccgcucuccguguggcccugccccccacuuccgcccagggcaucuggcccacaccuggcuucuauuaggaaaaccgcugcuggcagccagggccggugugagccgaggggccggcucgagggagaggccuucugggagcuccuucucuggcaauccuccuuccugccuagugggguguggcugggggucagggagcggggccgccugcccuccauccaaccucuguccucugugggucccaccccaccugagcccuggugcuaucccggagcccagagugggccagggaguccgcccuccacugucuuguuggagcccugccucaggcgugagcuuugagcaggggacccuggggaggcuccuccucacacccaugcuugguucuuauacugcauguaugacccuuuguuaugcgccaggcacuuggcauauuccacuuccucggaggugcagaccccgagagucggaugguucuguggcuucuccauggucccaccucagggugacagaggcaggcucgccccucuggaugcagaacccccaggacccccacugccgccccuucccuuuacaaccggcccagcuggggcugggugaggcccuggagcccaggcuguucugggaaaguggcagccccaaaugagugucgaggccucagaacccuugucugggcgggagggggccccggauugagcccucuaggaaucucagugcaucagacaggccagugggggguggugaaccucagaggagggaaggggguaaguggggggucuuacuauugaagcagguccccucaccccagcaaggagccagggcugcuccuggaaccauccugcccugcacaggaagugucgccauggugaugaaggggcgggcacgcgccuccccuccugcacccccugcggggcugacacugcuccugcccugccacagccccuccuauucucagagcuagguggugggggcccucuuggggcugcaggguagcaggaugccugggucccagcugcagccccuguucuugcccccuaugcaggagaaugaggagcuggggagacggcucuucucugaggcuugcugaggcuggcaaacgggucucgcucugucgcccaggcgggagugcaguggcgccaacacggcucacuguagcuuugaccuccugggcucaagcaauccuccugcgucagccucccugguagcugggacuacaggcacgcaccaccacgucaagcuaguuggguuguuuguuuguuuguuuuuugagauagagucuugcucugucacccaggcuggagcacaggggcacagucucggcucacugcgagcuccaccucccagguucaagcgauucucccgccucagccucccgaguagcugggauuacaggcgccugccaccaugcccagcuaauuuuuguauuuuugguagagaugggguuucaccauguuggccaggcuggucuugaacuccugaccucaggugauccacccgccucggccucccaaaaugccaagauuacaggugugagccacugugccggccuaguguuuguuuuuuuaagagagaaguuuucaguuuguggcccaggcugcucuggaacuccugggcucaagccguccucccaccacagccucccaaaguguugggauuacggcagguaccauugcgcccagcccaccucucauuuuugauacuggugaucacuccauugaugaggaguuacaggguaaggggugggccacugacccccucccucaccugggggcuuccuguggucucugggcaaacugagcuggguguacccacauuggggaguggcugggcacggacaaagcucuuaccuggaccucugaaggcugggcugaaugcuccagggagcaagagcuggcccaggauguuugcuggaagcagagcguuucuggggcagcugugguccugggcggcuccuccucccuucccugcugccuccuagcugcgacuuugugcaagccucaucaccacucugagccucacguccaucuugugcagguggaggagacagcuggggccaagccacuuugcaccauggcuucgucucucugugccuuuaggcuucccacaugugaauuaggaaggugggagcuacaggccaagggcgucccaccccuagccuuagccugugccccuaggugaaaagugcucaguggcagccccugggggacccugcaggcuuggcccagccuccgccucccucguccccaccugcuggcugagcgggucucucugcuuccaguuuccaacucuuugcagaugccaguucccauaccuggcucacgccuaucaacccucccagccuagcaggaaugacgcuaggucuucccucacuuacagucuggcgguacccugcuaucagcugugagacaugcacacuugacacgugucagacacaauccugagccuucuacaaguguucccucuuacuccuuguggccgucuucaaaaguagguccuucagcaccauaggaaagguuaaaaaaaaaaaguaaauucuguuacagugcuuuuuacagacauggaaacugaggcacagagcuagugacugacccaccaagggagguggccaggcuggggcucuccuggguccaccuccagagcuuccuccccuaacaccgugcggcucccccauggcaugcauagucacagggaaugacacacugauuucucuuuggccuacaucuaccuccccgauguguuuauuccacgggcacagggacuuuccccauuuuauucaccaugucaucucgaauaguguguggcucaaauacccauaugacgagagaacagaugagugaggggcacugcuuccccccagcaccugcccucuaucugagaaccauccggccccacugccagcuccuagcacaguucuggccccugggaggccuuguguguuucuugaaugaaugagugacuuuuggacaagcuaagagccaccuggugggcugcacacacgcagauauuugcacaacaaacaccaacgagagggcaggagccugaaugacacugugacccucuccggguguugagggcagggcuggccaauggcucgacccuuguccugacccgauauccccucuuacguggagagagggcaguggggccuugguucucaggcuccagccccaacuuccugugccggccacagccuggugggaagggaacagugagaaaagccccucgaaggacgggaccuggagccguuuccgauggucucccacgcuggagucagccuccacgggcuggggagggggccccaggccagcuccucgcaggcugcuucccucccucauucauucccaaggagaucgugggaaguucggaggaagcuggccaugguuuggggugagcuauuuuugguaacaggguccuucgucucaggcuccaggggccagggugacugggaggagcuguuugcauuuccucuggcccccucagcuccccacugccagggcccaggaggacagggccccacccaccaugugagcuucccucuccucccaggggccgggagccuuccugcuggcagcuccagcaccucgggagggccaggagaggcacuacuuggcgcucucuggacguugcccagaggugggucccaggcccugccucuugccuggggcagccacagugauccucgaaaucccccaguuuacacggugcuuugccacaagcccugcccuuccacauggugacagcccugggaagcggguggcaccgcaucgugagccccuuacacaagcgagagaaaugaggcauugacagagugugacauccccaggaucacacagcucuuaggggcaagaaagugccagugccuuuagccccuggcgcagcagggaaggggccuggagcuggggagugaggcagcccucuccuugguaggagggacacucgggaggagcagccagguuggccucugggugcagagcugcccucaacuggggcggaggcggggcugauccccggggugcuucggagaccacccuuggucccaguggggacguggagaaggacccagcccuucccacccucugugaggcuuucaggcaggugggcagcagaaguuccccagcucaggcccauuccagggggccccgcccaccagcagggcccugggggcucagguccaccucuugccuccugcagagcacgcaggcccaugagaacagcagggauagccggcuggcauggaugggcaccugggagcaccuugugucuacuggauucaaccagguaggggguuccuccuggaggagcagggcacggccagguggggacauguccagcccuuugggcggggacgaaaccaaugggaggcgggggacugagggccaguuccaggccuguccauauacggccuggcugugcugccgggucucagagccucaggggacugacggcugcugaaaacuggcagauuccauuuguaauagcucagccugaccccaggagccauaguggcccuacagggacccgagaacacagagggaaccgccccucauccuuugucaccuaaggguucuuaaaggggcagaacaugaaaacccagauucucuuucccuggggugacucccacccccacuccaagcccugcucuggggcaggugccccgugucaggcugcacccucaggcgcugguuucccugggagccccccggguggggcugagggacaggccccucugagccccucucucgcccucccugcagaugcgugagcgcgaagugaagcugugggacacgcgguucuucuccagcgcccuggccucccucaccuuggacaccucgcuuggguaggagcugcggcacgcaggugggcuggggggcugaugacccaaggcgccgcaggugagggcaccugauccggccugucagugaggcgggcugaucuccgggguguucugggguaccugaucugggcugcaaggccuugcaacagacaccuggcccuguacccccggagcuuccagaugucacgagcagcaggugcucaggugccccucuggccccugguagcagagugggcccuuggucaccagagguuucauggcuggggguugacacagguaugcuuggcauucagggagagggugugauccagaagugcaagaauacgcuucauuuuucuguggauguucuggcagggcugaggcccagggaggcuccaggcuaugauaggaggguggacgugggcauuguuggacagccuggcaggguggggguggggguggagguggagguggagguggaggugggccuuggcuuaugcggcccacugagguuuaugcggccuacuccacaccagccacauggcuguccuguucuauccugagguauguccccagguggggcuggugcccaggcagccuggggggcuccaggugcaccucauccuuccaucugcccccagaaguguguggagagggcuuuuggcagugccuggcgggguccuggccaggcacagucagcugugugccgagauggccuuggcccacugcggcucaggagccagacaccaggaggcccagggcaagcauuuaugagugacucaucuguucagaccacccacaacacagcuggggagacugaggcugggggggguguucagagacguagccaggcagggccgggguggagagacagggacuccauccgccuucugaaacuucaaccgugacuuauaagggccuugcuggaaucuucacaggcagggggauccgagaaugucagagccaggaaaggggugguacuuggcaagcuuauucauucuuccauugcauaacugaggaaacugagucacaggcaacagugaccuguccaggcucugggagcagcaaggguaugugucuggggguaaggaaggcugcgggaucuuccggggaguccccagaagagcucccaccugaguaccagcgagagcuccugccaagggcuuccccgggcugagagccgcccagaggagggguaggggucagggugacagugacgcccuuucccacccugucacacccagggaggggcugagaagcuggcaaggcccauuuuacagaugagggaggcaaaggugagcaagauucggcaccuucccugaagccauauggaggguaagaggcagagucagggcugcccucagccuccugccugcucugggcauuggagauucagggaggagucagugggacccgccccgccuugaggagucggagcucccgggccuucagacuccacgucuaggaucuggccccaugucccccaucccaggcccggagcugccuggcaucuugucuucuagaccuuucuaggucagacagccccuucccugcagggcccccaguggaggcauuugugugaagggaccuggcaccagucacuuccacccaccacuuccugccuuccaggcucugcccccagugacaggguccccauccccugaaagcgucuccugcccggccccaguguggccucuggaggaguuaaugaugcccagaccucacggugccacuggccaaggcugacccuguaauuaccacaguuaagaauagccucgaaggaccagugaggacuggaauuucucaaaucacucccagauggguggccaggcuaggguccucuccccucugcccccgagcccuggccccugcucugccagcccccaugaagcugguggaugccaaggaugugugccagccccccagcuguucugagagguggcagguccccugcacccccaggcguccuggaagcuggagccccccacuaacucccuggggugccggggccucugagcaaaucuaggcugagcauggaaagucuggagugucaucugugggcacggcuaauggggagguuggcaacugcauccacuccaccacccucgaguucuucuguuuuacagauuuuccaucuuggcuugggcagaacagugugugcccuuaugagagcuagaggaggccaggguucgugcacacaccccguccccuccucauccucacccaggggccuccgcuguggucccaccuaugcccuuccccugacauuuguggaguaucuaaggggaagccagccacagugagaggagcaggggcugggagccaggccagccucgaacaccaagguccugucugugcucaggcagccuccacggagggcugcccagcacuuugugugcuugguaccaugcuuggcgcaggguggagguggggggauaacgagagggacuggcagccugcacugaaggaacagcucaugcuuuggucuuggagaugcagagauacaccugucuugggugccacgcuucugggugugaauugagcggggaugagugugugaaugccugugagggggcugggugaacuguaucacccccuacccccauagaaguaggguguauugcuucuguagcucacaguggcccuaagcccucccgcguggccggcagccccacccguggcuggggagcaggugcugggguccugucuccacuuacugugagcauguugucuucccucccuguggccacuccuuuucaauagacgaggucgccgggcaugaaacaagagcaugugucacccacauggcccagggccugcugcagucagcaccuggugaugggggcucgcacacccccacgucugccccuggucccuggccuagagucggggggcuugucccgggucgaggcugcaucucagcuuggucgcccccuggcuggguucuccccuuccccgaagcccugaucugauggcacacuccagacacuguuccagggaaggcuuccuuuuuuugggcccugccacccccccgccacugcccccugccaccaucccacucggccagguuugcuuugcagugaaaacauuucuucagcagccgccguguucagcagcagccucaggcccacaaaggccccuuugacgaugcagccacgggccgggggaggcaggccuggccgcagccacuccccuaaugggacccaggccuacaggaaauccaccugggcugccgccgcugccucaggaagaaggggccccacccaggcccacugccaccacccacugcccgccaugacccacggcccgccuccucccuccucgugccagagcccucagcagccgcuaauugaauccagagccucgcguggcugggccugacucggcacugacaucaacacccgcgccacggggccugcucccugggucuggcugggcugacucugucccaccaggggugagccugagugcugggggccggggccaugaccugugggacaguggcauggggucugcaggaggcucacuccagcauguucugggugccccugcagcggcagcccaguggguccccuccccuccaucccacugaggguaacaggaaaaggugcuguguguccaucacuguccccaagcccccugcacccaguccaggccacagcugcacucagcaucacugcccccaccucagcaugcagccuuccuggaaaaugcucccacuucuaggguuuccagaaagccugggcacaucccuaaugcaggggcugagggggcaucccaaggccaccaauccuggcaccgucugcaagccaaccugggcccuuuguuccugucccccagcuuguccugcucacuggggcucggccccuuucuccccacccauggggucccugccuuugaugauucacacuuccccucccaccagagcccucgcuguagccaggggcaggaggcagggagcaggauuuccugcugcgcccauggugggcaguggaguggcauggggcuggggccaugcaaaccgcuuggcucucccgggacgcuguagagaaggucccggaggccacuugcucccgggaccauccaugaggccuggaaugagagagcccagggcccugucccuggaggaaagcaggcagugaacugcccaucagaccaacccacaagggacucaccuggccccacaugugccacaagccucucccagccgcacaugggccagagccccugcuggcagaagacagggccuggggaaggugaggcucccugacccguucuuguccgaggccagaggcagcccugcucccaccugggcccagccucaccucauucaagccuaggguggauggcacccaggucaggacaccugggagggcugcccaagcccaggggcugcugaggggcccuggcuccccagagcgagggccacuccuucuucaucucccuccacccagcccuucuacccuggggcugagcccaagaaacacacuucaucuuuuauuuuuucuuacaaaaggccuucauaucaucguuugucuuacaaaaaccaaaguccuugucucugaguuugaaaaacaucuucccagaauaaaugggaaaggaucucuuauaaauauauauauauuuuaaaaaagcaaaacauguuccuaaagcaucuuccuuuccaguuucuuuuguuccuucgcuuccuggggccaagacuagagucacacagccgccuacccgcucucccucugcucuuuccgggagcuuccuucacuggcccccaggguccgccuggagugggagagcccagcagggcccaggcaugcguuaccagcacauggcagggcccgccgugcccagggacugcacguugcggagggcagggcggacacuguccucauaggcacucgguucuggggacguuagggcucgucagcugggccacagcaucucacagaugaggagaccgagguccagagggaacagggcccagcuguggucacacagcccugucugcacacauccccgagguugggacugagaacuuacgugguguggcagcaggagggggcuggccaucucacuggcugagagcccggccccagcugcccugucucucucuggcuuagauguagggcuuugcguggaggggugacuggaggccaggcccugggaagcccaugaguggcaccucacacucagacccgcugggcagggccucuccaccgcccucuguugccuucgggccuggcuccaaggggaccuucacucccuccaguuccaggggcccagccccuggccccaccugcccuuuguccugagccgcugcugccauggcccgcccccgccgcacacaguaggcugcccccaccgcagccagcgcggccaggagcaccgcggccagggcgggcgcaaugaggagcggcagguugcccucgcgggccugggugacuggggcgugguuggaguggacggcuggggguguaugggccuccccgcaggccuccucgcccuccggcacccgcccgggccccaaaggcaugacacagacggaguaaguggcguugggccgcagcugggugaccguguacucagcgagcgaggcaggcagucgcagcgucaccagccgcuuaucagggcccgauagguugcgauaggugagacggaggcuccugagcugcacggagcuccccuggagguagcgcugcagccccacgcgcagggagguggggcucaccggcucgaugcccagggucagggaccgugguggccucggcgugacugguguagggcugggccguguccccugccccaucuggcucucacaguacaggcccgugaagccuucggggcacaagcacgccagguggugccguguccccagguggcaugugcccccauugaggcagguggacggugggcaguccuggggcugggggacaggcccuacagucgguggggcaguggagggcgggcugggggccucaguggccggcucuguggggcuaagccagguaggagccaagcuagaagacaaggcugugggcucccgcaccacgggccucguggugggcacuguggcugugguggugguggcugggcagccaaagucggcguagucaagcuccaggagcagccggccagcguucuugggcgggaaguggcagcgcgucuccucagggcuggccagugugacguggcucucgcgcacccaggggccaaaccagcucagggggcacacgcaguugaagggguugcgggcagcugccagcagccgcaggcgggggaagaggcccgagaggucgccaggcagggccugcaggcuuagguugcucacauccagcuccugcagggcagccaggccggccagguccucgggccgcagcugggcaaugcggguguugccggccagccgcaggcgcgucaggccccggaggccucggaucacagguggcacucgcuccagcugguugucggacacauccaggucguggagguugcgcaagcggcugaagagccccucguccagcugcugcagccccagaccagccagccgcagcgccuccacguuggcaguguccaggaugccgggcuccagggccaggaggcuguuguggcugagguccagcagcagcaggcggggcaggcgcagcgggggcagugcccgcagcucguuguccugcagcuugagcuccaggaggcggucgagcgugucgaaggcaccaggcuggauguggcggaugcgguucuugcccagguagaggcgcucgaggcgccgcaggccacggaaggucucauuggugauuucaugcagccuguuggcugucagguccagguugcugagguuggcgaguggcuggaagaccccgcugggcaggcuggcgaucugguucugugacagguccaggagcugcaggcccggcaggccggcaaagcugccugcgucgagcauggugaugccguucucaaagacguacagccccaccgugucggguggcacgucucggggcaccgugguccccuggcgggcagugcagaagacugucuguggcuggcugcacuggcagccggaugggcagcccugcaccccaggccccagggccaguagcaggagcagcggcagcagcagagggacccuggagcacaucuucugucccugggagcagagaggaggcagagacagaagacugugagucaggggccuagaaggcagacacgccaggaagagccagagggaauucacugcuucugcccccaaaugcaagagaacccaaugguuaugagucaggucgccagugccccgacccagguucugucccagccccgucacucccucacugugugaccuugucaaugcacacagaggucaucauggggcaugacauccacugaacgugcagugaccaugcacugcuuccuccugaaccccaggcccuccugccucugccuagguagguucccccauccccugccucagagauggaccaggaaggagagaauggugggacuuggagcggcagcuccucccuacagggucuggaagagggggcaggcaggcagcuggguggguguguaagcagagaagcuggcugccuuggccgccggcuccugcugccacgcuccgugucccgcccuccuuggaggagggaaugcagcgggaagacuucacauggaaacuaugggauccauguuuuuccacuugggcagucagaccugcuuaggcugggggcugcgggccgccaggaaguggccggcgggaagguuccuggaggaggggcagaggccacaggcauuggcagguguccccugugagggagggaggcggggagcugaggcuggugacagagcuggagcuggggggccacagggcucagguggggacacuggcuacauggcagccccaggggcagugccaggccugggaaaacucugcagagucauucaucuacuuuuuuuuuuuuuuuuuugagacggagucuugcucugucacccaagcuggagugcaguggcgagaucucggcucacugcaaccucugccucccagguucaagcaauucuccugccucagccucccauguagcugggacuacaggugccagccaccaugcauggcuaauuuuuguauuuuuuuuuuuuuuuuuuuuaguagagacaggguuucaccauguuggucagguuggucuggaacuccugaccucaggugaucugcccgccucagccuccaaaagugcugggauuacaggcaugagccaccgugcccggcuucgucuacuguuucuuggggucugcccugagcugggcaccaagaaagaugagcagcagccauccccuuggcagugauggugcaaguccuucccaugugccagcgaagugggaaggacgaaggaacacuaaguguuuaccgucaccucagguagccccccagcagccacgucagggcagacagaagaaagcagggcucauggaggugcagggacucgcugccauugcggugccagcaaguccgagcuagagcccaggugugcagcagccaccugugaagggugcgugcccuccagauggcccugggggcgggggcucccaccagccgcuccaggcuccagaucuuagcugcacugcccaagucaggcaggucuguggcuggcccccaucaccuagacuccuggggagaccgcuggggccguccccaggaagagcccuccccacuuuggcaccccuagaagucccugagccucauacggggugccagcccauccccaggaagcauccugcccaguggcgccugcagcucacacaagagcccuuugugcuggaguccgggcuuccccuucccccacacaggcugugcagguaguccagggaacacgaccccgacccagccugcacuccgccccaggcuggggggacccguccauagggcucccucucccccagguacguggguuccuggaaugugaggaggagcagguggucccaggacagauuagacaagucacuggugaggugaccacuggggucugcggguagcucgaggugaaggaagaagcccuuguccccgggguugggcccacgcaggcccugcccacguguaguaucgcacugccagagucgucuccccuaggagcuaccgacccugagccccuagccaguuagcgacaacaagcacccuucagaggccagcaggcuaagccuccccaaccuagcggugucccccuugcugucgugugcccccucaccucccuaaggugagacccagccugccuuugccauaggugucuccaggcccacuuagcucaggucugcugagugaacagcccaggagggccuggcacugagcacuggaagaaguuagcaccccaaaccccaggcacgcgucccuggcccggccagcccaccccaggggggcucgugucugaugaccuaaggcccuggggccacaccccuagccuucucuucccccaugggacccgcuccacccucacugacucagaggacggcgggugcggccuggccuccagaugugggcugugagugacccccacccaccccauguccauauggggggugaggccaccucugccugaauuagcccucccagcagggccagaccagggucaggaaggaugcagccagguuccagagugggaggggauccuccacguggccagccuggccagccuggccaccacuguggccgcagcuccccuugggccucguuuaaggucacaguuaagagcgcucacuccaggcaggcggcccugugcucagagguguccaagcugugaggccgcagacagugacuuugcucucacaccucgguuucuucaucugaguaucugggacacuucagggcugcagugggggaugcauguggaguccucagcccugcaaggccaggugugcaggccagcucuuaggggcacgugcuggggggugcucuucacccugcacuggggagggggaccagccauagcucugggcuccguaaucuguugggucuuuaaucagcaagguugugaagggagaggggaugcuguggguccaucuggccacaggguggcuuuccggcugacagguagugagcuguggaaugugcguuccuguuagcaggacaggggucuaggucaggacugugggcugggguccugggcugaccauccagcaggcggcagccagccugcuucccagccccguaaaaugugcggugagcucuuuugccugagccccaauucuacccccacaucaaagggaggagggaggaggcagcgcuggagcuuuggaaaaccccagaguuuguaagcuacaggcuggcagcucugagggcaccgccagggacuccuggcacugagaacccaucagccagccccgagaggaacccagcgagggaaggcugacuguggaggggacgguggcaggggacagaggccagaguuccuuucucaacugugggccucaguuucucaccucuggaguuggugcaagcagcccugcccccucacccucuggaguuguaguuuucuguuguucuguuuguuuucaaauggggaaguucuuuuaacaaguucugggagcugucccgcccgccuggggucugggcgugugcuuggugugugcguggggcugggggcugucuacaggucacacggugguugccgccgcccacccacccucccacccggugaucccaggaccugggcuuugauauuugaucacuagucaggcagggaggugagaccuuuuccucugccuggugcaggagguguuccggaggcagcccugggauuccugggauucggggacgucggggggugggaagaugacgcaagggucuggggccuccguccuccacccaaguuccucagccuugcugagugcugcugccggccuugcucccucccuggcacaguaacuggcauagggcgacaggguccacagcccggccacgaccccuaccucagcccccauugugcagugggcgcugcucguggugcucguggugccugugucuggggugacuuggucugugcucggagcacuugccaaguggucgguaaacauucacugcggagggcgucacucauaaacgcagaacucugccugcccccugggcguggguacuacuaagggagaggguuucaggccagcuuuacacagaucagacauccccacaccaaggcugcccuucacccugggggcuggggagcgggggugggguaucucugguucuggaagggggcacguggugggugagcugucccuuggcggccccuucagcacaggacuucagggaggggcccuaugaguaaggaggacaaggcacucgucaucucaacucccagggggacgcccacccaccucugggguacaccacacacgcccagggucaggcggggacgggccaggggauagcauggcuggggugggacccaggcaucuggugaccacaucagccccuggcgagaacaucucacugauucuggggcaggcggugugccugcugaguaggggacaggcuuggacagacagauagacagucugaggccaguacgccccuccugugccguaugcuucagcgugggugcaggacaggcgcugcaggucugacccugagacuccgggcccccgcuccucaugcuggcccgccaaggcucuguguggccggucaggccuggcagcagcccagccccgggagucugccaaccccuccaggcaggcgggacugugccggcggccaggacggcuggcuccaguuucgcugacguguccgaggaggcucagggcccggcuggguccgccccgucuccccuuccuugggacacagcagucccaagggcagggcagagaggucaggggucgugggcccucacagaaggggcagagagggcugggccucgaguuccucagggacugcggcagguagacccucccuauaggcgcggggaccccuggcuggugauugagcggggguccccaugggugucagccucuuucuuacuccauccaccaccccaagcuggcgcucuucauuccacagauaaugccacagccaggagcucagucaggcacucacacgcuuugugaccucauccaagcaagcuccccucucugggcuuccgucucccaccugugacgccagggcuuugcccgccgggcugcacaucagaaucauccaggaagcuuucuaaaaaaaaccuccaugcuggggccccacccccaggccaauuaaacaagaaauucugccgggcaugguggcucacgccuguaaucccaguacuuugggaggccgagguaggacgaucacgaggucaggagaucgagaccauccuggcuaacauggugaaaccccgucucuacuaaaaauacaaaaaaauuagccaggccugguggcaggcgccuguagucccagcuacuugggaggcugaggcaggagaauggugugaaccugggaggcggagcuugcagugagccaauauugcgccacugcacuccagccugggugacagagcaauacuccaucucaaaaacaaaaagaaugucuaggagugagacccaggcagagcuguauuuuggagaagcuccuugagcgaguccuccgcacagccaggguucagaacaccaggacagaggguugcaaaggggacagucaggaugucagcucgucuuccugugcagggaggaggcucuguauccuggagcagguguggaccagcuggcagggcugggagaggggcaggcacagggucuucccuccucccuccacccaggaggcuggcccggccccaggugggugccuucaguagcaccgugggugacuuggcagcugccagaccuguuagcccagggcagggagaccagugacuaaggccaggccccagcucaagugagccccuggggcggugggacgugccaucguagucacaagaggugcaaccugucagggaggacaccuguggcccugggagcugugcaguggcugcagcccaacuagaaaugggccaguccagaugccacuuucggcacgcggcaggugugaugccaccagggcugggcccucacacggggccuccucacugcccuguccccacccaggggcaagcacccaucuaguaaggcccuaaccugcaauuaacccugaacuugccagaagaacaccuuagucaccaaggaaggccgccagcccuaagcuuccugggccugggggucugagaaggaaguggcccuggaaggggucuugcccuucucaagcuccccaugccgaaccccccacaaucacccaggguucuuggccaacccguggcagaaauggcgccccuggggucugugagcugaucaaugggcaggcgggauggauucagggaggcagaacaggaccuggccacugaaccacaacccugcccccgcacugcucucaaugcccagccgggcucggggcccagggccagcaggggccccagcggccgccccagccccuucccgguguaggccggcucccuccucccuccuuaauuaaaucucucaggcagccccugaggaaugucagaaccuuauugcauuccccacgaagagucuggugggggccgucccgaacccugaagaauaacuggccccucgccugcccccacccccugcccaaaaccgagguggccugagggagccuccuccagccuccucacacccagggaggcuggaaugaggaaaagcgggggaggccggcggcccagcgcggagggaaagcgauccggcugacucuggaauguggaaaccgauaaaaggaaggaggcugaggcccugccccuccuggugcaagcaggcucccccaaacacccccacccacccccaaauacacagcccugcuccagucacgcgcacacagacacgcccacgccagacacacgcccacugggcagugcuccugcagacacacacacacacacacacgugcacccucccccuucuccaagaacucacgcaaauuccacagcagugaggggagcugguuuucuuggcagcacagagccuugggcuccccagcccagggaggggacucuaagggcagcugaugggggguccaggagaggucacuaacagaguuagguggccuugcugcccucccaugagcucagggcuggccaguggucagggauagccaucccugugggcagccuccccucuacacaccucugcucacuggcaggacuggcugucuggccugcugaggugggagcucccuccugggcucagcagggcccugcuuucuuguucccagaggcugcccaguguuguguugggacccacuuauaagcccaggcaaggacuuaauuuucuguacuugggacuugucccagcucccccggggcugucagugggggugacaguaaugggagcuaggagccgcggacccaucuccugcccggggcaucucccuugccaucucccuggccccugggcugcgugccagaggggccuuccucggguaagcacaggucugggcagugucugagaggcuccuuaugcugaaucccauucucccauucccagaauauggagagagaggugccaucuggacaaaugcccugggaccccagcccccagccccauccccaucugacccuccggacccacagguagcaggacagcuguuccaacgugcaggagacaggggcgggguggggacaggcagugcccggcccccaggcuggcaugugugugcgcauccucccuccccaggcccaggggaggcuagauaauggucuggaggggauccagcugggcugcucaucaccagagccucuuccugccucugacacucuguuuacagaagcuccaggccaacuccccugggagaagagaguaaacucaggggacugcuccccaucccccacccgccugccccagcucuguuggguuuuugucaauagcugggcccauccuggacuuugcugcccccuggacuggcccuaauggacccugcuuggaaggucccagcccggccaccccucuaugcccucaacacccaaaguacagucuagugugaagggaccuuggagauuuuauccaauccccagcccuggaggcucucagccuggggaagggggcucuaggucccgcugccucucuccagagccucaccuguccuuggugcaaaaggcaggcauggggacaccuagacccccaggaccucuuccuuccacccugcacacuccaccccugggccacagcaggggaggcggucagugacccugguguggcaaucguuaacgaaugggggagaggcagaaugguuggcaccaaucggcuggccugccagugaccacaggggaccucagcaguccucaggccccagcacugccagcccagggacacaaaggacuaggcuggcuccaggccacuggguuugcagcccaagcaaagccccuucccuggcagaggcagagacccggcacccugccugauacccgaagcucuaagggcccuggccaguacagguccaucccccaccuggagggaugggcaucggacgcccaccagccacuccccgccccucccuagggcugcauaucuguagcccccagcugugcuuugagugacaaggguccagaggaccccgggcagcccuucugcacagcagcaccuacugccggaccccaggagggaaaagugacccaagccuguggcuuggcuaucccccucaaagggguuugauucauaaaacuggucaugccggaggcccagccgugggaggaggaagcaugggacgggguguuuauuuugucugcuugcagccucgcgggcucaccgcacacucaggcgcgcacccuggccggccgcggggcugucggcgccccaggacggcgggggagggagcguacagggccugcccgccgggcggcccaggugaccguguggggcuggggccgcggucccgcccgagagugcgugugugcgcgcggcggcgguccccgcgcgugugcacagccuggccguggcgcccccuuccccgcccgcagccccccagccccacagaaacucaccgggaggcggcggcggcgcagggagccgggcggggcaggccgcggccucagucuuuccuggcgggucgggcccgaggggguccugggucccgaagcaacugcguucgaguccgcguccacccgccccgggcucgggcuccggagucggcucgcuggaggcaggucgcgccuuaagagucccggggggcgggcccgccgcggcaggggcggggccucuccccauuggccggggcggagccgcguggagacacgccccuuccccaccgaggggcucgugggccggguugcccuggcccucacccugcggccaccugaccugcgcggggagaccuugcccgucguggguuugccggaugacacugggcagguuucugcuuuuuguguaaaaagcgagagacuauuuaggaauccuaagcgucacagcccagaugccuaugaggcaccaggcaggugacaaaugccagaaguccaccccagggccucugcggcccuggagaggcaggauggcgggaguggggcugguaagggcugaguccucaugaccagcccgggccagcuagagcuuuggauuuuugaagagaaacuggaaauccagauuuuuaggugaaaucucucaauguguuauuguugguagcuaaucccaauuucaaaaaacuccuggcagcccacacaaagcccuuucaagagccuccuaaguauaaacuccaaugccaaaucugagcucaggguccucuuagccacgacagccuuaagaguugugagcagcccuggacucucuuccccaccauauuaugagaugaaggggcugugucagggagggcagugguggucugcccacggccccacaguuacuggcagcuucaagccugagcuguggaggcauagggguggucaccgucgguggguggggccugggcugcaguugacaguggcccuugauugggcaggaggggcgggugccaggggccggacuaguccagaaaaauccccugccuuggaggauuccaggaaaacacucugcccuccucccccuccgcguuuguggucagucaugccucagagccuuugggggcccagcucagcuccugacuuccggagagccuugggacacccacacccccuccagcccggccuguagccaaggcccuuggcugggcuagcucuagucuuuggggggccugaaggcuuaucccugggaggcugggccacaccagcuggaggguuuccuagucucuggaggacucaguuaucuccagaaggcaggauggccucugugucuagccgucaagggcuaagcagggccuggcugggacagucaccuucuggaccucccguccacagggcccucuccccacagggccccuuuccagggcuggcagggcuccacaacccauacguuucucggucuacauggauuagggcauggcuugcggaccucuguuccuggguuggggcuggccuuugggugcauuuagugcaggcuuuaugggaguuuuuacaacuuugaaggcacugcuaacauugaaaaaucaggugguuucauauuaaaauggggcuucccagcuugcauugaacaggaacucucagcuggggcugaguggcgguugcucccucugccaaaaugugggcucaugggucaccccaguccccaccacucccugcugccuccugccaagcuguccacucacuugaguuuccugcccggccccagaaccaucugaguuuccaaucagugcugugcagccucuugucggacuguuucccugccucuucccuuggcccuguguccucugaagcccucagaagcauccacagaugcccagggucagggguaaagagggcuccaagagccuccagccuggcuuuccucaaggaacaggaccuccugauguccuugaagcuucucaccucuguggcagguucuuguagacggagagaccccaucugccugguguucacccccugccccaauccugugcccuggccuuacacagguccccacuuacccagaggcucaagggaagcuuuuaggagaccccucucaguuuauccaacauugccuuguaugguuucaaggugccacccgccuuuagaaccugguuaccagcagucugcacacagcgggggagcuaggggcuguggggguggaggggggucaaaggauccuaacuaacucuccagccugggugauagggacagauccaagggacccagccugcuuugaacuggcgcaauggcagaaugucuggguuggugggaaggggccugagcgggagggaugggcuggaggggaggacagaggaggagccuugcagcugcuccuuguagcaagcacacccuuggugcuuccccucggugcuaaucacaggaguccugggagagcuggcggggcuuauccggaggcugaaacugcucgugccucccaguugguacugagguugucuucuagcuccugggaccuggcugaggggcgggggcagaucugggcuuuagaccuucuauaacuuuaugccugggacagaccccuggaccugggucagggucagagcccuucccaguggcaggcccagauuccagcaggagaggugccggcaauaccucuuaccaccucuggcccucugccuggcuggggcucauguaccauguuccagacccagacccagcuuggcucucuucacacagccuggggucaggcccaugccaacacuuggccaaccuuuggggcugggugccaugaccccauuucuuggcccgugccacggcagacaggaugccccugccuggcagaguuguccagauggcucugccugaggcaaggaagacuggccugaccugucagaggagccagcccugcccucccugacuuccugcccacucggccucagcuccugagucaguggcuggcuggcugggacgauggaacgggggugagggaggcugagcaccaggccuccucaggcaguuggcucagcgcacaggugagccucugaugccaugagguggccccaggccuguuucccaccucucauaagggcagcagaggggccacaggagaccugccuauccuacuugcccucagcuucuguccuggcaccuguuuccacuccucccagccugugcccccagcagccagugugaucccuacucugugccagucugguccuauccucuuucuauuuuuauuuuuuugagauagggucuugcuguguuacccaggcugaugugauuuuuuuuuuuuuuuuuuuugagauggagucucacucuguugccaaggcuggaaugcaguggugcaaucuuggcccacugcaaccuccgccucccggguucaagugauucuccugccucagccuccugaguagcugggauuccaggugcacgccaccaugcucagcucauuuuugcauuuuuaguagagacgaguuuucaccauguuggccaggcuggucucaaacuccugacccaaagugaucggccucccaaagugcugggauuacagaugugagccaccaugcccagcuggcgaugcgaucuugacucacugcagccucaaacuccugggcucaagugacccuccugccucagccagccgaguagcuggaccacaggugugcacuaccacagcaggcuaauuuuuaauuuuauuuuuugagauggagucucacucugucacccaggcuggaaugcauuggugccaucucggcucacugcaaacuccaccugccggguucaagugguucuccugccucagccucccaauuagcugggauuacagaugcacaccaccacacuuggccaauuuuuguauuuuuaguagagacaggguuucaucauguuggccuggcuggucucaaacugcugaccuccagugauccacccaccucggccucccaaagugcugggauuacaggcgugagccagcauaccucgcuaauuuuuuaauuuuuaauuuuuugaagagccauggucucaugauguugcccaggcuggucacaguguugaccuacugggcucaagugauucucccaccucagccucccaaagugcuggcugggaucacagacaugagucacuaggccuggccuagccucuuuugcuugaaacgcaccgucaccuuuucauugcucguccacuggaggcagaacucccccuccccacaugcaccaggccccuucccgucuagccuccaccugcccauccugagccucagcccucacccacacuguccaggcugucaggcacauuguccaucuuguuccucaaacaggccaugaacccaccugccacaggaccuuugcacagguuguguucucucugaaacucucuuccugugagguguuugauuucugcaugaccuugggaucgcagggaucaccccuucccccacugcugaggcccagucccccugcucugucacuguguguccucggugaaccuucccuucacauguuugucuaugggauugugucugucugccucuugugcuaggcugugagcaccuugaggacagaggcagggucuguugcacucaucucugggcauaccuacaugcaggucgagccgaggaccaggcacagaccagcucaucaaaggagugaaugauugugaacgaaugaaugagugaaagcccugucaaagcugcugaagggacuugcuuccagccccaguggagccagugucaguguggagggcacuccaggucacgcaccaccuugguccccuacccuccgccuccgccuccaccucuacaagcaguggucaggccgggaugcaaagggcauugcugagcccggcucacccugcugggcccucaguaaguaggggccuguguuacucacaggugaccagcccaaggcacuccaggaagucauggagacacccagggccccacccagcuucccagccacucuguggcuccuggaaguguggggaggggaggugggcaggacugcuuaguggucggcuggcaggaggggauggguggacaguggagggcggcugggcccuuugucaccgcagugagggauagaggcagcugccacagcugggugaccucugacccuggcaacacaguggggacgggguccuguuuaagggugucagugucuggguugggaggguccaggccugcaggucccagaaacaagaaaccaagaccaagugcaguggcucaugccuauaauccuagcacuuugggaggcuaaggugggaguaucacuugaggccaggaguuugagaccggccucggaagcauagugagaccuuguuucuacaaaaauagaaguaaaaauagccagccaugguggugcacaccuguagucccagcuacucuggaggcugagugggaagauugcuugagcccaggagguugaggcugcagugagcaaugauugugccacugcacuccagccugggugacagagggagaccgugucucuuaaaaaaaaaaaaaaaaaaaaaagcaaagaucaggagcaagaaacacaggaaggcaacugggcaucugggcaucugucagaguccuuccagguccccauuccccucaaaaggcccuggagugggaaggcagcucucacagggcugaggggcugugcaggggucucugaggggccccgggagggaggcauaaagcccggccagugacaggcaguuggccaaggcugagcuggacauagaguggcaggggcucugggggcuuccggcccgcccacucuauucccagcugccaccccgcccugcuccugccucgagaccagagaaggccugggagcaugcugcuggcaggcucggccggggcagcaggccuggggugugcagggaagcccagcggccggaggagccccuucucccgggcacguggcucagauuuggacacaggaacuuuaacucagcaugggggggucucugagcuuccaagauaucacugaggcacaggaaacgugggguaacugaguagagggccccaaaccuuagugcagauucggaacggcagggcugccugcacugcucccggaugcugccuguccacaggcagugccgaguggggacgggaggcuccucgccuccggccucaccucuccaccuucccuggcaaugcuggccugaugucuaggcugucgaaggugggaggggcacagaaugcauguggggucuucuuggaggaagagcuguggcugagaucgggcccgaguuccccugugcccacuccaguccuggagugacgcaggugugcagguggaggcccuggggaggagcagcuggggugugggcguguguugggcaugugggaagcucaggaagaggaggggguuccuggggaccaggcugaacauggcuggauggccaagcggcucccagucacuguggugccuguccugggcuccuacaugggguuacgagucuggcagcccucccacugcccugacccgccaucuugcccucucuuccccaggugucucgugccucugcuggacccugacucugggcuccugguccuggcaggaaaggugagugagaagcuggggcucccacccacauccacagccuggaguccagccccuggccuuccccaagagagaggaggaacucgaacagggccucugugucuuccccugugcagccaaggugacuguagcucuccuagaacacuggccuuccugagaacaaggccgagaauagagcagugucagcacacagucagcacuccauaaauacugacguacacccccggugcucaccccaugugcaacgaggcugagcaagugagguagucagccuagggcucagcucagcgcccagcauguuggggagccccaucuccagccacugugguucuguggcucagguccuuggggaccugugggggagcugaugccaguccugggcccuccccagggguucagucagcaaacggggcucaguucagacucauuucagggcgagaggcagcuguacuguuacgagguggucccgcagcagccggcgcugagcccagguaagccuugcuuccucgcccccauccccuacccuccccuccccugcccauccugccuguuccccuaugguguccucaacagugacccaguguguccuggagagcgugcugcguggggcugcccuugugccccggcaggcgcuggccgucaugagcugcgagguacuccgcguccuacagcugagcgacacagccaucgugcccaucggcuaccaugugccccgcaaggugagggggacuugggcgagggacugcgggggcuggggagucggggggccugggccucacuagcugccugcuugucugcggccaggcuguggaguuccacgaggaccuguucccggacacugccggcugugugccugccaccgacccccauagcuggugggcuggggacaaccagcagguaggaccagggcuggcucaccucucccagccuccccgagucccugguagccccguguggcugugugccaacucagucuggccugcugggugccccccaucccuacccaguugacccucccaugggggcccuccugaccgggcagcccaugcccccaucuccccacugccggccuccaugcaggugcagaaggucagccucaaccccgccugccggccccacccgagcuucacuuccugucuggugcccccugcggagccccucccugacacagcccagccugcggugauggagacacccgugggugaugcagacgcaagcguaaguaccagggccgcccccauccucccucagcgacacugcaguggcugcccugaguguucaccggcugaacggccuuuuuuuuuuuuugagacagugucucacucugucacccaagcuagagugcaguggcgcaaccucggcucacugcaaccuccucuuccuagguucaagcgauucuccugccucagccucccgaguagcugggauuacaggcaugugccaccauggccgacuauauuuuaauuuauuuuuugagacagaguuucgcucuuauugcccaggcuagaguacaauggugugaucucggcucacugcaaucuccgccucuuggguucaagugauucuccugccucagccucccgaguaggugagauuacaggcacccgccaccaugccuggcuaauuuuuguauuuuuaguagacaugggguuucaccauguuggucaggcuggucucgaacuccugaccucaggugauccacccgccucggccucccaaagugcugggauuacaaucaugagccacugcaccuggccuaauuuuuguuuuuguuuuuguuuuugagaugagucucgcccugucgucuaggcuggagugcaauggugcgaucucggcucacugcaaccuccgccucccaguuucaagcaauucuccugccugagccuccugaguagcugggauuacaggcgugcgccaccacgccuggcuaauuuguaucuuuaguaucuuuaguagagauggguuuucaccauguuggccaggcuggucuuaaacuccuaaccucaugauccaccugccugggccucccaaagugcugggauuacaggcgcgcaccaccacgccuggcuaauugguaucuuuaguaucuuuaguagagacggguuuucaccauguuggccaggcuggucuugaacuccuaaccucaugauccacccgccugggccucccaaagugcugggauuacaggcgugagccaccgcgccuggccaauuuuuauauuuuuuuuaguagagucaggcuucaccauguuggccaugcuggccuugaacuccugaccucgugaucugcccuccucggccucccaaacugcugggauuacagccuugagccaccacgccuggccccaaccuucuuugucaaguguaacagagacagagaaacacguggagcauaaagaaggaacuugcacagugcuuucuaaauugggcaaacacuuaaaaagcaagaauuuucauacagaucuagauuucuggcuucucuuaaaauacuggcagaucuaacccacugggcacacccuccugcagggcugggagccagcagcugccacuugcuguccccgcggucugaagcucggcugcuucccugugugucugcguuuaugcccgugccccccgccgcuccugucgcaugcccacagugggggcuccuccaguccgcagggggcccagaguggugacccuggaguccgcuggcacccccuccuuuuggccaguacaccuaggagcaggcuggcugaccccaugccccuccccaggaggguuucucuuccccucccaguucgcugaccucgcccuccacgcccuccagccuggggcccucacucuccagcaccaguggcaucgggaccagccccaguuugaggucgcugcagagccugcuggguaaggaggcaggacggggagcucaccccuaccgcaggagcccugucugccccacuccccgucauccuccuguguacccuacugcugagcacaggccucaugcagggcaccccccucacccagacucacuggcagggucauuuguccugggggcuggggugugguggcugagucucaccugcaaaauaggagggcggcuggggccaccagcuucugagcagccaaagcccugggcuccaccaagauuccccgagccaccauggaacaggguauaucauuccagacauuauuccugggcgaguugcauccacuggauuagcaaaggccugggccuagguccaugcuguacauccaccuggggugaggggagugggcagccgggacucaaagagugcagggcgggcggggacggcauccucacacgugguuccaugucccugccaccugccaggccccaguuccaaguuccgccaugcucagggcacuguccugcaccgagacagccacaucaccaaccucaaggggcucaaccucaccacaccuggugagagugacggcuucugugccaacaagcugcguguggccgugccgcugcucagcagcgggggacagguggcugugcuugaggugagggccccaccccaccagggcugccccucaguucccugccuguggcaaagacgcggagggccuuagcuacccacacaacacagggagcacaaaccuugugucaggcuccugcccgccuguccugugauccucccagccaccugccauggggccugccacuuuuauccccauuuuacagaugagggagaagaggcacagagagguuuagugaccugcccgggucacacagcuguguaagugguggagcugggauccgaagcccggccaccugagcccuaagccggagcuuuucccgccaguucacgcugcugcccccucacucucuggggccuugugguuggcacuuggggcucagagcgcaagguggucagggcagagagcuugggucacccagcggugggagccucugcugcagagggugggcucccagacaugcugcuugcccgcagccccuggggacuggcuuuucugccugguacugaugggccucggggugggggcaccucccacagcuacggaagccuggccgccugcccgacacggcacugcccacgcugcagaauggggcagcugugacugaucuggccugggaccccuuugacccccaucgccucgcuguggguaaggaggcugggugccugggcuugagggaggguccugggucccggauaggggcuggggagcccagaggucuugggcucagcaaugaugagccccugucuguccucugcagcuggugaggacgccaggauccgacuguggcggguacccgcagagggccuggaagaggugcucaccacgccagagacugugcucacaggucaggcaggcucaggaauggggcugggguggccagugucucccaagggcuccugaucaccccugccuuccuccaggccacacggagaagaucugcucccugcgcuuccacccacuggcagccaaugugcuggccucguccuccuaugaccucacuguucgcaucugggaccuucaggcuggagcugaucggcugaagcugcagggccaccaagaccagguaggacggcugcagagguggggccagcaguguggagaggcggggccagcaguguggagagguggggccagcagugaggaguggcggggccagcagugaggagaggcaggaccagcagcgaggagggguggggccagcagugaggagaggggggccaguggugaggaggggcagggccagcggugaggaggggccgggcuagcauugaggagaaggggggccagcagugaggagaggggggccagcagugaggagaggcaagaccagcagugaggagaggcgggaacagcagugaggaggggcggcgccagcagugaggaggggcaggagcaguggggagagguggggccagcagugaagcaaggcugucucucauaucccuuccugcccccagaucuucagccuggccuggaguccugaugggcagcagcuggccacugucugcaaggaugggcgugugcgggucuacaggccccggaguggcccugagccccugcaggugagcacacaggggcuggggaguggccucagaccugguucaggggugcuggcugggugucacgcgauguaucucaacaggaaggcccagggcccaagggaggacgcggagcucgcauugucuggguaugugauggucgcugucugcuggugucuggcuuugacaggugaggacucaggcauccccauccccaggcuucagaagccaccugugucccccuucuccacagucacauacauuugucaggcuuucagaaaccauuccugccccucacuggaugguuggguggguggguagaugauuggaugaguggguagauggguggauggauaggugggugaauggauggauggguggaugaaugaauguggggauagaugggcggauggcuggauggaugaaugaggggguagggagagaucgauggaugaguuggggguaagggggagauggaugcaggggagggugagggggguaggggagauggagggauguuuuggggguaguggggagauggauagaggggugggugagggguuggggggagauagaugcaggggugcacaaggggcucugggggagauggaagcaggggcggugaggcagucagggguagauggaugggugagugauuaguggaggagaaagagucaauggggaacccagagguggaggggcagguuaggauguggcugcggugccgggccacacuaggccucgccuacaacccagaacagagcaggggcuacgugggcgccuucucccugccccaggccccuucagcucugaaacaccugcuucagcccccaaacccccuugcagccaaagugagcgccagcugcuccuauaugaagcugaggcccuggccggcggacccuuggcaguguugggccuggacguggcucccucaacccugcugcccagcuacgacccagacacuggccuggugcuccugaccggcaaggugggcugggcuggagggcgggauggcaggugagaggugguggggggaaggccaguguugccggaggguucccagccugccuucuuccccgcagggcgacacccguguauuccuguacgagcugcuccccgaguccccuuucuuccuggagugcaacagcuucacgucgccugacccccacaaggugaggccacccuggcgccucguccccgaugggaccacaaggcugcccugcccccugguggccaugugggcaaguacaggagccugugggucgggggucagaguccugggcuggggcugggccuggggcugugcccagugacuggcaagaagaguugcugcuggaauuauuuaggaauuuugagagccauugucauacucaaccauuauuaaaaaucauacuguaggccggguacgguggccuggaaucccaacacuucggaaggcugaggcaggagaauugcuugagcccaggaguucaagaccagccugggcaacauagcaagaccccaucucuacaaaacaaacaaaaaauugcacuagauaagguuaaacuauaugaaccuacaauaugaaccuaaaaauaauauuaaaaaccaaaguaauaaacacucaguuuaucacuucuaauuaauuuauccaauuuuacuauuauuugugcugaggucacauguuucuguguuggagugcauggaggaaaugcaggaugaugugcuauuuacaucucuucccaacaccacauucagggaguggagguggcacguagaagcugcccauggugggaguuuguaaacuguggaaauaggaaaacaccacaaaucagggcuuucccuccagagagcagguuguucaacaugaucaacacguuacuguccagggacaggcccuaggcauggugguccuaagugaggggugccggcacccuggggagacuacgugcccagccaugagcucuaggucccagcggcagcuccgacucccuugcucccccagggccucguccuccugccuaagacggagugcgacgugcgggaaguggagcugaugcggugccugcggcugcgucaguccucccuggagccuguggccuuccggcugccccgaguccgggugaggguggggaccugggacucccaugcccaccgccuucucggugccuagaggggaguuugggucccgucugacccagcuuccaaacuucccuacccauuguucauggggacaccuacccccuucugcugagaugcugaaacucauggaagccccaggcuggugggagggucccaggucuugcccugucccuccccaacagaugcccgugugcccugggcaccuggucaaugucucaggacagcccguuucucccucugcagaaagaguucuuccaggaugacguguucccagacacggcugugaucugggagccugugcucagugccgaggccuggcugcaaggcgcuaaugggcagcccuggcuucucagccugcagccuccugacaugagcccaggugcaccgagggacuggguguggggaggaagcgggauggggguuggagaaagggacagaaggcccagguugaaguuccauuccuguuggcacgcagaauccucuggccuuugggaggguggaguggcugugucaaucagucucugagccaguggagggcagggcucguggucuguguuuucaucacagguccccaccccuaacacacacacacacgcacacacuguggugucuagggcagggcuuauacagugaggcuccauugacuguuaauaccaccucuuagaucugcgccauagaaauccccuaggucggccaggcgcgguggcucaugccuguaaucccagcacuuuaggaggcugaggcgaguggaucaccugaggucggggguuugagaccagccuggccaacauggugaaaccccaucucuacuaaaaauacaaaauuagccuggcguggugggcgccugcaaucccaacuacuccagaggcugaagcaggagaaucgcuugaacccagaggaggcggagguugcagucagccuaggucacaucauugcacuccagccugggcaacaagagcaaaacuccaucucaaaaaaaaaaaaaaaaaaagaaagaaagaaaagaaagaaagaaauccccgagggcuuggcaccaaagagcccuaacgaaggggacucucugacacguguccuugcucugucccagugagccaagccccccgagaggccccugcucgucgggccccauccucagcgcaguaccuggaagaaaagucugaccagcaaaagaaggaggagguaggcaugggagagagcagcugugcggaggugacagaguccuggcugcaccuggccacggccccuuaguucuccauccccaacccagacugggacagcagccacaugucacguccccuucacaccagagccugguggggagaccuuccagagcccuaccacugaccauggggcccgggaagugggggagggcagugggagcccugcccuggccaggccaaacccagccuaagccggcaguucugggcccaagugcuuuugggaccuuggaguauauuuugagcacuugaggccaugugcagagauaguagcccuuguaucuggugccacaugccgcagccucucagucucuuacucccccugucucuucuuugugucuuuuucaauagaaacccaucgauuuugucagggcuguaauuaaaauggcucuuuugaggccgggcacggugguucaugucuguaauccuaacacuuugggagcccaaggcaggcggauugcuugagcucaggaguuugagaccacccugggcaacacggugaaaccccgucuguacuaaaauacaaaaauuuagccgggcaugguggcgggcgccugugaucccagcuacucgggagacugaggcaggagaaucacuugaacccaggagguggagauugcagugagccgaaaucgugccacuguacuccagccugggugacagagcgagacuccgucucaauaaauaaauaaauaaauaaaaauaaaaauaaaaauaaaauauaguggcucuuuuggccaggcauggugguucacaccuguaaucccagcacuuugggagaccaaagcaagaggauauaagugauggaguuugagacccagccugagaccagugaaaccccaucucuacaaaaaaauuuuuuaaauuaaccagguguggccaggcaugguggcucacgccuguaaucccagcacuuugggaggccgaggagggcggaucaccugagguugggaguucgacaccagccugaccaacaugaugaaaccucgucucuacuaaaaacacaaaauuagccgggcaugguggcgcauaccuguaaucccagcuacuugggaggcugaggcaggagaaucgcuugaacccaggaggcagagguuguggugagccgagauugugccauugcacuccagccuaggcaacaagaacaaaacucugucucaaaaaaauaaauaaauaaaauaaaaauuaaccaggugugguguuacacacuuguagucccagcuacuugggaggcugaggcaggagaauugcuugcacccagaaagucaaggcugcagugagccaugauugcaccacugcacuccagccuuggugacagagcaagaccuugucucucucuaaaacaaacaaacaaacaaaaaggccgggcgcuguggcucacgccuguaaucccagcaccgugggaggccgaggcgggcggaucacgaggucaggagaucgagaccauccuggcuaacacggugaaacccccgucucuacuaaaaauacaaaaaauuagccgggcaugguggugggcgccuguaaucccagcuccuugggaggcugaggcaggacagugguguaaacccgggaggcagagcuugcagugagccgagaucgcgccacugcacuccauccagccugggcgacagagcaagacuccgucuaaaaaaaaaaaaaaaguucuuuucacagccuugucaggguuguucuuggagugggagagggaacagggaguccuauucccuuaccuacccuucuucugcccucucucccagcugcugaaugccaugguggcaaaacuggggaaccgggaggacccacucccccaggacuccuuugaaggcguggacgaggacgagugggugaguagugaguggccucacuucccggcaggcagcgcggucccucgcacaugccacggugcaugccuccucccuucccaggcccuccugacucccucccaccucuugguguuucgccccaggacuagccugcgcccccgucaccuccaccucaccugugcugccacuuccuagugcacaccucacggcucauccucaagcuggaagauaccucucuggccccggcacaugucaccccugcacuccugccuucccgugggcacuuccacauccucugggccucuggcaguucccagggacuguuuucaccucugcugucucuggggucagcugcugcucaucagcugcccgcuagcauguggccaggggugcaggguggcggggggucagcagcaugucccugggcaggcccugggcacccugucuccccuggucucacugcugaccugggcuggucccagccuggauuggccucauccaggaucuuuggucaccccacgcugccccaucuugccugcuguuccaguucuggucaagggccuugggggcuggccccccaccaggccuucuagagcagcaccagucucagggcccugggaccagcugcccuacuucccagguuuguagccaggagaagggggcaucacagagcugaugguccaauaaggggggugugagccccgcagggacuggcccgcaccugccuuggauguuuucagcaauuaaacuuuuuuaagcuggcca

SEQ ID NO: 192973 - RNA, 256017 nt, Homo sapiens
uccagaaaacaauguuauguaaauuuuaauauauaaauggcauccuuuuauaaccacuugauauuuuacaacaugugacuauuugguaaauacuucaaaauagcuuaugcugcggucuuguaaggcaguuucugaagcucuugagauuuuacaacaguuuucuucauacuaguguguuucuaugugguuaacaaccuacgacauuuagucuaacagcagcacuguguauuucaaugugguaacacacucugcugccuaacggcucuuggauucgguuauaaguuacaugaugccucaaauuguuucaagaaaauguuagcuugcaaaauauauuuuuucuuucaaaauucaagacacacuuaacauauggauuuuacaauacaguuuauuagcuguucuccucuucuucauaaauggaauggauaauguugauaauucuuuacaaaccaguacucauuuaagaaacuaaugaggagguugucaaaaacacauauuuaauaaacaacuccaaagagcaaugggaagccaaauauuauuauuaauaugaaggaccagagaaacugauuugugaaauaauuucuaccuuucacuaacauuucuuaaaauugcucaccaugaagauuugugcaauucuagugcagagcaguggaugaaagcugucugaggggaaaacacacacauaaauggggcuuuugccugccuuccuauuaauaaaaggagaacuagaaggaaagggcaaggaccaaaaucaaaccugaugacaagaacaacaguaacaacacggacaacaacaaaaaaccucaggaaccauuugaaaaccuuuguagaaaagaggagaauaugcccacacuuuuacuuauaaucuaauuucccuaaauguuuccuccucaugaccaccaugcccccauuuucaguucacaugauuaaggaagauaagucuauucaauuaauauuuaauuuaaaaaccaaacaaaaaguuaggaguagguggcaaaagaaacaaaauauauuuuaaauauauauauauguuugugugugugcgcaacuauguaaagaaaauaauucccauaguuacaguuuaaagaaaguuuuauauauauauuuauauauauuuuauuauaacaaaauaggcagcuauuguggguaaaauauucaguaaaaucugacuccuaagaauacauuugaaguuuuaggcuaugaauuggacuccuuuccauugccaugaugguuacuacgucaccacuguaacgucugauuuaucuguauuuauaucuaggaaauuuucucaaucuucuguguaaaaggcgaacuuccuuagcaccugaacauggccucaauucacgaaaugugaugaucauuuacauaugaacaacuuuuguaagacacgauaguguugcucaaguagauuaaaaacauugaaacguuguuauuccuagcaaauguccugggaaaaaagaaccgucaaauacuaaaaggcuuuaagaauguugaggaaaaaaugaaaucccuuaugaaagucaacucagacaugaauuuuuaaauuaaaaaauguccuuauuuaucuauaaugaaacaauugcuuugaugauagaaguugauugagaaaaggacuugagaguaauacacuggccaaaccaugcuauuaaacugaagcgugcacaguugcucaaagucuacuaaaucacugauuaaaaccacuuuuucauuuguacugaaauuugaaaagaauguauauaaagcuuuuccaaaaaucucuuaaaguuacuuucccuuaaacauuaaggaauuuuaccacaauuucugcgucuccccacguucuuaauagcuggucaggccauuccaucuucaguucugaaaaauggccacuaaccaauagugacauuaaauaauacacacgauguaacuugaaggagacacuacaugugaaaaagaagcugcagaccaugaugugugggauacaauucaacaugaaaucaguacucaagaaagacuccagaggaaagggcaaagagaugccaaagaaaauggaauuguggaaaagagaaacagagaaacaugaguuuucauagcuuuucuuuugccggaacccagauguaagaaccagauuguucuucuaugaucuguuucacuugguuguaaaugucuuccagcguaucccccuguacaauagcuguaaugauagaaacaaaaucagaaaucuccauuaauugucuauuuuugccauuacaauuauugaugaaauaguagaagcuaguaucuuugaaaaaguuacucauccaggaagaaucaccauuuacacacuguucacuuaggaaaaaaggcucacuucauuaauuuuccuauuuauauaguauaaaauuuuuaucuuaaaaauggaucaaaaaguaagacuuggagaucuuuucuuuuguucuuuuaccaucugagcauauauuagcuuuauuauuuuaaaacaaauuauuuucuuaacuuuccugauuucuccauaaacauauguagaaaaaaggaaacuggguacaaucccauagacaggaugauguaaggauaauuuuuuuuuuuuuugggguaggaucuugggggaaaagagcugauuacagauugauacuacuuuuuucaguuaagcuagcaugucagguacuguaguguaggugaauugagagauaccuaagcuagcuuguuagugguuagagacuuaacaaucaauguuuauuugcugucugaaauaaugugugaaaaaaagaguaacaauuacuaacaacuaauucuuugggaauagcugaagccccugaggucugugagggauuaguuaauaaagcaaacaaacaaacaaaaacaaaguaucgcuagacagcacuaagcaugaguaacuaacuuuuuaagaaagaaagaaaauguuuaugguugggcaugguggcucaugccugcaauccuagcacuuugggaggcugaagugggaggguugcuugaggcuaggaguuugagaucagccuggggaacauagugagacccuguguauuuaaaaaaaaaaaaaaauagcugggcaugguggugugugucuguaauccuggcuacuugggaggcugagacaggaggaugaucucuugagcccaggaguucacaacugcagugagcuaugaucguaccauuggauuguaccauuugccugggugacagaguggaaccuugugucucguaaaaaaguuuacauauaaaugaaauaauugagaauugcaaauuaaauaagucacuuacuaaacuacaaaaaaaugcccagugaucuuggaagagcaucauagguguagauuuccauggucugaaaaacugagcauaaaaugucaaagggggauuuuaaauaauacugucuauuugguaccugagaugaugugcauagaagaaagacguuguauguagguaggaagcacuuauacauagcuaggaacgccugaauaaccaagaauuuucaguaacaugauauucgcuaguaucaguuuugugagacuucuaccuuuugagcuaaaugcagacaugccucaaugucccugaagacucaguucauuugacaaaauacuugguucguggguuuggcaucuugaugcaccccaacagcacaggacagaaucccagagcauuucauaguuuagguugacaacagcacgcaaggauuuauuuuagagcauuucauaguuuagguugacaacagcacgcaaggauuuauuuuaggagaaaacagucaggaacugacuugggaaauauacauuuugcuuacuuuguaaauucauuaauggaaugguuaguaaaccagggaaacugggaaagcauaaggcugcagacaccuuaaccaugugauuaaaauuagcaucauaaguaacggcacaaguagacuuuguaaaccuccuugcaugauacacagaggacacaucauuacuucauugcuauuccugccccaaaugcagaaccuaaaucgaauuaugagaaaacaucagauaaauccaaauugagggagggacauuuuauaaaagaaugggucuuuggccgggugcaguggcucacgccuguagucccaccacuuugggaggucaaggugaaggugggcggauuggaugaguuugagaccagccugggcaacauggcgaaauccugucucuacaaaaaauacaaaaauuagcugggcauguuggcuguagccuguagucccagcuccuugggaggcugaggugggaggaucacuugagccugggagguggagguuccagugaacugagaucgcaccauugcacuccagccugggugacagagugagacccuggcucaaaaaaaaacaaaagacaaaaaacaaaacgaaacaaaaaacaaaacgaaacaaaaaacaacaaaaaauccccccuaguguuuuuacucuuaaaaaaugucagucagggucaugaauaacaagacuugggaacgauuucagauuaaagaacauuaaggaugugauaauccaauacagcacgugagccuccgcuggauccugcaccagaacagaaaaaccauuuuuuuccauuuugcucuaaagagauuagaagaauagugaaauacuaauaagaucuauaguuagaugagacauauaauuauuaaauuuccugauuuugauaauaaaacuaugauucuauaagggaauaucccuguuuuuuagaaaauacacacugaaauauuuagaaguaaagggacaucuaccugaaacuuacucucaaguguaucagaaaaaaaccuauaaaugugguaaaauguuaacacuugaggaauuugggugaaggguacaugaaacucccuguacuauucuuguaacuucuauuuaagucugaaauuaguuugaaaaaaauaagaaagcacaagguuuaaaaaccaugacccuuacugauacucagugugaaugucaaauuuaggcugauauuauuucaaacaaacaaguaacaacaacaaaaauguccaaagacuugaggaggaaguuaaaggacaaggcgaguaaaauaagaauauuggggaguugcuaccuacuuuuuuuuuuuuuaaacaaauaguauuucaaaacggaucaaagggcaacuaaucauuaaaaaggggccaagacuacacaauagggaaaggcuagugucuuaaauaaauggugcuggaaaaucuggauauccacaugcaagagaacgaaacuaaacccuuaucuuauacaaaauuaacuugaaauagacuaaagacuuaaauguaaaaccagaaccauaaaacuccuagaagaaaacacagggaaaaaagcgccuucacacuggucuuggaugauuuuuuggaaagcacaggcagcaaaauaaaaaaucaucaagugggauauuaaauaaaaaaucuacacagcaaaggaacaaucaacaaaaugaaaaggcaaccuauggaagaggagaaaauauuuccaaacaugcaauugguaagggguuaauauccaaaauauauaagaaaaucauuagcaaaauaccaaauaauccauuuaaaaaaugggcaaaggacuggaaucgacauuuuuccaaagaagacauacagauggccagcagguaucaguaaaagugcucaaccucauuaaucagagcaacagaaaccaaaaccauaaugaggcugggugcaguggcucacgccugccauccuaacacuuugggaggcugagacgggcagaucacuugaggccaggaguuugagaccagucugaccaacauggcaaaacccugucucuacuaaaaauacaaaaauuagccgggugugguggcaugugccuguaaucccagcuauucaggaggcugaggcaugagaaucgcuugaacccaggaggcagagguugcagugagcugagaucaugccacuguacuccagccugggugacagagcaagacucugucacaaacacacacgcaaaccauaaugaaauaucaccuuagaccuguguggauggcuguuaucaaaaagauaagagauaacaaguaggcaaugguaugaagaaaagggaacccuguacacuguuggugggaauguaaaugaguaaagccaucacagaaaauaguguggacauuccucaagaaauuauuauuacuauuauuauuuuugagacagaguuucacucuuguugcccaggcuggagugcaauugugcgaucuuggcucacugcaaccuccgcuucccagguucaagcaauucuccugccucaaccuuccaaguaguugggauuacaggcaugcaccaccacgcccggcuaauuuuguauuuuuaguagagaaaagggguuucgccauguuggucaggcuggucucggacuccugaccucaggggaccugcccaccugggccuccaaaaaugcugggauuacaggcaugaaccacugugcccagccaccucaaaaaauuaaaaacugaguuauuauaugaucuagcaaucccacuacucgauauauauacaaaggaaaggaaauugggccaggcgugguggcucacaccuguaauuccagcacucugggaggcugaagcaggcggaucacuugaggucaggaguuugagaccagcacggccaacccuguaacccugucucuacuaaaaauacaaaaauuagcugggugugguggcaugugccucuagucccugcuacuugggaggcuaaggcaggagaaucaacagaacccaggaggcgaugguugcagcaagcugagaucacacccgcauuccagccuggacaacagagugagacucugucucaaaacaaaacaauaaaaaacaaaaagccaacaacaacaaaaagaaaaccaaaggaaaauaaaucaguauguugaaaucugcacuccuauguucacugcaacauaaucaacaauagcccagauaugaaaaucaccuaagagucugucaaaagaugaaugagccgggcccgauggcucacgccuguagucccggcacuuugggaggccaaggcgggcggaucaccugaggucaagaguucgacuagccugaccaacauggggaaaccccaucucuacuaaaaauacaaaauuagcugggcaugguggcacaugccuguaaucccagcuacucaggaggcugaggcaggagaaucgcuugaacccgggagguuguggugagcugagaucaugccauugcacuccagccugggcagcaagagcaaaacuccaucuccaaaaacaaaaaagaugaaugaauaaagagaauauuguaggccaggugcagugcaccuauaauccaagcacucugggaggccgaggaagaacgauugcuugagccuaggaguuugagaccagccuaggcaacauagcgagacccugucucuacaaaaauaaaaaauuagccaggugugguguugcacgccuguagucccagcuacuaaggaagcugaagagagagaauugcuugagcccaggagguugaggcugcagugagccaugaucaugacacuguacuccagccugggcaagaacaaaacccugccucaaaaacaaacaaacaaaaccaaaaacaggccgggcacgguggcucacgccuguaaucccagcaauuugggaggccgagucggguggaucacgaggucaggagaucaagaccguccuggcuaacauggugaaaccccaucucuacuaaaaauacaaaaaauuagcugggcgugguggcagcugccuguagucccagcuacucgggaggcugaggcaggagaauggcgugaacacggaaggcggagguugcagugagccgagauugcgccacugcacuccagccugggcgacagagccagacuccauuucaaaaaaaaacaacaacaaaaaaaacccccaaaaaaacccaacaacaaacaacaacaaauauauauauauauguauguauguaugcaugcauaugguauauauacaacaauggaauauuuuauuaggccauaaaaaugaaaauccuaucaucugcaacaaccaacaugagugaauguggaggaccuuaugcuauaugaaauaagccagacacagaaaagcaaauacuguauuucauuuauacguggaaucuaaaaaaguagaacucauagaaacagagaggugguuuccagggacugcagaguagaagagauggggagauguuagugaaagggcacaaacuuucaguuuuaacaugaguaaauucuggggaucuaauauacagcaguagugacuauuguuaauaaagaguagaucuuaagagucuucccuacacacacaaaaugguaacugugugguuaaagacauguuaauuugauuguguuaaucaacuuacaauguacacauuuaucaaaucacauuauaugccuugaauauauacgaauuuugucaauuauaccucaacauggcuagagaaaauggaucaaaauuuauaaaggauaagagaaaaaucagaguuucauagaagaaaugaaaucuaaaucuauuuuucucuggucaaguaugaauuauuccuguuuuuguuguucuaaucaauaaccuaagaaacauuaaauuucaagauuccuggcugggcaggguggcucaccgcuguaauccuagcauuuugacaggcugaggcagguggaucaccugaggucaggaguucgagaccagccugaccaacacggcgaaaccccaucucuacuaaaaauacaaaauuagcugggcgugguggcaggugccuguaaucccagccacucgggaggcugaggcaggagaaucgcuugagccagggaggccccagcuacucgggaggcugaggcaggagaaucgcuugagccagggaggcggagguugcggugagccgagucauaccauugcacuccgcuugggugacagagcgaaacuccgucucaaaaaaaagguuccccagcaccacugccuaggcuggaugauacuaguuacuacggguagauguaggcauaguucaaaauccaccugaacgggucgguucacauggcuucaaagcaaaauucuaucuuaaagaggacuguuacaacacgguuccaaccugugaaauguucaguaaacuccuguuccaguuucauggcucucucaaauguuuuucuggcuuguucuucuguuagacgcuuauucauuucccuacgaaaauaaauguagaaauugauaauuaccaaauuauaauacuuuuaaaaaaaagauggcaaaggagagaugacacauaaaauagaaaaucaugaaaaguugaacucugcugaaaauaugaaugucauuaaaaacuugagucauucuggucauuucugggaauuuuuuuuuuuuuuuuuuuuuuuuuugagacagugucugacacugucacccaggcuggagugcaguggcacgaucucagcucacugcaaccuccgccuccuggguucaagugauucuccugcccccaucucucaaguagcuggauuacaggcaugcgccaccacgccuggcuaauuuuuauauuuuuaguagagaugggguuucaccaaguugggcaggcuggucccgaacuccugaccccagguaaucugcucgccuuggccucccaaagugcugggauuacagaugugagccaccgagcccagccuguuucugggauuuuuaaaaauaaaaauaauaggcuggacaugguggcuaauaccuguaaucccagcauuuugggaggccaaggcagguggaucacuugagguaaggaguucagggccagccuggccaacaagacgaaaccccgacucuacuaaaaauauaaaaauuagcugggugugguggcgcaugccuguaauccuagcuaccugggaggcuaaggcaggagaaucgcuugaacccaggaggcagagguugcagugagccgagaucgugccacugcacuccagucugggugacagagcgagacucugucuccacaacaacaaaauaaauaaauaaauaaacaaaaauaaaaaaauaaaaacuagauuuagucacugaauauguugcuguauacuuggaaugacagaggguuuuaacaaauucugcaucagcucaguguagccaaaaaaccuauucauuaauuuaugauacuuuugacuuugaugaaaauuucauauuaaagugacuuagagaucuaccuaucaguuuacagaaaauaaggggacaaacaaccauauaaauaacaccaugagaagguaaucagaaaauacagucuggggaaacaucugcagaagaaaugaccugguuucuaucacaaauaaaugggagguguggcggggugggggcauaaaagagagauguggagagagaaucuauagguuaaacaacuuaaccaacugccaugaauagaucuuacuaaaaauuuuauuccaacaaacugaagaaacacaaacaaaacuuaugaaauaaccagcaacauuugaacuuuaucaaauaauuauuauuuuaaguaugauaaucagugacuuuuuguaagaaauuaucuuucaaauacacagugauguacacagacaaaaugauaggaaugucugagacuuguuucaaaauaaucuggaaugaagguguaaggaggugggugugaguggagagaaacaagauuggucauaaguggauaauuauugcugcagcuggaugaugaguauagaguucguucccaacuuaaaggaaagccuucaauauuuugccauuaauuaugacguuugcuuugauauuuuguagaguuacugucuaguacucuuucaucccacccuacaaaauucucugcagcauuucucguaagggaggacuacagguaauaaacucuuucaguuuuaauuuaucugggcauguguuaauuucucccucauuuuugaagaauagauuugccagauauaggauucuuuguugacaguuaaauuuuuuuuuuuuccuucaguguuuugaacccacuguuuucuggccuccagaguuucugauaaaauaucugcuggcagggcaugguggcucaagccuguaaucccagcacuuugggaggccgaggcaggcggaucaccugaggucaggacuucgggaccagccuggccaacauggugaaaucccgucuccacuaagaauacaaaaauuagcagggcacaguggugagucccuguaaucccagcuacuagggaggcugaggcaagagaaucacuugaacccgggaggcagagagguugcagugagcugagaaugagccacugcacuccagccugggagacagaguagacccugucucauaaaaaaaaaaaaaaaaaaaaucugcugauugcugggcaagguggguauuuauuuacaccuggaaucccagcacuuuggaaggcugagguggguggaucacuugagcucagaguucgagaccagccugggaaacauggcaaaauccugucucucuaaaaaauacaaaaauuagccaggcguggcggugcaugucuguagcccuagcugcuugggaggccgaggugagaggcugcuugagcccaggaaguuaagacagcaguaaccuggguaagcagcgagccacugcacuccagccugggugacaaagcgagaccuugucucaaaaaacaaacaaacaaaaacagugacugauaaucuuauugggaaaucccuugugugugguaaguugcugcuuucaagauucucucuguauucugacacuuugauuauaaugugccgcaguguggguaucuaaguuuauccugcuuugaguucauugacuuucuuggauuauauucacgucuuucaucacauuugggauguuuuuggccauuauuucuucaaacaaucucucugccuucucucuauucuccuucaaggaccuccacaauguguacguugacugcuugauggugucuuauaggucccuuaggcucuguucacuuuucuucagucauuucucuguuucgcagacuaaauaauuuccauuguuguaucuuuaaguuaaaacuuguugauucuuucuucugucugcucaaaucucccugaaucccuguagugaauuuuccauuucaguuauuuuuaccuccagaauuuccuuuugguuuauuuuuagguuuuuuauuucuuuguugauauuuccauuuuguucauguaucuuuuucaucuuuuuuuuccuuuaucuuuuuggagacaaggucucccucuguugcucaggcuggagugcaguggugugaucucggcucacugcagccuugaccucccaggcucaagagauccucccaccucagcuuugcauguagcugggaccacaggcucgugccaccauggccagcuaauuuuuguuuauuuuuuuuuuugagacggaguuuugcucuuguugccuaggcuggggugcaaugguauggucucuacucacugcaaccuccgccuccuggguucaagcgauucucgugccucagccucccaaguagcugggauuacagaugcccgccaccacgcccagcuaauuuuguauuuuuaguagagaugggguuuugcuauguugcccaggcuggucucgaacuaccgaacucagguguucugccugccucggccucccaaagugcugggguuacaggcgugagccacugcgucuggccaauuuuugcuuaccuuuuauagaggcaaggucucacuauguugcccaggcuagucuugaaccacggaguucaagugauccucucgucucagccuucuaagugccaggauuauaggcaugagccacugcgcugggccuaucacuuucuugagacuuuguccaugucuuuuagcucauuuaguaucuuguuuuacagucuuuauuaagucuaacucuuucucaaguauagucuuucucagggauaguuuguuuauuuuuccuuugaaugggcuauauuuuccuguuucuucguaugucuugugauuuuuuugugggaaacuacacauuuaaaucuuacaauguaaguaacucuggagaacgaauucucuuccuuucccaggguuugcuguuuuauuuaaaauuuaauuuuauuguuuacuguugcaagguguuucuguaccaggaaucagccugagguguaaacuuagggucuuuucagguauuuucuaagccugugauuuuccauggauaugaaaaccuccccucauauacuuuugaauguccuggucuggcccccaaaaggggagggggaaaaaaggugugugugugugucugugguguggggggaagagggaagcacuagcccuuuguuuuuacuuaauauuuuuucuuucuccucacuaaucaccacugaaggcaauggcccuuuaaaucuuuaagucacuucagccucaaguggaggggcuuguaacaguggcagugggguuugcaacaauggcucacuguauggcugcaccuccaugaucagaagcaguaauuagcuaucagagcaaagauuccugcuauuuggaggacagaauccuuauuguccacacuggcucccacaaacccuaugcaaagcugcuugaaaauguguacauggcuacaugcuaugggacugaggguagacgaacagguaguugcuaccauguuaagagcugaaauuaaccuuucaaaccuuccccuggaagucauaagccuucaauagacuucagaguucccaaccugauaaaaauggugaacagagauccgaaauaguaacaucagacagauucugccagugcaguugucgucuggguggggagacagauucccagagcuuccuacucugccaucuucccucuagcuccauaacugauuaguuuuuaaaugcugcagcaguguugcauaccaggaauauacccaacuugguuguuacauuuugccuuauuaaaaaaauuguuugauucaauuugcuccuauuuugguaaggguucuugcaaucuauagucauaauuaagacugacuuuaucauuuuccuuuccuauauagucccuuccagguuuggguaucaaauuaaugcucauaaauuaguugaaaaguuuguauaaaauugacauagcuucuuagcuuuugguagaauuuaguaagucugcuuggcuuaguauuuaauuuguggaaaggcuuuuuaugacggguucaagucuuuaauaaguacuagauuauuuagguuuucuauuuuucuuuuccuuuucuauuuuuuccuuaacauuuucugaaguauauguuucaaacacagaugagcaauauuagaaaaaucguaucauacagcuuguuacauuuucacaaacuuacauguaccuguauacuuaggucaagacacagagcaugacuaggaccccagaaucugggugugcucacucuagucaccaacccauucuuacaggguaaccucuauuugacuucuaugagcaauuauuaaauuuggagucacagaguauguauaucuuuaggucuggguuuuuguuuuuaacucaaauuguacuugugagauucuucuauacuucuguauguggcuggagauugcucacauuaucacagaauguuucauugugaacaugucauaauuuauuuacauauucuacuccugauaguauuuggguaguuucuaguuuuuaguuacugacucuuuguuuuuuuuuagagacacggccucacucugucaccaaggcuggagugcaguggugcaagcauagcucacuacagcuuggacagaacuccugggcucaagggauccuccugcuucggccuccuaaguagcugggauuacaggaaugcaccaccacauccagcuaccuuuuaaaguuuucuguagagacaggauugugccauguugcucaggcuggucucccaacuccugaccucaagcaauccuucugucuugggcucccaaagugucaggacuacaggugugagccgccgcaccugacagucguugacuauuugaacaguacugucaucacgcuuguaccugucuuuguaaacacagguaagcguuucuguggagugugcgucuaagaauaugacuucugggucauaacucgugcauguucagcuuuaggagacacuaugauacuaucaacaguuuaccaaugaagaugcaccaaucugcaccccuaacacuguuacgaguuucaguuguuccacaucuuugccagcauuaaauauuuugucuuuuucauuuuuuuaaccuguauuuccaugauuaguugggcacuaucucacaggcuuauucuuuggagauucucuuuugugauguguccaagcccuuugucccuuuuccugucaggcugccucuguugaucucuuuggugucugcugcauguguagucauauccucuuugucuugccugauauucacauugauaugccuucuuucuuuucuugaucacuccuaaugguuuauuguauuuuauuuucaaagagaacacuuuuggcuuuguugauccucuuuaucauauguuuguuuuuucuauuucauuaauuucugcucugccauauuuuuuauuuuuaaauuuuuaaauauuguuuucuuuuuuuuuuccuugggacagggucucgcucugucaccaggcuggagugcaguggcaagaucuuggcucacugcaaccucugcucccugugcucaagcaauccccccaucucagcaucccaaguagcugagaccacaggcgcacaccaccaugccuggcuauuucuuuguauuuuuaguagagacagagucucaccauguugcccaggcuggucuugaacuccugaacucaaacaauccgcccaccuaggccuccugaaguguugggauuauaggggccggccguugugccccgccuucuuuuucaguuucucaaaaucuuagauuuucaacuuuccuaauauuugauuuucaacauucuuuccuaacauuuaaagcuguguguauuccuucaaagcuguguguauuccuucaacaaagcuaugaaagccuccaaacucuacuuggcaauucacuacuauuuaguucaaaacaucaauuuauucugugauuucuucuuugacucacucagaagcauaaugcuuaauuuccaaauacaugaggauuuucuaguuaucuuuuaauuauugguuuccauuuaaauugcauuauggucggagaguauuuguuuucuauccuuugaaauuuguaaucuagcaaaugaucaguuuuaguaacuguuucauguacacuggaaauccaugugucucuugcagaugaugagugcaguguuuaacagaugucaaauagguaaaguuuuaaauuuguguuauuccauaccuucacugauuuuuauauuuguuuucuuauuuaauugcuucugucccucucgaugauguuggaauuacuuuucgccccuaugcagcugucaauuuuuauuuuuuguuuugagaaugcuaugaagugcaaacaaauguacgaacagaucuuccuguuggagugaauauuuuacuuuuaugaaaugucacucuuuuuaguuuuuugagauggaucucgcucugccgcccaggcuggagugcaguggcgagaucucggcucacugcaagcuccgccuccuggguucacgccauucuccugccucagcaucccgaguagcugggacuacaggugcccgcgaccacgcccggcuaauuuucuguauuuuuaguagagacgggguuucaccguguuggccaggauggucucgaucuccugaccucgugaucugcccgccucagccucccaaaguggugggauuacagacgugagccacugugcccagccaugaaaugucacucugaagcuaaguaauacuucuugccuuaaaguauauucgucagccauauaaaaaucagccuaguuuagcaugguauaucuuuuccuauucucuuacuuucaaccuucccauagccuaauuuuuaaggugugucugaugaaagccacauauaauuuacuuuuuucuucaccccuugucuuuuaauuggaacauuuagucuaguagucuauuauuugcuuuaguuuauaccaucucacuauuuauaugguucugccucacauucuguguuucuauuuguucuuucuuaauuuuuacuuagauucuauuuuuuuguccccugaaaguauuagguaaugguuauacauucuuuuauucucuuaaugguuaccugagagcugugcugcguacuucaguagccacuagucacacguggggcuauuuaaaguucuaacacauguuaccuuauacuuuaguaauauuaaugaugaugauuacaaugacaauuuauaacccauagugcuuauuuaauccucaccacauaaucugaggugaauaaacauacuacuauuaucucaauuuuauagauaaacugagaugcagggagaguaaauaaauuacccuacagugacugaauuuguacacagaggcuaugccuuaggcauuuacacuuacaugauauuuuccauggauuuggguuuaauaaaaauggagauaggguaaagcugugcaaucuguaaucucuuuauggcauuuccagacacaucaaggauacaguguuugcccuaaaauaaagggaacaaagaaaaaaaacaagugagccaaauauucucaauaauaucaaagguacuuuuccuacagguccacagucuaaaucaugaucuguuucgauccuuguucacuuuuaguaaacuugucauuucucucagcaaacuuuagauaggaaaugaaauggcugaauaugcauaauuaauuugccauuuucaaacaaauguuauauuuaaaaaggaaugaaaauacaguuccuaguuuucacggaucaguuauuucucaaaauggugaaaaauagagcucccccgccguucccuuuuuuuaaaauuuaagggacggggucuuguucuguugaccaggcuggucuugaacuccuggggcucaagugauccucccaccuuagccucccgaagugcugggaugauaggcaugagccacugugccaggcccagguuccuauuuuucauucugccaagaaaaguuauucauuaagacuccaaacuaccaucuccccauagcuaucauuucauaaaagauaaaaaacccuagaguaagggcaaaccuuuuaaauaaacaaauuugugaaaccucauugccacuacucaauccuucuauuucucauuuuauuagggacugacaaaaacucauaaacuagcauaugggaccccaguucuggauuuaaaugacaacuuuucugacaagcuuaaacucacugacaaaggauacuuagguuuuuaauacagaugagcauuuccauguuaagcauaguauuuauuauuuaugacagauuuucuucuaauacauuugaaaucaggcccuccccgauaaugcaacuucaguuuuuuguuuguuuguuuuugagacgaagacuugcucugucacccagacuugagugcaguggcaugaucucggcuuacugcaacuuccgccugcuucagccuccccaguagcuaggacaacaggugugcgccaccacacccagcugauuuuuguguuuuuuguacagaugggguuucaccauguuggugaggcuggucucaaauuccugaccucaagugauccacccaccuuggccucccaaagugcugggauuauaggcgugagccaccaugcucagccccauaaugcaacuucuaacccaaggacuugaguccaagucaauacaugauaauuucaauuuggugggcacauuuaaaauaaaaaauuuaauacuguaaaauacuccaaacauauagaaaaguaaauaauagacaccauguacccauuaucuacuuucaucagacauaaauauuuuacaugaucgcuuaaacauuuuaauaacuugauacugaaauauuaauauucuagguuugcuuuaacucuuucuauauauguacauaauaguuugagaauaaacugcauaaugcuccuucaccucguauuucuuaaaaacaauggcaucucuuacauaaucacaauaugauuccaaguggccaucuaauguuccuuauuggaaaagaguaaaaaaauguccuggucaaggaucgaauucaggaucauaggaucacacauuguauuuaguuguaaagucuccuuagucuccgucaaucugacacaguuccucagucuuuugucuuucuugauguuuuugaagaguauaaaauauuuauaucauagaauaugccucauucuauggguuuauggguuuguguguuuacucacucucggauggcagguuacacauuuuuggcaggaauacuacagacauaauguguguccuucuuaguccaucauaucugggaggcgauauuauaucuauuugucccauuauuagugauccuaauuuugaucacuuguuuaagguuuuaucugcuagguuucuccacuguaaaauuaucauuuuuaccuuuguaacugauaaguauuuugggggaggacacuuugagacuauauaaauaucccuuuuuucaucaaauguucacuaauuuuagaauacacugaugguuucugccggaaacaauuaccaccaugcgguuuucaaaagauuuucuaauuuaaucauuucuucuaccuugauuaguagacaguccaaagcguucccuucuauccacuuacuuacucacauacagaugcuccuuaugaugggaguuacgucccaauaaacccaucacaaguugaaaauacuguaaauugaaaaugcauuuaauauaccuacccuacugaacaucauaccuuagcccagauuaccuuaaaugugcucagaacacuuacucuacagucggacaaaaucauccaacaugccuguuuuauaauuaaguguugaauuuuucauguaauucauugaauacuguucuacaagugaaaaacagaauagcuguauggguacuugaaguauggcugcgacugaauaugcaucacuuuugcgccucugaaaaguugaaccauucuaaguugagggccaucuguguuuguuuauaucauuauggacucuacgauuuuuauuuuacucuauguauuauaauauguuauuaucauuuaucuugauauucaaauuaucucagacuuggccagugggggacccuacagcuugguuccuuugccuuuuuacacaucuucaucauucuuugagugcuuccuuauuuuucuggcagcaaaauguuacaggcuuaucucacacuuuuccaguccuggccccagaaucagccauuucucuaaggaguccuggaucuuuuaauuaacgaauuauauuuagaagcccagauccgggccccagauauucucauggcuuauucaguguuauuuuuaggucuucuuaguggauaaagcaaauaaacauacguguguguauacauaaauacacaucuauuucuauaucuacucuuaacaauccauggguucauauucaucgcucuaauuaucuaauaucuccaauccaauuaucacagaguucauuuuacccucucccuuuuucugacagucaaaccucacucccacuacugccauuguauuaguuuauuugcucaacccuagaauauauauuaguuucagaacuguaagcccauacacuccacccaacaaaccuacuaauuagaguuuuauuuuguuuacagaucugucuucagcuuguguuaaagaaucucugggauuaagacuucuccccucuucaauguaguuaaguuauucauuugaaauacaggcagguuuauuguacccuaaaacuuaaaguauaaaaaaaaaaaaagaaauacagucagguuuauuuaguuucuacuuauguaucauuuugcuuuucccccaucuuucuuuguugcuuuuauuuuugauuuuuuuaaauauguaaaauacuaacauacuuucuaaaaguuaaaauaauacaaaaauguauacucagagaaaugucauaccccucauccuuuccaucccauuccaaauucccucucuacaucacucccucuguagguaaccaaccucauuaaguucugauuuaccuuuccugugcuuauuuucacacaacugagcagagauuuguauuuucccauuuucucuuauuuuauaccguagauauucuuuugcauguuguguaucaguucaaauaccuuauuaacaguuuuagagaacuucauuuugugaauguaaaauuaauucaaucacuuuuaucugggcauuuagaugauuuucaguauuucacaauuauaaacaaugcuacaaugaauaaauacccuuuugcccauguauuuucauacuguugggguauaucuuuggaauaaauuccuagaagugggaugcuggguugaaggaaagcugcuagauauugccaaauacccuuccaaaaggcaguaccaguuugcauuuccaccagcaaugcacaacuguuuucucucagucucaccaagaaaaugucuucauauuucucccugaaucugauaggggagaaauugaauuuagaguagucuucuuaauuuacauuuuuuuuuuuuuuuuuugagauggagucuugcucuguugcucaggcuggagugcaguggcaugguuuuggcucacugcaaucuccuggguucaagcgauucuccugccucagccuccuuagccaggauuacaggcaugcaccaccacgccaaguuaauuuuuguauuuuugguagagaugggguuuugccauguuggccaggcuggucuugaacuccugaccucaggugaucuacccaccucagccuuccacugugccuggccuuauuuuuuuuuuuuuuugaggcagaguuucacucuugucacccagguuggagugcaacggcacgaccucggcucacugcaaccuccaccucccagguacaagcaauucuccugccucagccuccugagaagcugggauuaaggcaugcacugccaagccuggcuaauuuuuguauguuuaguagagacgggguuucaccauguuggccaggcuggucuugaacuccuaaccucaggugauccgccugccuuggccucccaaagcgcugggauuacaggcgugagccaccgcacccggccuuuacauuucuuuaauaaugacuacaguugaacgucauuuccuauguacaaaggccauuuuauaucuuauuuuugugugaacuauauauucugaucuuuuguccacuguuuuuuucuauuggguuucuggucucuguucccuguuuuuaugaguucuuuauauauugggaauauuagcccuuuucuugcaaauuuuuucugucaguugucuuuugacauuguuaaugguguuuuccaauaguuuuuggaaaaagucuuuggccauaaaaaaaguuuuuuaaaaauuuuaagugguuagauuuauugaucuuucuuuuuuuuucuuuuuuuaagagccagggucuuguucuguugcccaggcuggaguucaguggcaugcucauagcucacugcagccucaaacucccaggcuucagugauucucucaacucagccuucucaguagcuaggacuguaagggugcacugccacacccggcccuuaucuccuuuuaauauaugcuggagagcuaggccuaaacaaaaggucuaucucuagcaaaugaccugaaaauaacuucucuuacauucauguuaucauuucuauuuucacuuucuuuguuuaccuuauuuaccuguuuuaucuuguaugcacuuuccuaagccauggaaaauuaauuauuuagguaagcaaauucaucacauuaacaaaacuaauuagugcuguaucuauccuaccagucuugcauacugucaaaggcauaucugauuagaagcuauauucugggauuagucugaugcuuaccuuuucugcuacuucucguacagacugaacacuuguuccauauagaugauuguuauacuggccagcuucaaugaauuuauguuccuggauaucuuuuuccaucugcucucuugaagucacaaaaugauaaucucuuccaucuaccucauaaucucguuuuggucuaguuguaucuuuaacagaaaaaaacuugggaaaguguuuaauauuaaaaaaaaaaccacaauaaauccauuuucuacuuacaucguuuuguaaaguucaacagaacagauuaauuuaaaucugagaaaggacaauaauauggaggauggaagaguaacugauaaaauaaguacaaaccauuaaaaaaugguuauaucuauuuuucccacacacagugacaggaaauguuaagaguaacaauuaaauguuuuuguuugguuuacuuacgaggaacacaggauccaaauuugucaggaaauucugagaucaagucaucauuuauccugucuuucauaggucccaauaugaucacuggucgaguauaauuaacuauaaagauaaacugcauguuaaaaggaauaaacauucaacaaauaucaauguauuuuauuucaccagcgaacaaaaauauccuuaacuguuaugacuaauuuuuuucuucccucuccaucucacucuaccaucaaccaaagaugcguaacuugcucuuuuauaaucuugacucagaucuuaaacuuuacuuagucuucugcuagaagucauauugauaauucaaucaaguuaaauuugguguuuucgcagauaauguuucuuuacauugcaaaugacagaauaaagucuaguguuuuacagauggcuuugaaguagaaauuguaaggaagcagagcaaagaagggcagaacagaaacuggauguaggaagugauauaaucccaguaguagcauucuagaaagaugaucuaacagaaguguaaacucuggguggucugggaucaugcuggaauaauggagauugguagugagacugagaacuaacauugugauagaagggaugaaaagaaggucauaaauaagaaagaagugggauaaacagugccuggaaccuaacuggaugaggaggaggaggaggaacagagaaggcucaaagauacuuccaagauuuucaaaaaaggguuauuuggaagauagugaugcuaacaagaacacuggaacaaaguugcuugggaaauaaaacacaaauauaaaagucaguaugaaaugacuagauucuaauauucuguggaguaaacuauguuucauaaaacacauguaguaaauuucuacauguauauguaguaaaaaaaaauuuuaauacaacauuuuuugggguaugagaauuuuuuucccccaaauuaaaaaguauauucuucuagaagguuauaaaacaucaauaggcuucacaaaccuucuuguugauucacugguucauaagauaagacguauucuucuugaccaccuauuagaaagugaaggcacagaugaaaaauguguaaagauaauugaugcuaaucuaauucuucauaaacaacauauacauuacuagaacuuuccugagaaaauggcaaagauauggaaagagguacuuuauggcaagauuuaguuaaaaaaaagugucaaauuauaaagucuuaaaagugaguuugcuaaauguaaaacaaaauacaaaugggcuauauaaucaauauuauauuuuauagauaaucaaaucuaaaaaucuucauuugugaugcuaugugcuacuccuuuauuuagaaucuaagaauuauuaaaucuguuaaagauuaaugcuuuaaugagcagaucugucuaucaucuaucuacguauuagguaauuuguuacuauuaaaaacaugcuacuuuuuuuguuccaccaacuacaauacugaauacaguauauuuuauuuuuaaaauaauuacaucuuaaaauuaaaaauuauaaaugcaaagguaaaacuacuguuacuauuucacugaugaaaaauucacuaacucaacuuuguaaaaaaauaauaaauuuaaugugagucaaaaagagcuuuagauaaaacuaaauccuuccaagaaaauaaacaacagugauaguaaaggagauaaauauauuugcuuugaccuuaaaaacacaagaaguuaaagcuucuaaagguuaaauuaaagguucggagcuuaggaaauacucuaaauaaaagagucuacaaauuauaucugaauaucugaauccagugaaaagaaauaaauaguuaaaaacucugagaguuuuuuuuuuuuuuuuuuuuuuugagacggaguuucgcucuuguugccuagucuggagugcaauggcaugaucucagcucacugcagccuccaacucccggguucaagcgguucuccugccucagccucccaaguagcugggauuacaggcaugugccaucaugcccagcuaauuuuguauuuuuaguaaagauaggguuucuccacguuggucaggcuggucucgaacuccugaccucaggugaucugcccgccucggccucccaaagugcugggauuacaggcgugagccgccgcgcccggccaaaaacucuaggaguuuuaaacuaacacacacacauccccccucacccccacgccuaaaauuagaaaagacuguguuaacccaagugguucaaugaaagcaaucaauauuggauaauguauuugaagacuuucucuuuaauuaucaagauccuauaacaauuuuaccaugaauuuugcaauugguuuauauuauauguauguagcuguaggucuuuuaaauccauacauuggcauaaacauucuuuucuguuuuagaaguauuucuuuguuuucaauuuuauuaucaaaguacauaagaccaauauuuuauaagcuguuuuuuaaaguacuggaugugaaacauggcuuacauacuagcaaacacaugcaauuugaauauuucacaccuuaauaauucaugcaaauggugagagacaguauauacuuucauuaccucuuuuuagccuagaaagccacucaacuacccuauaguggguucugguuauaauuaauaaaaugcugaaauacaggaaaucauuuccacaccaaaaaaaaaaucauuaaguaacuauuguguagaaaaauaaucaaccaaaugaaugacgguuaaaaguauauacugucaacaugaaaaaguauuagggacugauauuaacaggauggaccuuuugagcagccauacucaucuguaaucaagauuacuuucauauuagacagcaguaaaaaaagaaaguuagaaaaguaauuuuaauuuuuaaggugcuacaacugauauuauguacccuccccuucucccaugcccaagucuguuuuaaaacaucacaugcuugugcaguucacuuaauaaaaccaagaauguaauauaaaacagcaaaagaaaaauuaguauuauuuuucaggugaucauugaaaauguuuccuuauuucuuccguucaccaagugcuggugauaaacaaugacaugacccagaucaguauuggugacaaagaauaaaaauggaaauaaagcuaaugauaauuuagcauuacugaaaaauauuauuuuagugcucauguuaaaaccaauuacuaaacagaaggucaaaauacaaguuuucccccauuuaacuagauauuuacuucuuacaaaaaauacauauacauauacauauguaucauguacacaaauaauauuuuuauuuuauuaaaauuuuauaaauuaaccucuacauauauaguaugauuuuauuuuucaaguacagaauuuuacuugucucucccugauuuuaaaauaacgaucauauaacuucagguuuuuauaacauaucacucagaaucccuccaccccugcagaggauguauuacucgagauuacaaaagaacaaguaacuuaaaacacuuacgguaacuacuuucacuaucgcuggcauuagaaguuacaugcucugaaauugcaggacaaugaaaaaaaauaaaacagugucaugaguuuaaaaagcaaauaaucaaaaugaaauguugagauauaagccauauauaacaaaauaauuuuuuaaaagcauuuucuuuuucuuugaaacguuuaaguuuuucaaauaauaaauauauauuagcaaaggaaaacuccuguaauuaaggacaaugccuuauuuuuguacaacacaguuuaugaacaaaucuauuauaaauagcaaguagaauaugacaaaaagggcuaagugacccugaauuaguccaaauguagacauaaaacucaaaggagaaaauacuguuggcacuauuucaguuuuugaaacagcguuaacuggcaaaggggacaaacuauauuuaaacaaauagaugcccauuuuaaugacgggaugucuuuguaauuaaaaauaaauagaugaucuuauuuucaauccagcuuugcuccuguuucugaagaugaaaauccauguuucugagaucauauagauaaaggauuguaaaggucauaaauucagaugucucagcuggaagggaaggcacugaugguggcaauugcauuuuaaaaccaacuaauauuagaagucauaaauucagaugucucagcuggaagggaaggcaccgaugguggcaauugcauuuuaaaaccaacuaauauuucuuagaaacucugcuuugauaagacuggcacuggcuggcuuuugcaaaacauaaaaaagacaaugagaacaaacacacccagccagaaacugccuggcccuccuuaaaagugacuccauuucacgacuuuauuguuugguaaaaccauaggcacucuucucauccauguaaaugucaucucaaguuuucucucaauaaauaucucccuucaauuaaacaaagacuaauacuuuuauuuuuaaaaaauaaaaauaaaacuuucaaugagacagggaaaucugaauuuuuauuuuaacuuuuuuuuuuuuuuuuaauuaaagggacagggccucacucuguugcucaggugggagugaggugguaugacuauagcucacugcagccucgcccuccucuccugggcuucugugauccucccaucuuagcccagaguggcugggacuacagguauguaccaccaugcccugcuaaaauuuuguuuuuuuuuuuuaauaaaagagacaagucucaacuauguugcccacacuggucucaaacuccuggccucaagggauccucccaucucagcuucccaaagugcugggauuacaggugugaaucaccacacccagcuggaaauuucauuuuuuuuuuuuuuuuuuuuuugagauagucucccuuuguugcccaggcuggagugcaguggcacgaucucagcucacugcaaccucugccuccuagguuuaagcgauucuauucuugugucucagacaccugacuaccuggcacugcagguauauagcaccaugcccaacuaauuuuucuauuuuuaguagagacugguuucaccauguuggccaggcugauauugaaccucugagcucacgugaucugucugccuuggccucccaaagugcugggauuacaggugugagccaccgcaccuggccaaaugguagguuuuuuaaaagcucauauuaaaauauuucuuuccaugucaccacaugggcuugacagcaauaauuuaaaauugguguauaauauucuauuagauugauacauuauuuaccucgcuauuuauuagauauuuuuauuugcuuuaaacuguuuuucacaaguaucaacaauuaugaaugucuucauuuauauauaccuuuuaacuuucuguccuauuuccuuaaauuucauacccagaaacacgccacauuaaaaaaagaguuauucuguuuacauuaguauugguauuacccucugcaaucucuaguuuguaaacuaaagaaaaauuaguuauugcaauggggugaagggaggggaguguaagugggaguacagaagaaacagaauuggcaaauguucaguugacaauuaugaaagcuggauaaacaaauaccugcaggguuuauuuuuacuacuuuucuacuauugaauauaucugauauuuauauaauaaaaaguuuaaguuaccaaaaucucuucacugucuuuuuuuuuuuuuuuugagauuucuccuacucaccucaaacccucuaagacugccaaaagcuacgccacaaucaaauucugcagguucuuucaaauaucauuucacuuagcucuucuacaauaaagccucacuacucaaaguaugguccuuagaauagcgucaucauaauuguuuggaauguuauuagaaaaauaaaauguuuuucuucugauaauugaaaauguuccucuucaaagcauuuuaccaaagaagacagucaaauaaccaauaaacauauagaaaaguguucaaguuaauuacuugucagggaaaugcaaauuauaaccacaaagagugucucugccauccaccagaauggcuaaaaugaaaacacaaaacagacaugucaagcaucgauaaugauaugcagcaaugggaguucaugcgcuaggaaugggcaaacugguaaaacuagaaaacuaauuggcaauagcuacuaaggcuggacaaauguguaucuauacgacccagcaauuccuuuccuagauauuuccccaacagaaaggcauauauaugcuuaccacaagacauguauaagaauguucaaagcaacacuauuuaaaauagcuccaaacauauaagacugagacaauauaugcaguuucauauuuuacuuuuuucauagauaguaagcauuuccccaugucauuaucuuuaaauaugauuuuugaugguuauguaauauuacauaguauggauaaaucauacuucauuaggcacuucccaacuguaagacauuuuaccacgguuuuuuuuauuuuugcuguuauuacucaauaauauuauaauaagcauucugauauauaaggcuuugucuccaucucuaauuacauccuuaggauaaauucuuugaagaggauuuagugggucaaaagaugugcuuuuucaggaaggcugugccaauuuacacucccauacauuuacuuguaauacauuauuuacuuguaauacauuaaaagcaggcauuuagcagcacucucuccgucauggguuuucuuuuuaaacaaaagucugccaaagugacagguaaaacauuuugcuuaucacuacuagggaaauuaaacauuuuuuauaugcuuauuucauuugcuuaucuucugagcacucuugcccaguuuucuaauggagaguuagcuuauuucuuauuaccuguuaaaaacuuauaaagauauuauccuugugacauacaugguacaaauaaauucuucaaguuuuuauuuuuguuuaugauugucuuaaaaaaaaaaaaaacaaaaaaacaaaaaaaaaaccugagucuugcucugucacccaggcuggagagcaguggcgugaucucggcuuacugcaaccuucaccucccggguucaagugauucuccugccucagccucccucccgaguagcuuggauuacaggugugcaccaccaugccuugcuaauuuuuguacuuuuaguagagacgggguuuugccauguuggccaggcuggucucgaauuccugaccugaggugaucugcuggccucagccucccaaagugcugggauuacaggcgugagucaccgcgcccagccuguuuaugauguuugaugaacagaucuaucucaaaucucucuaaccaaguuuuaucauuguacucaaaugcuucuuccugauacaguacaucauguuucucuucugcucuccucuaauacuacaucaucaaucugaagcaaugaaacuacucuuacaucuuauucguaaugcaaaugaaaauaagucuguuuuuggcauuuagaagcucugcacaacuaugcguacgucuuuaaagugagaagaaagaaaagacauauguaacaggaaaccuacgugccugaggaaauuuuugagguguuguacaacauggaaaguuguaaaaauggaaagccuacauguaauaagaacaaaccuugucucaaaucuuaugucauaauuuuacuucugagcaccuuauguaucuuuuauugaguuauguuuccuuucagucucuguuaaaggaaucuuaccuaguuuuagucccuugagcuuuuucaaaauuaccucccuuaaagcaugaaagcggcacggguuuuuauuucuagcuuuucgcaaaugaugacuuagcugcauucucccaaacuuccauuguacucucauuaguucuguuuagcaaaauuagguuugauaagacgauuucucucacuguuuucucuacuguuaacagggaaaucaauaauuuauuugacucucuucuucucagaauaaagaacaaaugaauucaggucuacacaaagcguucuaugguaucacuucuguuucucugucugcucuucaauuaaauaccccauuuuucauagguugugugaauuuacagcagauauacauuuuuuuuuucuugauauucaguguuauuccauuucucuucaauagguucgguucucuggaauaacuuaaccuucuuuuuuggguucuuuuugaguuuuguuccaauaaggccugaugacuaccuacauuaaguugcacuuauuuucuuauauuaaagucucucaagauuuugcuuaguuuauucccuacauucuuaacuucagaauguaaguaacugaggccacaaguaacguccuugaacacauccuucuucccaguauuuacuacuacauaaucaugggcaccuugucaacugccuuauaucaucuauuuuaugugauaaccuccaucauauccaguuuuagaauuuuacugauauuuuucugucuucuccaacauuuugugaauaaaaucuugaucugaugaucaaguuaccaggugaauaaauucuuuuaauuccugugagaugaagcacagaaaucuauuauucaagagaucuuaggucacucuccagaaaauaaaaucuuuuucugaauaacgucgucugauaaucaguuaccauuuuucauauuauuucucuuccaaagucucaaucuucaaucagaaccagagaaagagggucaagguauaaugaucaucuauuauaacaucaauaugggaaccaaauucuucauuuaguuucuuuuucuaugaguuuccuaugucucuguucacuuaacauauaagaaaaaucuguggguccauuuguugauccauaccaccucuaaaguauguuaucaaucucaaaauaaauucuauagcauacauaaacugugguaguaugguccaauuuuagagguuuucauugauaauuuuccccaaauguaagggugucacuagugauaggaaaucuguggcccuuacuaaauccuauaaaggcacaugcaaaaauaacaaagugugucuaacagaaagaguuguaaauaaacauacugucuucaaucuaauacaaacuuaaaucacuaugguugaaauaaaaguaccugcaguuuagauuaaaauuucagcauaaaagcauaaaucagaaaaaugucuuauguaaaauuuaauguuuauuaauguaggucuuagaaaguuaaaagauacuggcuauaggcuuaaugaucaaugaaugacaaagaaguuuucaaaauauuuaauaaucuaaauagaaagaaccauuuagaaaauauuagauuaaaagauuacuucuaucacucacugucaccuaaaguuacucaguaauguuugguaaauuuucaguuaagcaauuugaaaacaugcaaauuaaaaauuuuauuugcuaaaauggcuucuugcuucauucauucaugccaacauuuauugaaugucuucuacauacuagacccugugugaagcuuuacaugaagauuaaguaacuagcuagaaaauuaaacaagaacagcagcaacaaaaaccaaaaacaaaggcaacaucuuagcuaaaggaaaaacaaaauaguucuuauacucuugugguaacuuauaacuuucucaaaaaaaaaaaaaaaaaaaaaaaagagauacacaaccuauccccucaauaaacugcuacuugcguaguauucuauugugcuuuauacuuuuauaguaaugcuuuucuaacacauaaucaaaauuauuuuaaauuauuuuaacaaaaaaaaggggaacauaaaacuccaaggaagcauauuucuacauucuaauaaugaggguacauuuaaaaaaaucuuaaaaguuuuuauauuuuaaaaguuccuagcaaaaguaacugucguaaaaauuacaaaaaggaaaauauaguuacgagcaagagaauuuuucaaaugacaugugaaaaauaaaaacaaaaaguuauguauuacagaaauaaagucccaagcaugugauaaacaugaaaauucuaaaagcaaucuaaaucauacaccuccuuaugccagaaaggcacuaccaugaaucucaaaauguaucugaauaagguaggucugcagauggagguuaaaaaauaacuugggaguauuuugaucacuuacucaggccuuuugaucccaugucgucagggaucuccuguagaggguaguccccagagagcaagcaauaaaaagauaaucaaagaaaauaguugucaguaaugcauaaaauuggugcuacaguaagagacaguuccaagaccauuacagguacauauaucuuacagagcauuuuuacauauuucuagaacuuugaaaugagcuagcugcuaacuguaaucuaccaaaagaaugaaaguucuagcaugaaggcugauucagguacagaagcaaaauuuuagaccauuucuugcuauuuuaaaaguaaaauccagauugucuacauauaaugaagaaauaggguaaaauguaaugauuccagagaauccaguuaucagacucgccauguuauaccuagaaaucaacagguagcuucucauguauucauguucuuccucuaaaauauucuuugaauguaugaauguguuuuucauaaaaaucuuuccuucaaauaacugcauuuauacauauuuauauguucaaguuauaaacauauaacugaaaaauaauguuugcuuuaaauuaagaauuccuaaggugccagaaaaaguuaagaucggcauacaaauuaauuuauaacuguuaaguugcccuugaagacaauuagcaaccugcugcagcucuugaaacugucuccaugguaacaaccaacugcagggcaguaggucccucuccauuuuauuuucaguugaccacuggauccacauacuuacggucagcaucacuuguuuccugcucacucugguccuuguucuuguagaaggggaauuuucgggaaaagagguucuuuuuacgcuugucauugaaugacugcugaagaagagaaggaggggcaaaacaaagggaugucuacugucuguguguacaaaggcccagccuagcagcucuguggaagcugacuccuaugaccacagugugcaguuuguauaugauuuuuacuuuaaucucauauaaagugaauuucuacuuuuguauaaauucuaacauuuugcaacugaaaauacuuaagaauuucagacagcauaguucauuuauaccuaaaaauaaaaaugcuacuugacaaaaaaaggcaaaucaguuacuacuacaguacaaaccaagcuaacauuuguuuauacuaauccauguuuuuccagaaaaauuuucaaguauuaagugcucuacagcaaaaguuauuuaauguuacuuugcugcucaauuacauuuuauucauuaucuucauuuuauuuuggccugaccacaguuauuccuuuaucucuuuuuuuguggcuacgaugagcuaacagaaaagucauuauuuaaaaaguaaaccaaaaugauuaugagaaaguugcuaaugcugaauauuuaaaaaacaaauauauauauauuuauauauacacauauacauauucuuggaagaggauaaaagguaacuaaaugcuuaugagccagaaaaugggaagaaaacuaaaagguccaucaagcacacagaguccagcaagagacuuaucaaugccaucucuuagccaagcaagaagagucagaagucuccugaccaacgugaaugcuucaguacugaagucuccugaccaacgugaaugcuaucaguacugacuuauuuauucuuaaguucuacucuacuuauuaaaaaaaaguacacauaaauaauguagaaccacauccaaucauuggcaccacguccuucauagggaauaaaaaguuugguguccaccaaagccacaaggcaauuaagauucuaacaguuuauacauaauuguaacguggaguugagcaguugauuugaugucucuuauugcacauguuggaaacaaguuuuuccuugaaugucucauuugugcauucauagauuuaagagcauguagcacaagaacgaugaggcuauuaaacagaaauagcuucuuuugucauuucucugucauaggcauucauguuuugaaggaaacgggcuuaccuaccagugacacuaagaauuauuauuuuuuggagggggaagggaaaaauauaaagaauagauuuuuuuguucugauuuuuaugaguuuauacacaucuuaagaugcuguauuauucauuauuuugaaguauauugacaagaacaguguguuuuuggcaugcccuuauuuuaagcaugugaugccagguaauuaaggugaagcagccaggugugguggcucacaucuguaaccccagcccuuugguaggcugaggcaggaggaucgcuugaggccaggaguucaaaaucagccuaggcaacauggcgaaaccccaucucaaaaaaaaaaaaaaaaaaauuagcugggagcaguggugugcgacuguagucucagcuacuugggaggcugaggcaggagaaucacuugaacccaggaguuugaggcugcaaugauuagcuaugaucauaccauugcauuccaaccugggugauagagugagaccuuuucuuuaaauuaaaaaaaaaaaaaagugaaguagauuaaagugacuuuuagcucaaauucuaugacuugagaagacuuauuuugauaaagaucuuuauaaaaacaagguuaaacuuucauuuuuaccuuuucauauaauuaauucaggauuaauaaguucacaguucauuagccaagcagacugucuugauuucaaucuuaaaguuugaaggcucugaggaacuagauaaaagagaacucuaaguagaaguuaaaaauucaauggacagaaaaaguauuauggagaaaucugggcuuauaacuauuuuauaaacugucaaguagcauuauuugaauaaaaaucuuuguucaaauccaaauuuuagaaaggagauagacgagaaaguguuuuagugaaaaaaauuaugguaaucuaauuuagggaaaaacuaaaucuuuucguucauaagaaucaaugguuuugaauuuagcaauaauuuuuauaucugauacaacugauguguuuuuuauaaaaguuuauucaucccucuuacugcaucuauaguggucagagucaguuucacagcaaacaaccaaaagaaacaugaaguuuaaaaugucugauucuuauuaucuuugcaguuagccaaaaugagauaucauaaagauaucauaauauaggacagagagaaaugcuuguuaguuaagaaaguauuaguuguaucacauuuaauauccuccaggugaagaacuuauuaaaagugaaaaaaauagcacaagcaaccaagacaaaaauguguagggaaaacacaaaacugaagacuugcuaccuccaguuucucuguauuuucaaucagaaguacuacauuuaauacuuacugucauuaaugcuauaucgcaagagagacaguguaagaauugauaaaauaucauaaauucaugauacauauauuaaauaucuaaauacauaauuuccacauguauuucaaaauagccaaaugaauguuagacauguuaaugagaaacuaaaauguuguaagucuguaguaaaaauaaaguccauaaucacuauguaaggaaaggaggagaaguaggaaaugguacuauagaaagaaaugcaguucugaucaauggcaagcguauuuucaccccacucaguaucaugcauaguuuuggugcuguguuagaacacagugacucuguauaaaguugguuacagucaacaaacaagacuaagauuuaaacacgucguuaauucaguuaacuucuuacaguaugaaaggaaaguuacaacaugcaaccucuuuuucaauuuauugaugguauauuguacuaaaucauuuuuaaagauauacauaaaacaagcauuaaaaaauucacauuuuucaaauccugagcauuuaccugggauuuuuccucuaauacaaauuucuauuuuaauauugcuucagaucacacuauauaauuuggaauuuuucugaaagcuacaauuuuaaaggaauuuaucauuucuaaaaaauggaauguaacacauaauuuucucagauuuaacuucuugaaccaaagauauuucucaucuuuuaaauuuuaaagcuuuaagucugagugcuuagugauaccagagauguacagaguaaauuuauuugcugaguuaacauuccacauucauuucaaauauuaucagaagacuuauaaaaauuuuguuuaguauuaaaaaaaaccccaaacauaaaacauugcuauaaaugguauuuaacauaacauguauucaguuuguucuccaggcuuacugcuagaauauuccacugcagugaguucaggauuauuaagaauuacauccaccaauacgggaugaagccuguaccaucuuucucaucuaucgacagcccaaguauuuagaugcaagcagaaggacuuaaagugaaggaaaaauaaauacacuucuaaaauauaugaugaaagaauugauauauuuccuuuuuuuuuuuuuuuuuuuuuuuuuuuuugagacagggucucacucugucacccaggcuggagagcaguggcaugaucauggcucacuacugccuggaccuccugggcuuaagcaauccuuucacuuuagccacuggagcagcugggacuacaggugcaagccaucacgccuggcuaauuuuuuaccuuuuuuuuuuuuuuuuuuuuuuuaagagauugggucucgcucuguugcccagucuggagcacagaggugcgaucugggcucaaugcaaccuccgccuaccagguucaagugauucuugugccucagccucccgaguagcugggauuacaaaugcccgccaccaugccuggcuaacuuuuauauuuuugguagagacgggguuucgccauguuggccaggccggucucuaacuccuaaccucaggugaucugccugacuuggccucccaaagugcugggauuacaggcgugagccaccaugcccggccuaguaacacaaauuucuaauuggaaaucgaaugaaggucaaauacauuucauuuauaaaaauaagcuugacccaaaaguauguugcuaauaauauaucaaaugauaguuuugauaauuuggaagggucugugaaaugggugcuugaauuuaacaaaugcuuaaguaucuaccauuguaaagcaccauggcaagaacugaucaugaauaauucugauagcaaaauccuuuucauuuuaacaauguagcucaaacaggaauuacaaaaauguagagauuucaaauacucaccccuuuaucucucguuuuagaauugaauuucacuguuuuuaaucgggcucguucuuucuucucaacucugucaaaguauagaauguuauuuuuuaaguaaaccaaacauaucuggggucuuacuagaaauaaccagaauuguuaucuuuauaaugggcauuuuuauacucuaaaaccuuuaagagucaucuagguuugcauccccaaauuagaauugcugaaaaaugaaauaaagggcucauuuuauuaugaaacaaaaccugaugcuaugaaguuaucaacacacaguauauauguguauauuuuuauauguauauuuaguuacaaaauuauaugaaaguaugaggcaccauuucugaguuuaacaguuuuccaaguuuuguuuguuuuuaaguauuagcuuagcaugaagcacauaugcuaaaaauuaagcuagagaaagcaaauguggcaaaauguuaaaaacuggugaaagugggagaaggauauguggacguucacuguauauugccguuuuuguacuuacuuuucuauagcucugaaacuuuuaacaaaaagguggaauauuuaaaaauuaagccuaauuuuaaugauauauguguguguguguguaaauauauaaauaaccaguuacaguuauugaaguaagaguuuuaaaguauuuuuggaaggauacauaagaacuguuaaucuuuaccccuauggaggugaaauggguguugugagagacagccuguaaagccuucacaucuuuuaaauucugaacuuuaccuacucaaaauaagcaagcaaauaaaacuacaaugaaacaaguuuuuauguagauuguaacacuaauguaaaucuugcaaaaugucauguaaauuaagcuuucauaaauucuccaauuucgacauagcaauuauguuagcauauaacagaaaagccuaccaaaacaagacuaugaauaaaugaauuuuauuuuuuccuuauuaucuauuuaguuuuacuauggguacagcaggaccuuagcauucaugaauuuaaauuuuaaauuuaagucuuggcgcaguggcucacgccuguaaucccagcacuuugggaggccgaggcggguggaucacaaggucaggaguucaagaccagucuggccaacauggugaaacccugucucuacuaaaaauauaaaaauuagcugggcgcaguggcgggugccuguaaucccagcuacuugggaggcugaggcaggagaaucgcuugaauccaggaaguggagguugcagugaaccaagaucaugccacugcacucuauccugggugaaagagcaagacuccgucccccaccccaaacaaaaaaaaaaauuaaaacucaugauuuuuacgauucaagaacaauucugaggcuccaugaccugaauaauuuauaaucuugccuagguacuuaucaacagcaccacaaaacuagcauuuagugggugagcauuuacaacucaacuuuguuuucuaaucauuauuuuguuuaguacauaauucagcaacuuaaauugucuauauuuguaaauauuauuccugaaagccaagaauuguaggaauuacaauuccuauguuauuuuagaagaggucuaagaaagagauaguucuauuuaagaaaagguaaguuuugaauacauucaagaacgaaauggcauaauuaguugugguuucuuacuguauuuuacgggaguaagauuauauucugcaaugcuacucaugaauguggaaauuggcagaggucucaagauaucuuucuuacauuauugcuugcuuuaaaacacaaucuuauagaauuuuuguacaaaaugaaaaaaaaaucucuccagugaagccaacaguguuuauuauuggguguaggcacagaaagccuuuguaagguaugagacuccaagaaccaagacaauuuuuaggagcucugaccuugauauuuaagauguaagguuucuacugacucaacaaggcauagaggaagcauuuccgaauuuaaagcagacuauguucuauuucuggaaaaaaguuaugcugauugcugcauugcuaaaagaggauuugucaucaacugaaagaucuagccaaauaguuggaucaugcuaaauauauggauacagccaacagcaguuauaagcccgaaaaucauaauuauaaaucuugauuauaauuuaauaauauuacuuuucaacuucuacaaacagguaaauaaauaaaggucuagaaauaguuacgaaauagguauaaauucaacuaauaagaaaaagauguuuauuacagcauaaucgacuuaaaaugaauuaacuaguuauaauaaacauuucuuuaugaucucauuaacuauuuuugcuggcuaucuuacuacuacuacuuuaaaaagcucuuaaagaagaacuuccagacaaugauuuggaugaagcagaucucauaaauaagcuaucucaggggaauucugaaaugacauuuuaacaccuuccccacaaaagcagagacacucaacagcacuucacaggccuuagaagagguccucuaagcugggaccauccuuugcaaagagggccuguccuuaacuacuuuugcuaugugcuaaguauacacccaugaaucacuaaaaugaaucauuagggcuggcugcaguggcucacagcugucaucccagagcugugggaggcuggggugagaaaaucgcuugaagccaagaguuuaagacuugccugggcaacauagcuagaacccaucuccacaaacaaaaacaaaaacaaaaacaaaaacaaaaaacuuagccgggugcagugacacgcgccuggagucccagcuacuagcugagguggggggauagcuugagcccaggagucugagguucagugggcuaugaucaugucacugcacuccagcgugggcgacagagcaagaccuugucucuuaaaaaaaucaaucuaccuaccuaccuaucuaccuauauauaaucauuaaaagcaaagagaaaagaccagugaacugcaccaauacauguaauuuaagcaaggaaaaagagaagugaagcguauuaccagauauuuccaaacauuuuggcaugaaggaagaaauucaugccaccaaaaauacaaaauuuaaguccucuuacuuaccuacaccaaccacagacacuuucaguuuucucuucacugguauagcuaaauggcacacugauuuaauauauacuuacuuuguuuucaguaacuaguagcuuuagaucaauuucugcuuggaggcaucacuuuuuguuguuuuuuuuuuuuugagucagagucuugcucugucgccgaggcuggagugcaguggugcaauuucagcucacugcaaccuccaccuccuggguucaagcaauucuccugccucagccucccaaguagcugcgauuacaggcgcccgccaccacacccagcuaauguuuguauuuuuaguagagacgggguuucaccauacuggccaggcuggucucaaacuccugaccucgugauccgcccaccucggccuccuaaagugcugggauuacaggugugagccacugcaccuggcccauauuuucuaguuaugucacugguuacaauuccauuugaauaaaaucaaauggcugugaaacacaauauaaaaaacugagcauaaaaucauuuuaguaaaauaaauuuauuuuuucaguucuggugauuauuuuuaauuuuuuuauguguauauuuuauauauauagauagauauagauauagauauagauauuuagacagaguuuugcucugucucccaggcuggagugcaguggugcaaacucaggucacugcaauuucggccuccugaguucaagcaauucuccugccuaagccucccgagcagcugggacuacaggcgugugccuccaugcccagguaauuuuuguauuuuuaguagagacaggcuuucaccacguuggccaggcucgucuugaacuccugaccucaagugauccacccgccucagccucccaaaagugcugggauuacaggaaugagccaccgugcccagccuaauuguauauauuuaaguuguacaacuuaaugauuuuauauauauauauuauauauauacauacugugaaauaauuacuacagucaaccuaauuaacauauccauuaccucaccugguugccuuuuuuugggggguaagaacacuuaggaccgacccucuuaacaaauuucaaguacaguacuauuaccuguaguugccaugcuuacauguuggaggugcagaacucacucaucuugugucacggaaacuuuguaucucauuuccccauccuccuaaccccugguaaccaccauucuucucuguaugacuucgacuacuuuagauuucacauaaaaaugugaucauacgauuuuugucuuucugugucuggcuuuuuucaauuagaauaaugcacuccagguccauccauguugucacaaauuaaaaaaaauuuaaaagaacaucaauuauuuauguugccucacauucaagugguaagaaacaggcauaccugcguuuacugggaaucacuccgaccucaucgcucucaccaucugguguaaccugccuggcuugccaccauucaucaucagaagcauuaauaacauggaggauaucuccaaauuugaaguucagucccugacugggaagcccacugucuuuagucuugucauaaucaaaaagggcucuagagucagaagaaaaaaaguccauaaucacuuguuauaauauuaaucaacauaucauaggguucugaaaguauauguaauuuggguaauuaaauauaucauaguaggccaaauaaugcccaguucaauucugcacugcauacaagauaagacaaaaaagaaauagcaaaaucaacuugcuaugaaaauacuguauuguauuauuuguuucuuucaauaucacaagacaaauuuuaaaaacgcucuuggauuguaauccaaugguaaguuauauugaauucuaaaauagacaaauccagagaguuugaaauuaauaaacaaaaaguauuaagauacauucuucucuuuacuuugauuagauacauguaggaaaacaaauucccugauauauuugauuuauuaguuguggacuguacgacuagaucaacauagugacuauucuguccauuaauuauuccuuccauuuguucacaauacuagaguugauagaguuuucagagucaguaacaaugauggacacuaauuacagaugacuuuaacagcugccaaauauuuuggagaaaguaauaauuuaauacgguaauugcaaaguguuaagaauauuuuaaaauuugauaaaaagaaaauauugugugcuaccacuugauuaauuaauguacaacauuaaaauaaaucaaauucuuaaguccaaauaagcucucucaagaguguaagaaaggaucacagcaauuacauuuauaauauaauuuauucauucuuuuguucuaauuuggcaacuggaaauuaggaugaaaaucguaaucuuuuucacacuacccaacauuuaagaaccuagcucuucaaguaaaacucaagagggguggaauuacuugauggcuaaauaaauaaacuaguaguuaaugguuuuucaaaugaguucuuucaagucuuuucguggggcuaaaggugcuagggaagcaggggggaucguuaagcaggagggcucacuuaaacauacauucaaacauagagaagaugagggcacaaauaagcauaauauaaaauagaaaauaaaguaccuuaagagguaguacaaaugucaagacauucagaaaaggaaaauacuaacuucuuacauuauuauaaaaauucaucuuuugaaucacaaaauguaacaguauuauugaacaacaaaggaaaucacccacaaucucuacuuacguuagcauuuuaacauucucuuuuaauauauuugauucauaaaaaaagaaacccauggaauacaugugaguuauuaaucguaagagugcaaugaacaucuguucaccuacuacccaacccaagacuacacacaaaaccuucaucaguaauucacauucaccugcguauauucccucugauccugauucccuuggaucaagaguuaaccacuauuagaauguaacuaucauucuuaauguuuauuucuuugacucauucuuuuuugguugguuugguuuuaucauauaauaugugagugacuaaaagauauaauguauguuuuugcuuguuucagagcuuuauaaagagguauucuguagguaguuuuuugcagccuuuuuuuuuuuuggcuuuugaaauuagaaauacauugacuaaaaaaaaccccacaagacucagguguggugguggugguggugugugccuguagucccagcuacuugggauguuaaggugugaggaucccuugagcccaggaguccaagacaagcuuagccaacagggcaagaccccaucucaaaaagaaccaugaggcuucugauuaacuauagcacacugugucuauuucuucuccacccugacucauuaaaaugacaauaaaauacgaaaaauacaaaagagagaagacaacaggggaagagagauuuuaacacauuucuggaugaugcuaauuaaauuuagcagaaugaaagaagcuauaaauggaguggcagcagagaggguuauagaaacaaguuuuauuccauaagaauccuggagauggucauaaauuagaaguguacaguaguaccaagguaggcagggauaaguuacuguacuaaaaacagaagguagaaacacuguauguagcacuuagaccaaccccaccaaaguuccuuuucccaguccccaaacccacagaagaccagugguuuagucuccagagaaauugaauuugaggagcuguauacucugaaacuugguggagaaggggaaggugguuggacugaaauggaugaaaauaaaauucuagcaacuugguuuauacuauuggcaggagacagggauucuucucuaaggauauuuaauuauagaaaagaacagaaugacgugggacaggagagaaaauuuaagagccaauuuaucccccccuuuaccccacugucuucuaguuaaauccauuaucuucauuucucuauuccuaagaguggaaaacaaugaaaggaacacuggauauuuaaagaaugccuuauauaaaacacuaaagaaaaaaccuccaagaaaauaggauagcuagaaaaaaggaauacagagaaagcaaagaauacaaaaaagcagaagaaaaucucagagacacaccagaucauguccacaaaagaaauggaagaugagggagcuccugcaaaauaaaacaggguaucauucccucccccacauuccaaauucucuacuggggagaaggcaaaacaaagucauuucagacaugcuaagccucaaagggugccucccacacaccuuuucgcaggaauuuacuggaggaugugcucuaggaagauuaauugagaaagaagaaaauguggcaucuaggaaacaugugacauaguagacagccaaaggaaauagaauaauggcaaaagggaagucccagcugagagcuauacagcacguuuacagaggaacuagucuagacuggagcauaaagauagaaaaaaccugaacuaucagaccguaugugugaccauauguuuucaucaugugaaaaacucuacagugguuacuggaagauacagaaagauauuuaguaguaagaauaugaaaaaucaaauaaaaugcaagacaauuauuaaguccaggaaaaaugaagggcugcagaagaaaggaggcagcucauaggguaccacucgacugagucaugacagcuauugcauagucacaugacuguaaaugcuauuaguuuuauuaacagagauaggcuauguuugggugauggugaugagacugaaugagugguuugguucuacacagaaacguucucaucuaccaugguuguaagacuaaugcgcaaaacugguaaaguagaagauagcaguauaugcauguuauuuagaaauauagaggcgaaggcuucauauuuagaaauaaggaggugaaggaaguuugcuaggaaaauggaggaugcuuguuucuggagaaugaaacuaggggcuggugccggugacaguuguuuuucauuauaagucuuuagauaauauaugguuuuaaaaaauagaagcugggcacaguggcucaugccuguaaugccagcacuugggaggccaaggugggugaggcccaugaagucaggagaucgagaccagccuggcaaacauggugaaaccccaucucuacuaaaaacacaaaaauuagccaggcaugguggcaugugccuacagucccagcuacuuggggggcugaggcggaaggaucccuugaacccgggagguugaggcuacagugagcugagaucgcgccacugcacuucagccugggugacaaagugagacccugucuuuaaaaaaaaaaaaaaaacagaaagaaaauagagcauuacuucucuaaaaauaacaagugaagauucacuaaauguaccgaaaauaaauauaaccuauuauguucugauuuuuaugccuuuguaaauauuuaaucaaguacaaauaaaaggcaacaccuauuaauuauacuaaaauuaggaaauguagauaagcaaaaaaaaagaaaguguaaaaaagagaguagaaaaauccauguucuuccuucuucgauauauuuguauauauaaaauacuuuuaaugacuuuggaacacaagaguuuaaugaguacugcuagaauuggcgaagggaaaaaaaaaucugaugcauuuaagauucccacaucacugguaggguuauaaguaccaaguacagcaaaagacaaaaggaacagaaagaagaaagugagaaagguuugcuuucaugauguaucagaguaagauuaugugaagacaguaagucauaucauauguaaacaaguacagaguaccuguuuguguguauagauacacguguauaggauacauguuuauauauguaacauaucucucucaucagaaggauaaaugaaacguauuaggaacaggucccccaacagaaucaggacgacugagaugauaauuuauaaagaaugguucagauuacuuacagugcuaauguuacaguaacaguauaauaaaguuaucaguuaaaguucuacuaaaaguauacagaauacaaauacauucggauuucuguuuuaagucuuauaagccaacgaaaugaaaaaaaaaaaaagaaacaccccaguuuauauacuaauaucaccuauuuauuagaccuauguugccacuuaaccuuuauauauuauaggaaaauaacauauuugccuucucccaaguguuuaaaaaaugcauguagaaauuuuccaaauaugcauuauuuaccgaggcuauucacauuuuaaauuauuauuuacauaugccuccuuugcuacuauggaaauugccagguaauuaaauguuacuugaauggaaaauauauuagaaaaggacagagguuaaaucuaaguguuagacaugauaucaucaagcuuguagucacuacuaacacaucaaucugaaaacaauuucugguccacagaaauuucuuccuuuauuauaucaucauuauucaaggauuacauaacuuucauuaauaaaauuauuaauacaauaauauuccaauucuugaaaggcacacugucagagagaaucaauaauaaaaaacaacacugauuggcaauauauuuucuuacgguaaaacuaaguaaguuauagugaaaaauacaaaauaauuuacaugcauaacuaauuaagauuugccauaauuagaaguaaaaaaauuuaccugacauagagggaucgcuucuggcuaguucgaagagaaccugacccugaacuaauacuacuauucaucaucugcucccguaaaucauguauuuuagcuucaaaacgacuguauucugauggaagaaaaagagaaauaaauugauauauuuucaaaaaauaaguuauuugaagauaacguauuaaauauguaaacuguccuauaauugauuaaaugugguuagaaccuuaaaauaguaauaugcgaaagauuuugcccaacacauaaauuucaaaaaaaaauuauuaauaaccuaaauguaccauaaauuagaauuggcugaguuagaauuuuucuacaugcucuuuuaaaguuuauaccacauuuagucaauuaaaugacaauuuccaugcaucagacagcaguaaucuuauauuacuguugaauuuaaguguaaauuuuaaaaaucaggauuuauucuaauuuuuauauuaaggaagaaaccuauaauaauaauuaauacacuagaugcuuugauuauugacuuuuuccccuugagacaaucaguucauuuuacauacuucaauauggaacuugugcagggucaacauuaaagggaaaaauaugccuuaaacaagugauaaacaaaauuuauuuuaacugauuuuauaauuuauaaauuaucaaaauucaagacacaaaagcaaucugaaguaauauuugugaauauuuuuauuuaaaauauuuuuuauacaaaaauaugauuuugaaaauggacaauuuaaagcuacauauuaaaaacuacuaaaucuauuaaugacaaaaguuuaagcaccuuuucaaaaauauugcaguuacaugguuauaaacacauaucuuuuuuccccucuauuuauaacaaauugcagacaacuaggucauuucaaaucugaguuucuuauaaagccugucuuacagcaaauaacuucucugggauuuuguguagguuaagaugacagaguaagaguaagcaugauuauuguugaguuacucuuucuuucaccauaaucaucaacuuuguuuuacggauaauaagcucaacugaagcaacaauucaucaaaaagcuuagaaacauuuaaaauuccacauuaauaauaaaauauuuuacuauccuuucaaaauuacaacaaaacacuuaaaauaaaaacauaaauagccuuaauaguagaauguauccaucauaauuaaauaaauaucaauccauggcaaguugucuuugguauguguagaaacagcuaaacuauagacugaugaauggagaucauaaaaauauaucaugaguuuauacugguuuuucuaaugaaaaauuaggaccacuggguuuuuacuuaagcucuccuauuuuagcguuguaucugcuuucuuggauaugaguaauucugguucucaagauaguggagauagcagaauaaaaguaccggcauaaugacuuacuuguuuuauccaauauuacaacagugaauuagaccaccaacacuacuaccaugauaugauuacuguaaacaguuaacuauuuccuguagcuuuuaauccuuaggcuauagcuagagauguaugguugaauuauuguuuucuuuuuuuauuuuuagagacaggguccugcccuguugcccaggcuggacuacaguggcacaagcauaguucacugcaggcuugagcuccugggcucaagcaauccugccucagccuuccgaguaggugagaccaucgugugcaccaacaugcuuggcuaauuuuuaaaaaauuauuuuugguagagauggcaucuugcuguguugcccaggcuguucuugaacuccuggccucaagcaguccucucgcuuuggccucucacagcucugggaucacaagugugagccacuguaccuggccaauuaccauuuuaaaaucacuuggaauaguuccuuccugaguauuacuguugccaaguggauacacauuuagauucauuuguacuuuauuuucaacuucaauuugccuuuaaaauuuuucauugauuuuauaaguagguaaaauaacuccacagucaaaucuauaaaacacagguauuuaaaaguccagcuucuaucccuuuuucucauccuauucuguccugauccuuauaugucaacauuuaaacaauauaaagauacccacaaacacgcaaauacauuuacauuuauuccauauuuuuauaucuguauauauguguguauauauacacacaaacaucacaagcauaauacauuucuuuucuuuuuguuuuuucagacggaguuucacucugucaccaggcuggagugcaguggcgcgaucuuggcucacugcaaccuccgccuucuggcuucaagcgauucuccugcuucagccucccaaggagcugggacuauagacaugcgcuaacaugcccagcuaauuuuugcauuuuuaauagagacgggguuucaccauguuggccaggauggucucaaucucuugaccucguaauccgccugccucggccucccaaagugcugggauuacccacugugcccagccaacauuucucuucuuucuuaaacaguagaauacacauuucccugcuuugcuuuuuucacuuaauaguaaguauauccagaagaucacugcacaauauagaaagaugucauccacgcuuuuuuuuuuuuuuacagcaauaugcaguccuuuauuuuuaaccuuuacuucuuugugguagguaugacucuuauguacugcacaggguuaaauucugcuucauuagcaagccugaaaauugucugcuuuuaugaauuaacuuuugauauaacugaaauuguucucaguucuguucuuaccauccugucuuauuuauucaagcuuuuaacauaaauaaaccaguggcagauuauauuuuccaaagaugccugcaucccacaugcucuuguacacugugaccuugcaauuuccccaucgacagguggaaucuaauuccccucuccuggaaucugggcuagugcuuugggucauuuguaugccaaaaaaugugaaaguaaucccguaugacuuucaaggucagauuagaagaggccaugaagcuuuugccugguucuucuguaaugcuuguucaguggaagccagauaccauguaacaagacuguucuaaaaccaccauacugcagaggucacaugauggugcucugagcccaaacuucuagccaguaccaccaacacauaagacaaggagagcaaagccaaacugggcccuccaaagcagcucauuugccaccuaagucccacuaagugaccucaguugaugccagaaggaaaacaagaaccaucuggccagaauccugccugaauuccuaaccuacaaaaccuauuaaaaggcuguuuuaaccuauuaagcuugggguaguaucucaugaagcaacaguaacuggagcacagucucacuauaugguuuguucuuuuaaguguguguguaacaauucagacacgcuuguccuuuuguucuaauggcaaacuuuuguuuggcuuuugucuuuuggucuccuccuacaagcaaucuucccagauuggauuggaaauacuauccuuuuauauccaguuaaaaacuuuaaagcaauuaggaggcuuauucuguuuucauauuauccucaaauucuguccccauuuucuaauaauuguaccuuaucaaaauugucagagcauauagcuuuuucauguuauauacucucuuccuuauaaucuucuucauuaaugcuaacaccaguccuuaugucaguaucucuccuccuaucauuuuggaugucugcagguuguucucucaccccaggaaguguuuauacgaacacuaucacucuauuuguugauauauuugauuccaguuuuuauaugugaaagucuguuugauucagcuucuuccuuuauugaguauguucacuccauugucuucuauaaacugagaacaacggaauuuucuuucuuuuucugcugggggagggaaguggaauuccagauauuuuuuuccuuuaaauccuaaucauuuuauuauggcauuuugaaguguaguuugaaauaacuuuuuuaauuuuagaaaagauuucuugucuaugcauuuucuagcauuguuuuggauuucuuccuaggagacuccuauuacaugcauguugaauauucuuuaccuaccuucuauaccugucacuuucaaaucuuuuguuucuucuuacuaauuuuuuuuaaagacuagagcaaucacaaacuguuuuuccugaaccauuugacagcaauuugccuucuugaugucucaucaucccugaauacuucaguguguauuuccuacagauauuuuccuauauaacuacaaaaccaucaaaaguaacauuaauacauuacuaccaucuaaugcucggaucccuaugaagagucaccaguaauguucuuuacagcaaaaggauccauuucaaagucauuuguugcauuuaguugucacgucuuuuuagaucuuugagucacagcaguuucucgguguuuccuugacuuugugaccuuaauacuguuggagauuacaagucaauuguuuuguagaaucucucucaauuuggguuugccugaaguucccacacaauuagauugaaguuauccaacuuuggcaggaauaucacaaauguuauguucuacccaauacaucuguaucaggugguacacaauuuugauuugucccaucaccaauguuauuaacuuuaaucgcuugauaaaaguugugucugccagguuucucuacuguaaaguuacuuuucccuuuugcaaauaaauuacugaaacuguguacaauucuccauucucaucaaacuuucaauuaauucauuuauuuauaugaguaaaaacucauuauuuccuacuuuauucaguggguuauaaucugccauuauuaucaccaacugaaugcugagauugcuccugauuuggccagugagagucccuugaaguuagauucuggguccauuugacaugucuccaacauuccuugaguacuugcuuguuuucuggcaaaggauauuauagaacaaucuagcauuuucuuugccugacuccuggggaaccugccguuugucaaaaaagccuuaguaauuucagugggaaauaauauuugcaaggcaagaucuggaugcuaggugcucacugcucuugggguggcacuaggcucaggcccucucagugggcagagccagggaaaauaacauacacacagauacauacacacugacguagauauuuauguuuacaucuguaucaauggaaaaccaucccuucaaaccaacuucuucaguucuaauccaguauuacaggauucauguuuaaguuuucuucccuuccauauuuguaacucucuucucaacagugaaaauuaugaauaacaauaaccuaacauauauauuaauuuggucaaucugaauuugaacagccauccacuucccugacugggcucugagcauucccauaugugcuuuccucaccagcccucaggcucugacuccugaaaccaaggcauuacccugcauggaagccaaccucauggguaaguccaaugggccaccgaaaaucuccuaaaccucuccagaugugagguguagauuaaacuauuuuucucuccucuacauaauggcuuuaggacuaaauugaucaaguuguagaaagagaaggucuauuuuugcuuuacaaauuuuucuucuuuuucaccuucuugguuuaaggaaguaugucucuuuuagucaaauuuaguuuuuaaaacaauguuuuuauuucuacuaauuuucugaguucuaucaacuuauugauguuguucuucgacauacucuaucauuuuucuuuguuucaaaauauuaauuuuauuuuacacuagcuucauaaacuauaugucuuucugguacagcuugacuguggagacauuacgcuaauccuuauuuucacuuuucaaauagguuuccauggauuugacugugaucuuuuccuacugcucauuuuaauaugaaauuaguuuuccccaacuuuuacauaggaguuacgagucaagauagguuuucuaacuucacagcucuagaacucucuauuuuguuguuucucucaaguguuuaaagacaugaccucagacacugugagauuuccugaaacuuuacuuacccccauuaaucugaaccuucuauuuccuuuggcucuauuaucccuauccuacucaauuuggauuuuauucccagcaguucuuccuuaguguggggcuuuaaauggaaagggaacuacagcugguuaacugugucauagggcccagacugcucguggccccuucauaucuuaguguagauuccuugcacucaacaugcagauuguacaaaaacucuuauaguucacuugguguucucaaauuuaccuacugcauuuucuugugaggacugguuaacauugggcuucuccuguugcauccccuugcacagaugcugauaucagauggucuuguagcuguuaauaccuuguuuacaucagcuuauauuugggguucauaggauaucuuucaucuuuuugucuaguuuuauuguagauuuuuaacaaauuuugguuuggcuuuccuaauuuuuuugagggagaggaggaguuuugggcgauucaguuuuaaaucuacuaucuuuuuuuguacuuucuuuuuuuuuuuuuuuuuugagagagagucucgcucugucauccaggcuggagugcaguggcgcgaucucggcucacugcaaccucugccuccuggguucaagugauucuccugccucagccuccugaguagcugggauuacaggcgugcaccaccacgcccagcuaauuuuuguauuuuuaguagagacagggguuucaccguguugaccaggcuggucucaaacuccugaccuugugagucgcccaccucagccucccaaagugcuggaauuauaggcgugagccaccgcgcccaacccucuuuuuguauuuucuguuagucucacugguuuauguuucuauuauuuuacuuccuagaaaacaacuaggaagugaugacuuuucaauauuaccuuuguuuuuaauuuuacuauuuuaaauauaauuuauuuguauuucuguauaauuuuauuuuuaauaaaggcuauguuuuaguuugaaaaauaucugaaaauuuaacuggcucucccaagcccguacgcuguugcucuugaaacaaaagagacuucucugcuuccuuagcccugaguuccgaguuccuaguuucccuucauguuuuguuugcuaauuccuuaaaaguucugcaaugcuuuuuaaauaagauguguauuacauuucauguagcauuauuaguuuuuagcaauuuugcugaucugauuaauagaaguccuagugauuuaagauagucuacauuuuagaaauuuaaaagcuuucuguguaaaaagaacacauuacuuuuuagugaugcagaaaaauauucuuucuuaaugaguaacuaaguuacuacaaagcaguuaacauagucucagauauuaaaaauuuaagauacugaagagcuaagucaauuccugauaauuucuuaaauuugugaucuauuucuuucacuguauucagaucuucauauuuauagucuuugcuuagagucuucccacccgcccccaccucgcucuguugcucaggccggagugcaguggugcaauuccggcucaucgcagcuucugccuccuggguucaagugauucuugugccucagccuccucaguagcugaaauuacagguauguaccaccaugccuguuuaauuuuuauguuaguagagacagaguuucaucaaguuggccaggcuggucuugaacuccugcuuucaagggauuugccugcuuuggccucccaaagugcugggauuacaggcgugagccauugcgccuggccaagucuuugccuuacucuuaacaauuccucacagcuaccuuucuauauguucaaaacauacuucggcauuuuaaaguuacuuuuccuuuaaaccuucuauuucauuuaccuacuuaagauuccuaccuuuuccuuuuguuucaaucaauugauacuuuuaguccuaucagucuccacauuuuaccuauccuguguauauuuucguaaauacucccaccaacauauuuuuguuuuguuuuuaagguuuuuuuggagacaggcucuugcucugucauccaggcuggagugcaguggcacgaucauggcucauaguagcucugaccuccugggcucaagcaaucuuccuaccuuagccucucaaguagcugagccuacaggcaugcaucacuaugcccagcucauuuuuaaaauuacuugcagcgacaggguguccuauguuacccaggggaucuucaacucuuaggcucaagugauccucuugucucagccucccgaagugcuaaccacuacaccuauuuucuuaaauuuuuauuuugacggaagaguuucaucccuuuuuucaguuaagucauuuacacuccucuccuagaauuacaucaaaacucagcaaagcuauaauuuuacauaagagauuuucuccauucaacaucucaaaaauuccuguaucaaaccauauuucuugucaugaaacguauuaggacguaucugaacugcuggcuacaaguuaguauguauacgcuuauacaaggagagauauuuaaaagcugauuuuuucauuugauauccccuuucaaauuuuaaccuuuguuuucaccgccacacuagaaguaaaaagugaggaagggguaugggggaaauuggacuuccucaaucucuucuuaacaugcaaucccuauaaagaaaaacauucauuuauaacuguaauaaaauacauuaaacacagauauuaaacccaagagaaacaauucucagaggauggauacuauuaauuggccuaaagaaaaagggaaacuauuuuuaagaaggccaguuaguuguuuuaaguacaauagcucucuggcauacucggaggauuaguuccagaaccccacguauaccaaaacccgugcauguucaagucuaacaggaggccuuguggaaucugacaggcauauggcauuuucuaucccaguuugguugaacagcacgugcguaaguggacacucgcaguucaaaccuguguuguucaagggucaacugcagcacaggcgcguagaaaaauacagcaagggaagugggaaagcaggagacugaaaaaaauuuuaauuaccuaucuacuacugaaaaugauaagaaaugacaaaugucugcaaauaaaugccacuaguccacugcaaucuucccagauuaucuccaccucuucucccuuugguugguauaagaaguaauaaugaaaauaaagucaggacacuggguguuagaaaucuaccuuuguaacucaagauuucaaucaaagcuuugaagcgcagaaaaguuaagugacuauggccuaaccucucuagacucuggucacuugcaaaauagggauuaugccaccaaacaguuuuuuucuugcgaaaauaaaauaugucacaaauauaagaccuaaccaaugggaaagagaaaauaaauuuaacuuauauauugaguuucuuuccaauuuauuucuuuuaugguauuauuacaauauaauuaaugcuuucugaacaaaagauugagauauaagcucugaaaguuggccuaauacucuugaggaacaauaagauuaaauauuugaggugagagauuccaagaguuuaaugaguaguugaaagaguaagaacaggguauggagacccacccagaaccccagaguugccacaaagauuuuaagcugaagauaucugagauucaacagaugcaggaaaaaagccuucucggaguuucucuaaucugacuaaaaggugcagcuuccgagaaaugaaguuaccauaaauacccucugaggagucugauggccccgaagaauggaaagaccagucauaccaguuuagacaaaugucaucacaaacuuuaucccccaucucuucuccuaaaaacuugucuuuccugaagaaauguacguuuuucuaauaaaagcuguuucucccuccuuccuuucccuacuagauuagguguacaagcuuuuaacuucauccacaagcuagcuucaguauuucuucuguugccucuugcauccauauacaagaaacuuuuuuuccauguuaaucuguuuuuuuugucaguuuacuucacaggcccguuacugaacauacaaggguggaggaaaagguuuuucuucgcuuaaaaggggcuagaagaaaucuuaaccguuuaacaguuguguaacuagcaaauuacuuggucucuuuauggaagagcuuauucaacuacaacguaaaacggggauaacggugcuuacuuacaggauuaucuugggaguuaaaagagugaauaaacauaacaugguucguaucaugcauggcguacaguuuuacuauuauauacuaucacaggagauucuuuuuuuuuuuuugagacagagucucgcucugucgcccaggcuggagugcaguggcgugaucucggcucacugcaagcucggccucccggguucacgccauucuccugccucagccucgcgagcagcugggacuacaggugcccgccaccacgccuggcuaauuuugguuuuguauuuuuaguagagacgggguuucaccguguuagccagaauggucucuaucuccugaccucgugaucugcccgccuaggccucccaaaaugcugggauuacaggcgugagccaccgcgccuggccaagagauucuuaaacuauaggaaguaugugauaaaacuuuauaacuuugggauauggaguccaaaacgaguauaguauuauauuuccaguucccauguucgauuauuuuuauuuuuauuuugagacggggucucacucugucgcccaggcucaagugcaguggugagaucauagcaauccugccuuggcugggacuacgggugcgcacuaccacgcauggcuaauuaaaaaacuuuaaaaaaaguuuuagcagagacaagaucuugcuauguugcccaggcuggucucgaacuccugggcucaaguaauccucccaccuaggccuuccaaagugcugggauuagaggccugagccaccacguccagcuaauuucugauaaugauucuccaaaaagauuaacaguaaaggccccccaaagugaauuauuccuugccuuuggaauuaauaaaacugaaaggaguuagaagauaauguuccuucauaugucuuguagagauuauuuuuucucauaaucagaauccaagucaagaaaguucaaaguacacaagcugaaaaacccauaaaaguacuuuuuuggaagacuaauaaggcaaaccauagauccugaaagauaaaaaacuuaauucuaccaaaagcuuaccuuugucucuaucugucugucuuguauguauauauauaagauuaucaacaaggcagagaaucccaagccuuuaggaaagauacuaacugcaagaugcugauuaucagagugucggaugacuccuuuuguacuucuuaaaauccgauuuguguuaauguuuuuguguugugugugcguguagcuaaccuguuacuaagcuuugaugcuuuuccccaccucuuauuaucuuuguaugaaugugaggcuacuuuuaaauuacuuauuacuggggcugggggcuguggcucacgccuguaaucccagcacuuugggaggccgaggcaggcagaucaccugaggucaggagaccagucuggccaacauggugaaaccccgucgcuauuaaaaauacaaaaauaagccgggcgugguggcaggugccuguaaucccaccuacuugggaggcuugaaccugggaggcggagguuacagugagccgagauugugccacugcacuccagccugggcaagagagugaaacuccaucuuaaaacaaacaaaaaaaauuacuuauuacuuugcuagauuuugcuagaguagcuauuccagaaagucgaggggugcaggaaagauagaggcacaggacauuuuuacagguuuuaaaacccaaauacugucacauuaucugauccuacagaggcaggcugcuuuauccaaauacggguccucugcuuuucuaaaccaaaccacauuaugagugaaauuuuauaccauauccuaaauuugugccaucacaaacauucucaacauuccauauuuuaacucuuccccucuuuccguguggcuucugcaagaccucagcugcuuaaggagucuuuaccucuacuugguuguccagguaucauaccugccuucuuaguuuuaguuaauauuaagugaaguuguguggguaggagcaugcguguauguuuuguuuuucuuacugcuuuuguguguucuguguguuuugagguuagggagcagauauuaaguuacccguaaccauaccuaaaaaguuuauauuccuuauaaacauauaaaugagaggcugucuauaauacuaaggaaccagugacuguaacucggcuuccauauaguguaccuacgggguggaauauguuggccagaagauaaaaguacaacauagggucccauuggcagauuuguuucucacaaaaauuaacgaauugacauucugacuucauacguuagucucuauuguuugguuaaugugaauuaauauucagaauuuacucccaauuaaacaaauuuuccccuguuuaguuacuaagccuaaaaggccaagguuuuacuagauugauagaaccucccauacuuaagaaagaccaagcaaugcucaacaugcugcuuugaucagcuaaaaaacauacuagauuaaaaaagaaauucugcuucaaaaaagaauaaauguaauuaguugauaaauuacagaauuacucauuuagcuccuuuacucacaucaucuuuuccuuauucaucauguuguuuaugagcaucaacaaauaugcuauguauucuuuuggguauuuaagcuuucuaaauuccacugagguuuuauuggagaugugguuaugcugauguacacuagagucuuacauauguuuacuauggcaugaccucaaauucuccaucaccaccuucuucccccaggaacuuaguaaagucacauccaccauacuucaccaucuagacacacaguauacuccaaacuuggcauucuucucuuuauuuuaaauagcggcaguaacagcuauuagaaacaugucuuaaaucuugauauuaauaauuauaaccuaauucaaaagcuagaaaaaaucugggugaccuaauuuuuuugggcauuauuacuauaucugcuuaugguuuuuauuauuuuuucagaucaauaaaguaguaaaagggacauuaaaagcuaugucuucaguuacagaacagauuuaaaaaaguaaacaguuaaauuaacccacauaauggggguuuuguggguuaagcuuguggaugccaguucccacaucauuaaaaaauacuuuuggcagggugcaguggcucacaccgguaaucacagcacuuugggaggcugaggugggcggaucgccugaggucaggaguuugagaccagccugaccaacauggagaaacucuaucucuacuaaaaauacaaaaaauuagccgguaugguggugcaugccuguaaucccaguuacuugggaggcugaggcaggagaaucacuugaaccugggaggcagagguugcggugagcugaguucgcaccacugcacuccagccugggcaguaagaguggaaccccgucucaacaaacaaaaaacaaaaaccaaaaaaaaccaaaaaaacaaacaacuuuugaucuggaaaaagaacuagguucagacuaaacaaauacuggauuagcaaaucagaaaaaaagcacaaaaaaggaaguuuagcuuggaaguuaaacauuauuaaauauuaaagaggaagaauuuuaaaaacuaaaauaagcaauaacuauagacaauaagaauguuauuaccuucaggucgauauugugcaacaauugugacagccuggccagcauuuuucaaugcagcugcugccugcucaugacuagcagcucugaggucaacacuguuuaccuguaaaucaaaccaaaucuuaauuugggagaaaagaaucacugugauuagaaaucacaauagucuauucuuugaguaagcauguauuaaaaaauuaguugcaauaacuuuaccacuaaaauguuucuuguucugauugacuaaaaauauauuguguaguaaaacaaaauauuaucauucaaagcuauuuuauuuacuaaaaccaccuugcuuaaugucaaguuaguaaaaccaaaacauuuuccccuagaaggcuggguaucaauccauugagaaauguaccuuaauuugagaaccugaaaaaucaaguggcaucauuuugcacacuuuauuuugcuaggaacucaagcaaugggagggaaagucauuuugcuuguagcauccauuuaccuccugccacauucucacgccuacugcucaauucaguuccaauuauuuuucuuccuguacaaacuaaaacuuccauucuuuugguauaauaggaaagcuauuauuuagaaauauuaaaacagcucagauuucaaggacugauuuaauuagaauaaauguuaauuaaaugaaccaggaguuauuuuuugaauuaagagcccuuccuuaggugaaauaauuauccaauucuaccaguagguacaauccuacuccagaagaagaggcaacuuaauucuuauuucucaaagguuaccaauacuuugcgcgcauauauacauauauagugcaagguacauuaucuuaagagauuguuccuuuuccacaauaagacaaacuuaagaggacauucauggaagcauuauacuugaauguaauaaacuuuaaauaccgaauuaaaaaaaauuaagaagcaacaaugaauagaauauggcaauguucaggaccuucacugaaaauuuuuggaaaggaacgaucaucaugcaauuuuuacacaaaaacuuguuuuguugagaacuaaucuaaaaucuguuaaagaucacauaucacuuuuaaaaaauuugacuaugagcccagaaauucuugggaucauaaauuuacauaaagaacauuuuaaccauauaaagaucugauguuuuauauuaucuaaaaagaaaccauuaugcaacuaaauuuaaauacauaccccuugaggcugggcaugguggcucacaccuguuaucccagcacuuugggaagcugaggugggugguucacuugaggccaggagucucagaccagccuggccaacauggcaaacaccugucucuacuaaaaauacaaaaauuagccgggcaugguggugugugccuguagucccagcuacucaggaggcugaggcaugagaaucacuugaaccugggaggcggaaguuacagugagcugagaucacaucacuguacuccagccugggugacagagagagggacgcucugucuccagccagccccccccaccccccucaaugaaaaccaagaucuaaaauccauaacauaaacaaauguaaacaaugugguuauuaguaucuccagcugaugauggccauauaaaacucaauacaauguauaaacaguucuacuuagugcauaaagaaaauccucccaauuccugggagaacauaucaggcaagaaauauaaagaaagacagguuuuucacagauuauuguagaaaagauuaagaauguuaaugaauuauuucugugcaccaaacucuuuuaagagcauaauuuguugaacaaaacuacauauuaaagacuuuccagacuaucacugaacauuucaauugaagauacauuauuaaggauauuuuagaagaaauuccaguacugagagagauacuuguauaaauagccuuagagucacuuuuuuucuuuuacaccgacauuuuuaaaaauggagaaauaauucgcauaccauagaauucacauuuuuaaagcauauaguuuagugguuuuugguauauuugcaagucugugcaaccaucauuaccaccuaauuccaaaauauuuucauuaccccaaaaagaaacucuguauccacugacagucacuccugugucuccucuccaucccuggcaacuacgaagcuacuuucugaccauacuguacauauaccuauauauaccuauucgguauauuucaaauaaacgggauauauaauauguagccaucugugcuuggcuucuuucacuuauuuuccagguucacccuuggagcauguaucaguacuucauuccuuauauuuaguggcgcuaaauaaugcgccacuaaaauccauuaaaaauggauauacuggccaggugugguggcucacgccuguaaucccagcacuuugggaggccaaggcaggcagaucacgaggucaggagaucgagaccuuccuggguaacauggugaaacccugucucuacuaaaaauacaaaaaaauuagccgggcgugguggcaggcaccuguagucccagcuacuugggaggcugaggcaggagaauggcgugaagcugggaggcggagcuugcagugaacagagauugcgccacugcacuccagccugggcgacagagcaagacucugucucaagaacaaaaaacaaaaaaaccaaacccaaaaaaaaaaggauauaccacuuuuguugauccauguccuuaaauuuauacuuaaguauuuuauucuuuuugauaguauuauaaaucaauguuuucuuugucuauccugcaaauuuaacugaacucauuuauuagcuugacagucuguuguuguauuucuuaagauuuuuucuauacaagauuaugucaucugcaaacagaaauaguuuucuugcuuuuuauucugguagccuuuuuuuuuuuuuaaucuugccuaauuucuagaaccuccaggacaauguugaauagaaguaggaagagcagauacccuugucuuguuccugauuuuagagggaaagcuuucagucucucaccauuuaguaugaugucagcuauaggguuuccagagauacccuuuaacagguugaaguucccuuuuauuccuagucuauuuaguguucuuaucaugaaaagcuguugguuuaugacaauugcuuuuucugugucuacugagauaucaugugcuuuauguccuuuauuaagauggugucuuacuuugauugguuuuucuauguugaacuaaccaugcauuccuugaauaaauuccauuugguuaugguacaucauccuuguucaugcuguuggauccagguuguuauuuuguugauuuuuacaucuauauucauaugggauauugguuuguaauuuuuucuucuugugaugucuuugguuugguauaaggauaauacuggccacacagaaugagcuggaaagcauuccucaugcuuauuccuuuuuggggaagaguuugugaaugauugguguuaauucuuuaaauguuuggcagaauguaccagugcagccaucugguccugggauuuuuguguuuuguuaguuuuugauuacuaauucaauuuccuuguuuuaaaucuauuaaaauucucuauuucuucuugaguuaguuucaguaguuuaugucuuucuagaaauguauugguaauuagaguauauaacuauaaaauauauaccaucuaugacuacauaaugauauacuauaaaugucuuucgccuuuaguaauaauguuuuucuucaagcguccuuugauauuagucauauuaguacagccacaguaggugucuuuugguuacuuuuuguguaaugcaucuuuuccacccguuuacuuucaaccuuuuugugucuuugagucuaaagugucucucuuguagacccuguguaguuggauucuguuuucuaaucuacuuuaucaacaucuuuggccuuuuaacuggagugcuuaaucuguuuauauuuaauauaauuacugauaauguagaauuuacuuaauuugguuauuuguucuaugucuuuucuuucucuauuccucaauuacugcauuauuuuuauauuaaauagauauuuccuaguguaccauuuuaauucccaugucauuaauuuuacuacauauauuuguuagucauuuucuuagugguuaucuuggauuauaaguaaaaauuuaaagccagauguggugguucuagacuguaaucccagugacucagguggcucaggcaaaaggacugaagcaggagcaucacuugaguacaacacuuugagggcuggcuaggcaucacagugagacccuuaucucuaaaaaaauaaagaaaacaauucagccagguguaguggugcauaccugcagcccagcuacucgggaggcugaggcacgaggauugccugaguaaguuugaggcugcagugagcuaugacugugcuacugcacuccagccugggggacagagugagaugcugccucuaaaaauaaauaaguaaacaaacaaacauuuuauaagaaccuaguuucuuuacccgccuugugguguugucauauuaauuuuauguuuauacgaugugugcacaucaaauuuguaauuauugcuuuauucaguuguuuuuaaaaucagguuggagaaaaaaagaguugcauauaaaacaauacccuuauguuguuuuauauuuaccuguguaguugccuuuacuuaggcucuuuauuucuucauguggauuugaguuacucucuaguuuccuuucauuuuagucugaaggauucucuuauuuccuauagggcagguuuuugagagaugaacuccuucagcuuuuguuuaucuggcaauguccugauuucuucuuuauuuucaaaagauaguuuugcuggauauagaguucuagucaacaaaguuuuuuucuuuucagaauuuugaauuuguuauuucacugcuuucugaccuccaugguuucugaugagaaaucagcuauuaaccuuguugaggaucccuugcacguggugagucauuucuuuuugcuacuuucaauauucugccuucggcuuuagacaguucgauuguaaugugucuauguuguagaucucuuuaaauuaauuuaacuuggaguucacugagguucuuggauuaaugguuuuaaucaaguucuagaaguuuuugggcgaguauuuauucaaauauucuuucuucuuuuuucucucuuucccaucuuucacauacucccauuauguugguaaauuugauaguaucccauaggucucugaagcuguuaauuuuucuucauucuuucuuucuuuguuauuguucaguucuucagcaucaaaaucucaauugacccaucuucaaguuugcugauucuuucuucugccagcucaaaucugcuguugaccuugucuagagaauuuuucauuuaaguuacuguacuuuccaacuccagaauuucuauuugguucuuacauauaauuucuaacucuuuauugauauuuuuuacauggugagauauuguuccuuuacuuucaugucagucuacaggaugguuuucuuuuauuccuugaacguauuuaaaauaccugguuuaaugucuuuguuuagcauguucaaugucugaccuucccuaggaacgauauccauugauugcguuuuucuccuguauaugggccauacuuuucuuuccgcuugucucaaaauuuuaugacgaaaaauaggcauuuaaaauaaauauaauacggcaacuccagauagcagaacuguccucuuaucuacgcuugucauugcugucuguuagugacuuuucuuaauguuauaaaguccguauucuuuguuguguguggccacugaggucucugucugguuagcuuagugguuaaugacugaauacauauuuccuuaaauaccugaaacuuacaaaucuuccacucuuuuccaagggcuauaugugcauuuuggggcccaccuuuaacacucagauaagcaauuaacaacugccuuaaaucgcuugcacagaggcucaugaucagguagaggugagaguuuaaggccuuuucuagucuuuccugagcaugcgcacagcccugaacauguguguggccuucugguuccaaggauacacggagguuuucaaaggccuuauggagaauucacuccuccaauuuuccuuuuaaguuuauugaucggucuacuauuuccuagugcuuuuagggcauuucccuagagaaguucaguaagcauuaaaauuuuaagguuacugaugcauauugcuaaacauaaugcuguauuuaacugcacucacauuagggugagcuacuucccuggacuagcugagacuuccaguuuuagaaucaagaccaaaggguuuccagacauggggcauucaguucuaaaaccaugaauguucugggugaacuagguugaguugguuggucucacacacuuuagcacuguaucaaugaccuaucuaaagugguuccaaagggacaauuuaaaaacaucuauuacugaacucuaggcuaaacgaaaauuuauuuggacacaaagugugaagugaggcucuaagcuaauuuuauuucccuaaauaacuagguaauauguucaacaauauuaaucuuuuaaguccauucccuaccacuaaguuuuccuuaucauacuguaacuuaaauaaauuacaguauauuuuacaaugaaauguagaaauuugaacagcucagcugaaaggauuuugcuaaccauaaaaaucaugaaaccacuaccccagacaagacauguaucuuuuccaccgauguucaacugugcacuucuauagucagucccaaucacuggcaaccacuuucugacuuacagcaccacaaguuagugucaccugcucuugauuaucauguaacuggaauuauauagauuguauuuuuguuaucuguuuugcucaacauacuuguuuuguguuucaguaguuguuccuuuuaauugcugaguaguauuauauuguguaaacauaccacaauuuagcaauuguccugcugauggaaaccugggucauuucaaggucuagauuauuaugaauaagguuguuaagaauguucuugucaaaguguuuuuguugauguaugcuuucauuuguccuggguaaaaccugggugauaagauuagauguauguuuaacuucuuaaaaaccuucccaaaaguucuuguagugguauaccauuuacacguccacuaguagugaaugaggguuguagcugcuccacauccucaucaaugaauguuguuauuuuuuucuuuuguuguucaacuaagugggauauaguauuucauuacgacuucaagaauaccuauuuuuaucuaggcauaaucaaucuucuuuaguguauaguuaaguuuuggcaaaugugaauuucgugcagccacccacaaucaaaauauagaacaauuacaucacucuuauucaacucccuacaaaccucuucauucacugcgguuugugcacuucucugaugccuaauguuaagcaccuuuucaugugcuuacuggccauucacauaucuuuugugcuguaccugcucaagucuuuggugcauuuuuaauuggguuauucaucuuuuuauuguugauuuguaggagauauuuauauauuguggauacaaguaguaugucauguaugugcugagaauauuuuuuaccacuguguggcuugccuauuugguuuuuuucuuucuuuuuuuuugagacaggguguugcucuguugcccaggcuggagugcaguggugggaucaaagcucacucacuguagcuucaaacaccuaagcucaagugauccuccugccuuagccucccaaguugcugggacuacaagugcccacuacuaugucuggcuaauuaaaaaaaaauuuuuuuuuuaaagauggggucuugcuauauugaucaggcuggucucaaacgccuggccucaggcgauccaccugccucagccuccugaguuacugggauuauaagcaagagucacgucacccagcguauuugguuucuuaaugucaucuucuuuaugguuaguguuuuaugcauuuuguccaaggaacuguuaccuacucuaggccugugaacauagucucugauauuuucuucuaggaagauuaugguucugaguuuuauauuuagaucuauaauccaucuagaauuaaauuuuaugucuggaguaagacugguuuagguuuauaauuuuauauacagauaucuagguauuauagcaccauuuguuaaaaagauuuucccuucucuauugaacugacuugguggcccucugguacuauuuaagaaauuugucuaauccauauuuacuaagauuuucuuguauguuuucuuuuagaaguuuaguucuaugguccauuucaaguuaauuuuucuauacaacaugaaguaagaaaugagauucuucuucuuuuccuugugucuacuuguucuaucaauuaaagaagagggcauuuaaaucuccaaaugugacuguagauuuguccauuuccuuccuuaguucugauaauuuauacuucauguauuuugaaaguauuacuagguaugucuucuugaugaaaugacacuuuuaucuuucucgcugcuuuuauaauuaugaaaucuauguauaauaacauuauuugucuuaaauucuauuuugucucauauuaagacaguagcuuuaguaugcuauuugcauaguguaccuuuuuucacuuuuacuuacaacccaugaaccuuuauauuuaaaguaaauuucugauaaacaguauauaguuuggucuugcuuuuuugaaccaagccgacaauuucuguaucuuaaaaucguagcuuuuaagauuagauaaagaaaauuuaagcugcuauaguuucagauuagauauagauaagauauaguuaagauacaguuauagguaagguauagauaagauguaguuucagauuagauauagauaagaaaauugaagcugcuacaguuucagcuucuugggaggcucaggcaggaauaucguuugagcccguaaguuugaggcuauaauagugcucuaugauugugccugugaauagccacuguacuccagccuaggcaaugcacugaagcccugucucuuaaaaaauaaaagaaagaaaaaagaaaagaaaauuuauaaacuugaauuacaaggagacagagcuguaaauaugaaauugggguuaacagacaugaaaaacagauucacauccacucauaggaguuuagggacagaguacauacaacaugggaaaggcaaaauuugaaaagacaauggcuaagucuucagaauugaugagagaaguuuuuagaauugaugaaagacaugacuccucugacucaguaggcauaaugaaucccaaacacaauaaauaauaugcuagacaucgacaaaguuucacauuuuagugaaacugcagcacaucaaacacaaagcaucuuacaagcagccagcaaacccccacaagucaccuacgaacaagacagaguagacuucuuucguuaaauagaaacaacacgccagacaacauaaaacaguaucuucaaaauacugagagguaacagcuaucaaccuguguaauucuagauugaacuaacuuuuaaagugaaauaaaauaaagauacuuucagauaaagucuagaauauuuacgauuaaggaaccauugcugaaagcacaaaucaagggcuugcacacuaaggugcauuuagauaucugaagggcauuuuugcuuuuuacaaugacuagggaguuuuacuagcauguagcauguauaugaaagcuuuuaaaaaagggaaauuuucggccaggugcaguggcucacgccuguagucccggcacuuugggaggccgaggugggaggaucacgaggucaggagaucgagaccauccugguuaacaaggugaaaccccgucucuaaaaauacaaaaaaauuagccaggcgugguggcgggugccuguagucccagcuacuagggaagcugaggcaggagaauggcaugaacccgggaggcggagcuugcagugagccaagaucgcgccacugcacuccauccagccugggcaacagagcgagacuccaucucaaggaaaaaaaaaaaaaaaaaaaaaaagggaaauuuucuaugaagagcaagacaguccuauacaacaaauaacuguacaauccaaaugcuguuagugguccacugagaaacacagaagagggaagauacaagaugggacgguaaacaaaaauuguaugaccuguggauuaacuuuuaauaaacaaaaauaaaaauuacaauuuauggguauaaacaugaaacagaaguaaaauacuagaaauggcaugauuagaauuaaaguuucccaaagucugugugucacaguagaacuauagguaaguuuuagacaaaaauuguguauggguaacaacauaagcacacaaauugaaaguaagaagaggagaaaagaugacacaaauaucaagccaaaaaaaaaaaaucagccacauuaauagcagacaauauagauucuaggguaaaaccacuauuauaaaucaagauguucauuacauaauaacaacuauaaaacuauguguacccaauaauacaauuucaaaagacauacuaaaaaaaccuaaugcuaugaggaccaacuguugaacccauguuuggguagcuuuaaaaaaaucauauuuggauagcuuucaaaaccucaauagaucaagaagguaacagauuaaaguauaaagaaguacacaaguaacaaacuugaguuaauagacacauagcaaacuuuccagucaauaaauagagaacacauaauuucuucaagcacauuuauaaaaacugaccccuuucuauaaaagaacaccuauuauauaauauguucucugacacuacaauucuacaauuaagcuguaaaauguuaagaagauaaccaagauauccccauuacuuuaggauauaaaaaaacagaagaccuugcuuuaaaaauagguccagugaaaauaacaaaaacgugaucuugacuaacgugucuuaccgauauaauacgaucuccuuuucugagcucuccacuuagaucagcagguccuccggcuaagauaaaggaaauaaauauuccuucuccaucuucuccuccuacaauguugaaaccaaggcccguugagccacgaugaagaacaacuuuucuagguucccuaaaaauuaaaaaaaauugaguaucuuggaaauuuuauauaaaaccugacauucuaucagugagaacuaccuacugauaauuuuuauguuaucaaacuacaaagaaagcuagacaaaauauaaaugguuuuucuaaaacuacgagauaaagagauucuaagccuacaaaucaaaggaaaaaaucuaauuuuauauaaaagcaaaaaaccuguguuauauaaaacagaaaugaaaccaaaacagaaaaaaaacguggaaauuuaaaaguauuauaagagcuuaucaggaaauacacauacucaugaaaagcugauguugcacacuuuauugccuucaaagcaaucacugccccuacuuagaaguuuaaaaggcagguauccuuuugucuuagagaaggcaggcccuuucuccagucucaaagggaugaaccauaaccaaccuaaacaaguuauugcaaucccaugccccuuugcugaggugagaguauaaccccauucuaaccucugguaaaugaagggaaauuuuauugucauuuucuagagacagacaaaccuuaucaaggacaaagcaucuuugcuaccuuccuuuccucaaaaaaacgaaacaaaauaaacaaaaccccacacgacugaauaauacaaucccuuuacugguuuggacauauuauaaucaggaaggugaaaccaagaguauaccgaagacaccacaggccuaagguugcuauaccaaccuuggaaaugcccaucuucaggcuuuuuauaugaaauaauuaaaaccuaucugcaggggcacagguagguuuuaucauauuagugauguuuuauuuccuaaauuagauggugaauuccggauuuacuguucccauuaugcuuuaaaauauguaugaauuagaauuuuauauuaggaaauuauacuugauuaaaaaauacucagcugaaauucaacaguauuuccaggggaaaauacacucugauuuucaaauaauguaagcacaugaaaaggugcucaacaucaucagucacuagggaaagagauauaaaaauaaugagauacuucaggucuacuaggauggcuauuaaaaaaaccacaaaacaaaaaguaacaaguguugaugaggauguaaagaaauugcaacucacacauuacugaugagaauauaaaacggugcaggcacuacgaaaaccaguuuggugguuccucagaaagcuaacauagaauuaccauaugacucagcaauuccacccuuagguauauaucccaaguaacugaaagcagugauuuggacagauacuugcaugccaguguuuauuauagaauuacucacaauaaccaaaaggugaaaauaacucaagugcccaucauuagaugaauaaacaaaauguggcauauauguauaauugaacaguauugucauaaaaacaaaugaaauucugauacaugcuaacaaaugaguguaucuugacaacauaagugaaauaggccagucacaaaaggacaaauauuauacaguuccacuuuuauaaacuauccagaauaggcaaauucauagagacaaaaaguagauuaaagguuaccaggggcugggaagacaguggaagggagaauuacugcuuaauggucacagaguuugucugaaguaaugaaaagguuuuggaaauagugaaggguuccgaaaauugugaaugcaauuaacacuacugaauuguacacuuaaaaauaguuaaaaugucaaauuuuguuauauauauuucgcuacaauuuuuaaaaacugauguaauauaccacaaauuguauacuuuaaacaggugaaauuuaugauaugugaaucauaucucaauaaagcuguuaaaaaauaaacuuuagaaccaaaauguagguauguugugauuuuuuuuuuuacuuuuuugauauugguaacaucugaaagacugcuuaaagucaaauugugaagaacuuauaauguuggaaagauuuuauacuucauuauuacaaaguagugugauuaucaaaagggagugguucauacuuaaaaguccaaugcaauauucuagacaagagacucaagugaagaagcaugaggaacaguaaucaaggugcaaauauaacuuauuuuuuaguuuguaaaauaugcaaagagauuaaagacuagauaagccauucacuauuacaguuucccucuuuacggccuuaaauaggcacuauuagaaaguaauaaaaauaaauggcaaugaaaggucacucuagaagcacugccugaagacuagcagccuuggauauucccaucacaaacaaauaagaacacuauucuuucugcuaauuuucaucccaaacacaauuacugacaaccuauuaaguuuccaacauugcuaauucuuuaugaaagaaaagagacaaacacuccuaucuguccuaaagaucacugccuagaaucaggagucugauaaguaaaaaauaauaauaaugcuaacaauaauguaaucaauaaacguuaagaacagacauuacuuaguacacauuuuaauguugaaucuguaauauaaaagacguguacaaauuacaaagcaaacucuauagugucuuauuacuauauugaauaauaugaaaaagaucuacaaugcuuuuucaccaauuuuuuucuaccucauuagaauucuuugggauuaaaaagacaguuaaucuauacauuucagugcagguaguaauuuuagaugaaaguaaauuuugugugucagaauaucaaggauauauagcaaacaaacaaacccacccaccagccaggcaaaggggaucacgccuguaaucuuaguaccuagggaggcagauacgggaggauagcuugagucuaggaguuggaggcugcagugauguacguucauagcacugcacuccagccugggcaacagaguaagacccuccugcuaaaaccaaaccaaaccaccacuuauugaauucugaacacaaaucaaauaacugccauauuuuuaugguauauauuagauaaggaacauauaaaauguuacuuuaaaauaugcauaagaauuuucuuaacuuaguuuuacuaagcuaauuccuaaggacaauuuaccaagccucaaagaaaagcaguauuaauuuuaaaaaaggagugguaauuuauuuguaaaaauaaaacauguauauuucaggcucuucaaugaauccuccuauggaaaaaaauuaaccuuuaagcucacuaacugucaauaaaauuuuuuaguccuaaaaauuguggcuaucuuacauggcugauuaaaauucaauuuaauaguugauuuuauguaagaaggauaaauguuaacuuccuuaccuuguaauuucaucaucuccaaguacugcuuuagaaacuggggaguaucuggcuggagaugcuggugucuggcccaagaaggaagaugggcuaacaugguuaucaacaggcugagaagaagcuucaaaauaaacaaagugaaaaauacuucaaacacgaaacaagccaaucaguauuccauuuaugagugauuaauguguaauuuauaugcacuccuuuauauaucagaauuugguagagaagauuuacucaucagccaaaaaacuggacauuauguugcccagguuagucucaaacuccuguccugaagugauacucccaccucagccucccaaaguguugggauuacaggcauaagccaccacacccagauuacuuaaagaauuauauacaguccaaauuugauugugaauaauaaaaaucagaggcuuuccaauaagugcgaaaagacuauguccuuauacuagcucagaucugucaaccuaauuuacaucuaugcuuuuaaauucacccauagaagaauaaaaaccugguaaaaagcaaaaacgaaaaacaagcaaaaacugucguccaggcguaguggcucacgccuguaacccuagcacuuugggaggccaaggcaggcggaucaccugaggucaggaguucgcgaccagccuggccaacauggugaaaucccaucucuaccaaaaaaauacaaaaauuagccagacuuggugguguggccuguagucccacuuacucgggaggcugaggugggagaauugcuugaaccugggagguggagguugcagugagccgagaucgcaucacugcacuccagccuacguaggugacagagugagaugcccugucucgagaaagaaaaaaaaaaaaaaaaaagcaaaaaccaaacguugguucacuucaauaguaauaaauaccacauauagguuuuccauucuagcaaaagcuaauaacagaaaauuauagugauuccugaccaugcuuucuaaagacacagguagguaacacauggcagcuguagcuuacaaagacauaagacacuugaauuauuccaaucauuaccaaaacacagaggaagcaauauuuaacuuucuugaggcuucaacuaugauaaaguuacaaagcacuucaaaaguagcuguauuauuuaauuaucaagcauuaaucucuuuuuuauuaaauuagagcauaucuucuauggagggaagcagcauacuacgcacuggaguacaaaaaugcaggaauuauuaguucaaauuacuauaguggccagauagguaacauaaaggaauaaagugaacuggaugaaagacaacaggaaaugacugaaacgauaguauuuuagagaugcaguguaucuauugauauuacagguuugcaguauccaacagcaauuguuuccuauccaguucauauauaagaugcucguuuguauuugagccaaaggacuuucuaccaauggcucuuaacuuugaaaguccaaagucuuuccuggguggucaguaagaauaugggauuuucaagugaauugguauguagcccucaaucaauagauacccacgugaaccucuacaaucacuagccuguuaaaaauccagaguuuacugauuuuugacucuuaaauucuuuugcugcauuuucauauuuagaugaaacaaaaaaaacaacuagacaagaaauccagucaaaugcccaaaccagaaaauauacauuuucccugacacauccagacuaucccuuuagucaaugcauccuuucuggggcaguuaaucucacauguaccacauacucucagacaacagagacuaaaaauuaauguuccuaugaaagaaaugacggccucaaagaaggaucagauaaaacaguacuauuucuuauaccccaaaucuuauguaaaaaggucccccagagaagcacaagagugccuaauucauuuuucuuauauauuaagaugaaugauucaacacuauaagauuuuauagaaaagcaaguagaagagcuugaagugagaaugggaaaagacugguguccaaaucagaaguagcaaggccaugcagcuaaagagaauauaaguuaaaagcgagaaaauauauacuguaaaaaacaggaacauuuuaaugucggcagagaaacuguauucucuguuagauucaacagacuucuuuuuuuuccuacuuuuauuccugaguaucauauuuugacuaccuuauuuugguuauaaacauuguggcucuuuaucuucuauaguucauguauaacuucuaugaucuucccuauuucuuuuacuauucuugcuaaaaauauuuuucuaacuaguacaaaaauuguuuuccaauuuugacaucugcucacuugcaaggcugccucugugagaaacauccccuccaucaaugcuugacaaucaccacaaaaaaaaaaaaaaaaaaaaaucaaauguuaucuaguccucuuagguaacaagagaaagaaaaucugaacauucuugugucugcuaaggaaaaugcauucagaacuaaaauccuucccaagaaaacuccagggccagacagauagauagcuucauuggaaaauucaacaaaacaucuagagaugaaauaacauucugaaacauuacaagacagaaaaauuucaggacacuaucguuaaguucaugcuugugaacacagauguaaaccuaaacaaaauauaagcaguucaaaaucaaugauauauaauauauauuauaaggauguggguuuuuuccccccacaaaugaaugguuuagcguuagaaaaucaauguaauuuaucacguuaacaaaauaaaagagaaaaaucaucuccauaaauaauuggauaaaauucaauacuuacaggauaaaaacuccccauaaaccaggaauaaagauuaacuuucuuaauacaaaaaggguaucuacagaagaccugcugguaacaccauauacaauggugaaauacugugucccccaguuugugaacaugacagugauauuuauuaucaccauuucuguucaacacugaacuggaggucuuaccaaugcaucagacaagaaaaaagaaaaugaacaguauaaagauaggaaagaaggaaguaaaauucauuguucacagaugacaugguuauauacguagacgaucugaaagaccuauaaaaccuaacauuaacaaauuuagcaagauuguugacuaagcaauuaauauacaaaacagauauuuccuauauaucaguuaaaauuagaaacauuuacaaaguaguacauuuauaauagcaugaaaaacaucaaauagccaggacuaaaucuaacauauaaaaccucuacuauacaacacugcagagagaauguaagaaggacuucaauaaaagaagagauauucauauuaauggacugauuaagaaacucaauuuaauucuuccuaaaccgaucuguaauguuuuugauccuaaaauuaaaaaggaaauucaaagacccaacauaaucuugaacaguaacaaaauuaagauuuacuuuacaucaauauuuauuauaaaauuaugauaauuaagagacugcaggugguacaaagacaaauaguucaaugaaacagaagagccuagaaauagguucauauauauguggucacuuaaaagaaaagcaccaaugcaauucaguggcagaaauggucuuucaauaaaugaugcuagaucaauuauauaucugcauauuaaaaaaucucucauuacaugcaaaaauuagaucaaaauggaucggaccuaaaugugaaaggcaaaauaauaaagcuccuacaagucccuuaugaccuaaggauaggaaaaauuucaacaggucacuaaaagcacuaccuuaauagaaaagacugauaaggaauuaaaaaauuuuauccaucaaaaaguaccauuguuuugagggaaaacauaaacucagugaagacaucugcaacagauguaacugauuagaguuauuucucaaauacauaaaacuuccuuuaaaucaauaauaaaaccaauggaaaaauguaaaaagauuugaacagacauugcauugaacaagagucaaagcaauaagcacaggcaaaaaugcugaaaauaauuaaucaucaggaacaaccagcaauaaaugaauaaauaauaaucauuaaaaucaugagauaacuuuauacauauacauacuauucauaauuaaaaagauggauaauaccaaggguuggugaggauguagaaaaacuggggucuuaauugccuccuauacuguugaaauuguucagcaguauccgcuggagacuaaacauaugccuacccuguaacacagcaaccucacuccaugagaaaugacugcuuaugucugacaaggaugugcaaaaacauccacagcagcuacacucauaaaagaucagaacuguaagugacucaacaguaaaaugaaaaaaauuguuguacacuuauacaauggaauaauacauagcaguuuuaaaaagccaugugacugaucauuaagcuaaauucuuaaaauugguacccuuacugaauauauguuuuaauucaauuaaaaauuaaauaaagaggucaggugcaguggcuccuaucugcaaucccaacacuuugggggcacugaggcaggaucacuugagguuaggagcuuaggcaacauagugagaccccaucucuacaaaacaauuuuaaaaauuagcugggcaugcuauccuagacacuuggaaggcugaugugggaggauggccugagcccaggaauucaaggcuacaaggaacuaucaucgugucacuccacugcagccugagcagcugagugagauccugucucagguaaaagaaucuuuuuauagacuuuccccauuucuuuacuggguauguuuuuuuauuuuucuuacagagucuugcuuugucgcccaggcuggacuacaguggcgcgaucucagcucacugcaaacuccgccuccuggguucaagcaauucuccugccuuagccucccgaguaguggggacugcaggcacuugccaccaugcccggguaauuuuuuguaguuuuaguagagaugggguuucacuggguuagccaggauggucuugaucugcugaccucaugcuccgcccgccucggccucacaaagugcugggauuacaggcgugagccaccgugccuggucucuuuuuuaagagaugggucucauuauguugcccaggcuggagugcaguggccagacacaggugcaauaauagugcacuauaacccccaaacuccuggguucaaacaacccuccugccucagccugccaaauaauugggaccacaggcacgcaccauugugccuggcuuuuuuccuuuuugaugugaagaagucuuaacaugguaggaaaaucagcucucggugauauuaagcagagaaaaggagcaguguuagagagguaucuuaagacuguaggacgaucccuccuauuuccuucagauaaggaguauguaaacauguucgugugcugaugguaaugauccaguagacagaggauuugauuaugcaagagagagaagggacagcugcaagaacaagauucucugcagacaacaaacaaugacauucaguauacaaauggaagaccugguuuucaacaggaacaaugacagugacucccauuaaaacacaagugaaagucgaguuucgggguaaaaauauaauuacauagguauaucugaaaguggaaaaauaaggaaauucucuucugggugcuuauaugaaauaugaagugagaucaucauucaugaauaguagauggcaagugaagguuugaggggagagaaaaauucuuuagagugggagagugaauuagggaaauguaguaggacugcaggcaagaguaaggcacuaucuaugauuuauggccauacguaaaaagcagaauuuugugcuuuucuccaugguucugcuuuuuaggaaccauaaaugaaauagcagaguuugccugcaccaguguugggggauucugcugcgaagaagaagggggcaaaggacuugaagaugugcaaugaagugaacaugagaaaccauggaaucuaagcuaauacaaauagaaaaauugagacaaggggcaacaaaauaauaaugucaaaugacugaaggucaaaaugagauggaauugcuagaauagaggugaaugaacugaggguuguagucacacaaugggaugaucaaacugguauuuuagaggugaugaaaguuaauaauuauagauaacaaaaucuaaaguauuaucuuagaagcaaguaacugaguugaaguggagggcaggauagucagaaagagaugaagaaaccaaaaagucaggguguuggaugaaucauuagugugguuuuuggacaugaccaggaaugacagcaugaguaacaguggcaaaacgacaaugggccuucgcacuaaagucuucagugacuacagccagacugaugaagagaacaccagaucaccacagccagggauagagaguaagcugaauagccugacagcagggugacugugcaggcuucagaagaacugacaaguaaaacucacuuauguaaaaaaaauuuaaacacaagugcuuuucaaaaaacacaaacagauuguuuaugaauugcauaugcagaaguguacaacgaaacccacaucuacaguugccuaagaagggaagggacuggaagcaaaauauuaugaucaaguugaaacugcaaggugaaugucagcuuuuucauaaugcuuuauuaguucaauaacagaugggggaaaaaguaacauaaucagcugggcucgguggcucaugccuauaaucccagcgcuuugggaggccgaaguggguggaucaucugaggucgggaguucgagaccagccugaccaaacauggagaaaccccgucucuacuaaaaauacaaaauuagcagggcgugguggcgcaugccuguaaucccagcuacugaggcaagagaauggcuugaaucugggaggcagagguuguggugauccgagaucacgccacugcacuccagccugggcaacaagagcgaaacuccaucuuaaaaaaaaaaaacaacauaaucauaaucagggcacuaauacucaauucguggaacaacugucacaaugugcacaugguuauuagauaggcagcauuuaaaauaagauacuugaauugaugaauaaaauggcucauuauuuaaaaaauacacaaagccuuuauauaaaguuuaugugcuagaggaaguauauguaagaauuucaaauaaguagcaagguucuuuucuuugacacaaaagaaguauaagacaccaucccuguacaucagacagguuaaauacuauuaaggaaauaauucaauuauacuugagcaauuaauaaaucaaugagcagauaaugaagauacauuacuggagggcaguauguagauuucaaaaugucauguuuuuaacugauaaugauuaguaauauaaugaaucuugacaguucuaaaauuggaagcacuguuacuuuaaaaaucaccaauauuucuaaaauucuacaauuuaaaaaaggagcacucaaaagcagguuauacccaguacguuuaagaucuuuauuauuuacggguucuucaaacauuaacucaaugcaaagaacaaauacagauuucauuuuuccaccaauacaaacacauuaaaaaauauacuuaaaucucuucucagcuuauauauuuaaaaaacugaauauaaaauggccaggugcgguggcucacgccuguaaucccagcacuuugagaggccgaggcagguggaucaccugaggccaggaguuugagaccagccuggccaacauggcgaaaccccgucucuacuaaaaauacaaaaguuagccagucauggugucgcaagccuguaaucccugcuacuaggggggcugaggcaggaggaucgcuugaaccugggaggcggagguugcagugagcugagauugcaccacugcacuccagccugggcaacagagcgagauucugucuccaaaaaaaaaaaaaaaaaaaaaaaaaaaaaaaaaaauauauauauauauauauauauauauauauauauauauaaaguaagaaaccuaaaaauacguaaguacuuuaagaacaauuuaaucaacugcaacacaacugaacugcauacaaauauaagcacuagaaccugaaaguacaaagauaaauaguaucucuccucauguaccuaagagcaaagaaaaucccuuuaauuuuagauauauuguaaaucaguguuucucaaagugcaggccaugaacuagcagcaccagaaaccucagaauuacagacauaccucagagauauuacaguuccauaccacagcaauaaagcgaauauugcaauaaagccugucauuauaaauuuuuugguuucccagugcauguacaaguuauguuuacacuauauuaaguaaggaauagcauuaugucuaaaaauacaauguacaggccuuaauuuaaaaauacuuuauugcuaaaaaaaaaccgcuagcaaucaucucagccuucagcaaguuauaauguuuuugcugguggagcaucuugccuuaauaaugauagccuugauacugagggugguaguugcugaaggguggggugccuguguuaauuucuuaaaauaagacaaaaaugcaguuggccauauccacugacucguucuuuuacaaaagauuucccugaagcaugugaugcugguuuguuagcauuuuacccacaguagaacuucuuucaaaacugaagugaauucucuuaaacccuacugcugcuuuaucaacuaaguuuauguaauaucccaaaauccuuuguugccguuucgauaauguucacaucaucuucaccuaccaggauuagauuccaucucaagaaaccacuuucuuugauuaucuauaagaagcaacuccuuaguuguuaaaguuuuaucaugagguugcagcaauucagucacaucuucaggcuccacuucuaauucuaguucucuuauuauuucuaccaauuugcaguaacuucugccacuaaaguuuugaccuguuccaagucauccaagagggcuggaaucaacaucuuugaaacuccuguuaaugcugauauugugaccuccucccaugaaucaugaauguccuuaaaggcaucuagacuggugaauccuuugcagaagguuuucaauuuacuuugcccagauccaucagcggaaucacuaccuaugacagcuauagcuuuauaaaauguauuucuuaaauaguaagacuugaaagucaaaauuauuccuugauccauggacuacagaguggaugacaaguuaguaagcaucaaaacaacaucagucucccugcacacugccaucauagcucuugggcagcuaggugcauugucucagagcacuaauauuuugaaaggaguguuuuuuuuuuguuuuuuucugagcagcaggucucaauaguuggcuuaaaauauucaguaaaccaugcugucaacagauaugcugucauucaggcuuuguugcuucaguuauagagcacagguuucauuacaguuauacagaacaggcagacaggcuuagcauaauuccuuggauuuucuggacugguaaaugggcauuggcuucaacugaaaaucaccagcugcauuagcaacuaacaagaaagucagcuuguacuuugaagcuuugaagucaggcacugacuuauccucucuagcugugaaaguccuaaaaggugucuuuuuccaguagaaggcuguuucaucuacauugaaaaauuguuguuugguguagccacuuccauuaaguaucauagccagaucuucuggauaacuugcugcagcuccuacagcagcacuugcugcuuuaccuugcacuuucauguuauagagaugacuucuuucccucaaccucaugaaccaaccccugcuagccucacauuucucuucuacagcuuccucaccucucucagccuuuucagaauugaagcacaguuagggucuuguucuggauuaggcuuugguuugaaggaaucuuaugguugguuugaucuaucuagaccacuucaaacuuuguccacaacagcaaucagauugucuugcuuucuuaucauuaguguguucacuguaacaguacuuuuaauuuucuucaagaacuuuuccuuggcauucacaacuuggcuaacugcagcaagaggucuagcuuucucccuuuauugccauugaacaugccuuccucacuaaguuaaaucuuuuugacauauaaugagaaauaugcaacuuuucacuugagcacucagaggucauuguagauuuauuaacuggccuaauaucaauauuguuguaucuuggggaauagggaggcccgaggagagcgagggagauaggggaaugacuagucaucagaggagcagucagaacacacacauuuaucuauuaagcuugcugucuuauaugagugugguuguggcacuccaaaacaauuaaaauaguaacaucaaagacuagugaucacauauuacuguaacagauauaauaauaaugaaaaaaguuugaaauauugcgagauuuaccaaaaugugacacagagacauuaagagacaugaagugagaacauguugcugaagaaaaaaggugcugauaaauuugcucaauucaggauugccauaaaccuucaauuuguaauaaauguagucucugugaagugcaauaaagcaaagcccaauaaaaugagguaugccuguacuuugcuuguuaauagaaugaacggcuuguucaagcaaauuucugugcucaaguggaaaacuuagaacaaaacaauuucaauauuugcaaauguucuuuagugacuguuacuuacauaaaaguuugaaaauccuuuaaauguaacuacuacuauaaaauaauaaaggugaaaaggaucccccccuucuaauuauaaaaauuuugacuuaaaguagauuuuaaaaaaugaguagauuaacaugcuuaauuguuucuuuaaaaauauuugcauaauguuuaaacuuuauuauacugagaacauuucacuaauggcaucacaacugaagaaguaagauaaauuuaagcaaacguaugcuaacagacuuacaguuggugauaucagguggugcauagccaucauucauauacauacuuguggguuuugccacuuucaaauaaacaaaaucagauguguucuuuaaggcaguuacugcuucuucaugaguaacuucuucuaaacauacguuauucaccuaaaaaaagucccaaaagacauuuaugacauauucacuuguucucugaguuuuggaaacaauuucacgaaaagaaagggaaaauaagagagugguuuaaggaaaauaaagguaugccgaaagaaaauacccauguuugaugucuaugaucucaguaaguuguuuaucaugacaugugaagucguugaauguuaacagaauagcccaucuugauuccagucuccauaccuccuauucucccagucuugauuuucucucauucuuaggcauuuaggaauguguguggaugcguuuuagacauuuuuaucuuuaaagaaaugaaaacauacuaaaauuuuuguuuuuauguuaggauuuuuaauguaagguaccuuagagacuguuccauguugggacacaaauuaauagaauuacuacauuguaacaaaacagcugcacaguagcccauuguguggcuauaucauaauuuauuaaagaucauaucuguuaauauucccauauuuagauuggaaaacuauuagaacacaauugagcacaaauauuuaaauuguucuccuaaaugguuuuaguaaauuuauacucacuaccacagaauaugagagugcccaucuacuuagaccuuugccaacauuaaacauuaucaacuaauuuaaaaaaucuguaaaaugaugcaucuuuuaauuuauacaucaauuaguuuuaaauuucuacuuucguaauacucaaguugauuuuuuuucaauuauuuuuuggccauucaccuaucuucuguauagaaauauaacugauuuuuagguagugauguauccugcaaccaauacuaaacuaauuuauuaguucuauuagcagguuccuaggauagucuauauacaauaugaugacaucagcaaauauaguuuuauuucuuccuuucuuuuuuuuuuuuuuuuuuuuuuuuuuugagacggagucucgcucugucgcccaggcuggagugcaguggcgggaucucagcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuauuucuuccuuucuaaucugauuuucuuuuucuuuuucuuuucuuauugcccuggauagaaucucaacuauaacacugauuagaagugguaguuuaugucuuucuagcaaucugucaauuucaucuaaguuaccucagguauuagcacauaguuacucauaauagucucuuguuuucccucuuucaugcuugcuuucagaaauuucagccuucucucuuuuuucuuggcuggucugaagguuugucauuuuguugauuuuuuuuucaaaggaccaacuuucaguuuugucugucuucuuacaucuuuucuauuaccuauuucauuaauuucugcucuaaucuuuauuauuuccacccuucuguuugcuuuagguuuggauuguucuucucuuugauacauuuuuuuuuuuugcaaauaaguaaaacauuaucaauguuuccguuuuaaauuaccauguauuaacaauauuaacuuuaauauauuuuucacuuuuuccuaauuuguaccuuuauaguugacuauugcaguuuuuaauauuuucacaaaaaaauguaaaggucacagaauaauaauuucccuucacugaugauuaacauugcuuugcagagucucagcagcauggucauuuuuauggcuccacauuaccaugcaaagcaaggacugccugcauuuugaaauacauauuaaauagcuguggcauacugcugaaauacacauuaaauagcuguggcauacugcugaaauacacauuaaauagcuguggcauacugcugaaauacacauuaaauagcuguggcauacugcugaaauacacauuaaauagcuguggcauacugcugaaauacacauuaaauagcuguggcauacugcugaaauacacauuaaauagcuguggcauacugcugaaauacacauuaaauagcuguggcauacugcugaaauacacauuaaauagcugugguauacugcugaaauacacauuaaauagcugugguauacugcugaaauacacauuaaauagcugugguauacugcugaaauacacauuaaauagcugugguauacugcugaaauacacauuaaauagcugugguauacuucugaaauacacauuaaauagcugugguauacugcugaaauacauauuaaauagcugugguauacuguuucuuugguggccuacaauaagccaugcauccugguauucacacccuuguaaaaaucucuuucuacacugaauuuugcuuguccacguaacuagcuuuagccaaugagguacaguaguugugaaggaaagagaagauugauaaaaacaauguaccagugcuugucuucuuuggaaagcuuacuuuuggaaccuagccaccauccugugugaaacucacccuaaccacgcaaagagaccacuggauaauuaagcaccuggcuaacagucccagcugaguucccagcuaagagccaacuugcccaccauaugugucagccaaccuaacaguggauuuuguggccuaguacagcaaagacaaguuguuccugccaagcccuauccaaucugcagaauuguaaacaaauacaugagugguguuuuuuagccauuaaucucuguguuuucucacauaucacuagauaccugacacaagagcugacacaauuugcugagggauuuaaugugaaauguguaagaugaugaucccaaaguuuuacgccagagaaaaguuauuugaccaucuaccagagucgucuucuacacauuaagaaacagugaccuugggagugaauaguaaaaaggagaaaauggacaaggagugaguucuggauuacuucaauguuuagagguuacagauaugaggaggcaccagacaucagaaagacagaaugaagaguggcuacuaagaagagaaauaccaagauaaagggugacuauuaggcaaaugaaaaaguguuagaaggaggaaggugugucaaacuccagccagauaagucaauuaagaugaggacugagaauugaaugauuccaguguaauuaagagaacaaaagccucacuaaaaguugauuuaagagagagacuugccacaaugguaucagcacagguugcugucuccuaccaccaaagccaguucuagagaaaccauaaaggaaaacaugguagccaagaaauuaaaaaguaaaacugagaaaacuagugcaacagaaggcugucuugacuguguuugugugugagugaugagugauggugagaugguacugguuauaguuugaggaaagaguggugaucuuagcugugaaaggauaaguuagagaaacauaguucaaguucugcucuuuccuuuucgccaucauuaacuaaaaaaagucuccuugcaacaauaaacaguacuaaacaggauguagaacaaaggaaucuuuuauauauugcugauguaaauuuuuacaagcagccuggaaaacaacaggaugguuuuuaaaaagaaugcuacuaguaggauaaucaauaaucccaugacagucaaguaaaauucuuguacauguucaccagaacacacagcagcucuucccaggaaaauuauucauaauaccaaaaaaaaaaaaaaaaaaaaaagacuuaaaauagauuuuuaaaaaccaguacuugcuaguauauuuuuaaaaaccaacuuccuacuaugccagauccaguuuaugugccuuuucagauucugcuaggccuuggcugcuugcucaguggagaguccugacuauuauacuacuuucaucuugucuccugcccuucccaguuuucugagccucuucuggcugggacugggcauggcugauguguuccacacagugagggccauaacaugucacaaaccuauguuugaccugucauaccacugcaacucuaccauuuuugggcuugggugaaguguugugccauggaguauaggagcuggcuucccuagaaacugcgcccaggggaguuggguaacacaauccaaaagcuugggacaaauaaccccuaggggguagacaagagacaggagaauaaaagggccagcagauaaaccuuucuuucuuuucucuggauggcuggauguaagguuuaugaugcccggaugguuuuuacagugucugccuagaagacuguuauacaugacaagcaacaagcuaccuuauaaaauuacagccagcucagacacauucuaccuucuauuggcucucguucauucucugcuucacuccucauuuuuacucacucuagccuucuugagaucacacagccaaauaauaccuuagcacuuuagcuuuucuucagauuccguuucccuaaggaacauggacugagacaguuauugauugauaugguauggcucuguguccccacccaaaugucauccugaauuguaauccccauguguugggggagggaccuuguaggaggugauuagaucacggagguggcuccccaugauguucucuugauagugagugagucucaugagaugugauuguuuuauaagcaucuggcauuuccacugcuggcacgucucucuccugcuggcaugugaagaagggcguguuugcuuucccccacccuccaccaugacuguaaguuuccugagucuggugagucaauuaaaccgcuuuccuuuauaaauuacccagucucggguaauucuucauagcagugugaaaacaaacuaauacacugaugaagacuggacaaauaaauugcaguacagacauacaguggaauaguauguagagauaaaaugaaugaacuuuagcucuaagcaaugauauggguaagucucaguaaagcaauauugagugaaaaaaauacuggagaugaaagucucauacagugcaauaguguuuugaaaaagcuucaaaacaaauaauacuaaacaaaauuauuuaggcauauguauauaauuaaacuuuuuuuuuuuuugagaugggcuuucacucugucacccagacugcagugcagugggacaaucacagcucacuguaaccucaaccuccugggcucaggugaucuucucaccucagccucccaaggagcugggacuauagguguauaucaccaggucugguuaauuucuguauuuuuuguagagacaggguuuugccaugcugcccaggcuggucuuaaacuccugggcucaagcaaucuaccuaccucagccucccaaagugcuaagauuacagacaggugugagccaccacacccggccugauuaaacaauuuuuaagaagcaaaggaauaagaaacacaaaaugguugauguucuaauucuugggcuggguaauuacuagguuucauuauacuauuaagugaaguaaaauaaaaaagggucaugcauaaacaaaugaugacauuguuuuauaaaccuaaggauuaugaugaaacacucugugcauacaagcccucaacaacaacaaaggaauaaaaggaaaagggaggaggagcuagcagagaaaagagaaaugacaaauaaagaauuaccaagaaucauuuuuuaggauuugauacagcaaggcuaguauuugcuaauuuaaacaucauuuagaccuuuuugguauggagaaauuccaguaucuaucagaaaaauaaacagacuacaaaaugauuuaaaagacaauagauuucuuauacuuacugcuaaaaguuuaucuccaaucugaaguuugccauccuuaugugcugcaccuccuucaauuauuuugguuacauagaugcuauuauccccaggaauaugcugauuuccaacaccuccagcaaugcuaaacccaagaccuguuuggaaaacaguucuagauucucauccauaaauaugaacuuaagcccagaaagaaaugguugaaaacuacaagguaauuauucccucacacuaauauuuuuuaaaauagaaaagaaucuauuuaguuaucuacuaguauauguucugcaaucaagggacacuuagacauacagcugcuccuagaguuacgaauagauuccuuuuaucccacauguuccuucuuaguaucuuuucgcaaaugcacuuguuauuccaaagugacauugcgaaauuauguuuuacuuuuguuuccaucauaauuaugcuuaccuacacuuuuaauauuuucacaagaacaaaauuauugagaagaaauaacaacauugucuggugauggugggcagaaccaacaggcuuuaaaaaugugaauaccuuuguucuucuucaauauucuaugaauuaacaauuuuaaguaaggaauuucuguaauuccuaaaucccauagcuucaauaucagauaauuucucagcucuccauuccuuuuucauuuguugacauccucccucuuccaugaagccacauauugaaacuacuauuuccauuuauccucaagccaucaauguuuuaaaaauucagcaaucacaucuuaacaguccuuuacugcagauguaacugcucauaauacauauuauaaacacuucuucuuuuaacuuagccuguguaccugcauuuaaaguauuuuguagauuaucacaaguuaauagcaauacuaaacuucaaaguguucaaggacacaaauauuucacucuuuuaaugcuagaagucuucaauauaagaauacuuaauacaaauagggacauauccacuuauaaaacaaauagauauuuuguucccuacuuuuaaaaacucuuaaaaacaugcugagcaaauauugaauauaaaaaucauaaaaaacuuauaaauuuauauauaugcucacugcaguaaaauguauaaaagcauacaucaauaaacguaagaauuuugggccaggugcaguggcucacacuuguaauaccagcacucugcggggcugaggugggagaacugcuugagcccaggaguuugagaccagccuaggcaaugcagggaggccuccgucucuacaaaaaauaaaaaaaaucagcccagugugguggugugugcaugcaguccaagcuacuugggagggugaggugggaggaucgcuugagcucaggaggcugaggcugcaguaagccaugacugcaccacuggacuccagccagggugacagggcaaaacccugccucaaaaaaacaaacaaaaaaaccccgcaaaaaaaggaacuuuucaaaugcugcaaucuugguagaaauguaaauauucuaaaaugcuacguaagacaaaaaucaguagaaauaacggagaaauuaaaauccacucaaguucuguagaauauuacuaauacuguacuuggaauguaugucacagauaaaguucauagguauauuuaacucagagauuucuuaaagauuuaucuuaguuugacuuaccacauaccuuuaggaccuuuaaugagcuuuauuuccauuauuuuuucugacacugguuuccuucuuuuuacauacaagcguacaauagacccugcuucuuucaacgcuucaacugcuuugcuauguguuacaucacgaacaucuacuucauuuacucguaauauacagucauugacccugagaaaacaauuaaauauuaaaaauaaaaauuaaauauaauuuaaauauaaauuuuccacuuuaccaauuuuuuguuacuucuuuuuuaagguaaagagaauuauaaauaauucuggaguaauuccagaaaacauaaaugaagaaaguauaucaaaaacuaauauaaacaaauacaaacauuucccaagggccagcaaaaggaacaaaagaaauagugaaaauaauagauuauauaaaaauguuaaauaauaauuacagcuaccauuugcauacuuccugcaugcuuauucuguguaggcauuaagacacacuuuauaaaaauagcaaacauuuauuuagcacuaaccacaugccaggcacuuucuugguauuuuaacccucaugacaccuguaagcuuaauauauauuuuaaucccuauuucacagauggagaaacugaggcacaaagaauguaaauaacuuuccuaaggccacccagauaauaagugacagagcugugauucaaagauaagaaaacugaggcucacaucacgaguuuaaggucacagagauagugugaaaacugagauaaaguaaaaauaauuuucugagugccuauuccaaccuauauauuagacauaaaacaauuaaguuauuuuuugaaauuuauauaaagauuaggucacuuaauucaaagguuucguagguaaagaacuuauaauuugccaugguguuauguuuuuuaaaagucugauuuguuccuagucuuagccuuuucccuaguucuggucucuuugauugcaugguauuccaccaggaaaaaaagauggucaucucaaauuggguagagaggguaaacaaaacauaauuaaaauauuaaaacugguccugacaagcuucuauaucuaacagaaucaggaaguaaaugucuacauuuacaugaauggucaaaugauuaauuuuuauaucuauuugauuucauuaauauaccaccugucauacccagugagaauuauaaagcuuagaaauucaaaaacugcguaaggcaucaacguccuuaaaauaagaugcuguuuuuaacagacuacauaaacucuuuaguccuaaaacuucaggguauuugaacaacaaacaaggaaauaggaaaaaugacauaauuuaugacccucaaaaaaucaaaguuugcaaaauauaucuuccaaaauggaacacuaaauuuaaacagagacaaauguuauuuucaucuagucaauaagaaaauauauuauuuaaaguuugcauauagucuuuguggugugggauucaacauggaugugugauccucuauccuccguaucuuaaauaaguuuauauacauguuucccagccagagaggaaauggaaaauauucugugaguguacuuaaauaaguuuauacacauguuucccagccagagaggaaauggaaaauauucugugaguguaucugaaaacacaaagggaaacucaugauuucuauaaauaugcucacaaagauuuaaaccaucaaccaaauuuguuauucaaaauguuauaauaucuaagauaaaacuggagucuaaaugaaaacaggaacacaaugcuuagagcauaauuaucucauucauugacuugaauguuguuaaagcaucuacccuaugcuaguuaucaugaucguguuuguuauuuguauuuaucccuuauccagucugcuucaagaaaaauacacaaaguggauucagcaucacaauaaaaagcgcaaaacauaccgcaaucuuccaucuugggcggcugcucccccugugauaauuuugguaaugaaaauacuugagucaucuccaauguguggguuguccguaccuccugcaaugcugaaaccaagcccugaauuucccugaggauagaagaaaaaaaauugagacugaauaugauuuaucuuuauggacagguuccugucauuaaaggacgcagaaacuguacuaacauaaggaacacaacaaauaaagguauaugggugaguaauauaaagauucuaaauuaaauggacuuguucuggaggaaaguccuuucagaggcauuacugcugaacaggugagguucaagaaaauacaccaaggacuuuugaaguauacuccacaguucuuucuuuaaaaguaugugcaacuugucguuggauuagucacccaucugcagaggugucacuguaagucuguuucuuuuagacugcaccucagccauguuugguagggcacaucucuccuaagagacaaaugcugaagugaucuucccgcuguuauuucugaguaggcaaaacccauauacuguuuuagccuuuaaaaaaggggguggcgauggugcuuuucuucugcuaacuugacaucagcuuauuuuuaaaugaccaaauuguggcugcuaagugauagcugccaucagucccugacauguuuaaccaauauacccgauuagcaaaaggcauuguuucacacugacugaaagaccaaccugagaacuuaacauuggugaauuuucuugacagcaaaguaaauuuugccaaagcagcucuacuuuuugcuuguuuuaugaacuggagaaacaagauuucugaauauguucuucacagaaaggguucgacugcuacaaaaagccuuuaaaaauaauugauuuaaccaaugguauuaaaaaauguuuauuucuugaagaauguucuaacugaauuucaggcaacucaaguaagcaaauauauguggaccuaucauuuaacuguuaguauuaaacaguguaaacacccacucuaccaccauuugucuuaaaauucuauuuuaauaaaaaaauguuuuucaaucuaacuucaugaauuaccugaaucuuaagaacaguaccaguggauuaugggagguuaccaaauuacuuagguacucaaguucuucaaccagugaaaaauacaauguauaguccuaacuaaacaaaaggaauuuaaaaggcccugggaaaagauaaaaaaucaauaauauaaaaaguuaggagacaucacaaacuacuauauuaaaguauguacaguacauuaauacugugcuuacuugaauauuacuccaguagccacccaacuugagcaagugauccgaauuuaaguagauggcaauaaagauauacauguaagagacucucucagauuuauuuuucucagauucuauuccaauauaaauaaaucuaauuaucuaggauuucagucuugaguauacacacauuuaguuacuuaagaaaucugcuugugugaaacacuagauuuccauaaaaugcuagccagauaagguggcauuacuauuauaacauacaauaaaaacugaaugcagauauucuuuuuucuuuuuuuuagacagagucucacucugucacccaggcuagagugcgaucucggcucacugcaaccucugacuccuggguucaagugauucuccugauucgaguagcugggauuacaggucugcguuaccacaccuggcuaauuuuuguauuuuuaguagagacggaguuuugccauguuggccaggcuggucuugaacuucuggccucaagugauucacccgccucggccucccaaagugcugggauuacaggcgugagugcagauauucuugagggaaaaacauaucuuaagaaaauuugcacaucugaauugcaccuucaagucauuuucugauugggcaaguauaccauaauuaguuuuuaauacagcucugucuguuagaaguaugguuauuuugcuagaaaagaaaauugauauaaugaccauguuacuaguauacuacuuacuuaauacgaacaauacuucauuaucauaugcauauaaacaauauaaacaaaauuaaaaagcaagaaaaaucugagaaacuaucacaaucuagaggggucuaaggcggcaggauaacuaaacguaauguaguuuccuggaugggccucugagagagaauaacauaaaaaguaaggaaauagagacuucaguuaauaauaauguaugaauacaggugucuuaguugaaauaaauguacucuaguaauagaagauguuaacaauagaggaggcugaauccagaguaaauggaaacucuugggacuaucuuuacaacuucuuuguaaaucuaaaacuauuguaaaauaaaaaguuuauuaaaaaaauaagguuacuaaagaaaaggcaaauguuuugaaaauaccuuggccaauuuuaugaacugggaacuuagaaaauaucauauaguucuguuuuugagagaucucccuuggauucuguaugaaaaagcaguauauuacaaaguucucuagaacaacagauuaagauaauaguuuuuacccuuucaagugugauuucuucauauucauaaucugcaucugugccauuaaccuacaggggaaaagaaaagcagcucagaaacuucagaguguaaaauccaaaauggcaaggcaaaauuuuuguaugauuuauuaaugaaaaccuguugaaugcgacaguaaucaaacacaauagcuucauuuuaauaauucuggggaagauuuucaaggaauggaaaaauacaaaugugauuaaugaguugacaacauucgugguaucaugacuuucaaauccaggauagguacauucagcuuuuaauaguuucaaccuccgauccuucucugucuugauccacacaucuaaucaguuaccaacuguuucugauuugaacaccuuaauuuuuuggaaaaucaucaccucuucacucucauuucuaauaccuuuguucaggccuuguucaaccuccucuggaauggaauacugucaaugcagucugccuaaucgcuuagauuaguauuccccacugcccaaaucacuguuuuaaacagcuggaucuuuuuuguuuuguuuuuuugagauggagucucgcucuguugcccaggcuggagugcagugguggcgugaucuugguucacuacaagcuccgccucccggguucacaccauucuccugccucagccucccgaguagcugggacuacaggugccugcccaccacgcccggcuaauuuuuuguauuuuuaguagagaugggguuucaccguguuagccaggauggucucgaucuucugaccucgugauccacccgccucggccucccaaagugcugggauuacaggcgugagccaccgugccuggcaacagcuggaucuuuuuaaagcccauaacauacuuccucuaaaacuuucacaacucucccuuccuagaaauauccaaacucuauggguugguaaucaugucuucgaaugaacugaccccaauguacuacuucccuucauucuucaccucuucauaggccuuacauaccaacccuuucugugaacgacuugcucuuuccauuacauauccugcaauuuuccacuucgacaucuggaauuuugugccuccucggucacaaauuucacuuacauguuuuaugucaaaaucagucaccauucaagauaucuuggucacaauuuaucucccuccaauuuauuuccuagucucuccugaaagaaguuaacuccuacaguaaaggccacuggugaaacaagucccuggaaucagaugaacauggguuugaauccuuccuuuaaaauuucucgugauaugaggcugggcaaaacucuaucuaaaucaaauguggacugugauaaauucuacuucugaagauggcucacaucuuccauuccagacauucuuuugcaauauaacuaaaucacccuaccaucaaaaggagucucuuuccucuucaauuagaucuaggcaagcccugugacuagcuuugacuaaaauaaauguggcacaaaugaugcugugugauuucugagacuaggucaucugaugccugauaguauuauuugccuuugcuuggaauauauuuucuuuagaacccagcagcuauaacaugaguaaaacucaaacagccuacagagagaucuaaccaacagagaaccaaaacccuuggccaaaagccccagcuacacuccuaaccagcagucagcaccaccaacuaucagccacgugaauaaggcuauuuggaccucccaaccuugucaagugcccuaacccacaccauguaaagcagagccauccaauucauuaugagaaaaaaugaacuguuguucuuuuaagccccuaagcuucaggguaguuuguuaugcaaugauagauaacugcaagagaaauaacaaaaccuacauaagcuacuuugcuuucuuaaccauacuauaaaauguagcccuuaauucaggucuaauauagggaccaggaguuucuuccuugagaacuuuugaagcccaucucuacuacccuuuuggguucuuaacucuugugauucuccuagauucaaacccuauuacuauuuuguucccucuucuuucucaucuauagacauuuuccucuuagagauuauauguuauaaaggcauuuauauagagagaguugggauuucacucuguuacccaggcuggaaugcaguggcauaaucauagcucguugcagccucaaacuccuggacucaagugauccuccugccuuagccucuugaguagcugagacuacaggcacaugccaccaugccuggcuguuuacuuuuguuuuucauagagauggggucuauguugaccaggagcucgcuugcuugcucucucucucucucucacacacacacacacacacacacacguaaaaucucuuuaucucaguuuaggaggaguaacuucaagagcuguguugaucaugucugugcaucuagaguacgggaggcuuaccuacuugacaggaaguccuuuguuacgaguaaaauuuuuauuugcagcaauauccccuuucuuauucuaaagguuauuugcaucaucuuguuucuuacucaagacuugcuaaaagucuaucagucuuuaucgaauaagcaguuuugacauuauugaugaaucuauuacauuucaugguauuacuuucuguuuuuaacaguucuuuaguccuuugauuuucuaaaaaagauuuuugaguugaaugcucaauuuaugcuuacucuauucuauuuuuagaaaccucaaaauuuaccaauuuuccuuggcauauggauuaggccaaaucccacaacugcuagcugcacugagcuccauuuuuguucauuuguuuauuucuaaauaaucuaaaauuuuauuuucgaaaacauuuccaaaugagugugcuuauauggcccuuuuggcauuaacguaaaauuuugauacugugaccuuaugauuucugccuuaaggaaucugagauuuuucaccuuuaaguuuccucacaagguaggugcucaguaaauauuccuggugcuuaauuuaaugccaauucaugauguagguuucuaagcagcacauaaaaggggcuuuuuagguagcacugaguacuuuacuaaaaauacaaaaauuagccaggugugguggugcacgucuuuaaucccagcuacucagggcgggggccaaggggugggguagggugggggcugagacaggagaagcacuugaacccaggaggcggagguugcagugagcugagauugugcuacuguacuccaaccugggcaacaaacagagugagacacugucucaaauaaauaaauaaauaaauaaauaaaauaaaauaaaauaaaaagaacucgacccuuuuuacaauagcuaaaggaaaauaaaauacuuaagaauauacuuaaccaaggaggugaaagaccucuacaaagaaaacuacaaaacacugcugaaagaaaucacagaugacacaaacaaaaacacaucccaagcucauggacagguagaaucaauacugugaaaaugacuauacugccaaaagcaaucuacaaauucaaugcaauucccaccaaaauaccaccaucauucuucacagaacuagagaaaacauuccuaaaauucauauggaaccaaaaaagagccuccacagacaaagccaaacuaagcaaaaggaacaaaucuggaggcaucacauuaccugacuccaaacuauacuaugaggccauagucaucaaaacagcaugguacugguauaaaaauggacacacagaaugaagcagaauagaaaacccagaaauaaagccaaauacuuacagccaccugaucuuugacaaagcaaacaaaaacauaaaguggggaaaggacacccuauuugacaaauggugcugggauaauuggcuagccacauguagaaaaugaaacuggauccucaucucucaccuuauaaaaacaucaacucaaaauggaucaaaaacuuaaaucuaagaccugaaaccauuaaaauuuuagaagauaacaucagaaaacccuucuaaacauuggcuuaggcaaagacuucaugaccaagaacccaaaagcaaauccaacaaaaacaaagauaugcagaugggauuuaauuaaacuaagaagcuucugcacaacaaaauaaucagcagaguuaacaggcaaccuacagagugggagaaaaucuucacaaucuauacuucugacaaaggacuaauauccagaaucuacaaggaacucaaacaaacaaaucagcaagaaaaaaacaaucucauccaaaagugggcuaaggacaugaauagaaaauucucaaaggaagauacgcaaauggcugacaagcauauggaaaagugcucaacaucacuaucgggaaaaugaaaaucaaaaccacaaugugauauuaccuuaccccugcaagaauggucaucauaaaaaaauaaaaaaaaauagauguuggcguggaugcagugaaaaggaacacuuuuacacuguugaugggaauguaaacuaguacaaccacuauggaaaacaguacagagaguccuuaaagaacuaaaaggagaucuaccguuugauccagcaauucuacuacuagguaucuacacagaggaaaauaagucauuauaugaaaaagauacuugcacaugcauguuuauagcagcgcaauucacaauugcaaaaauauggaaccagcccaaauacccauuuuuccaugaguggauaaaaaauauauggugugcacacacacacacacacacacacacacacacacacacaccauggaauacuacucagccauaaaaaggaaugaaauaauggcauuugcagcaaccugaauggaacuggagauuauuauucuaagugaaguaacucaggaauggaaaaccaaacacaguauguucucacucauaagugggagcuaagcuaugaggaugcaaaggcaugagaaugauacauuggcauuuggggacucgggaaagcgugggacuggggugagggauaaaagacuacauacuggguacaguauacacugcucagaugaugggugcaccaaaaucucagaaaucaccacuaacuuauucauguaaccaaacaacacccgcucccuaaaaacuuacugaaauuaaaaaaaaaauccaaaaaacaaaaaauaaaauccugaaguuucccauccuuuaaaauuaaaaaaaaaaaagaaauaaaaggcauccagagguaaacuaucucuauuugccagugacaugaucuuguauauagaaaauucaaacuacauaacuaccagagguaauaaaugaguucagcaagguuguaggauaaaagauaaacaccuaaaagucaauuauauucccauaugcuagcaauaaaaacuccaaaaauaaacaaaacaauuccauuuauaacagcaucguaagaauaaaauacuggcugggcaugauggcucaccccugaaaucccagcacuuugggaggcugaggcgggcuggaugacuugagcucaggaguucaagaucaaccuaggcaacaugguaaaaccccaucucuaccaaaaauacaaaaaaaaaaaaaaaauagccagucaugguggcacguguccguguucccaacuacaugggaggcugaggugggaggaucaucuugggucugggagguggagguugcagugagcugagauugugccaaugcacuccagccugggugacagagugaaacugucucaagaaaaaaaaaaaaaaaaaaaaagagagagaauacauagaagugaauuuaacaaaagaacuccaagacuuguacacagaaaacuaaagaacauuauugaaaggaauuaaagaaauauacccauauauuuacaguuaacugauuuucuauaugguugccaagaccauucaaugcggaaagaauagucuuuucaacaaacagugaugcuauccacauacaaaagaaugaaguuggaccucuacuucacauuauacaaaaaucaacucaaaaugaaucaaagaccaaaaucuaaaagcaaaaccauaaaacucuuagaagaaaacuuaacucuaagucuuugugauguuggauuaugcaauggcuucuuacauacaauacaaaaaguuacaaaagaaaaaauauaaaaauaaugguuuuuagacucaaucauuaucacgaaauugcggcauuuucuaaaguuuuauccacuuaaacuucaacaaaaauguagcaguauauuuuuaccccauacugucaccagcagaauguacugacaaacuuuuugcucuuuugauaacauaauguuuaagauguauuaauuguuuuaauuugcauuuauguuauuaacucaccuuuuucuacuuuuuuaccuuaacaaauuauguugagauauucacauaucauaaaaucuaccuuuuuaaaguaugcaauucaguaguuucuaguuuauucacagaguugugccaucaucauuacuuucuaauuccagaacauccuuauuaccccauaaacaaacccuguaccuauuagcagucacuccccauucugcccuacacccaccaccuggcaacugcuaaucuacuuucaguaacuauggauuuaucuauucuggaacuuucauauaauaaaauuaugcaacaaguggacuuuugucccugaucaauuuaaaauuacaaaguuauaacuaauuauuuucguauauaugaaugcacaaaaaaaaccugguuacuaaaaaucuagucauucaauuagacuucuaaaaugauuuaaauauauggcacuguguaagcaaccaauggucagagacaaccuuuugugaaaguuagccaucauaauuucugaauuaaauuacgaauuucuauuucaaaauuucugcuuuacaaaaggaaaaaaaaaugaccaaaggaggaccauacuacuuaauuuacuauagcaauuacagcuauaguauauagugauagaacaucuuaagagaaauguauuagagaaaacaaugccauggucuucgcauuuguaucaaaaaacggaacaggaaaggcagaauuacuucaauguggggaggaaauggaacuuacguaaguugguguuuccaagcuaucuguguugaccaguacugggggaggauuugccuuuaagaagaaauuguaaauguguuaacaagaaaauaaaacauuacauguucauguucacaauguuagaggcauaggaaagacuugcuauuucuuaaguuauaaucuuauaugagcuuuuuauauguuaaauaauauauccuuucuccagcaccaaacagaaaaaauuauguauaagcaguuaaaacagauuugcuuuuaagaaauaaauugcuauuucugcuaaagcagccaugauuuucuuaaguuuuacacagaucaccauagccuucucauaaaacccaugaauauucuuuaguguaaccaauaacucuuccuagguugcuuagaaaucauuguuuucucuucccaaagauacaguaaagauuucaaucauuucaucacccaggagaaaauucuuccccacagugaacuguuuuuaaacaaggaaaaaaaaaaguucaucacagaaagaaaucaauuguaaacuuuuagaaacuaaaaacacacucuuaauguaaaaacccgauuauuuucagcugcaaugacugcuuuccaguuauucuagaccacucacagaauuaacagugauuuauuacagcaagaaaaauaagcagaauaacacacaccuaguuaaguuuggauugaaaaaaaaucuugguuuucugguuagguuagaaauuauuauguauaugaaacuaaagaauaaaaugcaauaacaaaugaaaaauauaauaaaaaucugauguaauuccccucaaaauucuuucuucugcauauuuaaaguuaugaaaguaccaagucacauaacacuuucagagaauaaaaaagaugacuauccuuuaaacaaacuuuagaagauaugcuuacacacauuaaugguucuacuucaauuaccugaggaauuauacauaaaagcuguauaaaguaacacuguaacacaaaauaaccauuuucuuccaaauguacaggcuuuuaauaaaggggaauauucaaacuucaaauaacacauuauuuucagcacaguaccacagcuaaaugauaugacaaaaugcuuaaagacaaccuaguuucaugguuaaaaaauuaaacaguaugcauuugggcuacaucaagcaguaaguuaaaaaugaguagcuaauacuucauuauauauaaaaauaaaauuaaauauaauacuuuauguuuagucccaccauuaaauaauagucuaccuuugaauaauucggugaaaguccacucaacaaauaaaaauuguacuuauaaaacugcuauuuaagcaaagcuacccaacuuacagacauuugagauuuuaugaauauuucaaauuacuuauuucccaaugguauauugagauuacucaaacugguauuuuacguugcuaaaaaaauuaauaauacaacuucacuuuauucugcuuaagcaauuacagaagaaaagggcaagaaagaauaggauauuuaaaguuacaaaagaaauuacauuuuaaaaacacuauggcaagaaagccuuuuggucccucugccgauuuuuuaccaaacaugcaguggaaaaaguugguuuuuaucaaaaucuaauuuauaccauaauuauuauguuagcuguuuaucaguaccaacucaucaucauuuuauagaaguuaccuuuugauucuauucauuuagaaagucucgcuaauauugaaauauauauaaacgaaaugauauaagguguuauauuuacuucaaaauaaaacaauggaagguugggaguaggagggguuaugaaucaaauagaaguacacgaguugauugcugcagcuggugauggguauacauagaguucauuguacuauucuuucuacauuugaauauuucugaaauuuugcauaauaaaaaguaaaccaaaaaaucacuuugagccaaguacucaguuuuaaagagguuaauagcuaaaguaguugugaaauacucugggucaggguugcuauuaagauacuggcauucagccaagugcaguggcucaugccuguaauccuagcacugugggaggccaaggcugguggaucacuugaaaccaggaguucaaaaccagucuggccaacaugggugagcaaaauuauguuucuuaagccuuauuaccgaugcuugggucaaauuauuuaggggcuuuuuaguuccuccuucuggaauauccuugcccuuuuacugccucuacccccaaucucuaagugaauuauagagcuucacuguuguccaaguuggaacuauacacaaugguauauaaauuuuaguaacagaauaagcauuucuauagcuuccuaugauuugcaacauauuuucuuuuauauuacuucucuagagccucacacagucccccuggguaaagacagguauugcuaucuuuucacagauggagaaaaugaauuuuaauaauaacugugauuuaccuauacucaaaugucacugagugguagagggagguauagagagaccuagaaccaggucugagauuacagggucacuugaaccaaggugcaaugagggcuuuuucuucaucugaaauaauuucacguagacucuuuccaagucuuuuaguuguaguuguuugauuuuccauguuaccuguucuacuacucgcugucuugguuaaggaucccaaagucuuuuuuuuuuuuuuuuuuuuugagauggagucuugcucugucacccaggguaggacuuuuuaaaacucaaguuuaggccgggugcgguggcucacgccuguaaucccagcacucugggaggccaaggcggguggaucacgaggucaggagaucgagaccauccuggccccgucucuacuaaaaauacaaaaaaauuagcugggcuucguggcaggcgccuguagucccagcuacuugggaggcugaggcaggagaauggugugaacccaggagguggagcuugcagugagccgagacagcaccacugcacuccagccugggcaacagagcgagacucugucucaaaaaaaaaaaaaaaaaaaaaaaagucaaguuuauuggcugggcacauggcucacccaaauuuuaccauucuauuucaucaacaaaggaucuuguagugauugcugcuguaacagacugaagcagccuuacaaaguuucagagggcaauauuacauuuuuaaaaaucguguuaaaauacauucuaagauccaauuauuuuaaaauaggucaaaauaguuuagaaaauccacuuuuacaaucugcauuguauuucuccuucucagcauugaucaaaguuucauuauguuauuugucuaguguuucuuucuccucuacucaauuaugaacaagugcuuuacaagugcuuuuccaaugcaaaacucacaaacuccagagaauucuucuuagauccuaauuugagacacauugcauucaaaguuaaaugcuaugacugaggugaucacugcagguuaaaaugauuguaaaaacaaaugggguggauucuggaaagaagguagaguaggaagcaccacaaaucuguuucuccaccuugaacacaauuuuaguggcagcaugugucugauguagauguuuuggaacuuggagucuacugaaggcuggcaacuuccaggugaacuguaguuaauuucagugaccugcaggcuuagcacagcagcagcuccccacacucuaucccucagucaacuguguaccgccugcacaagccacggugggcagagaaaauuacauucuccaaauacuggagaucugugcucugaaugcugcuucucaucacaaaggugcaaacaggcccuggauacugcuguuccaccuccuccucauuguuggaaaccccaccccaaccucccaggcugaacugacuuccaggagauugaaagagcuggaggccuccccuuccuacacaccaauucaauuuucuuuuuccccuuuugggagccagacauugaagacuaggacauuaaaaaccaaccacauguauggaggaaauuagaaagucacugugcaugcccaggggaaggcauaggcucagaaaauaucuaagaagacccuacguuuacaccugaggcugaucuuugauagccuacaacaaucagaaaaacaauaacaacaaaaaaagaaaacccuggagaagaaggagaaucugauuuucagaguuaccaaauuauuaaauucaagugugcuguuuaaauaaacaagaauaaguggcuuauuaaaaaaaauauaaaucaauauaaacuguuccuuaaaaaaaaauaaggcugggugugguggcuuacgccuguaauccuagcacuuugggaggcugaggcgggcagaucacaaggucaggaguuugagaccagccuggccaacauacugaaacccugucucuacuaaaaauacaaaaaauuagcugggugugguggcaggugccuauaaucccagcuacuuggaaggcugaggcagaagaaucacuugaaccuaggagguggagguugcaaugagccgagaugacaccacuguacucuagccugggcaacagagcaagacucugucaaaaaaaacaaaacaaaaccaaaaaaccaaaaaaacccacaaaaaccugauagcaaaucuacuagacaaagacuuuauuaaagaauuaaaagauggccgggcacaguggcucacaccuguaaucccagcacuuugggagacugagguggguggaucacuaggucaggagaucgagaccauccuggcuaacacagugaaaccccgucucuacuaaaacuacaaaaaauuagccgggcguggcggcaggugccuguagucccagcuacucgggaggcugaggcaggagaauggcgugaacccgggaggcggagcuugcagucagccgagauggcaccacugcacuccagccugggugacagagccagacucugucucaagaaaaaaaaaagaauuaaaagaugugaacaaaagcaagaaagugcuguaugaacgaaacggaaauaucaaugaagagaaauaaaaauuauaaaauucaggaaaugagaaguacaauaacagaaaauucacuggagagauucaaaagcauaucugagcagguaaaaaaaguagugaacaugagauaggacaagggaaaguacugagucugaagaacagaaauaaaagagauucaagaaaagugaacagaaccuaagggacccgugagacaucaucaagcagaccaacuaaugcauugugggaguugcaugagaaaugacagauaaaagaguagaaaaaauauuugaauaauagccaaaacuucucagauuucaugaaacacaugaauauaaacauccaagaagcucaauaaacaauaaugaaauccaacagacucacacugagacacauuauacuagaacugucaaaggccaaaaacaaagggagauuuuugaaagcaacaagagaagugacuugucacauacaacaaauccucaaugagauuaucagcagacuucacaucagacacucuggaggucauauggcaguggguggaaauacucacugcuaaaauaagacgaaaaaaacccaaaccugucaacuaagaauccuauauccagcaagacagucccucaaaauuaagggggaaauuaagauguucucugaugaacaaaagcugagggaguuuguuaucacuagaacugcccugaaagaugugcuaaagguagcaguucagguugaaaugaaagaaaacuagacagcaacucaaagucauaugaagaaauaaagaucucaguaaagguaaauacauagguaauaauaaacacuaguuaguaauauuguaacaaugguuauguaaaucugcuuuugguuuuccacaugauugaagagaccauuacauuuucaaauuuaaaaaaaaaaaaaacuuagccuagccaggcaugguggcucacaccuguaaucccagcacuucagguggccgaggcaggcagagauggcuugagcccaggaguucaagaccagccuguggaacauggugaaaccccaucucuacaaacaaaacaaaacagcaacaacaacaaaaauuaaccaggugugguaggcacaugccuguagucauggcuauucaggagacugaggcgggagaaucgauugggcccaagagguugaggcugcagugagcugugauggcaccacugcacuccagccugggcuacagaaugagacccugccuauaaauaaauaaauaaauaagccuaauauuaauaaacaaagucaauauugguaaauaacgaaaaucaauuauuaguuuaaaagcuaacauuauaacuuugauuuguaacuucauauuuugucuccuacauaauuuaagaaacgaacgcauuaaaaauuacuaguuucuguuuuugggcauacaauauaugaagauguaauucugugacaucaacaacugaaagggguugggacagagcaguuaaaggggcagagguuuuguauauuauugcaguuaagcuuguacaaauugagauuagaagugucuaggauguuaaauguaauccccaugguaaccacacaaaauauaacuaaagaauagacacaaaggaaacaagaaaguuaaauguuucacuacaaaaaauuaaucaaagaccaaagaagacaguaaugcaggaaaugaggaacaaaaaagcuacaaggcauauauauaaagaaaacaaauagcaaaaugacaaaaguaagucuuuccuuaccaauaauuacuuuaaauguaaauaaacucuucaaucaaaagacagaaauuggcagaauaaaaauuuuaaaauguuccaaccacaagcuguacacaagagacucacuguagauccagagacacaaauaugcugaaacugaaggacagaaagggguauuucaugcaacaguaaccaaaggagagcaggaguggcuguacucauaacagacaaaauagacuuuaaauaaaaaaaagguuaugagacaacaaagguauuauacauuaauaaaagguucaauauaggaauguaacaauuacaaaaauuaacgcaccuaauagcagaccaucaaaauguuaaguagcaaaaaugagacagaauugaagaaagaaaugguucuacaauaauagcuggagacuucaauaccacauucuccauaaugggcagaacaaccagacauaugauaaguaaggaaauagaggagaugaacaaacacaauauaccaaagagacacagaacucuaacaauaacagaacacacauucuucucaagugcacaugggaauagaaggaaacuaugucaaccuaagaaaaaccauauacaaaacacacacagugaacaucauacucaguggugaaagacugaaagcuuuuccucuaagauaaggaagaaggcaaguaugucugcuuucaccacuuguacucaacaugaccacuagcugaauaguugaaguuguugucaaagcaauuaggcaagaaaaagaaauaaaagacauccaaauuagaaaggaagaagcaaaauuacuuguucacaaaugauaugaucuuauauguaaaacacccuaaagauucuacacaaaaacuguuagaauuauuaaaccaauuaagcaaaguagcaggauacaaagucaauacacaaaaaucaguuguauuucuucuaacacugaacaaucuaaaauggaaauuaagaaaacaauucuguuuauuauagcaucgaaaagaacaaauuuucagaacacugagccuccuaaaugaagaauuaacuucaucaagaaaguaaaaaacuugggcaaugaaaacuauaaaacauguaugaaagaaauuaagaagacauaaauaaaugggaagggaucuguggucauagauuggaagacuuacuauugcaaaaaugucaauauuacccaaagcaaucuauagacuuaaugcaauuccuaucaaaaucccaguaggguuuucaaagaaauagaauaacccauccuaaaagucacauagaauuucacgguacccugaaagccaaaaugguaaugaaaaagaaaaacaaagguggcgggcuaacacuuccugauuccaaaacuuacuacaaaguuacaguaacagaaacagucugguacuggcaugcagacagacauacagaagggaauaaaacagaauccagaaauaaaugccauauacaauuaucaaccuacaauggaucaugaucuaaauguaaaaccuaaaacuuaaaacuguuagaagaaaacacaggcuaaaagcgagacacuggaauugucaaugauuucuuggauaugacacaaagguacagacaugucuugucuguaaucucugacaagacaugagacccagaauacacagaggaacuccuaaaacucgacgauaaaaccaaacacccuaauuaaaaaauggucaaggaacucauacagacauuuucccaaagaagacacacacauggacaauaagcacaugaacagaugugucacaaaugcaagucaaaacuacaaugagaugucaccucacacccacuagccuggcuacuaugaagaaaacagaaaauaaaaaguguuggugaggauguggagaaauuggaauccuugugcacuuugguggaaauauaaaauucuacaacuggcuggaugcaguggcucaugccuguaaucccagcacuuugggaggccgaggcaggcggacuaccugaagucgggaguuugaggccagucugaccaacauggagaaaccucgucucuacuuaaaaaaaaaaaaaaaaaaaaaaauuagccgggcgugguggcacaugccuguaaucccagcuacucgggaggcugaggcaggagaaucaccugaacccgggagguggaggcuguggugagccgagauugugccauugcacuccagccuggguaacaagagcaaaacuccauuucaaaaaaaaaaaaaaaaaaaaaaagcccagaggcaguaugaugcucugcucuggacauaccucuaagguaauuacucucacauuaugcgggagcuauuuguuaaacuugucucuugcacaaacaccuaguaggccccuagaggacagagacgauguucuauucaucuucaaagcacauauucaaauaucaaaaaagaccaugcacaaaaaauuagcucuuaaagcauuuucaacaauacuuuaauuacaugauagcuuuucagaacugauagaaauaaagguuuaaaacaucuaguuuuaaagcagaguauuuacucuagggugcaaauaagccucuggauuuaauaggcuaguaucacagagauuauguguuuacacucccaguaagaagaacuaguaacugucaccuacucuguacucaguuucuauguggagaaacugaggcucucagaaguugaguaauuuccacaccaucacacguagaaacaggugaagcuaggaagugguggagucggguaggacuauaaacuccacguucuuucugcaauauuaagcagccauuaaauauuaccuuuaucugugccacucuguauaauaagcauaauucugauuuguagaagacuuucauaaaguacaaacaauaugaucaaugugaaaguacucugaaaaguauaaaaguguucuacaaaucaugaaagacuauauacuuuuuaaaaaguuuucaucuauguaucuuucuaauuugccugacucucaaacucauuuuaaaggagucagguuggcguuaccccccauuuuaauagaugaaggggguauaaaacucagagaggguaacuagcuugaguggcaaagacagacuagauucuaaaucuuuucuucuguuuuuauuucuaauacauccuaacgcaucuaaauguaaaguaguggaucuuuuaagaauacauauucacuuaauauguugaaauuggguuauauguuaguauguauuuuaaauuuuacuuggggacggauauuuuaguccauuauuuuaauuuuauaauguacacauuguacuucacuaauuaggaacacacuuauucuggaaaaugaggugcacucauuggcuucucacauaacacaacaaaaaugguaaaacuaucuuucaugaacuuccguaguguauuuaaaaccuaaagugaagcuaugcagaauaaauaggucuuuuuuguguguauccucaauaaauauccucauuuaaaaaaacaaaacaaaacuuguuccuuaguuugcugucucagagaaauaugagauaacacuaaaaauaugggcggcuaagauuaugugccaguaccugacgugcauuaagcauccucuccaucacuguaaagcgccucaaguuaguacuccugucuaucuucaguguuacagaugaguaaauggaagugcgcugugguuaagugaagugugcaguuacacagguuaagugguaggacuggaauuccaaccccaggucauucugacuuuaaaacguguauuuuuauaagacuaugcaagaucucaacaauuuucaaaugcagugggaugcuaaguuaggguugcuuggaguaaauaaaugagagaauucugaauaggaaaagacaggcucccaaaugaauauaaagagacugguacaaauucucaaaggauuccagaaaacuauuuuaacaccaaaaaauugacugaagugagaagaguaaaauaaacuuucaauucuauuaaaaaaaaaaaaaacuguacuaauaaacucuauauauuuggaaagauguuacauuauuaugaugccauaauaacccuuaaacuguuugcucagaauuauauuuuauuuauaaauucaauuuuuuuccugcaauauagagagaauauccauuuggauucaucuauucauuguugguuuuaugacuuaauuuuuaauuauuuucauaaucaaaaauuauauaguagcaguauuauuauaaugauuacaauucagucuuauuacaguaaggcugaagucauuguaacacuguaauuuccccuagaauccuugguuguauggauguucccacugacuucacuuuuuaggagaggggaagggcacugagaugugaauaaucacagcugauauaucauuuuuuccccaauggagcuuauuuugaaacuguuuacacagcaaacauauguuuacccagauuuuaggcuacagaucaauaauggcaaaaaaaaaucuauggguucauuuauuuacacuuuaaaugagaucgugaucuuucacaccaaagaucuuuauuauuaucuuuaauaccacuaccauuauuuugacuuuggauaacuguuggaagggcaguuaaugucucaagccaccccuuggaaguaguaaagcuuugaaaaacuaaaaaugauuagacucucucacauuuggcuauuauuuuuaaacuguuacacauaauuuuuuaaaaguaaaauuuuacaacagauuuacagaaaaguugugaagauagcacagagcauucccauauacucccagauauguuggcuauuauuuuuaccuaauaaaugugaaguguguuaucuaaucaaauaacauaagaaugaauauuuccaaagaagauaaauauauaacaggaaacaaaguguuaaauaaaaugauacauugguacaagaucaggaguacaaugauuuuuacuaacuuuagaagaauaaaguguucuaaaguaaaaauguuuaaaaacuguuuuaagcagauuucuaaguacaaaggcaugaaaacaaaucuaagguucaauauuaugaaguucauugugucccauuucacagacaaccuaauaaaauggcaaauccugacuccacuuauauuaaaucccaaauguuuaagucccuaaaacuacuaacugaagcccaaaguaaauuaccaaauuacaaaaaacagcucaaacaguuuuaaaaaagaacacaaaugaaacauuaaaagcaaaugaaauuuuuauaaagaaaaaagaaacuaauaaaaaccugugguaugguggguaggaugacaguauucucagcagggacuggcaggacagggaucacagggacagugggaggagagggaagaacagcuucuguuggcuaaaaaucaucaaugacaaaaaaucaggaaaaacaccaaaauaaaagggaaacacauaacaaaaagcugugccauaaagauaaauuauaguuuucagaaauaacuaugcaacaggaaaaacauuaauacauuacacuaauauaaaugagaaaauauucucuagaaauuguuuuagaaaguuauacccccauaauaauuuuaaugauucuguaauaaaaugaaugccuacucuuuagaugcuuaaaucauaauaauaaaagauuaucauuuacaauauuccuuccuucucugggagauaagacacuugcuucauagacagacugcaaaauauuuuuucuagcacucagaauacaucucacuacuuuccucuaugcauucagaaaacuaaaaguaauuuuauuagcccaaucaggcagacaaagagaguuuacaaauccgugauacuaacuucuguuaucaagaacaguaauaacuugccucaacaugccuguaauuaauucaacuaacauugauugucuauuacaugccagacauaucuggcaaaaaugaaaaaacaacguagagagaaccugguauaaauuaaacuaaaaaguucacuguuuuaucuggcuuguuauuuuuaaaaggaugaaacuggaacacaggaaaguuguuuaguaauaagacccauuugcuauauaaauaaaauaucuuauauauguaagaaaaacacuaaaaucaagcagaugaggacagccugccuuaacaggccuuaaaacaggaagaacaaauugccagacuaaaaaaagggcuuaucuucauucauaaaugcaaaauaaaauggcaaugaucuuuucugccuaccaaauuagucaaauuaagauuuauuaacaauguauggagucucuucaacaauggugcugagacaacuggauauccacaugcaaaagaugaaggucuauagacccccaucucacauuauauauaaaaauuaacucaaaauugauuaacaaccuaaauaugagauuugaaaacauaaaacucuuacaagagaacauaggguuaaucuuugugaccguggauuugguaauggaaccuuagaaaucauaaaugaugaaagaaaaaaaucaauuagacucuaacagaauuaaaaccuuuugugcaccaaagggcauuaccaagcaagugaaaagacagccuacacaaugggagaagguauuugcaaaucauacaccugauaaggguuuaauauccagaacauuuaaagacucuuacaacgcaacaacacaaagagaaacaacccaauuaaugaaugugugaagagcuugaauaauuucugcaaagaagguauacaaguggccaauuagcacacgaaaagaugcucgacaucauuaguccuuaggguaauacaaauaaaagcuauaaugagagauuacuucaccacuacaagggaagugucuaauuaaaacaaaacaaaaaacaaaguaacaagugguggcaaggauguggagaaacuggaacucugguacaaugcuggugggaaauguaaaaugguacagcuucugaggaaacuuuuagugguuucuuaaaaaccaaccauagaaucagcaucugaucuagcaauuggguagguaaauaugcacuggguaggcauauucccaaaagugagagcaaggacuuggacacuuguaugccaauguucaaugcagcaucacacacaacagucaaaaggcggaaagaaaccacgugucuaucaggagaugaacggauacacaaaacgugauaauauacacacaauggguaugauuuuuuuuuuuuuuuugagauggagucucgcucuguugcccaggcuggagugcaguggugcaaucucagcucacuguaacguccgccucccggguucaagcaauucucugccucagccucccaaguagcugggaugacaggcaccugccaccaugcucagcuauuuuuuuuuuuuuuuuuuuuuuuguauuuuuaguagagacaggguuuuaccaucuuggccaggcuggucuugaacuccugaccuugugauccacccaccuuggccuuccaaaguguugagauuacaggugugagccacugcacccagcccuaggaauaaaauucuuaaucaugcuagaagauggaugagccuuuaaaacauuaagugaaauuagccagacacaaaaggauaaauauugcaugauuccacuuaaaagacuaguaaguuauacauauuuuaccaauaaaaaauauuccaaaaaagcuuuuaaaaaugcaugaaaacugguccucucacacugcuguuggauauacaaauucacacaaacuuuagggaaaguaauuuggcaguaaauaucuagagcuuuaaaaaugucuaaacuuggccaggcacagugguucacaccuguaaucucagcacuuugggaggccgaugcggguggaucgcgaggucaagaguucaagaccagccuggccaacauggugaaacuccaucucuacuaaaaaaaaaaaauacaaaaauuagccgggugugguggcccaugcguguaaucccagcuacuugggaggcugagacaggagaauugcuagagccuggaagguggagguugcggugagccuagauugcgccauugcacuccagccugggcaacagagugagacucugucucccccuccucaaaaaaaagucuaaacucuuugacuuaguaauucuagaaaucuacccuaaggaaauaauuuuaaaagccuauguuuuaagguacucccauaagguguucuaagguuuuaagauagucuuuugaacacugcuucuauuugguaaaucguggaauauuugaaauacccaaaggugucagaauuguuaaguaaaaaaugaaaacucuaugagauugaggcugggcaugguggcucaugccuguaauccuagcacuuucggaggacgcggcaggcagaucaccugaguuuaggaguucgagaccagccuggucaacauggcaaaaccccgucucuacuaaaaaaaaaaaaaaaagaaaaaaaauacaaagauuagcuaggugcgguggugcaugccuguagucccagcuacucgggagggugagucaggagaacugcuugaacccagcagguggaaguugcagugagcagugagaucacgccacuguacuccagccugggcaacagagcaagacuaucucaaaaaaagaaagaaagaaagaaaagaaaauuauaugagauuaucauacagaaauuuaaaauuaucaguacgaacaguuuauaaauuauaugggacauugcuuaugacaaaacauuaaguaaaaaagggaagaugaaacacauaaaaaauggaaagaaaugucugaaaaauuaaucucuggggugggaucaugagugccuuucucuaucgcugcuucuuuauucugaauuauacuuuuccaguuguugacaaggaauacacaguggcguuauuaauauaaaugcaaggggaaggaugggagauccauugugaauauuaacagaaaaacaauuauuaugaucuuuaagugucauucucuagaaaacaaacugaaaauguauuucacacucuggacuccuguuaccuggauuuauuauuuccuguagaaagagauuuuuaaagcauuggauuuuguguuuucucuuucuuuucaauguucccagucugggaugaugaaaaguucugaagauugagagugaugauacuugcacaacacugugaauguacuuaaugccacugaauuguacauuaacaaauggcuaaaaugguaaacuugauguaaacuuuaacacaauaaaaaaguauacuacgaauaaagccuccguggguuuagcucgggacuccaaucaccauuuauauauuguuccuggagaaaaaaaauucugaauuccacauuaugagcucaaaauuaauaacaaucguaacugauacucacugcaauauuuacauggccuucuaagaauguuugaaaacccauagguucugacuucugauuuaugaaugcauaagaaaagcguggugguuuuguaagaacugugcuuggaucaaguggauauacacauggaaaaaucaaacaaauacugauuccuacccuuaaacuauacauaagauuaauuucagcugguuugcugacauaauugagagaaguaaacaauauaaggcuucuagaggaugauaugguagaguaucaucacaaccuuggugcagaugaccuccugaauaggaaagugcauguugcugaagcucacgcagggugaggaaagcaucuguaggcagggaguggaagggaggcaauagccuggcaaagggugcuggagccucagcauggugacgagggugucuacauggacaaagccguggcggcagccugugugugguuggaacccaagugagacagauagcaucuaugaggcaguagcugcagucuggcauaagguuuugugcugucaguggacuaaaugggaucuucuggagccugagcagcgugagaagggcguccaacuagggcagcaaugaugacaggagauugcuuauauacagggcauucugguccaauaaauaaauacaugaaggauacugacagcagguuuccuugcgucagaaaaggcaguuauaaauaugaaaagauagaaaauuagcaugagaccuaugguguuacacuaaaauuggagguauugguauaaacaguuuucaauauauauagauaaauacaaaaauaaauauagacauaaauguguguguauauaugugcauaggucugcuaacuaugaggaccuggaugcagcuaacagcucaacagcacgaauacaccuggcauccaaaucuugauuucuaaauacucauucugcaauuuaaaacaacacaacauggccgggcacggaggcucaugccuguaaucccaacacuuugggaggcggaggugggcggaucaucugaggucaggaguuugagaccagccuggccaacaugaugaaauucugucucuacuaaaaauacaaaaaauuagcuggacaugguggcgggcaccuguaaucucagcuacuugggaggcugagccaagagaaucgcuuugaacccaggaggcagagguugcagugagccaagaucacgccauuccacuccggccugggcaauaagagcgaaacuccgucucggggggaaaaaaaccacaacacaaaaccaaacaaaaccaaaccaugggucuuugaagaaauggcugacuccagugcuagagcucagcaagcacaagauguguguagacaucuugcuguaccagaagauaagggaaguacucaaagaggaugacaaaggacacagaaguuggcuugaagggcugccacuggccagacugggaacaaucuguaacucaaugauaacaauggcauaacauccacugaauaaaauaggaaucugggagcccauacugauauaaauaaauacaucaauaaauaaaugaagauaagagcauuuucuuacaacaaaaugcuaacuaaaaauguaaugauggaauuauaaaaucaucauuuggcagccaucauaguaauagaguaauucauucaagaaauauuaaugaauauuaaaacuuccuguugccaagugaaacguccauuccaguggaugaaugggauauacucauacaaaagugucuccuuucaaagcauuaaugacaguggagaaaucugcagacaauaucugaaucaagugaucaaaguuaacaccaccaguaacgggaaaaaucaaaaucauauaucaugugauaaaauguaaugagaguacaauacuuccaggauauuucuaccaaagguauauaacuugaaucuaaucauuaaacaucagacaaacccaaauugagugauacauuacaaaguaacuagcugcagucaucaaaagugucaaagucaugaaagucuaacguuauuuuuaauucaauuuuauucuaguuuaaaaacaacuuuacugagguagaagugauauaaaaaacugcacauauuuaagguauagaauuugaugaguuugcacauaggcauacaucuaugaagccacugccauaaucaaaguaacaaacguaucuaucaccucuaaaagcuuccuugugccucuguuguuuuuuguuuugguuugguucuuuuaaggacacuaaaguuuauuuuuuaaguguuugaaaaugucacaaauguaauauguuuucuuauuaacagucuccagcccuaacaauaggauaauagcugauuaauaaucuacuuugauagccaaaauaagacaaaaguacaugcuuaugucaaauuucaaagcaaagcacaaaaauuuucuccacugggcaggugcucuccaaaacccuuuaugauaaaccaugaauccuuuaauguuacauuuuaaucccacuuguaacccucugucucugagccucuucuagaaucaccuucuuuagacgaggaugugaauaccauuuaaaaaaauucccaguuuacagcaucuuaacccaucccccucucuacagggcacugaccaaguuccuugaagaacauaggccccugccucuuccuuaaggccaacaccgcugagaaagucaacgacgcaucaacacacacaauucccuaaucacaacugauaaccaauucugguaacaaacaauuacagaacaacaaaguaauucauuuaguucacuugaaacaaaaaugcagcucuaaacaaauaauaaucaaaugaaggcugacugaugaggaacagcaaagauaucagaucugaucacaggaugcuuugggcaaagguuuuagagcaggguaaaacuccggggagcuguauaagauucuaaauuagaaaaugucaaacuuaagauucuaacauaaauaaugaagcagcaauauacaguaaccauuauauuuugguuauuacagaauucaguauggcauuuuaaacuugaaaaaucuuauauaacuauuucauuagacagugacuguuaugccaucauccuuguuuugcuccauuuguaucacucaauaagaugagaucuaaaguuuuucuguuguuguuuuaaaaaaaaucuugaccaugugacuagcaacggucucaguuguuucuauccacagcaacaucauggaaucauuagccucugaggcugccuucagagacuuguuuccauggcaacagaggcuaugauauuaacaccgucacaaggaaauuguaaauuucuacaaaauuggauauauuguacauauuuuaaaguaccuuuuaaaaaccaguaucaaauggauggcuaucugaacaaauguuuaaagugauuuguuuuuagagauuaauuuucucuauagcuuuauauuuuaaaucuaauuuaagaucuuaaaauuauaaaagcagcacuuaaaacagauuuucauaaaguggucugaacacucacuacauacagccauuugcaucuguucugcacauccacauuuaugaccauguaccgcccucccucacuuugauucauugaaaaauaaauguauauugaaugagccuacuacuuuuauuaaagccuuuucugcuuaaagcacucaagugguuuucauuaugugcauaugaacccugauuaauacaggaagagacagaagggacaauuaggaguuuacuguaauaauccagcugaaagguuauugguggcuuaaacugaauggugguaauggacauaugagcagucaaaucaagacacauuuugaauguagaguugguauaucuuggugacugaugagaagucuggagugaggaaggccuauuaacacucacaauagccacuaaaaaugaucuuuuauacaagaguucgacucagguauaaaagaguugcaaggcuaucuaaauauauuuaaaaacauuuucucacuaauuuauuaaaaugacuuucauagcauaagaugcaacuccaaagacgauaaaugaacauacuaucugauagcuaauaaugcuuauauuuuacauuaacacguuauaugaaggggguaaacugaccuaagaauauacacaaagauucacuacuguaucuuuuuaauucaacuuuuauuuuaaguucagggguacaugugcaagcuuguuacacagguaaacuugugucacugggauuuguuguacagauuauuucaucacccacauauuaagaauaguacccauuuaguuauuuuuccggaucuucucccuccucguacucuccaccccucacaccggccccaguguguuguuccgcucuaugcguccaccuguucucaucacuuagcucccacuuauaagcgagaacaugcgguauuugauuuuuuguuccugcauuaguuugcuaacgaugacgcccuccagcuccacccauguuucugcaaaggacaagaucucauucauuuuuauuguugcauaguauuccgugguguguaugugccacauuuucuuuauccagucuaccauugaugggcauuuagguugacugcaugucuuugcuacugugaauagugcugcaaugaaccuaagcguucaugucuuuauaacagaacaauuuauauuccuuugaguauacacccaguaauaggauugcuggguugaauuguauuucuguuuuuaggucucugaggaaccaccacauugucuuccauaaugguugaacuaauuuacacucucaucaacaguguauaaguguuccuuuuucuccacaaacuugccagcaucucuuguuuugauuuuuuuuaaaguagccauucugaauggugugagaugguaucucguggcuuugauuugcauuucucuaaugaucagugacgcuaagcucuuuuucaugacuguuggccacuuuugaacagugucuguuuacguccuuuacucucuuuuaauaggacuguuuuucucuuguaaauuucuugaaguuccuuauagacgccggauauuagaccuuuuucagaugcacaguuugcaaaaauuuucuuccauucuguagguuaucuguucacucuguugacagcuuccuuugcugugcagaagcucuuuaauuagaucccacuugucaauguuugcuuuuguugcaauugcauggugucuucaugaugaacccuuugccuguuccuauauccagaaugguacugccuagguugucuucuuagguugucuuauagcuuuggguuucacauuuaagucuuuaaucuaucuugaguuaauuuuuguaugcacacuuccauauuuuuagagaaaaugagauauaugaauuagcaaaucuuuugguaccaauaucuuagauggcaaggaaaaguaucaacugucgugucacuguggguuaguaaggaucuuauuuugguuuuguauggcauaauuaauauuccuaaucuaaguucuuugguucuuuguuuaaagauguauuaugcuguaauguggcauguuucucugauuaaaugucaaagaagcuauuuaaaaguaagagagaaacuaaaaaaaacugcaagccuuuugaauguuuauagaaggauaaaauauagcacaguagauuuauaaaaacucugcuuaggaaucacuguacucaacgggggcccaguaccuucagaaaaagcugauuuuuaugguuuaaaucuguuuuuuuauucaaauguccuuugguccugucacugcaaacagguaucuuucacauaagccgguauaguaaaaaaccaacaauauguuauuugaaccagcuucauaugacuuccaugucauaacuaucucacaagcaaacaauuauaaaacuaaacacauuuuuaaacaaaucacuaaggguauuaaaaucauuaaauuuaaaacaaaacaagguaaauaggaaaacagaucuagcaauuaauuccauuacagaaacaugaguacaaguguguuaguucacacagacagaucaucuaguucaugaaucuaucucuaccugugagacucacaauauucaguuaagguuucucaucccuccauuaugaaaagacaguauucuaucagcauucagaugacaaucuuguccuaguaaaggaugagccaaacacgaaacauuucaaaguaaacagacacuaaaacuucaauauaugguuacauaauugacaaauggggauaaaauuaccaaaugcaauaaugugcuuuuuuaccugauuuuuaucagaauguggcuagagaaauaagcaaaaccacagacuucaugacuaauaaccuaaaaugggcccuuaaugcuucccaguaaucagauuugccuuguauuauucacccucuacaagucuguaaggauucaggucccuguuaucacucucucaaguugccuucuucuauuucccccacacaaauacacacauuuucuauuguuucuuuccuuuauuuuuccuccagaauaccauauacacucauacgucacauaucaacauuuugguuaaugaugguccacauguauaaaauuauaauggagcugaaaaauuucuacugccuagugaugucauagccauuguaaugcugcaguauaauguauuacauuuguggugacgcuggcguaaacaaauauaccucacugccaguuguacagaaguauaauacauauaauuauguacgguauauaauacuucagaaugauaauuaacaacuauuuuacugguuuguauauuuauuauacuauacuuuuuaucuucuguauaauuauauacaaaaauaaauauacaccguauucccauuaacugacaugugacugcauuuuggauaauuauauuuauuaucugucuucuucuacuuagagcagauuucuguucuguucacuccuauaugcccagugccuagaaaagugcacacaggaaguauuuaauauauauuuguugaaugaauaaaaccaugcgacugucaaaagaaaucaacuuaaucagcacucuaaaaugacuugggcaauagauuggguagguacagucuuccuuccccuacccacuuucaugcaauauacauaguagacauugcuaaaagguuauuucuguguuucugggcagccaccaccaaucagaagguguucaagauguuuuacaguuugauaaccuuagaacagaaguuucaaaauguaaaaaauugccaguuucauguuguucucuaucuagcaauaaugaauugccuaauaaugucccauuugaaaauaaacaugucuuggucaagcauauuugcuuaaaauauuuucaucgcuuuucuauucaaacugcauuaggaaguacaacuucuuacugagggcucauauuuaaaauccauggugcccuuccucugagguuccacuaauuucagcuuggguccuuuguuccccuacagguagcuacuucuguaaguuagucucgauuuuaccuuggcauucucauuuugccuuuccaguucuccaauacucaucuaaccaaucccauguaguguauuuuuauuguuaguugcugugguuucuguuucccuggcugcacccuauuaaaguuaccaacccucuagcuaaaacaugguugcuucuccguaucucuagauuccucauuuaaaggucagaauauuuuguugaaaugaaaaugauggugguggcggugguagugguggauaaaaggguaguugauaaagaugaugaugaccucacugauguaauuaauguauuauaauaagugcuuugcacauauugucucauuuaauucucauuaaauuuugaaaaagauaacacuuucauccccauuuucuacagaugaggagacagacuccgcauggagguaauuugcccaagguggcacaggcgauauggcagaauauaaauuuaaauccaggucaucauccucuaaagaugguacacuuacccaguacucuuuacuuaucucuuuaaaauaguucaaaaagagauuuugucuuuauuguuaccacuacauuuuacugcaaagacaauauauauuaccuguaaaaagaaauacauacugcaucaauccuuagaucagggguuagcaaacauuuuuggaaaugacaaaaaaagaagcguuauggaccaugcaguaauuguugcaacuauccaacacugcuauuguaguucaaaaguagucauacacaauacacaaauaggcauggcuguguuccaauaaaacuuuauuuacaagccaggcaugguggcucaugccuguaauaaucccaacacuuugggaggccgaggcaggcagaucacaugagggcaguaguucaagaccagccuggccaacauggcgaaacccagucagucagguaugguggugcacaucuguaaucccagcuacuuaggaggcuggggcauaagaaucacuugaacccgggagguggaaauugcagugggcugagaucgcgccacugcacuccagccugggcgacacagugagacucugucucaaaaacaaaacaaaacauuuauuuacaaaaacagguggcaggcuacauuuggccuacagauuguagcuugcugacuccugcuuuagcugcuuuuaaaaaaggagaaagaaaaggcuaaauaagucaaugaagaaaauagaaaauggcuuuaagacaccuaaguuaacuuuuacuaacuauaaaugguuuaauucuguugcaauucuuagucuacaauaaaaauaagccaauucucucuccccaaaaaccauggaagcgacaauuuaaaaaacaaggaaacaagauauacauauggaaauuucaaguuucaccuacaguucuuuaaaauaucuuuaauuaaaaagucuauauaauaaagcugugcucuuacaacugaaaaaauuuugccucuauacugaauauagccuuccaguuuggaaaaaaagugauuaaaaugauaugauuuuuauucucuuuucuuuguucucccuucaaaauccugcuaugguacuuaguuuggcuaaagcaauuaauucuuaauauugauaugcaucuuguuuguuuucuuucuaucuuacaaaauacuuuccaacugauuucuuuccaaauuuauaacccuuugauacaucagaucauccuaccaagauuagucagauuuauauacagauaaaugagggugggaucuguuuuaauuuaaaugccaguuuauugcucuugaacguggcuguuaaaaaaaaauuaacaaauaauuaaacaccagguuauaauccccaauucuuuuucucagaacaacaaaacaacacaaauuguaaagcaaucauuugguuccacucugucacagcuguaacuucuucacauuucaaagcugcuccagucaagaagucagaguuuugauuucacagauacugaaaauacuguucagaaaugcuaccaaauuggggcuuaaaggaaaaagaaugaauaggaagugcuccuguuacgaagugaggagggaaaaucuuuuaaauaaaugccuggaggggcaaguugcguguauaggcuucuauaaaauuccacugcucccagguggcacugccaguugguuuguauuugcauacgccuguuaaaauuaccacaucaguugguuuaaaguuuucuuuaaaaggugguaacuguaggcuacuguucucuacauagucugaacaacuauuuuuaccuuuaucaaaauucuaaacuuugcuauaaaaauggagggcuggaaauguuaucuaaauaauagugccaggaaguacaaggaauaauuuaagaaaauuuauuuaaagagacugauacuaaguaaaauuuucaugauaaaaauuuaaguucuucagauauguaagaguauaaaugcuucacaauuuuuucacagaaggaucugaauuacuucugaaauucacaacuuuacaaaaucugguaacauagacuugcuaguuuuuaagccauaguguuacauaaaaauggcuugggaaauuuacagugauccaacaauauuuagaaguuccaaacuuccacuucgucaacagcagauuaaauaaaaauuaacaccuguauaacaucuguuuauucauucaacaaauauuuaucaagugcauucuccaugcgaggcucuggggauaccaagggaaaaaaccacacacccuguagcaucagcucuugugaaacuuacaguuuaguggcugacauuaaacaaaaucauuauccaaaugacuacugaauuagagucgugauaagagguaugaaguacaauucucaugcaaacaaacauuacuugaaaauacaggagaaaaauguugcucaggcugacuugcccugaucccauaagcaugguucagucacuuuucagcacuguuauuaacacauuauuuuaaagguuaacuuuaaaacuucucugaauauauuuagaauauauaaauuauagccugugaaacuucuuuuugccuaucuauccuugacagaaacgccaucuaaacaaucaagacacuauacagaagcuacaaagaagaauaaaacacauuuccuaacuauaaagaccuuauaucauaaauuucaaaugucuucaagcuaagccaaucuaaucuacauuaagacaccaauuuuauaguuuuuaauagacuuuauauauuuuuuuagagcaguuuuaguucccauaugcccccugcucacacacauaaacuauccauaaucaacaccccugcauuucuaauguacauuuguuacaaucaaugagcccacacugccacaucacaaaguccauaauuuacaugagaguugacugugggggcuggauauuccauggguuuugacauguguuuaaugacguuuccgccauuauaguaucauacagaauggcuuuacuguccuaaaaauccucugugcucuauuauuuaucccucucaccuaaccccuggcaaccacugaucuuuuuauuguuuccauaguuuugccuuuuccagaacgucaucuaguuggaaacaaggguguguauccuuuucagguuggcuucuuucaccugguaauauucauuuaagguuccuccaugucuuuucauggcuugauagcucauuucuuuuagugcugggugauauuccauugucugaaugcaccacacuuuauccaugcacacacugaggaauauguugguugcuucuagguuuuggcaauuaugaacacagcuguuauaaacaucucuguacagguuuuuggguggauguaagcuuucaauucauuugggcaaauaccaaggaguacaacugcuggaucguauggucaauuuuguaauuuaaaaaagcuuauauaaccauuguaaccaacuacuuuugguuuaaucuucaucucuaugcuuuucuagaguguccuauugaacaaaugauauaaauuuuauuuuuauuuuuuauauuauuuuuuauuuauuuuuauuuauuguacaaaugauaaaaauguguugaaacaguguuuaagaaccaauuuuugagucaguacauguaggugcacuguaaaaguuuccagaaaaacagaaacauaaaauagauccuacaauauuuuuugugucaaagggggaacaauugauuuccaagucugagucaucauauuaauuucgcaaaguuaguagccuuuugaguagaaaauuaagaaacaaaugugucugccaagggucagcaucucacagccaguacaacagcguuuccauccaaacugugaauguuuggggagucaauaccaaaggagacuauuuccaccaauuucucuggaaaauaaccuaucaauuagagucaguauuuucaaagcaguuuaagaagauugucuaccuacccuauacguagucuacuuuuuaguacaaaagcacuacacuaaugaauaugaacaauuccauuccuuggagaugaagaaaaaauauuuuaucaaaacacaauuaucauuacacaugagacaaaaugaaugugguauguaccgauaacacgguuaggucaaucaaucuaggaugguccaagauggagaugucuuggugugaauuucagaccuguugccuggugggaauagucagaaaauaaaugguuauaacagagugaccccauaugccucuauuuacuugggaagucuguauuuaugccuguugucucacuuuaauuauuaaugauucccucuuuucauuaaaguauccuaguuuggucugaguuauauaguuaucccaguuuugaggaaauugaauucucuucucucccuaccucauuuccuuguguguauuucuucucagagggcaaguaagaaucaucaguuagagaacuauuacaaugcuaaauaaagugugaugcgcgcuucacagaaagucuaagggaaaagacagacaaacacaccugcuugggcccuccuuagcacaaguucguaugucccugucucuucacucauucaacaaauauuuucugguuaucuacagugugccagccacugucacagaaacugaggauacaacaauaaacauaacagaaaaaucccacccacauggagcugacagucaaguaaaaagacaguaaaaaauguauaauaaagaaucagguaagaagacagaguaaugucuggagugaaggggugcuaccuuagaggaagcaaaaaauauuaacgagagaaguuagaugucuacugcuguaguucaggcaacauauuauugaaucaguaguugcagaaguguugaaaaguggccaaaucauaaauauaucuugaauaaaaagccaacaggauuuggcaucagacuggauacggagcaaagaaaaaaggaauaaaagauaauuuuaaggguuuuugucuucagcaucuuagugaauggcauacugaauaaagaagauugagaccaauaaaacuagaaauucucuuuuuaauauguuaccuuucagaugcuuaaccgaaguggagauacugaguagaaaguuagauauaaaagucuaauguacagggauuaacucuggaauaaagagaaauacugaugguauuuaagggcauaggacuagaugcgaucaccugaaaugugaguauaaaaagagaguucaaagacugagcccugagacauuugaacauuuagcaguaggaaaaaggaggauacuauaaaggaaaaugaggcugguagaauauuaaaagagcaguacuauccacgagucaaaggagaaaaaagaauuuagaggagggaguaaucaauuguguuaacaguuguuguagggucaaguaaaaugaacacugagaacuggccacuggauuugauaaucuacacucacacaacgaggguuuuuuggaugguuguuuuaaugaaagauauuauagcagguguacauccugauaggacuuauagaggcaagucuaggggcaguacagaggcaagacagaugaugcagugaagagagaaagggauuucagaaguucuugaacaaccaaagggacuacgaucuaguacagaagugaauauggguaagcuuuaggcacacaguucauuuauuuuagcaggcuggaacacaaagcaagauuauuuauuugagaauaagaccaggaaucagguauuggaaguuuaacgugcagucugcgaguugguauagagaaggcagagcugcaauccggauggucuggacuuucuguggugacaggcuaaaagggauuuaggaucuaaaaauaguccucaugauauguuugggggaugcuuaggggagcuugguaccaaguggauaaucacuuaaauuuagucaucuacacgugacugguuuucaccaauuuguagaagggagugcuaggaggggaggaaaggucaaaaaacugguagucucaucaagaauuucaaaggcucuuuggggcaccucccuuaaauccuguaauuaaagguguugagaucucugguucuuaaaaaaaguggauggcuuguacuuacaaauuaacuuaaucagucaacaauauuuacugaauguuugaauguacugcgcuauccuaggugcaauaauuccuaauaaucuauaucugaauuuguucauauacuauuagaguuaaaugauauaaaaauaagcuaacaggggcaccuaacucuaauguagcacuuacucugugucagaugcuguccuaaguacuuuauuaauauauacauuaaauuauuugguagaagugacucaaugacacugauacuguuauucucucuauuggacaauauauccaaugcauagcucuaaaaauuaaauccucuauaacucagaaggcaucuguuucagacaaacaauauuuuuuaaaguguacaaauuagccuaaauauuuuuccacacaggcacuugaacaauguuuuccuauauuuuugacuuaggacaggguuuuuccucuaagcagauuauucaacucagcuaauauuuacucuuuaagaaaacuuuauuauucuauuucaauucugacaaguuuucaugucuguuccauauuccuaagaauacagcuuugcugcucucagcuuaauuuggcauguuguguuuuuuuuuugggggggggggggcuuuuugaguauuuauagugcucuauauguugagauuuucaaguaguccaaaauguaugaauagcugcuauacacacauucaaaaugacugaacacuucacaguuauuuaaaguucauaugauuacuacugacauuaauaaacgucgauaucacuaaguaaauaaaacuuuucaccuaggcguuaaucaaguaaagucuagcagcacugugcuggaguucuauaaaacccugcugaauauaaaaacuggucccagauuggaacaggacuguguaugcuaaguaggacggggccgauuauugagugacccucaacacaagaauaggagggacgcugagggugcggaaccaaggagggcuucgcaaugcauagagaacuuuuucuauacuaaucguuugaaauuaaggacaaaaacacuaugaagccucaaacugaaaaaguuucaccaauguaauucauaagaaacucauuuuuauuuaacauuaaaaaauaaaacaaccucucaaaaaacccacaauguaaaaugagauacaaugaaaugauaaaacugagagacaguguguaagcuauuugguuaucacuacugaguggggacugaaaggggugaggaaaucaggggaaucggggcagugugacuggaggauaguaugaagaauggaggggaagaaaaggcaguggaaaaggagaugggcugcugugaaaaaccaaagacacuugugagggaagagagaagauccaaucaauacagguacugaagagguauuagauuaggugucauauuuuggaaggccaggagauaacauuugaggugaauggaauaaaaauuaauuaauucuauaagcauuuauuaacaccaacuacaugccaaacccuaacugagaagcuaggugucuugcaaaaguuuauaaccacucaguuuccuuaucauucaaaaaacauuaaugacuuccuccugaguuccaguaucauaguagaaaauggcacauaaucuuaguuaugaacaugaauaccuccagcagacaagcaauuuaaaugaaucuguaaaauaaguacagguucuuuuuauguauuguguauauuuggggggauauuaaaucagauacuuuucauacuguauuugggggggauacuaaaccagauaguuuucauacuaauagaacuugauuuauaacaacucuccaaucugcaaaaaguaucauguggcuuagucauauggaauuagauucaaaguuaaucuuucugucaaaucuuagaguauuuuugacaucagugaaauaagagaccucuguuauuuaccaaucgcaguacaaaacacuaugaccuuauuauauucauagguauauauuauaugcucuaaguaugaaauuucaaucuacguuguuucuaacaauaaaucccuuagugcugcaaaagaaagcugccagccaugagucaguaagugcaauuuaaaaaaguauucuaguaucaaguaagauccaauuauaucucaaguuauuuuucagucccauuauauuuuaacuugucaaaucaacuccaguaaguuauaaaaaaauuaagauauauaaacuauccaauguaucaguuacaaaaauguauaaaaugaaaaacaaaauguugguacuccagugcaagaaaaacagaagcuaaaaccucuacccuaauacuccuauuucuagaaauaaaauagaaagguaaugaaaaagacaagaugagaaucaggaaagaggucugaaagaaauaaaaacuauuaauaacucauauacuagcauacaggaaugcucugaaccaaacugggugggggcugucauguaaaauggcuuugcagagcugacugcgaacaggggucaugacucucuucuggcgcaaucacagcaacguucugcuccuacucccaagcggcuauaacguaacucugugguuucaacacuuuauacaugaacuacuuuuccugucuuuucauuugccugcuuuuaauaaaccgagugacagauauaucaaugcuaguguuaucugugcauacauauauagaagggugugcauuuacauaaaccauauauauauauaaaaaguucuaaagauaucugucuuguugacaauggaaaauaucaucuaguauuaaucuacaaugaauaacauugucaaccuuuagucuuugcauccuuucgugauauauguaauugcagucaaaauaagguuaguaaaauucuuggggcaguauucaauuuaagaguuaaaucaaucguugcccauucaauaaguuuugauuguaacuuaaccucaaugccuacauaaugacucccccuuccuagguaauuccauuucucccaaauauuugagaaaaguaaguagaauuucuuacuuaagaaagcugauguuauuuuaaaucaacaccauuaaaagacaauucuaguaaccaaaaacaguaaagaaauuuauaaaaaacauauaaagaaauauagaacuguugacaguuauaguuuauauuuauugagcugcuucuauuauuuucuuuaaaagacagcuuuaagggaauuuauuuuaaaagguccuaaggaauguguauguauguauuuuccuaauuuaaauaucacugaugucagaggacaaaugcauucucaacuuguuuuuagaccauuucucguccuuuuauuuuuacuaaaguugaacugacugcuuaaaaauauuuagaaauaugaauauuuccucaaaccacccuuguagcaaacaauagguauuucaaacaauuauuaauuuuucuuuauuuuuccucccauagacaauagcucauuuccucaaaaagugguguuaugugauuuuuuuuaauuuugagagacuuuuaguauuugcucaucucuuuaaauugugauuugacuaugugaaaaaauauuccaugacuguguaauugcacaaguucacuuaauuucaaauuaagcuagauaaauaauauuuacaaaaaacgauucauuaaaucccuugaauaagccauaauauagcuaagaugucaguauauauaauacuagccaauuauauuaaauugaaucuauuuucaaaacacugaaaaaugaaaauauuucaaaguaucuucuguuucuuuacuguaacagucucccuaagguuaucuaauaacauacaaaaacuaaacaaaucagcauuuucuuuggucagacaucauacucuacagcauuuagcacagucuaaaaaggagaugagcauuauuaauucauauuuuauguaucaaugggcuuauauuuuuagaaaagucauucaauugaaucugaggcuauuuuguuugguauuacauaagagcauaaggaaaaauauuucuuguucccccuuuugugcuaaagaccuacacggauggacagaaaacauacauuucuacacauccaagguuucaaggcuauucuuuaaauaaaaaaucuauauuaagacauuuuuacagagcaaacguaaacagaaauagauugaaaauaauuucaacaagugguauguuaccuggguggagcugguggcuaccgagaugcagucaauaaagcugugucuucgagugaaaaaugcaacuaucugcugccagcgugaagguucuggcucagcuugcaguucaucugacgagcccuuuuuugcccaguguuucugcuuugggccugcugagccauggcuagagcuaguauugccuccucgacugccgcgagaguauagaaguguguuguuuccgaaaauguaauucaucucugcagcccugcaggugguugccaagcaggcuuacuucucuaccagcugcugaguggugaaugaucgguaaaaacugcagcuacaauuacagcagcaucacuuguagaucagugaaaauaaaaaccuugagaaaugaugcucauuuucucagugauuucuuccuaugaaagagcucguaucuucccucuguaccuguuagcuguaugauggcugaguuuauuuuugcagacaaaaaagacgacauaagguggauuucuuucucaugauuauuuuuucaccagcgucugcaggaaccaaaagcuguucuuuuguuagcugauaacuagauggauugaaauccaggaagugaggucgauuagcagguaaagaaggaugcuauaaacacuggacuaccaagacccuguggggcugccugauuuaaugcacugcguggaaaaacccuggauuaccaaguuucaaccacagucuguaguaaaauccaauggcaccuucacugcuuauauaaauuauaaauaugaacugaauuaaaacauauaagaggauucucucugcaaauaguucugacuguuaaaaugauuucacuaaaagaaucuuugucauucauauccaaauuucuacaccaggcagaucuuacacauuaucuggcacuggcucuaaguuguucaaaggugcugccuacauuaaacucugacuaucuaacgauagcgcuucauuacaaauggauuuuccuuuaucauuuuauguaauguauugguuuuuaaugauuaacaacugggucucaagguagauuaauuacuaaaacaaguauuuugcuucuggaaccuuuaugauaaaaaagaacuuucaagaaauuaucagcaucaucucucuaguauuuuauaaacauucauauuacaaggucauaaauuucuaaaaaugagaaagaauuaacgcugguaaauuuuucguuuuauaaucagugaaauguguuuuauccaacucuacauaaauaccacucugguucaccaaauacuaucaccugauugcuaaaggaacauauucuaacaucuaauauuuagguuaacauaauaguucgccugagaauugccuggggcgcuaguuauauaugcagauugguguauccucuccccaucaaaauguuuacgggcagggggaaccugggaauuuuuauguuuaaaaugcuucccaagugacucuuaaguaccuucaaguuugagaaccacaaacucccaagcaagcccucuuaacacugugcuauauuaguaauuacaacaauggucauuuuaaaacaauaugugaacaaaaacgcuacuugauaauuuacuauugguugaauaaucuaauuuuuaagcugauaagagcauaucguaagucccaaccucagccauggauauuuuuucggauguggacugacagaaucuuccuugucuacgugcuuaccagcaccaacuggaugcagccuuuugucaaacuacaauguugagguccacugcaaaucuugacuccgcaagaaaacaugcuaaugcugucucuaugaugcgucugcugagaagugaacaugugcucaguaagggugagagccaugugggacucuugagggcaagauauuuugugacagagauuauaccagaaaguuuggugcuucuucccaaggacugugccggcaguagcugacaauuuauggccccagagugauccuaucuaauucggaguagagaauguaagaaaauacuaagggcggacagguaacuaagaauccucuugugaaggaaaaaaugaaaccucccagaaaaaaauucaaguuuuguuauggaccagguaccuaguaaagaccugauuagugugguuuauauaaaugcuacgguaauuggucuggcccuaaaauaugugccuugauccaugucugaugaaaacuucaaggggaggagaaaacugauauggguucuguuauucugaauuaguauggaugaagauacugaauacaacuguugaaugcaaaucuccuaccucaaacuguaaacaguaccaaaagacauacaauaguaggcucuuagugagcaucuauuuauccuacagagccagagaacuuaggggucaaugguaggcucuuagugugcaucuauuuacccuacagagccaaagaacuuaggguacaaucuaaaguugacagaucacugccucccauauuuccccaauguacagggaagaaauacuucuugaugcaaauuuccuauccaaauccauucacaucaagaaaacaacuucaaguuuugggaaagacuucuuuaugaaaauguccuguuacaugaccuacaaaaaucuaggaacaccucauccauuggccaguagucaguauaugcacacaaaaaaucuauaccuaaaucacaagagggguuucacaugagauuagacugggagguggaaggcggaaggcaaccaacuguucuuugcuuuagaauauccucucucauuacacagcagagaugaaagauaaaaacuccauuaaaaccaaauuuaaguucauuaaagaaaaaccuggaaaaccuauuuaaaauaauggaugaaaagaugguaugcaaucuaaaccaccaaaaggaaucacuauuaacaucuuaauaugauauacaaagaauauucuuuuuuccguaauguguuuucuuuuucagagugauaauauaaucuauagaauucuagccuaaacaauagagaaagcuuaaguuaguaaacuaaauacgauuaguucaguggauuacuauguaauucaaaacaugauuaugaaaaauuuaugacuaugaggaauauuuacaauauuaaaugguaauaaaaaguuaaaaauuuauacuggauaggcucucaauuauuuguguacguuucuaaagucacaaacccagcagucuuuagguacagaaacaaaggcaaauacuaaauaaucuuuuauuuguuuguuuuugagacggagucucacuacguugcccaggcuggucuugaacuccuuggcucaauccaugcuccugccucagccacccacguagcugagguuaccaccaugcccaguuuacuaaauaaucuuagugaaaaauguaaaaagguaaaggacaagaggaaaagcaauacugaaacucuaaaguacaaaaaaaacccaccaaaaacccaaaguaacuacaaagcuaauguaacguaaaugcaauauaacaggcauuuuuauuacucuuuucuaaugugggcuauuaaauuucaaaacauacaacuguauugagauaagacaagacugagaagagugacaagaacacagauuugcuauuuaucuagaaaacccucaaugucacacauacaaaaucccuucuguaugagcaccaucuaguggucagugcaugcaaacuauaugcucaccuuaguauaccagguccaugauaaaauucaaucauguuucuauauguuccagagauguaaagauaaaguugauuucaaaaacugcucauuauauacuagaaacaggaaaacuucuauuccucuagcauuugguucaaaaggcuuauauuugcuuguguccauuuuucugccacucccauuucuuacaauuuuuuaaaaacuacuaagagcugcuagugauuucauuauauucucaauacuacuggaugaaauaaaaugcuaggaaauauacuuauuuagcacaauuaucugcucauugacccuguuuuuucuguuugauuucaagucccucuuaguaauguuuacuuuguauacaauaguuugagcauaauuuuccuugccauugaagacaaaaaccaaauauaaauuacuuguuucuucaaugaucacugcauccucccauacacucaauaauacuccuacuguccucccuguugcuucauguacauuucaaacuuuuugggaaaaggcugagguuuuuauuuguucgauuuacuguucuaacaauuuuuccuaauucucagcucauuuucaguuuuagaaccuugacacuacucuuacauaaccccaaaauuuacccacuguguccuucucuucgacauuaagauuuuuaaaaaacuauuauauccccuauuucuuucuugauauucuucccaacacuggcaagaaaguaucccuuucagagucuuaaauuauaaaaucauaauuaucuuuaugccaagcccugaauaaaguaacccaaucacuaucuuacuuuacucauuauuccaguaaggagagccaccaccauccacuaccaccaccaccaccaccacaauaaucuaauagauuaauucacggcauguuucaugguggcaaaccuuucauaagaacauucaucauacaggucuuuuagauuuugcccucauuuccuaacaugcacccuaaguaucagcaauaauaacauaaaccuuccugcauuucuacaguuucuugugauugucacccuuccacuguauuuauuuaccccaguaacggccuccuccucugacuuggcaucuuacacauccuucaacacuuuaugcaaaugucaacuugcuuuuuucagaaaacuccaagaauuuaauuucucccucuuucaugucacaucauacuguguuaacuaucuuuccguaaaaaaauacuaaucacugaugucuaacacaguuacuagcacagauguuuaauaacuguuugcuaaaugcauguauugcuugacacaacuaauauccuagcaguugauuuuuaaagcaucuauuaaauuuuauuuuuaccauuagcuuuuauuagaauugugaagacuaaagcugugccuaauuuacaaucuacucagcaaaccacuguuaauucuaagauacuuuuucaaauuauaaaauaauaauucauauacugacuucuacaugcagcguaacagcuguucacuccaaaccacaauacuauaaaagaggaaaagcucucuauauuagcuuuuauuuuaaaaaagagacuacuagucuaauacuugacacuguauuuuaaauaaauuguugagcuucuuauaacauucugguuuuuuaaaaauuaagaugaaaaagcauuaaagcuugccuucuuaugucaaaauaaggguuguuuuccuucaauuccgguuuucuaacaaaaaguuaaaggaacccuaccuacucugcuauaaugcucaccugcuccaaaucuauuacaccccucaaauaauuauuuuacguggcaucugccacaguaaccuaggaaugaaagaggggaagcagguagaaauuccccaaacgaaacagucuuaaucauucuuaaauuacaauucuaucagaauacaaucugucagaaaguuucaagaacuugagaaacguucauauucuucugacucaguaaucugacuucugguaauccauccaaaggaaagaaacuaaauacuuuucauguccaaagauuacucauugcagguuucuuuacaaaaccuaauaaaaauagagauaacagauaucugagagcugacauggucaucaaauuauggugcaaauauaucaggcaauauuauguaucaaguuuaaaguuuuuaaaguuuaaauuuuuaaaaacuugauacaucauauuacacaggaaauauacaagaaaauauguuuaacaaguuuacaauaggaaaaaacauuaacauauuaaagugugauuuagaaacaaaugauagagaauacacacaauuuuuuucugcugggauugaaaauccuuaucuacucaguuugcaaauaugaaucagacagccagcaaaccaaagugagggaaaggggacuagugagggaaaggggacuagugguuucacuuaagaaccccagaggaugguuuauaauuguuucagagacugauccuguuaauaccuaacaaaagagaacaagaugaacaaggcagagcaagagaauggcccacaaagauggccagguuuucagacgcuucucauagaaccagcugaaugauuaucauaauauccuaagacucaggaaagcaugcugguacuuucuugaucuuaacaaaacgugucaggaaagguuuacauaugacuacacaaagaucgccacucagauaaggccaugacaaaaugccagcaacugcaagauuuccaccaauuucagaaaugguaaauguggaaaagguaagucuuagaacugaugauaaaggacacuuuaauuaauaacauacuccuuuaagccucuauaaaauauuucuuuaaaaagcugugagggacauaauccuuuaucauugucagaauaaacaaaaagcaaguauauguaaagaaaaagcaauuuaaagcagauaccaaaaaacugacuucucaucucuuauggucagaaaauuaaggaagaaaugaaucagauuaagaaagcagugaaaaucuuaaaguaugaaugcuuucucucucaauacuaucaauuuaagucucucacucuagaaggaggauucgacaaaugaugucagaaguuuacuuguaaauauuaauagcucaacacagauagcacaguagugcaggaaaauaccucaagcuuugcauucacgggggacuaguuccaggacuagucccccgugaauccucgcauacuguacccaaauccucacauacugaaguccugaagucagcuaugcacuuacaggaagucagcccucuguauacuuggguuuugcauccuacaaauacuuuuauguuugauugcauuuguuugaaaucugcauuuguuucauccgcauauaaguggagcagugcaguuccaacucguguuguucaagggucaacuauaguagccguaauagugguggcacaaugcuucgcaacugugcccgcacauuagaaacaccuggagaacuuguaaaccucccaaaggccagucugcguuccaauucacaucccaagauugaucaccuugcauuuaauuacaagaaucauauacggagauggcugcuaaaaggguuuugucggccgggcgcgguggcucccgccuguaaucccagcacugugggaggccgaggcgggcggaucacgaggucaggagaucgagaccauccuggcuaacacggugaaaccccgucucuacuaaaaauacaaaauauuagccaggcgugguggcgggcgccuguagucccagcuacucgggaggcuggggcaggagaauggcgugaacccgggaggcggagcuugcagugagccgagaucgcgccacugcacuccagccugggcgacagagcgagacuucaacucaaacaaaacaaaacaaaacaacaacagaaagggggguuuugucauauuaaucuuugauuuacacaaaaagucuucccaauuauaaugaaguagguuuucacugaugaagguaguggcuuauuaaucagcaaaaugggauuucacuggugaaauccauagcaucccaguuaugugaauuuuuugaauuaauuuagagacauaauacacccuugcauaagggaaacggaagacucuggagaggccuaaacccuuagggauaacaccuuagguuuaaucccuaagacaucuggagacucuggguaaacaaaaucuugugucuggaacauuguuuuaucugcuuagaaugagcauuuuaggcaacaacggaaagcugagguuucaugagauuuaaagaauaggcuacauaaaauaugcaugcuggcucacuguuuaaaugucugcuugugucauaaucugcaaacacaccaaaauaacuacuaaaauaccuaccaaaagaccagaguuggccaugugcaaauuggcuuugguugguuuguaacaauaaggaugaccggaaauucaaaacaucagaaauaaaaaaauuauacauauccugggaguguuuuuggacaaaaauaauaaauaaauuagauuaacucaaucaagauaaaagcaggcugacaagaacagcacauucaacaagcaguguuagggcuuuacccgugcugagguucuuauguugucuggaguaagagugaauggcauuuauuuacuuuagacuuuuaaaaguuaaacauauauuaaaauuucuacaauaaccacuaaaggaagagaaacaauuuuuaacuuccaagcuaguaauaagggaaagugagaugagaaaauacaauccaaaagaagauaugagccaggugcaguggcucacaccuguaaucucagcacuuugggaggucaagggaagaggauuacuugaggccaggaguucaaaacaagccugggcaacagagcaagacccugucucuaccaaacaaaaaaaauagccaagcaugauggcaugugccuguagacccagcuacuugggaggcagagcugggaggaucacuugagccuaggaguuuggggcugcaguaagcuaugacugccaaugcacuccagccugggcaacagagcaagacccugucucagaaaaacaaaaacaaaaaagacaaaauggaaggaauagucucuaauguuuaagaauuaaacacgcuucuaaguaacucacgaggcuaacaaaaaacaaaucacaucagacauuaaaaaaauacaauaagaaaacauuacauauucaaacuugugggauacauuuaaaaaugcuguuucaagaaacauuuauaaaagaauacuacuagaaaagaaggcugguaauuagugcaauaagcaagugacuugagaaacuagaaaaacaagaaaacagaauaaacucaaagaaaccaaaaaagaaaaaaauaauaaugauaaaaagagaaaggaagaaaagauagaagaacuguuucugccacuaacugguaaacagccaaaaaaucagauuuuuuggcuguuuacucuccuuaacucucuuuuaguuccccaagggaggaucagauuacuuauacugaacacuaucuuuaauugauauucagcuauccuacauguaacuuauauuuacauauacacauaugaauguacauacauaaacaugucuuuauguauguguauguguguauaagaacagagggguaagggugguggcaaacagggcagggacucaagauaauuguuuuuuuaagacgguucuuugaaaagaccaucuuugaaauugacacuuuuggcaagaauggugacggaaaacaaagagucugaaauaagugauauuaugaauaaaaaagggaccaugccuacauaugcuauagauauuaaaagguauuagcaggauaucauaaauaauaauuugaaaauauaucugaaauguuaaaaauuacuagaaaaaaauagccuagcaaaauuaacugauagaaaaucugaaucguacuauaaccauuaaaaauuuuaaccaguaguaugauaucacuccucaaagagaauuacaaaauccagguaaauuuuacuaguaagaaaugauccuuaaugaaaauacacacaaccaacaaaggauuaauauucagaauauaaaagaaauacaaaucaauaaaaagaacgacccaauacaaaaaugagcaaaaaucuuaaaugggcacguaacagauaaggaaaccuaaaggaccaauaaauauaucauaccucccuaguaaaauucccauuaaaaucacacucagauaccauuuugaaaccaaaacaaugccaaaaauaagaauaccgauugaagagaacauggaucaauuaaaaacuguuagauguuccugcugaaacuggaaaugacacagcuacugagaaacaagcuggcuuuauccacaaagauguauauauaaccuguguuuuuacaagcacuuuuuacacuaguaauaaccugaaaauaaauccauauccaucaaaaguaaaauaaauuguaguauauucauaaaauagaaaacucuaaagcagugaaauuuaucaaugugaggaauguaauacugaguaaagagugcaaguuaaauauacaguaugaguccauuuauauaaaguccaaaauaugcaaaacaauugauuagcaaucgaaauauaugguagaacuuuaauaagaaaggguaaauauacucaggauuauaguuacuucugaggggagagaugauaggaucaagaaaagucacauauuuggaauuuaaagaugauguuaaugcucuuuuuuuuuuuuuugaaauggaguuauugcugucgcccaggcuggagugcaguggcguaaucuaggcucacugcaacuuccgccucccaggcucaagugauucuccugucucagccuccugaguagcugggacugcaggcaugugucaucaugccugguuaauuuuuuuguauuuucaguagagaugggauuucaccauguuggccaggccugucuugaacucuugaccucaagugauccacccaccucagccuuccaaagugcuggaaaugcacuguuucuauaccaacuaauauuuaaaaacaagugucugaaaauauuucagugugugguauuugaaauuuaauaguuauuuccaucgugggaauuuuuagacuuaaagauagcaucacugacuaacauucauuuauaaaauacauauuuaaaaauguuuucuggaguacuaauaagcaccuugaaauucuccauaacuaugaaacuaaaaugggggggugggguagggcgaaccuacaugaaagaauacuucucuccgagcaugagcuauauguauaacaaaaguaauauguaauucauaacaauaauaaauagauacuauccuaccuuuauuggugaaauaugagaaugagaaacaaauccauggacauucucaaucucugauaaguucuucucugagacaugaaccaauucuggaccuaucacuucauuugugauuuguggggaaauaugcucuugaggagguguaucuucauccugauaccuguauuucuguaaagaaaauaaacaugaagaagcccugauaagcaacaugaguuuaauucaaaucaugguuuucauaacuagccaaauacucaauauuuagcaauauaaaaaguauauuuaugguuuaauacaucagaucucagagaaauaggauuuuacuuuaaaaauaaugccaauaauaaaauuauuuaauuuaaacauuagaaauaauucaaagcuaggugacaagagaagacugaauauugauugcucauuucuuacccaauguuaacugaaucauguaucucuaagauaaaauuauuuaaauaaagucaauggaaaagccaaaguuaggcaccuuagucugguuuucuuacuccguuaacuuguacacaaauuuuuuaaaagucagccauuuuaauuucuaccugaaaauuaguucagcagacaaucacauuuuuuauuuuaacuauaaucucucucucucucucucacacacacacaccucuaugcaaucuauuucuaaaaaauuaccauaauuuuaaaaaaagcuuccucacaccaagcugagaaggccuauggcauaaauaaagacacacugagauaaaauauucuuucccaucacccucgaauaaaccuacucauaaagaaaagacacaaaacaaggcacaauaaaaaaagaauuucaacaagaaaccaagguuuauuaaguugcucuuaucaaugauuuaaaaaaaaaaaagcgaacauaaagugauauuuuuuuaaaaaggcauacaaaugggucaguacccagcaaucccacuacugggaaaaaaaccagucaaucaauugauugaucaguaauuauuccaagaagacacaugcauguucacugcagagcgauucacaauagcaaagaaauggaaucaaccaagauacccaccaaugguggaauggauaaagaaaaugugguacauauacaccacagaauacuaugcagccauaaaaaagaauuaaaucauguccucuguggcaacauggauacaacuggaggccauuauucuaacugaacuaacacaggaacagaaaacaaaauacuauuauguucccacuuguaagugggagcuaaacacugaacacacaugagcacacagaugggaacaauaaacacuggggacugcuugacuggggagguagaagggggugugggguggauggcuaccuauugguacuaugcuuacuaccuuggugacaggaucauuccuacgccaagccucagugacaccaauuuacccauguaacaaaccuacauauguacccccugaacuuaaaauaaaaguagaaaaaaaugggucaguaaacuuagaggaaaaaacgcucagcuucuuuagugagagaaaaaaaaaauacagcaucagcauucagagaaaugggcauccaucaucacauucacaguagaggccuuuuucuggagggcaguuuggcaguauguuucaaaagccuugaaaauguuuucacuccuugauccaguaaucccacuucuaggaaugagagacaguauuaaggaggaauaucaguuaucucuuguauagauaggaggaaaaauguacguuuguaaaugcacaccaaaaaaaaaaaaaaaaaaaaaaaaagaaugguaacuaugggcuugacugcugaaaguuacuauacaaccuccaguagcacuuuuuaaacaacauccuuuugugaaaugguacaaucacacggaaaacaucaaucuggcuuacaucaacauuagcuuauucgauaggauauaagaauaauguuuucacagaugacugcaauuaguuucaaaaccaauaaaaaaagguucucuaacuuuauccuguaaucaaggcugacguuaacauaaacauagaaaaccuaacacaguuuacauacucaguugaguggaaacacaaucuaaguacucucaggaguagauauaaggaaggaaauguggugccaucuuuugaaacucuacagguacucaacaacuuaggauauacuuuagaagagauacauggauaaggauauucacuacaguuuggaauuuuaaaaaacugacaauaaacugccuaucaaucaacuaacaaaaugucuaaagaaauauggcacacccaucguaggaaauucuacacagaaguuaaacugaccaaaaaucuacaucuucuaauaggacaaaguaaaaacauagauaauugaaugaggaaaggauguuucaaagcuacagauauuuauauacacaugacauguauuuucuacauaaaacuauguauguacauaaauauauuuaaaauuuuauauaaaugcacuguuuaaacauuuuuaagcaacacuguauguauguaucauuauauauguguauguguguauccaugcuuaugaauguacguauguaauuuggagggaagugaaaggaauuaaaauuuaaaaaagccucauucuugaaagaaauaauuuuaaaacuaugucuuuuaaguaucuuuuaauuuauaaguucccucuugauccuuuuuuauucccuauaauuauggaaaaacucaaggcauuugaccuaaagagguuccaguagaaugacugcaaaaucauggggcccuucaaugcagaccuuuugcuuccguauuuccuguaaauugguagcuggacgcaacaacuuaauuaaucucacguucaguccuuuugguaagacuacagguggugguguguuauuuuaucagaaagcauauaauaccugucucucuuuuuguaaaguuagcagcucuugauauucaaugccuaaacuaauucauucacugggauuugcaaaaauugugacaaacuaauucuauauuuauuuuucauuaaugcaauggaauacauguauaaagagauacuucaccuacuauuugguuaucuguugguaugguucacacaggugaaacaggaaaaaugcccuuauuuacuaguuuucaagacagauuugaaaaauuggcucccugccaucuccuaaggugaucaguuagguuucuauacagcauucaaugcaaucucuaucaaaauuccaucaggcacuuuucccccacagaaacugacaagcugauccuaauauccacacggaauugcgaggaacacagaauagccagaaauaaucuugaaaaugaacaacaaaguacagggcucacaccuccugauuuugaaacuuacuacaaagcuacauuaaucaagacuaugguacuggaauaaauauagauauauagaucaauggaauugaauaaagaguccagaaauagauccugacauuuacagucaauugauuuuggacaugugugugccaagggagaaagaauaguuuuuuuuaacaaaugauauugggacaacugcaugcaaaacaaugaaauuagauccuuuccuuacacuaggugcaaaaauuaacacaaaauuaaccaaaacuuaaauaugaguuacaguuagaaaacauaaguguaaaucuuugugaccuuaggauuaggaaaucguaucuuggauaugacauuaaaagcaucagcaaccaaagaaaaaacauaaauuggacucaucaaaacaaaacaaaacaaaacaaacaaaaaaauacuuuuguucaucaaaagccacuaucaagaaaccgaaaagaugacccaaaggggccaggugcgguggcucacgccuguaaucccagccuuucgggaggccaaggugggcagaucacgaggucaggaguucgagacuagccuuacuaauauagucaaaccccgucucuacucaaaauacaaaaauuagccgggugugguggugggcaccuguagucccaacuacuugggaggcugaggcagagaaucguuugaagccgggaaguggagguugcagugagucgagaccaggccacuguacuccagccugggugacacagcgagacucagucuccaaaaaaaaaaaaaaagacaaaccaaacaaugaggaggaaaauauuacaaauaauauauuucauaagggucuacuguccagaauacaucuuauagcucaacaagaagaugagucaauuuaaaaaugggcaaaagauuuaaacauuuucccaaagaagauauacaaacagccaauaagcacauggaaagauguuuaauaucauuaaucauuacauaaaugcaaaucaaacccauaaugagauacuacuucacauccaacaugaggaccauaauaaaaaaaagacugauaggugcggucaagaauguggaaaaaugggaacucucauacauuacugaugggaaugaaaaugguacauucccucuggaaaacaguuugaagguuccucaaaagguuacaugaaguaucuuaagacccagcaauuucacucaagagggagaaaugaugcuaauggauauggaauuucuuucugggaugaugaaaaccuucugaaauuaguuaguggugguaggugcacaacucugcgcacauaaccauauacuuuaaaagaguaaauuuuacacuauaugaguaccuucaaauuauuauaaaaauuaucaugauaaauugauggauuauacauagcuggugauaaaaucuauugaaaaaaucuuuucugaagcugaaauugacauaucucuagccaaugggaaucucuuaaaguuucugaguucccuuauacuuguaccuuuaagaaaaccuuuuauaaaaauacaguuaccaaaacuaaagucuauucucuauuauagguugagcaucccuaaucugaaaauccaaaauccaaaaugcuucaauuuucaaaacuuuuugagcaccaauauaucacaagugaaaaauuccacaucugaccuuaugugauggguugcagucaaaacucuguuucaugcacaaaauuauuaaaaauaguguauauaaaguccuucaggcuauguguauaauguguauaugaaacaaauuucaucccaucccaacauaucucauuauguauaugcaaauauccccaaaucugaaaaauuccaaaauccgaaacgcuucuggucccaagugcuuuggauaaaggaugcucaaccuguaauuauucaaaaaagagaaaccuuggguucauuacaauuauuauuugagaaaguacuuccaaguagcuuucagggccaucauuacauuacacagcaauauucaucuguauuucuuguuaucuaaagguuuaucucagccuauuuccaauuuuuuguaacacugaaaacuucauauaaaaccaguuugccaauaaaguagaauguagaaaacuaaggccucccuaaggaugguccaagucuaacuuaccuaacacuuauacuaaaaagaauuacaaagugugaugaggguuagggaugaaggaggaaacauauuuuuaaaugauuauaguaagaacauucuaaacacauuuccucauccuuuuuuauguuuuucaggccacuaccuuugacauaaaacuuuacacugcccuuaaucuugguuaacaauaucagcaauauuauuuuacucacuacuaugacuuacauauaggaaugugacuaaauuacuacuucauuccuguuagauaauuuccagauaucuuucuuuagaaacaauuuucugauuauggaaaugaugcagauuccugaaucuauuagaaaauccaaaauaacuaaaauuaaggccaaaaacuaaguauuuaauaaaauauuuaguacaagguucuuaaaucaauaccagacaguugaacaaauauuauuagugugcaaauaucucccuaucuaccccucaaauacuuauuauuucaguaguaaauuuaaaagaaauauuugguaccacauauuguuccaugcaagccaauauacuucauuuuaagaaaaacagcaacacauuaacauaaaaggagcagugaggcuuaauaugaauucuugaaacagaugaggauuaacauguguugaggaauggaggccaguauuacccuguuaucaaaaccagaaaggacacagcaaaauaauaaaacuauaggccaauaccacuaaugaacauagauguaaaaaccuaaagaaaauacuagcaaaucgaacccgacagcaccaucaaaaauauaauaccccaugauccagugggauuuauccugaggaggcaaggauaguucaacauacacaaaucaauaaaugugauacaucacauaaacagaaauaaggucaaaggccuuauuucaacagacucaccucaacagacucagaaaaaacauucaauaaaauucagcaucccuucauaauaaaauguccaugacaaacuaggcuuugagaaacauaucucaacaaaaaaaagaccauauauaacacacccacagucaacauuauaguuaauggggaaaaguuaaaagcauucccucuaagaacuggaacaauaccggaauacccacuuucaccacucuuauucaacgcgauaccagaagacuugucacagcaauuaggcaagaggaaaaaacaaaaggcauccaaauuagaaaagaggaagaagugaaauuauuccuguuugcugaugacaucaucuuuuaucuaaaaaacucuaaagacuccaccggccgggcgcaguggcucacgccucuaaucccagcacuuugggaggccgaggcgggaggaucacgaggucaggagaucgagaccauccaggcuaacacagugaaaacccgucucuacuaaaaauacaaaaaauuuagcugggcaugguggcaggcgucuguagucccagcuacucgggaggcugaggcaggagaauggugugaacccgggaggcggagcuugcagugagccaagaucgcgccacugcgcuccagccugggcgacagagugagacuccgucucaaaaaacaaacaaacaaaaaacaaacucuaaagacuccaccaaaaaaacucucagauuugguaaaugaauucaguaaaguuucaggauacgaaaucaauguacagaaaucaguaguguuccuauccaccaauaaugaucuggccaaacacccaaucaagaaggcaaucccauuuacaauaacuacaaaauaaaauaaaauaauaaaauaccuacgaauauauucaaccaaggagguaaaagaucucuacaaggaaaacuacaaaacagugaugaaauacauuguagaugacacaaacaaauggaaaaacacccaugcucauggaucagaagaaugaauauaguuaaaaugaccacguugcccaaagcaaucuggaaguucaauguaauacuacaauaaaauacuaauaucauuuuucacagaagcagaaaaaaaaauccuaaaguucauauggaaccaaaaaagagcccaaauagcuuagccaaagcacuucagugaaauaacucagacacagaaagacaaauacugcaugcucucacuugcaagcaggagcuaaauaauguguacacauggaggcagaguguggaaugauggacaaugcagacuugcagggguggaggggugggagggguggaugauaggaggcugucugguggguaccacgugcauugcuuuagugauggaugcccuggaagcccucauuucaccacaauacaguuuauuaauguagcaaaccugcacuuguaccccacgauuauauacaaauaaaacaaaugcaugaaaaccauaacaaauguaagaugagaagaauuacaaaacgagugauaacaauaaauguaacuguauuauaucugcauuucaagucuaucaaggaaacacugauugcugcauuccugaggaagacaaaaaacuuccaaauuucucaaccagauuauagaaccugaaaacacaagaaacgacgcucauuuugaauaugaauucaaauguuuuggaaggaaaaaaagcaaacugaauccaacacuaugaugugaaauguaucccaacaauaaggauggcucaauuuuaagacauucaugucuucauguauuuuaccaugaucaucucaaugaacgcucuaagaaccaccuaagaaucucaaaauuuuaaacccauuccugauuuuaggagaagaaaaacucuuagcaauacagaaauacaaauaaacuuuuaaagcaucuaccagcaaucauauuuaauggugaaacaggcauucuuaaaguggcaaucaaggcaguaucaucuuacucaacacuucucuagcguuucuaaccaauaugcuaaaaacaaaacaaaacaaaaacaagaaguguaauugccuaaaagugcaaaccagaaaacuguaaaagaauuguaaggagaugugagcauuauuucugaagaaguguucacaacuuuaaccauuuucucaaagggaucugggaaaauuacuuuaaauaagucugcaggguaaggaggaaugcuguccgugucagagaacgaugcagucuaaccacuguuagauuugucuuaacagugacagugaaguggaagggaaaauguguauuuuguguacagaaauguuaauuuuaggccugggacaggagcucaugccuguaauccccagcacuuuggaaggcugaggaaagaagaucaggugagcccaggaguucaggaccauuuuugagacucugccucuacaaaaaauuuuaaaaauuagcuggauguggugaugugugccuacaguuucagcuacuggggaggccgaggguaggagaacugcuugagcccgggagguugaggcugcagugagccaugaucacaccacugcccuccagccuaggcaacagagugagacccugucucaaaauaaaguaaguaaaauuuguaaaaucuccaucucguaaaauacuuagaaaacugugucauagucugugucaugaacuuucaaaaacaguuccaaaaucaaaauauuacaguaucuccauucgaaaacuagguuuucugaaagucaaaaguaggauauuuuaaauucuaaaauuuaucuaauagcaaauauuguaucucaugaauccaguacacaucaucaauuauaagaugccccaguaauuauauuuacccccaaaaaagaaaaaaaaaccacugccaaauaaauugugaaguacaucaauugcaaauaauuccaaauuugagacagguuaaaaguagaggaaaguacauuuuaagaucaauaaaauacauuaauuuaaagccacagacauuuacuacauuucuucuccaaaauccucacuuucacuuuugcaaucuuuaaccacuaaaaaauuauccuuucaagagcaaaacuauauucuugguuucaagguuaaaauaaauggccucugucagggaaaaagagcagucauuaaauuguauugcucgggcaggcaagagccacagcaagcaguaaaagugcacaaacugacaacacuauaauuaaaauagggcuggugggggcccaaacaacacagauacuuuuaggguaaggaagacaaugaaaucuauccuaugcaaagagucauacuggguuaggaaugaaucucucuguggcagaaggccccgguguaggugcuugucuuuaacuuacuuaaauagaguacaaagaacaccuugcucacaacagguagcucaagagccaagagcuuuucuguucuccagcuaaagauuauaaucuuauucccacugcucagucugcucccauguauaggaaaaauuaugugaaucagugugauuuccacauuacacugacuucauuuuucuacuuguacauuucaaaugagcuaaccacaauacagaaaugcauacgaaacacuauucuuuuuguucuugacaacgguuuaauaugaagcugcaggaauagaaacagaagaauccuauaacaauugauauuagauugcuuguuuuccugaacacgacaaaagcugcuacaggaccaacuuagagccacauccagacaaacuguuuucaaaugggguuaacuaugcucuuuguaaaacaccugcuacuuugugauaggaacuacagaaugauuuucccucauccaucaguguguuaauaaaauuagcuauuauauacauuaacugggagcuggaaugaagauuuuagguacaauuaaacuauugccugugguuaaacaauuucucccaacuagucagcucuccauaucugugaguuccauaucuacagauucaaacaccugcagauggaaaacauuuggggaaaaaaauacaacaaaaauaauacaaauaaagaacaaugcaguguaacaacuauuuacguagcauuuacauagaauuagguauuauaaguaauucagagaugauuuaaaauacaggaggaugugcacggguuauaugcaaauacuaugucuucuaugacuugggcaucagcauccacugauuuugguauccugaacccaauccccuguggauacaggaagaugacuauucauucacuugcuuggaauaaaaaaagcauuaaaaauccccgaaaccacugacagcaaucgccaaaagguuaagggccaagaagaacagaauuacuaauucaagcuuuuuaaggaaggaaaugucauauaccaagauaggauuuccacauaccaaaccaucuugaacauaccaaaaaauaaaaaauaaaaauguguucaaccuucauaugauaaagcuauacaugugaaaaaugguauaccuuaccaauacugggacuuacuccuucccccagaaguaaagccuggauuagggaaagggcgugggaggaagggggaagcaaaauacaauacgaacaaaauuguguuguuaugauuuuauaggaagauauaaauuuccaaaacuggccaugacugaaugagauaaagcccugaaacaauaaucaugagaaaggacaacauucuaaaaaaaaauuccucagaaaugacaaaaaaacuagaaaccaaucucacuuaugaauguaaauacaaaguuccaaaacaaaacauuagcaaaagagcucagaacaucaaaauauuacaacccaaguagaauacauuccaaaaaugucagaauagguaaauaucaaaaaagcauuucauguaacugaccucauuaacaagucagaaggaaaaaaaauuaaugaauaccaaauacucaacaaacacauccauuaugaugaaaaacaaccacuaucaccucuuggaguaaaacaguacaacuggacagcuuccuacuauaaaccaaacuaaaaccgacauuacaauuaauggugaaauauacucacuaaaacugagaacaaaacuuuucuauggcagcuauaguaaguuaccaaacauaguggcuuaaaacaacccacauuuuuguaguucuguaguugagaaguccaaaaugugucugaggaggcucuacagaagaaucucuuuucuugccuuuuccaguuucuggggacugucuauauacauugcuuggcagggggcccacuuccuccaucuucaaagccaccaaugucaggccaaguccuucucaugcugucaucucucggauucuguuuuccaauuccuucuuccaaggaaacuuuggguccacccaaauaauuuaggauaaucucccuaucuuaaaaucaguuuauuaaaaaccuuauuuccauuugugacguuaauuuccuuuugccauguauucacagguucaaggggcuaucuauagggcacagacaucuuugaggggggcagaaggguaggcagggagggcauuauucugacuauuacaguaugcuccugaaaaguaaacaaagaaauccaugacguaaagggucaaaugauuucuacggauucuucuaagauggcauuuaaaaaaaucaguauauacucuugauuuuaaaaauaacucuuaauuauguaagauauuuucuuuuucuuuugagacaggaucucacucuguuaccaaggcuggagugcaguggcgugaucucggcucacugcaaccuccccuucccaggcucaagaaauccuccagccucagccucccaaguagcugggaccacaggcacaagccaccaugcccagcuaauuuuuguauuuuuuguggagacaggguuucaccacauugcgcaggcuggucuggaacuccugagcucaaagcgauacaccugccucagccucccaaaguguuaggauuacaggcaugagccuugauuuauaguaucuuucuauucaccaaaaagucaaccauuaaucugauuaauggggaaacacaucauuugcauuaaagucagaaauaagcauaucauuauaacuacugcuaacacuuuucaggagauacaagaaaaaaaacuaugagauaaaaaaauuagaaggacaaggauaaaauuaccacaauuuacagaucaccugaugguaaauccagaaaauccaagagaaauguaaaaaauuaauaaauaaauaaauaaaaauaaagaacgauauaccaacaauaaacaauaaaagauuucaguuagguauccagguagaaaaugaauauauagauaucgauugcuuucauuuaacuaaguaugcuggaaauucuguuggacugcuuucaaguaggaccugccaccuguuuuuguaaugaaguuguaguggaacacagccacacucauucucauuuccauguaugauguauggcugcuuucuagcugccucugugaugcgguggcggagcugggaagcagacggcccacagaggcuaaaauauucacuaucugguccuuuacgcaaaguuugcucuuugcucuuuacgcaaaguuuguccuucacgcaaagucugcucuuuacgcaaaguuacacaaacuuuacgcaaaguuaaaucucugauuuaaacuaauaauaagcaauuagaugguacaaggaaauagaaggccauaucugaaauagaaacaaaaaagauaaaaugcccaggaauaaaaccaaaguauccaaauguccggcuuuaccaaaugaaaagaagacagaccacguucuuggcagaaagaaucaagucaaagauaucaucuccuuccuaaguuuaucuauacuuuuaucuuuaacauaaucccaauaaaaaggccaacagaaaauuuauucauuuauucaaauauuuaugcaggaauuagaagagguaacugaaauucuuguaaaaaaccagcaagaaaaaaagaaagucuauagauaaggaguaagugugcacaaucuucaacaaauuuuaaaaucuauuauaaaaccuugauuaauauaugguauuacugguacaagaacagaaagauuagugaaacaaagaugaaaaucggcauauaaauagaaauuugguacuauuuuuaauaaaguuuauaucuucaaccaauaucauugguuaaaagauuauucaauaaauagcaagggggaaaauggguagcuacaacaaaaauauccugaagauuuuuuuaaaugagacuauaacacaagauucuucuagagaaauucuuuuauaacuauaacaaagaccuauauagcuguaacauaauacugagaagccauuaaaaaaagacugauaaauuugacuagaagucaaaacguuaaaaaauacgaaaaaaaauuguaacuuaaauccaaaggacuaauuucacaaacacauuuaaaaacuucuuagucccuaagaaaaagauacaaaacccuccagcccucucucuaaugcauggaacaagaacaagcaaacaauuuagagaaaaaaaaaaaucaaguaauucuuacauauacaaaaauauguuuaucuacuacucccaagaggauaaauguaaauuaaagcuacgcugauauacuacuucucacauuaucagauugucaaauauccaaguuugauaacauacuauauacugaugaggacauaggaaaaacaggcacuuucauacgaaucuguggaguguacacugguacuaccucuauaaaaggacaauuucacaacuucuaucaaaauuaugaauacauagaaccucugaccugauaauucuacuuuuaggaauuuauccuauagaaauauugccauguuuacaaucgaaguguguaggcaguuauuuauuguaguauuguuuguaaaacaaauaauuaaaaacauccaucacuauauccaguaacaaugaacuugucaaauaaaucauucuuauucaaauaagagaauaucacaagucauaaaaugaugagaaaggucuucagguauggaaauagaaaaaacuccagaauauaauguuaaguggugaaaacaaguccagaauaguauagacuacacuccuguguguguggcgggguggggguaguuggggggauaguaagaggaagagaaaauacacauauuugcuuauauacggagaaaccaggaugcauaggaaacagauaacuuuaguugcuugacgagaggagauuuaccccugggggaaagaggcaagagggagaccuuuucaucuucauacagcuuuuaaauuucaagccaugugaauguauuauucauucacaaaauuaccuuuagaaugaaaaaaauuuuaaugaguugauaaaacaaucauuacaggagauacugguacacagcuagaaaauccaagcaaauccacuaaaaaaauuacuagaaguaauuuaguauguuaacugauuuuaauuaauaauuaguaaaaaucagauuucucauauuuaaaaggcaaauuaaaacaaauaugacuugggccaccacuaaaugauguugagaaucugagcaugaaucuuacuucaugcaaagcgagagauauacuucguaaaaaaaggcagagugaaagcauaugaaugaaaagaaaagguauauaaacuguaagcauaagaaagcuaaagugccuauauuaacauaugauaaaacagacuucaagacagaguauuuaucuaaagaaaaagagauuucaaaaugcuaaaaauuuaauucaccaggaaguuauaagaaccauaaauguguguacuuaauaacagggccuuaaaauacauaagcaaaaccaacagaaacuaaagggagaaacagacaauucuacaauuuuaguaagagauuuaaacuccuugauuagcaacugauagaacuauacaaauauaagacaaauugaacaaaguaucaacugucuugaccuaauuaacauuuaugauaaacaacacuuaacaacugaagaaaauacaucaccuucugugaauaugguacauuugccaauacagaccauaugcuaggccacaaaacaagucacaaauuuaaaaggauugaaaucacaaccaauccauucucuaaccacaauggaauuaacugagaaacaagguaucuaguaaaauuccuaauauuugaacauuaaacaacacacuucuaaaaaucucaugguucaaagaacucaagaaggaaaucagaaacaauucagaauggaguaauaaugaagcuaaauaggacuauguaguaaagaauuuaaccuugcuuuuagcucccuccaaacccuuggaauguccugauugaauuucccugguuggaauacucagugcuuauugucacacauuguuaccagaaggguuaacaucauccaugacuccagagaagacaaauggaaacuccucauuuggaaauuuucuggacuuuuaucucucccauggcugauuuuaaucuguauccuuucaaguaauaaaccauaacugugaguauaauagcuuucagugaguucugugaguccuuccaguaaauuacugaaccugaggguucugaacuauuaacaaacuuuacaaguacuuaaaaggaaaucuguagcuuuaacugcuuacauuaaaaaugaaaguuuaaaaucacugaccuaaggauccaccuugagaagcuauaaaaaaaaaaaaagacuaaguaaaguaaaccugaggggaagagaaggaaggaaauaauaaaaggcagaaaucaaugaaacagaaaacaaagaauugaguauauuaacaaagccaaauaaucauaaaaacagauaaacccuauucuagacagaucaaggaaagagagaauauaauuaccaauaauaaaaaaugcaagagagguuaucacugaaaaaaccuauagaucuuauaaagauaauaaaagauaauuauaaaaaacuuuaggcaaacuaauccaauagguuagaugaaaucaagaaauuccccaaaaaacacaucuuaccacacaccauauucugacacaauauaaaacaguaaaugugaguggccucucaaauuuauauauauauauauaagucuuuauaagaaauauauuuucuuuaauauauauuaaagaauucaaucuguuaccaaaauucuucccacugagaaaacuccaggcccaaauacacuaaauucuaccaagcauuuaagaaagaaacaauaucaauuuuacauaauucuuucaauaaauagagugaacaucucccaacuaugagaucagcauaaccuuaauaccaaaaccugacaaagacauuacgaaaaaagaaaaugacacaaauauccuucaugaacacaaaugcaagaauccuuuuuaaaauacagcaaauugaauaugaaaaggaugcuguaaaggauaauacaucaugaccaaauaugauuuauuucaacaaggcaagguuaguuuaacaucuaaaaaauaaauuaauguaauucucuauauuuaacagaaugaaggagaaaaauuauauaauuauuucaacagacauauaaaauaugugauccaauugaauaccaauucauaaaacucucagcaaacuaaaaauccagaggaacgaucuaaaucugauaaagggcauuuaugaaaacccuacagcuaacagaugcacaaagaagagcugguaccauuucuaccgaaacuauuccaaaaaaauuaaagaggcugaacuccucuccaacucauucuaugaggccagcaucauccugauaccaaaaccuggcagagacacaacaaaaaaagaaaacuucaggcccauaucuugaugaacauugaugcaaaaauccucaacaaaauacuuaaaaacugaauccuguagcacauuaaaaagcuaaaccgccacaaucaaguaggcuucaucccgggaugcaaggcugguucaauacacgccaaucaauaaaugugauucaucacauaaacagaacuaaauaaaugcaaaucaaacacacaaugagauaccaucucccaccugucagagugguuauuauuaaaaagucaaaaaaacagaugcuggugagguuauggagaaaagggaauacuuauacacuguuguugggaguacaaauggguucaaccauuguagaaaguaguauggugauuccucgaagagcuaaaagcagaacuaccauuugacccagcaaucccauuacugguuauauaccuagaggaauauaaaucauucuaccacaaagacacaugugcacaaacguucacugcagcacuacucacaauagcaaagacauggacaucaaugacagacuggcuaaaaaaaaugugguacauauacaccaugggauaccaugcagcccugaaaaagaacacgaucaugucuuuugagggaagauggauguugcuagaggcuauuauccuuagcaaacuaacacaggaacagaaaaccaaauacugaauguucucacuuauaagugggaacuaaacgaugagaacugaugaacacaagagaacaacagacacugggaucuacuugaggguggagagugggaggagggagaggagcagaaaagguaacuacuggguacugggcuuaauacuugggugauguaauaaucuguucaccuauguaacaaagcuucacguguaccccugaaccuaaaaguuuuaaaaaacaaacaaaaaacccuaccgcuaaugcacacaauggugauauguucaacauuaagauggaggaaaggaugcuuacuugccucacuuguuuucaacauuaugcuggaggcccuaauuguggcuggaaggcaggcaaaagaaaguaaaaguguaacagccaguaaagauuaaguaaaacugucucuauuugcaaaugacaugacuguucgcacugaaaacccuaaggaauuuacaagacuacaggcagaguuaguuucuucuaagggcugugaggaagaaucuguuccgugccucucuuccugacuuccagcggcuugcuggcagucuuccgcacuccuuggcuuacagaugcaucacucugaucucugccuucaucuucacauggcauucuugccgugucaugucucuuugaccaaauucuuccuuuuuauaagcacaccaguuauacuggaauagcccaucccaauaaucucauuuuaauuugacuaucucuguaaagaccuuaucuccaaauaaggucauauucugagauauuaggggcuaggacuccaacauaucuuuuuuugugagagacagaauucaacccaaaacacuuaacaaaagaagauuuacucauguaaagcaugaaaugauacucaacaucacaaguuaucaaagaaaugcaaauaaagccacaauacccacuaaaucacugcauauccgcuaaaauggccaaauuuggggagaaagaagagacaaagacaagcauuggugaaaauguggagcgacugggacucucaucaacugcccaaaugugaaaauaaccauucuuauaccuaggauaugaaaacaaccucaagacaguuaucaaagagaaauaaaaauauauguccacacaaaaacuuguacaugaagaucccuaacaccuucauucaaaauagccaaaagcuguuaacaaucuaaauguccaucaacagauaggaauaaacaaaguguuuuauauccagacaccagaauacaccucuucaauaagaagaaaacugcugacacaaacaaccucaaugaaucucaaaagcauuauuaggagcuuuuuuuuaaaaagacacuaaagagucuuacuguaugaauccauuuauauaaaauguuugaaaauguaaaauaauuuaucgugagaaaggcagauuagugguaccugguggggaguggagggcugaaugaauaccaaggagcacaaucuuuuuggagugaggaaaauacucuguaucucaacuauggaaaugguuucacaggggucugcagcugucaaaacuaaucaaacuguacgcuuuacacagacacagcucaaugaauguaaauuauacuuccguaaaaaugauuaaacaaaauaguacauauuuguaaaucuguuagaaaacaucccauuuccaaaagcaucaacaacaacaaaaaugagaacuugaauuaaauguaaagggccaaucucuaugaagaaaacuucaaaaugcuacugaagugaauaaagcaacacuacuuaguuauucuuggauaaaggcucauuauuuuaaguuugaauuuuccaagaaaauaaucuauaauaauguuuuugcaaucaaaauaucaauacaguuuuauuugggugagucagaguauguggcaggguacuaguaauuauaaucugaaaaaacuggcauaugagaagaaaauucugaauuaaaagucaugagaggcaacuggcucuauccaguucucucacagagaagcaguagaaggucucaauaauuaaaaguuugauagcagcacaaacaaagagaaacaaaguguugaacagaccacugagucuacaauacaaccaaaugaauaugcaaauguaauagcugugauaagaauaauauuuuaaaucaguaggggaaugauggauuauugaauaaacaguauuugguaaauggccauuuggggaaaaauauaaggauucuuauggcauaacuuaaaaaaaaauaccuauuagaucacagaccuaaauauaaagaacugacccaaacacuuaaacaaaauaugaauaaacuuguuccuaccguuggaauggugaagucuaaguaagaaaugauauucagggccaggcgcgguggcuuugggaggccgaggugggaggaucaugaggucaggagauugagaccagccucgcuaacacggugaaaccccgucucuacuaaaaacacaaaaaguagccgggcgugguggugggcgccuguagucccagcuacucgggaggcugaggcaggagaauggcgugaacccaggaggcggagcuuguagugagccgagacagcgccacugcacucuagccugggcgacagagcgagacucugucucaaaaaaaaagaaaugauacucggaaacaaaaaagacuaauaaauuugaauacauaaaauuuaaaacuuuugugucaccaacuuaaaaagaaaaugccaacuaguuuggggggagggguaggaggagggagagcucaaguacauuacaaaagggccaguuuugaaauuuauaauaaagucuuacaaaucaauuuuuaaaaaacgaaaaagaaaaaugagcaagacacacagacuggcaguucauuguauaaagaauuacaaauacucaauaaacaaugaaaagauguucauccucccacucaagaagaaaugcacauuaaaacaaugaucuaucacuuuuaucugggcauacccacaaaaccacaaaugcccaauaauaccuaguuuugaugaaggugugggaaaacagaaacucuaauacagguaaaaacauaaaugaaaguaacuuuuugccagcaauuuaacacuaucaaaauauuaaauacauauaaccuuugacucaggaauuuuauuuuugugugauagcagcgaaacuuguuauuuacaaaugauauuacuauuuguauacaaauacaauuaaaacugguauuauucuaaagcuuuaguaauuaagauaaugcguaauggcacaggguuagacaggcugaugacuggaacauaaguaauaguucagaaacagacucacaugugggaaugaaggacauuauauaucauggggaaaaugggaagaauuugucaauaaaugugacugggauaauugaguauccauuagaaaaaaugaaaugugacuccuguaucauaccaaaacaaaaauuucaggcagauuugagaucucaaugugaaaagauuuaauauaaaacuuuuagaagacaauacuacauaggagauuaugacuucuaguauguaaggauagucaaaacaagacaagaaauguguaaaccuaaacagaaaacacugguaauuugacauuaaaauuaccaacugauucuauucaucagaagauaacauaacggucaguuaacagaguuacgaaagaaaaaaagaaaagaaaaauaaaaaaugaacauauccuaaugugcugaaccaaaaagccacaagccauaaaaucucuaacaacuauauucaacauuacccagugguucaaaaauauacaaaaucaacaauuuauuguucaggaauuguuuuuuaaaaaagcaaggaauaccaaauauagaauucagaauuauuacugaguugggaaggaaugacaaagaaucugaggagagcaaacaggggacuucuaaggaaacagguauuacucuuuuauuauuuuuaauauuauguagcaauucuuuauaccuacauauauuuuauaccuauuaguuuguaucuacucaauauugaauaaaggcaaauuuuaaaugccaugcaaaugaccaagaaaccauacucugucaaacuuuuguauaccacuaggguucacugaacccaauucuaguuuuuauggggcagagggugguaauuaaaagcaauucuaaauauuuuaaagauugcuuuuccaauauuguuacucuuucuuaagauauuucauauaacaaagagaaaauuuacuuuuuuacauaugaauaaaauucauucuaucuggaaauaaaucaucacuauuccaucauccuucagacaccaacuugguaagucucuccuuuuuuuuacuuaagcuuuugcugaacacaguuaagaauucaaaaauuuuaacuuuuggccugcguugaaagauucccaagauuauucccagauucaaugauuugcuggcaggacuuaugagagugagucauauucacagauaugauuuauuacgacgaaaggcuacaaagcaaaaaucagcaaagaaaaaaggcacauggggcagucugggggaaacugggagcuacuuuccagaauccucucccaauggagucacauaagauuuccugaauucacccaccaacaaguugugacaauacaugugaaaugcugucuaccaugaaagacuguuagagacucaggacccaggguuuucacugugggcuggucacauaggcaccuagcacaugacaaaauuucagacucccagaaggagguauucggcagaaauaguauuuuguauaaacaguuuaggcacaguaagcgacuugaucagcuagugguaggaauccuucugaaaucuaaguuuccagacacuagucaacagccaaccuuacaagcuggccuuuucaaagagagcaguuuagguuauguuaacuuuuuugugaacaccaccauuaauggcaaagagaagaaaacugacagagagauauuuuacaacuacuagcugaucaaaauaugaaugaaaauaaagauagcaacacuguagauuaaugacaauggcgaauuuaauuguagaaguaacaucggagacaagucuucacaugacaauauucuaaaugaauuuucucaaauucaagaauagaugagugaacaacuuagguuuaaaggaaauguagcauuuucauccacuuagucauuaaacaggacuuaaucaugcaauuuuuugugacaagaacuuggaccaucccaguauccuaagaguauaugugagaguaugcucucguuuuuuauagugauacaccauaauuuguccguaagcugacaacuguugaagguagauaaguacacaaagguggaugaaaggaaacagaugauacaaaaauaaagaauuaaauggacugaucauucuaauugguguugauuaaucagaaaaugaaaugcuuuccaauuauggaucaagaacaaugaauguccucccuacuucaagauuaugaaccaucgaaguuuguaaacuauguuuugauuucaagugaaaaaacaaaaccuauuaaaauuuggaaucaguauguacaaaauggauauauauuucauguucauguagggcagcugaugagugguuauuuacauucaaagaauaccacacauuuuggguacaaacaucuucacaaacaaauguguuauaaacauacaauggaauaauacucaacaauuaaaaggaaggaaauacugauacaggcaaggacacagaugaaucucaaaauaauuugaaaggagccagacuuaaaaauagaacauauuuuauggcuccauuuauauaaaacucuagaaaugcaaacuaaucuauaaugacaaaaaucaaaccaguaguugucugggagagaagagaacagggaaggacaggagggagggacugaaaagcagcuuuggaaaauuuuuucaagugauggauacauuuaccaucuugauuauagugaugguuucacagguguacacagaugucaacacuuaaagacgcuguacuuuuuuaauauguguaguuuauuauaugugaauuauaucccaguaaugcugauuuuaaaaauuggguuugcuauguuuagauucuaauuaaaauuucuaacaaagauuuuucauuacuccuuuauucuucuguuauuuacaaacaacuucaauuauuuaaaaauaaaaagaacagcaauguaagauaaaaagugacaaagaaugaugaacaaucuucuagauacuguggguuaaguaacugucagcuaagagaaguguucgaggcagucuguauagcaaauauccaacacuuacaaaaacgaugaaaagagcaugaugaaauuuauaaucaucauaauuuacauuucaaauuugugaaauaugucaaauauggauugcucuuuucucuaaaaccaaugaggaagccuaaaaaaaggcuucugccaggaguucccagugguuugcuuaucacaucucuuaauggcuaugaacuucaagggaagguuucuuuuuuauguacuuuaucuccagcaagugccaaagacagcuuaaaauagacucauuuucuuaaaaaacacagcuauacugucagaacaaacccacucuuggaccguaaguccaggaaaacacagucaacugcuucauuccuuaaaacguacuaucaaacaaguuauuauuuucuacuucugcaagacuaauaagcaaucaggaacuauaacuucuccugcugucugagauguuuuuacagagaccguucccuauugauggauaggcuauauucaaaaaaucaguaauuuuugcuuguuuggaacaauuuaaaauaacaauguaaauuaugacuagguuccuaaagccaacccauaaaaagcccacuuaacacaacauaccuuagaccuauauuaauucaaacacagguagucaucaaacacacacagaugcauuuugaaauuaaaacucggccgggugcgauggcucacgccuguaagcccagcacuuugggaagccgaggcgggcggaucaccugaggucgggaauucaaguccagccugaccaacauggagaaacccgucucuaguaaaaauacaaaauuagccaggcaugguggugcaugacuguaaucccagcuacuccggaaggcugaggcaggagaaucgcuugaacccaggaggcagagguugcggugggccgagaugcgccacugcacuccagccugggcgacaagagugacacuuggacucaaaaaaaaagaagaaaaaaaaaagaaauuaaaacucagauuaccaaaacguucacuguccucuuaccuauccucuauucucaaacacaugcucaagauguuucuucuuugguaguagcaaauaggcauaggguggccaaauugagaagcagaggcuacaaugacuuucuuaaucugaaaauucaaguaauuuaaacauugaauauucuuaaaccacaucaccuuuacuuauucacuuggcaaucucccuugaugauaggauuuguucaaaccuaauuuacgaaugcucagugaacuuuauaaauaaaauguuuuacaaaaaugugauauaucaucaaagccuagauucaaaaccucuuucacaugcuugucaacuuaaagcccuggcucucccuuuacuaauaagcccuggcugaauuaugucccccgcccuccccaccaaaauucacauacugaaguccuaacuucuaguaccucagaauguaucuuuauucgaagacaaggacuucaaaaaggugauuaagauguggccauuagggugugguaguccaaucugacugguuuccuuacaaaagaaggaaauuuggacacacugagagacacagcggggauaugcaugcacggaggaaaggccacgugaagaggcaguaagaagguggccaucugcaagcugaggggaaaggccucaggggaaaucucaccaugcacagaggaaaggccuugggaaaucucgccggcacuuugagcuuggacuuucagccuccagaacacugagaaauuaaauuugcugucuaagccaaccaauaaaucugcaguuuuuguuauggcagcccuagccaacuaauacagagcuuuaaaaaacauuacuauguacacuguagaauuuaauacucuaaaaaguuuuauuccaucgucuccacugacagaauuucuaaauuaauaagagaaaaguuacacuagguaacaugauuaguacauaaaugccuuacgggcagauuuccuuuguuuacugcuauauaccuagugcacaggugcuuaauuacugagagaaugaaucaaugaauaaauuaaucaauaauuuucuucauaaaaauuagaaagacacauacccuauuuuaacuuccugaaaugauuucacugcuucaauguuauauauuuaaaccaagugguauuuguuuuaaaauaaaauguucuuuuaaaacguacgacuuuccauuuauaaaaagaaaauuuuauaaguauauaaagugugaaaaagaaaauuucaaaaauaaguacauucuuaaaggaagaaaaauuacauuccaaaauguaauguacuagauuuucaaagaaaaggcuaauaauauauaucacaguguaguucuaaauggauauaggagaacaauaaucaacuauuucuagcugcagacauauuauggggccacugcuaucagcaaaugcuaauagaaacuauuucccaauauaugaaaaaauuauuuaauucauucaguuuaagaaaggaguuuuuggacuuuuuucuuuguaccccaccuauccagcagaaaaagaaaggaguuuaauacaccauccugaaagacugaggaacuagcuagagucccauagucacugaagaauacuguuuuuccuuuggagaaaccaugaagucaauaaaaagggacuuuaaaauagaacaguacccuaaagauacuggcucaauguaaagguuugguagcacagaaaugagaaaguacauuucaucuuagaagaaggaagauacuagaggagggcugugcuuuuaauaucaaaaggcauuuaaccuuaauuacuguuaaaaauuauucuaauccaauucuaacaagcaaacugcuauugaucauuauuuauuacacaguauuuuucaauuugaaaucuuuuugaaacaguauucuuaaauaagaauaucuuaaguuaccuauuagugcucagugaacuguuucaaggaaaccuuacauaccacauaccauacccuaaaagcaaaggggcauacuccuuuuacuugaguguaaugguagcucuuuugcaauauuuacuuuugcuucugaaggcuggaacaaagaagugagaaggauaaagaaacauaacagggaccgggcgugguggcucacgccuguaaucccagcacuuugagagaacaaggcggguggaucaccugaggucaggaguucgagaccagccuggccaacuugauugaaaccccaucucuacuaaacauacaaaaaaugagccgagugugguggcgggcgccuguaaucccagcuacucgggaggcugacgugggaaaaucacuugaauccgggagguggagguugcagugaaccgagccgaggcugcaccacugcacuccagccugggugacagagugagacuccaucucaaaaagaaaaggaaaaaaaaaaaagaaacauaacaggaagcaaacacucaauaaagcuauguuucaaccuuuauguagacauuuuaccaacuagaugugugaagagagagccucaguugcacuuuucugcuuuaucucagcuaaacagacacauuacuugacaaguucuaaaauuaauccgacuucaguaaaaauacugccuguaugcauuaggucagacacuguagauugcuuugcccaacacuacaaucuguuuucccugcuuuuguuuaauauagaggcuauaaaagcuaaauacuguacagucauccuuugguaucugugggggacacguuccaggaccucccaaagagaccaaaaucugaagauacucaaguccccugauauaaagugguguauguaguauuugcacauaaccuauguacauccucccauauacuuuaaaucaucucuagaguacuuacauugccuaguacaauguuaaugcuauguaaauaguuguuauaauguauugcucagggaaaaaugacaagaaaaaaugucuguauacguucaguacaaacacaauuuuucccccgaauucugauccacagucgguugaauccacagaugcagaaccauggauacgaacagcugacugcaguuagguuuccaacucucccuuacuacuaggagaguccgugugacacaguuuuaaucaaugaaauauacgcagacaucuacuagcuucauaaaccacacuccuuuccccuuuccacccuuuccccgucuuuaugacuagagcugcaacagacaucuuucaaugaagcaaagcccaagaaaaaagauguccacagcuguagcagcugcauauuuccaagcugacuauaaugaggaaaaaauagggguccauuuguuuaaagucauuguuaguuuaguauuuauuauuugcaaauaucuuaagcauauuucacccagggagaagugggguggguaguggggaaaaugauguaauuguaagauaggucuucucguuuuccacccaauuaucucuuaacagcaaaaaacaaaucauuaagaauaugaagcaacauagcaaggagauacgaacaagucccugaagcuacuuguaucccuggccaagaaacacagcuaagugggaacaguaccuuuuccaauaaaauagaaucgccaaggcuuuaacaccuuacacuauuucccugcagagagaagacacccaaaaaaacacuccugacuuuauacuggguguucugccuucccucugggauucucucacuucaauuacugcugucaccaaacauacuuuaaugcuuuauuacaaaaagcauucugacggcuucucuuagggcaguuaguaaaggcaagaacuuucaagagcuugauacuacaaaaaaacaaacaacuuuaacuagcuucacaaaauauaaguuucugaucgucacauaccucauuuccuccuagggaccuuaggcuccggccucacugugccuacuauuuugaaauagcuaauucuacacuacagaguuggcauaccuucagaggcacuaugauuuugcuaauuucuguucacauccaccccuaaagaacugccuccuaaacagcuucauagucucuacauuaagaacuugaauguccucugcauucuccucacauucccaaagguccuuucucugaguucuaacgcgagacaugagagauuaaacaggcuucuuuccacagagacugacaccagaaauuaacucauguuuugcugauacugcuccaauuauacacacgcaugcacacucucacucugacacacauggggacuuccaagauucuauaguaaacauauugcuucuucaugauaaucuauuacuguaaccuucuuggauaaaugucucauaaagaacagaaugguuaagagguaaacucuagucccauagaaaacugacuuuuuaaagauacuuaauuuccaacaaacaaggugguguuuuuauuccuuuucaaaagcucauugccauaaaugaaaauauucagcuuaguuuuaaaugugauuuggaauuuacauaguaagauuacuuguuguuuacauacaaauuaaggaaguaaacaguuauuaauugacauuagaaguacuguuagaaaauaaacuuuuugcacaggcaauacugguauuaguuuauacacuggaaagaaagauguguuuacccuuauugucucaagccauuucugaaauguuuuaacuagaaguugugggauaauucugguauaauucccaauguguauucuucuuuaaucacauauuaaaauuuuuaauuaauuuacuugucaguuucaccacaaagccuuaauaaauuuugcaucuaucaaaauacacuaaugaaaaaugugacuaggaugcuguagucuuagaaacuauauuucuacacgucucuugucaguacuaccugccauaaaauucaaacauuuuggaaaacaauuuuuaaaaacucuauccacaaaugguuaagccccaaaauaacccacuucuuuuuauuuccuaaauuaaaguaucuaaugauuuccuaaauuguaaacauauaacuuagaugcccuuuuaacuaucuuuaauuaccaaguuaugugacauuuucaauacaauauuuucuucauuuucccaccagagggcaaccaagaaccucaaguggugcugugcaaugaauuuaacagcauccaaagugguuuaaaggaguggaggauaggggaggacuuuaaaguccaccaagacuaucagacuagucaugagcaaugccauguuacuucuuaaaaccuuuuauaauaauaguauuuugaaacaucuuauauacauaagauguuuaauuuaccuacauauaaggaggaacauuuuuuacagugauuagcuuuauaaaaauauuccuuaaaaaauuuaaaauccuuuuccuaaaacacucuguuguacauaccacaugaaaaaacaggcuuaacaccuaggggaaaaaaauguagccuuagcuauuuaaacaaugcauaugaauuuuuuacuggcucauaguuuaacaaccaauacgaauguuaaauuuguuaaaaaucuguuucuaucagcagcauacuuuuucuugugcaaucauuuccauuuccuauuucagaaaauuucugaaaucucaguaggaaaauaagaauucucugacaaaacaaagaacuuaauguaaagagggaaaaaugcuugggugaccagaaaagcaauauauucuuuaacaaccuuucagccuaauuuaaucagcuagcaauuugagaccucuucacaucagcaauugaaaaguuucagucauacaaaaacuaaaaagaaaaaaaaguucgauucaaaacaauaccucaaaauaaguaauuauucccccaaauacuacguuagagggcucucuuccuacaaauagcuuuaaaccacauguuguuuuuauuguugcuguuguugagauggagucucgcucuguggcccaggccggagugcaguggcgcgaucuuggcucacugcaagcuccgccuccuggguucacgccauucuccugccucagccccccaaguagcugggacuacaggcacccgccaccgcacccagcuaauuuuuuuguacuuuuuaguagagacgggguuucaccguguuaaccaggacggucucgaucuccugaccucaugaucuaccugccucagcauauguuguuuuugauugcagaaaucagguaaaaaugcacccgcucuuuguuccaucuaauauuuuauauaagaauaaccaucuuuaaggcaaacuacauucauuuuauuuauauagaacacauuacuaaauuaaccaguuucauuuauaggaaaugaguaguaaagucaugguucuuuugguguuuauuuuguucaaaagcuuucuuuccucuauacaaucuaaauagcaacacaauuuaguaucaaaaucaaagucuauggcauuaguuuaaauauuaaaacugccacaagcaguuucuuccaucaaagugaugucagaaaccaucuccaguccugcguaucaaugguguuuccuguacacuuaauucuccacaguagcaacacauaaaaaccaagucaauaauuaauccucauuaauggaaaaugacauuuuacaugcagcuuucauaaaaaucagauccuuuucuacuauaucuuaacugugcacagaccaauucuuuacucaugucagacacacaaaggacaggaaucuauuacaugaauuaaagucaaucaaaccaucuaaccuaaauuacauuucuuugcugaaauacuauuggauuuuaaaaccaagcuuuuuaaggaaguauuauucaaacccaccuuacauccaaacauuaaggauauugugcuguuggagcaugcuacuuuacaguggcauaacaucggagaaaagcaauccaaguuuuugaugcuaggagacauuuuuucagacccugagcauuuaaaucgauccaagacugaaauuccagaaaaaugccuuugugcauguuguuugcugacugucuugaacauuuaaucuagauccaaagcauucuuuuuaaaaaaaauuguauuaaaauguugcauucuucauuguuuccacccccacagcagagaucaggucgguauacuaugauuggaauuaaaaugcuguuucuuuuuccugcauaauaaaacugcuucacuaaaauuauagucaaauuaccagaaugaaagugcucauuuagcaccacuuugucagggccuugcuaauauccuuaaaauguaauccagcaucggauucaccacagagcuccacuugcugcaguacaagcucugcuaucuccuccaugagaauaagauacaacucgagcagagccacuaugcucaaauauaugcuggcugcuuugggggaggggcaaagauguugcagcaagggauucauuacacgguucaauaagagaugagcccagagcuugucauaugugaugcuuucuuacuacaccacuaaacacuguagucugauuuaaaauauaguuuuaaugguaaaaagaguaccucaauuaucacauuuuguaguuugauuccucucuauaaacaauucaagcaacaacaacaaaaaucaaucaucuggcaaaguuaaguagaauaauuacaaauuaaacuuggacaguaaaaaaaguucaguauuuucuaauacaucaaaaucacuuaaaaucuggaaaaacauuacugaaccaauuuugauguauaucuauaccauauggaaaguuuaaaagcagaaagucaagcaguuuaacucaccgacauaucacugauuuauccacucuuucaaauauuauuuucugugcuuuggcuuuuuaaucaacccuuuggcagaaaagcuaucauuaacuaauuacauucaaagcaacaaauaaaauacugugaaaaugucauucuuacaguauuuuauauuuaaaaucuugcacacagauguuacaucuuaugcaguaccuucgcuauaauuuaaauggacaguauuuauugaaacucaaaagcugaauuaacaaaugccaguaaaauacuaaauaacacacaaaggaauauuuacugcuucaucuauguaauuaucuuuucuuucuuccacuauuauuuggguuguucuaaguacuacaucuauauugcaguuaagaaauauaauugcuaaugaagacugucaacuuuuacaaaacugccuguaaucccagcacuucagguggccgagguggguggaucaucugagggucaggaguucgagaccagccuggccaacauggugaaacccugucucuaguaaaaacacaaaaaaauuagccaggcguggugguacgcaccuguagucccagcuacuugggggacuggggcaggagaauagcuugaaacugggagauggaaguugcagugaaccgagauugcgccacugcacuccagccugggcgacagagugagacuccaucucaaaaaaaaaccaaaaaaacaaaaaacaaaaacaagaacaauuuuacaaaacuaaaauuaucaauucauauauuuguacucaacagccuggucucuguaugcuuaguaagcaaagcuguuuguggaaaaguauacuauauuuugcuauacaccagaaacagcgugccaaaagacaaaaauucccuuaccaccaaccauaacucuaauuccaaaccugcucaagaacacuuuuaauuccaauuuccuacacaauucucuauucuguuccauuccuacuuauguaauuguauaaggggugagagagagaaaaaacuagguuacauuucuaaaacaguaaaggaaauagcugguucuccaaucuaauuacccugacagguaaauaacugcaaaucacaugacuuguggaacuuaaaugaaaagucaaaugucaacuguaacuagggcaagaaaaaguaaacugugcuccuuagaagccuuuauauuuaaaaauacauuuacuaagucagagccauaguuguuaagcugugguucucagccuuuuucacugcagugccucagaggugucaccaauguucuuucauuuuaaaacuuucauuuucaaauuuacaaauuuuaauuuuaaaaaccuggaagcacaaauguguaacaaguuuuaauacugguguuuaucuauaacaauuuauuuauccauacuaccaaguaaacucauuuugugucaaucucaaaauacaacuucuccaauuuuugugcacauggaggauuugucucauugaucauguagguuguacacgcugagucuuaauaaaauucaguucugugcagacaugucugcuccccuaaaacuauauaagcaagcacauuauuuggcacaugucuaauagaacaaaaugucaggcaaaguucaagcauguccacuuagccugugcucuuaauacagucugccuuauucaguugguuacacaauaaacauguaauauauucaacuaugauaauauugugcuaugaucauuuuaaugauuacuaggaauuaaccaguguuucuugucuguuuuuuuaguaaacugaaugaaugaguucaacguauacauuuugggucaaaauuuaccauaccuaaaacugcagaagacaguauaaaaaacaugcauuugauuuugggaccuaccaggaaaaaugacuaauuuugacuauuuugaaacucugaguggaucugauagauuugcacuaaagugucuuaggcuguucugcuuuuuaaugauguuaucuaacaaaucaauaucccagauacauucagccaaauaguaccuaucaaacuaccuaagaaacaauauuuaaguaauaauaauaaauaauuauuaacaguagcaauugucauuuaauaauuacuacuagucaggcauucugcaaagugcuuucaugugucagaaaaauuaucaaaagcuuggaaaaagaggcaaaaaaauugguaguacguucaaugcuguauagagacaaagguuguucaagauuauccagggcaaugguuuucaacauggaacaacuuugcgcccccagggacaccuggcaaugucugcugcccaaucgaggaaaagagucuacgggcaucuaguggguagaagccagggaugcuacuaaacauuuuauaacaacacacuggacagcuuuccacaacaaagaaugaucuagcccaaaaaucaaggaugccuaaauugagaaauucuaauuuaggggaaugcacacuuuaacacacuauuuacuagaagucccaucccagcacuuuaggaggucaaagugggaggauuacuugaggccagaaguucgagaccagccuagucaacacagcaagaguccaucucuaaaaaaaauauaaauaaauacuugggaggcugagguggaaagaucacuugagcccuugagccacugcuugagcuaugauugagccacugcacuccagccugggugacagagugacagccugucucuuaaaaaaaaaaaaaaaaaaaaaguccuagacagugaaguuauauauguuaaccuguagcuuuuuauucaauagagaagcaaauaauuuuugcccagauaaccacaaagauuaaauuccuggccucguuggauauuaaucaguuucuuaucuaacucagcaaucuucuauuaacauugccuauaaauacuuagauaacaaaugcacucuggucaaguuuaacaucuuacuauuucucucauuaacaagugaguggaauacaaucugugacacauguucauucuacauuugccuaagaacuuugcuuuuuugaaaaucauaccuuaacaagcguaaucgccuuacuuaauccaaauaugauuauuuggauauacuuuaacacauguaauuaccuuacuuaauccaaauaugaucuaccucuuacgagguaaaaaguauuauaacguccauuugauaaaugagagaaacucaaggcuuggaggagucacauaauuuauccauggugucacagcuagcagaaaugggaaucaugucugacuacaaagcucauuuucaacaauuaauaaaugcaagccaagguuagauauuuggcgagucaaguccaaaguccuuacuauucuuucuaccugcuagaaugacaauuuaaggcuaucaggcaagcuuuaaaacaguuuucaauuacuaaucuguuuaaauuggauuuuucucaguacuguauaacaaaauagagggaaaaaaagaugcugagauuaauguuaucaaaauguuugcacuacucaaaacugccuguuuagauuuauauaauaaacaaauguaaauaugaauuuauuaaguaaauauaugguaauaaauacuaccuauauuacauauuacaguuccauguuuaaaauuucacugucaacugaaaucuuauaaaaggguuaaaauacaagagcaacacccaaccaaacuccuucaccugucacauuaacuggagaucaaacaauauaguaaaaacauccaacuauuuagucaugaaauuuuuucauuauauauuaacucauuaucaaacaaaugcugaguuauuguuacuaucauaaaacaaggguaagcuaacaaauuuuuuaaguccaaaagaagcuaaacuuguagaccagcaguguuuaaauaagcaguguugugcuuuucuuuuuuaauuccuagaugauuuugacaugucacuguccccaaucccacugauuuucaaaacaucaugguaaaucuauugauaaauauuugaguuucauaccaaagauaguaauagcaucuuuauguaaacaauuguaauuccuacagagcagaggacuuagguaagaucacaaagugauguuacaucucaagaccagaaguauacaucuuaaagaauauuugaauuuaauuuucacacuugccaaaaaacaagaauaaaaugauaguaguaucugcuaagaaaugacauugcuuuccaugauucuuccaacugcuuuacauauaguauguuauuuaaucaucuuaaugcuaaguaaguuauagcauauaacuaguugcuauaacaccuaaguuuccauggugacagcuucaacaugaagaauuaaugaacauucacugauaauuucaacauuagaaacuaucuccaacagaagcgccuaacaguucuuaacagugaagaaaugcagcuagaucacacugcuguaagagaaccauaugggauuuaaaugauuaauggaguuagagaaacacuauuuuucuuaaauuacgugaagaauuaaugcugugguuugcuuauuugcugucuuuuugaaacggcaggaauuaagcagugacauuagauaccuaugaauuugccaucaauuugucuggcaaagaauagcccacaauaauguggacauuucuguuauaaguaggcuuacaaaguugauuuagcaaaaauaccauacaacugauuacauuuuguuguaagaauacuaacauacagccagguguggucuuacaccuauaaucccaacacuuugggaggccgagcgggcgggucgcuuaagcucaggaauucaagaccagcuugggcaacagagcgaaacccugucucuacaaaaaauacaaaaauuagccaggcaugguggcaggcgccuguagucccagcuacucggggggcugaggugggaguuggcuugagucugggaggugaagguugcagugagucaagauugcaccacuguauuccagccuggggaagagaaccagacccuguuaaaaaaaaaaaaacaacaaaaaacaaaacaacaaaaaccaaaaaacaaaaaccacuaaaaugcuacucugccaaauaaaauguugaaugaaaauuaaaauuaaugucaaaucaaaugcaguaacauucacucuugaucaaacugcacuaccuugacugauuucaauuaaccacagaauuucagcugcuuucacaguugaagacagccaauuagaagaaaugaacaaauuaaacugugacuacauacaauuucaauaauggggcaaaccuguaagauacaaaucauaccaugaaaccgcaauguacauggucacaauggagagcauaagaaucagaggaacaccaacaaauucaugcaaauaauuugcuuuguguauuacuauuuauaaaucuguucuaaaaggaaaccugguauaaucucaaucaccuaaauuugagcacaaaaaacagcuauuuggauugccacucuacucugaguggcacuguucugucauaguaaugggugauaaaaaugugaaagaagaccaggcaugguggcucacuccuguaaucccagcacuuugggaggcugaggggggaagacaacugagcacaggaguucuggcugcagugagcuaugaucacgccacuguacuccagcauggaugacagagaccuugucucuuaaaaaaaaaaaaaaaaaaaggugcaagaagagccaugcuaaugauacugcucaugguaacaaaaagaaaacuauuauuuuagaaaaagcuggaacugggcucaguauuagguuuauagcucuaugcuuaaauauuuaaaaccauuuaaaaaauaaauucauggaggaaacaaaacuuuguuaucaugggucugaaacucugaccucuaaccuacuagauccaaaucuugaacauucaucagaagcaaaugaacuuguuagaaaugcauccugcaggcacuucaugaauauuuguucaacaaaugguauuaaauuaucugccgugguucucauuuaaggcuacaugauaugcaacgcacaguugauccuaaaauuaccaucuaucuggcagaaaaaaaaaaaaaacuaugaaaagcuuccuugugccaaauuugagaacuacuaaguaucuccacagaaaaagcacgugacaaaauccaacaacuauucaugauaaggggcaccuacaaaaaaccuacauuuaacaccauaauuaauggugaaagacgaugcuuucuccuuaagaccagaaacaaagaaggauuuacacucucauuauuccuauucaaaacuguacuggacauucuaaccaguguaaucaggcaagaaaaauaaaaagcauaacugacuggaaaggaagaaguaauuacaaaauauguagaaaauccuaaggaaggaaucgucagaaaacuuaaaacugcaggauacaagaguaaaauaaaaaaauuaugauuacauauaaugaauaaucugaaaacaaaauuaagaaaauaauuccaugcacaaaaacauuuaaaagcauaaaaaauuuaguaauaaauguaauaaaagugcaauacucauacacugaaaguuauaaacgcauuauuaauagaaauuaaagaugauuuaaauaaauagaugguccauauucauggauuagaagaacugccaaguaaaaguagcaacuaucauuuuucaacuacuucuauuggaagguuuuuuaaaaacuuaaauucuuuuuuugagacagagucuagcuccaucgcccaggcuggugugcaguggugggaucucagcucacugcaaccuccacgucgcagguucaagcaauucuccugccucagucucccaaguagcugggauuacaggugcgcaccacgaugcccggcuuuuuuguauuuuugguagagacgggguuucaccauguuggccagguuggacucaaaccccugaccuugggugaucugcccaccuuggccucccaaagugcugggauuacaggugugagccaccaugccuggcuaauuuuuguauuuuuaguagagacgggguuucaccauauuggccaggcuggucuugaacuccugaccucaagugaucugcccaccucagcuucccaaagugcugggauuacaggcguaagccaccgugcccagccuuaaagguuuuauguaagcuucuacaagccaugacuccuaucucauacaguuugcuucaggcuucuccauguucaaggaaacuaaagaaauccauccauuauacacuggaagcggagcucugauaaacaauauccaugguaaacacauuugcuucuagcauaaaacuucuuugaaacagcaucuuagguggaaguccccaaaaaacgaaauagaugaacacaaagaggcuguggcugagcgccaaugagucucaucuuauguccuacuaagccaaucaacacacagucuuuaaggaaaccuagaauaccagagauaagguuuugaacagugguucccaaauggugagauauccaaagaagauucccagguauuuagucuaauuuaagccuaacgaucuuuauuuuuaacgagcucccuguccaguucuaauacacagacaggcuuacaaccccagaugauccaauuaagaaaagcaaagcacaguucucaaaccaaauugaguguaaaauuucaaugcagaaugcuuuucucagggaggaggaaauggauaaaacaaggacaaaacauuuccaaaaaguauaauggaugaauuuaggaguagaguuuuaacugacuggagaucuuacuuuugaaaagaauaaaaaugucuaaucaaucccacauucucuaaauaaaugaugauauauuccuguugugaaaucuuaaacugccauuauaauauggacagacaagcauaguuuuaaagaacauguaauaacaugaaaaacuaaccuuggacuaaaauuuugccuuuuagcaaaacaaacaaacaaaaacacaauacaaacugggggaacaaagaaagagggcuguaugucuguuuaugccccguaauuauguauaaaagggguuauauauauaaucacagaaaaaugacuagaacacagaaaaauguuaauagagguaagauauggagucugaguuuacaugagacuuagguucauuuuuguguauuucuaaacucuacaaugaacauacauuguaucucccucaucccaaaaagucacgucaaaaguuauguuuuuuaaggaaacuacugaaguaguaguuucuauuccagaguaaccagcuuaaaucuauugugaaauuaaacaggaucuaaauaaacaaaauaugaaaaaacuucuacgucaggccaugaagaaguuaacugguacagaacuugaccuucugccuuaaaacaacuagaaaacuagaaaaaaaauacaugccacaacaguuuucagcacuggacaacaagcaguacaggacuacaauaccugagagaaggaaaacaaagugagcucuacgaucuuccuggcuuccugccuggaggccauuuuuuggaacuugacacaugauggagaaacccaagccaauacagccaucuuacuggguugacaaaaaucaagacugguguucaaggagacggaagcacuggaaugugcaaggcagaauacuggaaagaagaaggcuaagcagaaaaagagcuccagaaaucaaauagugaguacccuugagacuucagucugaauacuaaucaacacgugaacagcauaaaauucaacaaggccaggcaaauaaaacuguaagggacuuauaaacaagcuucagagcucacaguaagcugaggaguguucaaacuuauacagagcagaggggccucaauaaacacuuguaguaaucaguggacacuccuagacagucaagccuuagcauuaaggcuaagcuggccuuaaagaaaaggcuacuugagauccaacuuuuaaaaagcuuuaaaaagucuugaacugaucaaccuuaucugcaaaugacuuaauugccuuccaaaacaaacaacaguauuuuccagagaaaacaguacuuaggaacacucaauuacauucacaaugucugggauccaaugaaaaauaaccagauaugcaaagaagcagaaaacugugagccaucagaggaggaaagccaguucauaauagacuuagaaaugcaaaaugacagaauuagcagauaaaaacucaaaaacacucauaaaacuuaaguaugcucaaggacuuaaaggaaaacaugaauaucaugacagaaauggaaccaauaaaaacauaccaaauggaaugagguuuuaaacgugcugggaaaaaaaaccugucaacccagaauuuuuuucaucaaaacuaucauucaaaaauaaaggcaggcuagucaugguggcucaugccuguaaucccaguacucugggagcccaagguaggcagacugcuugagaccaggaguucaagaguggcaugagcaacauggcgaaaucccgucucuacaaaaaguaaaaaaucagcugggugugguggggcaugccuguaguuccagcuacuugggaggcugaagcaggaggaucacuuaagccugggaggaaaagguuccagugagcugagauggcaccacugcacuccauccugggcaacagagugagauccugucucaaaaauuaaaaaaaagacaaaauaaaaauacuucuuucaaguaaacaacagcugagagaauucaucaccagaagaaaugcauuucaagaaauguuaaagaaguucuucacgcugaaaaaaaauacaucaggugaccuacaagauaaaauaaagaccaucaaacacugugugaauauuaacaacuuuauuugaacuacuguucaaaaugaucauuuggcuggcccuacauugccuaugggauaaaguccaaacuacucagcucaguguuuaugggacucaacgcccaaucacauuaccucucuccacuagcacuagaccuaguuucaaagguggguugucccuaaagggggacaggggaaagcuacagcugcagaaccaaagucaagaaaagucgauuuucacaguuuuaccaaguaacggaggugguagacaaucuauaaucagaugggggaagaaaucuuaccaggaagcagaucaacaaaugcuaaguauacuuuagcuguuaacauuugcuguuuuauucaagaauauucaucuuucaaaauaaauauauuauuuuauucaaacaucauuugcuguccauaaugaauucuguuacuaccaaacuaugaauuaggaaagguuauuuaauuuacauacuggagaacaaacaggcagucauuuaauugacuaaaauuuaagagugcaaaaaacaaaaacaacccacaauaacuagcgucugggagcuccugcucagaucagaauguggaaggucacacagacaauggcuuguaccauaacaacuagaaaaaaaagauaaacauaucuuuuaaagacaaugagggcuuccaauugaaagagagcguagacacuuuccuaugccacaugcuacauacaacuaaaaucuuuggccauuauauauaaaacaaaaauaagacugaaaggugaaaagaggguggcagacuagcuaggaauguagaacccuaaggaagacacggcagucagucccugaguuuucuuuuuuaccucagacuaucccaggauuucagcugaagaaaugagcaacccagaaacgccaaugguacagaccuaccuugugccaaaaaagagagacaccaauagaagcucuuuuaggcuuuuguugccacaggaacagaaaggggcagccuagcaagauacaacuuuuagaugacaacugcucuauuccagcuaaacaccacagaaaaaaacucugucaccaaccauauacacaccagcaaagaccagcagguagccuagaauuccacucucaugaggcuguaacaaggugucccaaccaucuuccccaacuggggcugggucagagaaggccaauuaaggagcugggacauuuguucccauccagcaauaaagagacagcccucuccacuggccggggguagagggaauguuagaagagguauagucaggagacgggauuuuccccacuauccagcaguaacaaggugcacaacccuacuucuacauacugucacaugaggagcaguaaugaggcauuccaacuucuagccaguauuaauggagaacuaacggggagcuggaacucccacuggcacccagcaguucucaacugauuuuaugaaguuuuaguacugucuugauuccaaaagcagacacgugggaagccuagacuugcauccaaauccacugguaacaaaagcuucuaccccaugcaguguuagugaagaccacauggggaacuauaacuaacacccuaucccaacaggagugaggaguauucucucuuagguguggaaggaagcagugugagaaaccugacuuuuaccuccacuaagcaguaaggaagcagugccccaccuuucacugucagagcagcgucagagaaaaugagccaaaacacaggguuuaaauaagaucuagcgucucauaauacaaaaaaugucgaaguuucccuugaaaaucacugagaaccaggaauaucucaaacugaauauaaaaagacaaucaggagaugccaacaucaagacaccacagauguuagacuuaccuaacagaguuuaaaguaggcgucauauaaaaaauuaaugaacaauuacaaauauacaugaaacaaaugaaauaauaaaaacucacagcaaagaaauagaaagucuaagcaaagaaauacaagacacaaagaacuauauggaaaugacagaacugaaaauacaauaacacuaaagacucaaugugaacaacagaggaaaaagauuuaagugaaaagugaauacagccuaagggaucugugagacaccauacagaaugucaauccauuugaaaagauagauauagcacaugaacuaucaucuccagcuacaacuggaugaagucagaaaucaguaauagaaggaaaacuggaaaauucaccaauuuguggaaauuaaacacacucuuacacaagcaaugaaucaaagaagaaaucaaaaaggaaauuagaagauauuuacauaugaaugaacacaaaaacacaacauaacaaaauuuaugguauaaagugaaagcagugcuaaggaguaaauguauagcucuaaaugcuuacauuacaaaacaagaaagaucucaaaucaagaaccuagucuaaaacuuaaggaacuaguaaaacaagaacaaacgaaacacaagguuagcaggaggaaaaaaauaauaaagaugagggcagagauacacaaaauagagaacagagaaacagaagaaaaaacuuaaugaaaccaaaaguuguuucuuuaaauaaacaaaaacacaaaccuuuaacuauauggaauuaagagagaaagaagacucaaauuacuaaaaucagaaaugaaagugagaacauuucaaucaauucuagagaaauaaauaggauaacagaguccuauauagagcaaguaaaugccaacaaacuagauaaccuaaaugaaauggaaaacuccuagaaacacaaaaccuaucaagacuaaaccaugaagaaagagaaaaucuaaauagaucuauaauuagcagagacacugaauaaguaaucaaaaaucuuucaacaaagaaaaguccuggaccugaaggcuucacuggugaauucugccaaccauuuaaagaaaaauuaaugccaauccuucucaaacuuuuccaaaaaauuaaggaggagggacuacucacuccuaaacucauuucauuaagccagcgcuaccaaauaccaaggccaaagauaguacuagaaaagaaaacuacagaccaauauccuucaugaacagugauacaaaaauccucaauaaaauacuagcaaaucagauugacagcauauuaaaaggauuacacaccaugacccagugggauugggauuuauuccuggaauauagaauaaaucaacauacaaaaauuaaucaagaggauuuccaguuccaaaaugucagcacagaagcaagcuggcuucacuccucucacagaaaaccaaaaacaaauauacagagccgauguuauuaccaggaauaucccagaacucauaugaagaugcgacaguucaggggccacagaaaaguuaaaaaaaaaaaaaagaauucuagcagauggugaaagaauuggacuuccacauccaugaugucccuccccucauucuggccagcaccuaaugggcaaaaaauuuucccacaacucacuguuucuacacuggaaaaagugagacugagauauaacucaugcuuccccaucaucuaauguucucuggcaggagacugucccuuaucuuagcccacaggaugcaucucaaaugccagaagggaaaaauaucccugcggauaggcagaaacaaaaaagggaggcaagacuaccaucuccagcucuggaaauucuacuguaacucagccaagcaagacacugaaucagaguagauguucauuagauguucaucaacaccaucuguagaagguuuauuguacagguccccugggcaggaacuccuagccagcauucccacacuacugggacauccccuuuggaaucucccucauucgggaagaacagugcucugguucuuuacuagaaccuaggugaaccugggcuuaagguaacuagagagagcuaaaaaggaggcagcaaccuaacaguaaagaacuucuaagcaaauacauccaguaaaaaccaaaacaagccagacagagaaggcugaauaaaacagccacaacaaacaacagaaaacagguacccaugaucuccccaaauggacaaagcaaggaaccaauaacugacacuaaugagauagugaucuaugagcucucugaccaauauucaaaguaguauuuuuaagaaaacucagugaucuccaagauaacacagaaaugcaauucagaaauuuaucaggaaauuuuaaaaagagauuaaaguaauuuuuuaaaauuauccaagucauaacaccaaaagaaaagaaaagaaaaaaaucaaacagaaaucuuggaacugagaaauacacuugcugaacugauucauuagaggcucuugacauaagagaggaucaagcagaguaaacaaucauuaggcucagagacaggcuaugaaaacacacauaggagaaaaaagaaugaaaagcaacaaagauugccuauaagauauagaaaauuaccucaaaaaaaaaauguaagaauuauuaguguucaaagaaaguugagcaaaagcaugagguagaaagcuuauucaaagaaauaauagaaaacuuuccacaacuugagaaaaauguaaauauccuaguacaggaaggucagaaaacacauuugacccaaauaagauuacccaaaggcauauaauaaucaaauuugaaaagucaaagacaaagagaggauccuaaaagcagcaauagaaaagaaacaaauaacauauaaagaagcucuaccuuguaugacaacagacuucucaacggaaaccauacaggccaggaagggacaggaacauuuuuaaugugcucaaagaaaaaaaccaaaacuaccauccaggaauauccuuguccagcaaaauuacccuucacauaugaaggggagauaaagacucccacacaaacaaaagcuaagagaauucaccaccacaagacucauauuacaaaaaaaaugcuaaaaggaauuacucaaucuggaagaaaaaaacacuaccaugaaaaauaaaacaaacuaaaaaaacauuugaagguguaaaacccacugguaaaauuauguauacacaaaaaacccaaaauacuuuacuauuguaauugugguaugcaauccacucacgacucuaguauuauauaaagcccaaaagauaaaucuaucaaaaacaguaacaguuacaacaaccuguuaaguggcagauaauauaaaaauagauaaacugagacaauuaaaagccucuaaugaauucuuagagggagggaugaaguuaaauuguggaaguucuuucaaauuuuccuuuguuucuauucuuuugugaucuaagauaaguugucaacucuuuaagauaauuuguuauuuuuuuguaaaccucaugguaaccacgaugcaaaaaccuauaacaaauucacuaaaaauaaaaagcaacacauuaaaacauaccaccagagaaaaucucuuaaccacaagaaaggaagaguuacgaaacaaucagaaaacaagcaacaaaauggcaguagucuuuacuuaucaauaauacuacugaagguaaaugcacucaguucuccaauuaaaaggcaaagaaagaaacaagacccaauuccaugcugucuacaagaaacccacuucaccuauuaagauacacauacauuaaaagggagggaaaagauauuucaugcaacuggaaaccaaaaaagcucaggagcaacuaugcuucuaucagauaaaguggacuacaaaucaaagacuguaaaaaaaagacaaagaaggucacuauaugaugauaaaggagucagucaauucagcaagaggauauaacaauuauaaauauucacccaucagagcucccaaguauauauaaaaaaauuaauacauccaaggggauagacugcaauacaauaauaguaggagacuuuaauacccuacucucagaaauggacagauaacccagacagaaaauaaacaaagaaacacuggaguuaaacuacaaacuagaccuaauaggccuaacugacauuuacagaacauuccacccaacugcuggagaauacacauucuuuuuaucagcacauaaaacaugcuccagaauggaccauuaucauaggccaugagucugaacaaauaaaaaaaaaaauagaaaucauaucaaauaucuuuucugaccacaaaaagaauaaaaauacauaucaauaaaaagaaccucaagaacuucaaaaacguauggaaauuagacaacaugcuccugaacaaugaagaaauucagaaggaaacuuaaaaacuugaaacaaaugaaaauggaaacacaacauaccaaagcuauggaauacagcaaaagcaguauuaagcagguuuauggcaauaaacaccugcaucaaaaaaguagaaauaggcugggcaugaugauucaugccuguaaucucagcacuuugggaggucacagcaggauugcuugagaccaggaguucaagauccugcagucuggacaugccuguagucccagcugcuugaagaauuaggcaagaggaugccuuguguuagaaauaagagcucagaguugcaaagaaaaugagcacucaaacaaaagacuucucagcaaggcaaauuucagaagggugcugccugcguuaguuacgaucgcaagagcacaccaaacaaaggaaagcagggguuuuuauucccaaugccguuccuguuucuguguccucccccaguuaauuaggguaggaccacacaaucuaaacugauuccgacugacuagauuuagcauuuagaaaaggaaaaagaaccaggaaauucauuguuugaaccuaacaacuucgaguaaggcggcaugggucagcuacaagguugguggauggaggcaugccugggccuguuaaaggcaggaaaaacuacuuauguaauagaacaaaggaaaaggggggugaaacccuuugaagagaaacuguuuguuccuaacaauuuuccccucuugaauuuacacacuuucuucuucaaacuuaccuaacaugaccugacuuugcuguuccucacugucuagaaguaaaaguuuguuaaacuaggguggaaaagaaaucaggaaaguuucaguaagggcuguuguaauaagucuuucaacuaauagggaugaagguacaacacuggguuccuaucaugacacagacuccaccucuuuuuuuuuugcuaauaucauaccuagcgccauccuauuuucccagaccauuuggcuaguaggcccuaauuguugagcuauucuuuuaauggcauuccuaguauaacugacaaaucguuguugguuauaguagauauaauuuauccaaucuacauuuuuauuaauuguugaccaccagaauaacauggacucagacccugcaguuaucugauuucgggcuuuaaauucauuucguaccccucgugggacuccaacggcgucuauauaaacaugagagucaaaggacccacgagggacaucucuuguuuuacgauguuuuaucuuuucugguugaugaaaugccagagugaaagggauauccaauuggaucagagugcaagugccgcuccaguuacuuggcagaguauccaguaauaguccaccacaauaccauccuacauuugcuuggggaugaauaaggggagacugauuaguaagcuccuggaagggcuuaagcucacugcaucccuuuaggucuccaagaaaugccaaguuuuccccguguugugagagacaugagguaaaacuggcauggggaaauggaagcuugauggcccuugggggcugacccgcagggugcuggacuugagggaauagcagagagggagcuuggcauaacuuauuaccccaggaugugagguguuggaagggaacuaccauacaguucaugccugguagacuggaggaccauucgaguggaaaggggacaaucugggccuuuggccugcugugcgcacaagcauagcaaucauuuuuguuuagagugcagacagaauauuuaauccauuucagccaggcauuugcaucucgguacccuguuucaaugauuagguuuguuuuagaucuuuuaccucuacgacggccacuuugguuuuguuacugggugaggaaaggauaauugucugacaguagagaggggaaagaaaaaaaggcacuauaagaggguuaagcuuuuuuuuuuuuaucuuuagcuugguaggaauuggucucggaacaauagcgcaugacuuugaagauggcgaugcuuuuuugacugggguaugaugggucugcauuuuuuuguuguuguuuggacugcagucuuggugguuagaagcacgagauaggguccuucccaagcugguuugaguuuuccuucuuuccagcuucugaugagaacaucauccccaggcugaugcugaugugcugggaacuccaaggguggcaucuguacuaaaaagccuuuagcuuugagggaagagaaaguggaagagagaccaaguacauagcucuugagaaacugacuuuuaguuucaaacguaggaaugucaacagugaagugugaguaaggcagccuauacagcauuucacaaggagauaagccaacuucuuucugagggacaguucggaccuuuaauaaggcaauaggaaggcacuugguccaugauaaucgaguuuuuaaaacuaauuugguuagauggcuuuuuaggguuugguucauucuuucuacucuuucugaugaaggugggugccaggggguaugguauucccacuuuauuucuaauaucugggcuagcuuuauauugucaugugcagugaaauggauuccauuaucugaaucaauguuuucuauuaauccaaacuuggguauaacauuuucuaugagugucuuaacuacauuguuggugguugcacuugaaaaagaaauugcauuuacccagugaguaaggugaucuacuaucaccaguagauacuuuaggcggccuguuggggguauuuugguauaaucaauuuggauacuucggaguggccuuaaucuuggguuucuuccuccaaggggugguuuucuuaggguuuauuaguuuucuuacauauuagacaauuaucuguaacuuguuuugcuagaguauaaauuccuauacauccauagacuuuaagaacugcaucacacauagccugagguccccaguggguuucuugauguagcugagacaaaaccucccucaugagagauuugguuagcauuucucuuuggucugguaacacccauuuaccuucugaguuuucuuuggcuccuauuuuuauuaauuucuccuuuucagcgggagugaagaugggaauggcaguugggggagaaagacaaugaguugguggaaaaugcauguuucagaggaaaaagcaguuuguuuggcucuuuggucugcgagguuauucccucgucuuuuaaaagagauuuuuuuugauguccugggacauggacaauacuuuuuuuuuuuugggggggggggagguggcaaaugaagguuauccaguaccugggugauuaauuaacuguggacaaggucuuggcccuugcuacugaugagacuucguuuaguccaaauuuuucuaaagguaugggcuacccugaaggcauacuuggaauuaguauaaauaguuccuucuugauuuuguaaauguucuaaggcuugauuuauugcaaacaauucacauguuugagcggaccgauuauugggcagucuuucugacucgacuucugcgacagcuuccccaucgaccacugaauacccauuauguuuuuuuccuucaauuaccugggaggagccaucuaugaauagcuguugucuuguuuugaaaggggucccuuaaaucaggccugaccucugugcgauaauuaacuaaauuuaagcacuuacacuuaggcccuuuuagguuuggguucccugucaggaaaccugguguguugagugaacugucagugguuaguguuaagucaucucucuuuaguaagggagcuucacacuuuaaaauucuugaguuggugggccaucuuccuaccuuuugauuuaagauuguccuaaccugaaggggugugcucaccaucaaguuucccccaaagguuagcuuccugcuuucuucaguuaaggcaguagcuguaauagacugaauaaauuugggccacccacagguuacuggguuuaaacuuuugauaggaaggccacagguuguuggugacccccauguucuugaguaagcacccugaaagucacccucuuguuugcguuaaugaaaaggugaaaugauuuuucuagggauggcagcgcuaagacaggaauagcgauggguagguguuuuagcugcucaaccuaguggauuucaucagaaguccacagaagagggucaggcuuuucuugggugagcuguauuguuaccaucccauugagggucuugggcuggaaauauuuggucugcugcaggaauguuuuggauggauguucacauucccagacuauuauagcggcccuauggaucaugcuucuuucuuccccugaaaagaggaugcccaggauggacauucacucagcccaaguauacagcuguggcccuaagaauugaucaauuugaucugcagucccauagggguuauuuaauaaugaucugaguuccucuuuuaaacuuuggacuucugagcuaguuaagggaccauuaacaaagccgaugcuuccuucuccaaggggcacuucccuuaagggaaagagaguuggaguugauugcuuagagguggaggggaaagggaaguucugaauaucuuuguugcacuguuuuaucucacgcuggagccuuccuggggggagacauagacucaggcgugugguuagggaggccagagaacauugauucaggauuacaugggggaggaacugagugaggagauuccugugcacccacuuggggcgggggauuuggcagauacagguggucuaguggguccagauguuagugggcuguucagggguagagaccuuacuccuuucagaggagcugguuucuggcuugcccccuauaccuuuaggggguaaaggaggacaggucccugcugccaacacagggcauaaucuauuuucuccugggaaacgggacucuugucauugacauacuuuauuaaaaguugacaaauuugaauccucauuugaccuaaacuuuggccagaaaacugagggcucaaggauggguucuuugguccaaaugaaacaacaauauuuuaucaucuguugcuuucucuuauguuuaguccucucauuaucuuuccaguauuauuuuaacaugagaccuaagggacuauuaaggggaauguuauuagccuuauacuuucuguuucuugucuuacuugggauaguccccauccuggagguuugguguuaggcucaauccuucauauuagagguuucuugccuucccucucccuagaggcuuaaccccacuuacuggaggucccuugcacucuucuuguuucgcuucacccucuauggccacuuccccagagggacuuuaggucccucuuagcacuggcagguucaguauaagccuuugacuuugacuccuuuauaggagggccgccaucagaagccauaugaggugaccacggaaccgcagauuggacuuacucacucuacacuuaaugugccugaaucucauucaugcacuuucaaccuccaagauaaccugaccacuaggaauacuuuaccaccccugcggcuuuucuuaccuugguauguucugaccaagauauacuucaccgcccccuggcuuuucuuacuuugaucucgaccaccaaggaaauacuucacugcccccacggcuuuucuaaccuuggucugugcagaguuacuugguugcugcgguaucuacuuguaggacuuuucuucccggguuuauucgucaugccaggugggucucaaucucuuaccccugaggccaccacaaugaggcagugggacacgucuccuaaugagagaugcuuggagaccuuuccccagaggagaaugggaucccagaugagcccccaaauuuguuagaagagcucaaagucacaaagaaaaugagcacucaaacaaaagacuucucagcaaggcaaauuucagaagggugcugccugcaucaguuacaaucacaagagcacacugaacaaaggaaagcagggguuuuuauuccuaacgccauuccuguuucuguguccuccccuuguuaucugggguaggaccacacaaucuaaacugaucccgacugacuagauuuagcauuuagaauaggacaaagaaccaggaaguuuauuuuuuguaccuaacaacuuaaaguaaggcagcgugggucggcuacaagcuugguggacggaggcaugccuggguguguuaaaggcaagaaagauuacuuauauacuagaacaaaagacaaggagggugaaacccuuuguuugaagagaaacuguuccuaacacuugugcacaggaguucaagacaagagugagguaugaucacuccacugcacucuggccuaggcuacagagcaagacuaugucucaaaaaauaaaaaaaugagaaagacuucaaagaaauaaugcaccugaaggaaccagaaaagcaagaacaaaccaaaucuaaaauugguagaagaaaagaaauaauaaacaucauagcaguaauaaauaaaauugagaauaaaacaaaauacagaugaucaacaaaacaaaaucaacuaccuuuuagcuaggcuaaaaaaaagaugacucaaauaaauaaaaucagaaaugaaaaagaaaacauaacugagaccacagaaauacaaaaaaaucauuacagacuauuaugaacaacuauaugccaacaaauuuaaaaacuagaagaaauggauaaauacuuggauacaugacuuucaagauugaaccaugaagaaagaaaaccucaauaagcugauaacaaguaaugagauugaagccauaauaaagucucccauuccacuaaauauuaaaauuuuuaaaaauaaaacaaaaaauuaagucucccaccaaagaaaagcccaggaccuaauggcuuccuaauaaauucuaccaguucuacucaaacucuuuaaaaaaaaaaucgaauguuuuggaauucauucuacaaggccagcaucacugugauuccaaaaccagacacggauaaaacaaaaaaagaaaacuacaggccaauaccacugauuaugaaauuagaugcaaaaucuucaacaaaauauuagcaaaccagauucaaccacauauuaaaaggaucacgcaucauaaucaagugggauucaccucaggaaugcaaggauggugugacauacacaaaccaauaaacaugauacaucacauuaacagaaccgaaaacaaaaaccaugauuauuucaauagaugccaaaaaagcacuugauaaaauucaauauaccuuugugauaaaaaccgguaacaaacuguuacagaugaaacauagcucaaaauuaaaagggccauauauaauaaacccacagcuaacaucauacugaauggggaaaaauugaaggucuuuccucuaaggucuggaccaagacaaaaaugccuacuuucaccgcuuuuauuucauauaguacuggaaaagcagugaaguaaaacaaagaaauaaagggcaccaaaauugaaaaggaagaagucaaauuagccuuguuuacagauggcaugaucucauaccuagaaaaaccuaaagacuucaccaaaaaaaacuguaagaacugauacauaugcuuaguaaagcugcaggauccaaaaucaacaugaaaaaucaauagcauuauauauaccaacagugaacaaucugaaaagaaauuuaaaaagcaccgggcacggcggcucaugccuguaaucccagcacuuugggaggccgaggcaggugaaucacgaggucaggaguucgagaccagccuggccaacauugugaaaccccaggucuacuaaaaauacaaaaaauuagcugggcgucauggugggcaccuguaaucccagcuacucaggaggcugaggcaggggaaucaguugaaccugcaagacagagguugcagugagccgagaucaugccacugcacuccagcccuggcgacagagugagacuccgucucaaaaaaaaaaaaagaaaaagaaaaagagaagaaagaaauuuaaaaagcaaucacauuuauaauagcuacaaagaauauaaaguguaugggaaucaauugaaccaaagaaguuaaagaucuauacaggaaaacuauaaaacacuaacuaaagaaaaugaacucacacgugucauuccagcacuuugggaggcugagguggcagaucacuugaagucaggagaucaagaccagccuggacaacauagugaaacccugucucuaccaaaaauacaaacauuagccaggcgcaguggcaggugccuguaaucccaacuacucaggaggcugugaagagaaccugggagguaaagguugcagugagccaagaucaugccacugcacuccagccugggcaacagagcaagacuccaucaaaaaaaaaaaaaaaaaaaaggaaauugaauaggacccccaaaauggaaagcuauuccaugcucaugaaguggaggaauacuguaaaaauaacaauacuaaacaaaguaaucuacagauucagggacaggcacgguggcucaugccuguaaccccagcauuugggaggccgagguggguggacugcuugacuacagccuggacaacauggugaaacccagucucuacaaaaacaaacaaaaaaacaaauaaauaaaauacagacucuaggcaaugccuaucaaauuaccaaugacauucuucacagaaaaagaaauagaaaaaaaacccuaaaaauuauauggaaccacaaaagaccccaaauggucaaggcaaagaacaaagcuggaggcaucacgcuacuugacuucaaauuuacuacaaagcuacaguaaccaaauaagcacgguacuggaauaaaaacagacacacagaaaagaaaaaagaauccagguauaaauucaugcauuuauagccaacucaucuucaacaaagaugccaagaacauauaauggggaaaggacagucucuuuaauaaaugaugcugggaacacuggauauccauaugcauaagaaugaaugaaugaaugauuuuuugagguuaagaccucaaaaccacaggcaaccaaagcuaaaaaagacaaaugagauuacaucaagcuaaaaagcuucugcacagcaaaaaaacacaaucaacaaagugaagagaaaacucacagaaugggagaaaauauuuccaaacuacccgucugacaagggauuaauaaccaggauauauuaagagcuuaaacaacuuaauagcaaaaaaacaaauaaucauauuuuaaaaugggcacauuuaaaaugggcaaaugaucugaacagacauuucucaauagaccugucgagugugggaaacaaugcccaguacaugguaagauucacuaauuguuagaagaucuuuuugauaauuuuuaugaaacaguaaaauauguagguuccuggcuguacagaacagucuuuucugaaucauucuuucucuuuucccucuuuuauaguucuuguuccuugcuuuuuaugacuagugugcuaguugucucuccuuaugagaggugguggaugguuuaaguacaggucuaucaucgagacaagcuggagguaggaauaaaaggaauaugaaagggaggagauuuaaagaugcuucuacccauuucuuuuucuacuuuauaaaccucuucuuuuacugcuuuuacuuuggauuuuaaaagcagugucucaaagagauuauacuguuuucauagcaauauuauucacaauagcuaaaauauggaaacaaaguauccauuaacgaaauaauggauacgaaaaaugugguauagacauauaauagaauauuauucagcuuuaaaaggguaggaaauuuugacauauacuauaacauggcugaaacuugaggacaugaugcugagugaaccaagccagucacaagaagacaaauaccaucugacuauacuuuuaugugguacuuacgguaguuaaaaucagagaaacaaaguagaaugauggcugagggaaugaggaguuauugucugaugagggaaugaggaguuaugucugaugacuauggaacuucagcuuugcaagaugaaaagagucuguagauggauagugguaacggcugcauuucacaaauguauuuaauaccacuuaacuguaaacuuaaaaugguuaggauaauuguccucguuucaguuuuacaagauuagaacagagucuauagaugaauagugguaguggcugcaucucaugaauguauuuaauaccauuuuacuauacacuuuaaaaugguuagaauaaucguccucuuugcgcagugggcagcaugucagucucauaaaaaugguuaccauaauaaauuguauguuauguauauuuuaccacaauaaaaaaaauacuaacccaaaauggauuaugaacuuaaucugaaaaaacaggagaaacaggagaaaauuuucaaaaccuaggguuaggcaaagaguuaugagauuugucaccuaacuugauaaauuggacuucaucaaaauuaaaagguuuuguuccacgaaagauccuuaaagaaaggaugaaaagacaagccacauacugggagaaaauaucuggaaaugauauaucugacuaaggacuaguacacuauaauagauuacauaaagaauucucaaaacucaguaguaaaaagaaccacccaauucgaauaugggcaaaagaccaugaagagacauuucaccaaaaaagauacacagauggcaaauaagcacaugaaaagauguccaaaaucauuugccaucagggaaauguggcuacacaucgaugacaaugacuaaaauaaaaugaggcaacaccaaaugcuggcaaggauguggaaaaacucgaucauucacacauugcuguuggaaauguaaaaucauacagcuacucuggaaagcgguuuagcaguuucuuuaaaaaaacaagcaaacaugcaacuaucauaugacccaucaauuucacuccccggcaaucucuugaaaauuaugcucagugaaaaaagccaauccugaaaguuuauauauuuauuauuccauucauauagaauugcugaaaugacaaaauaauggaaauagagaacagaucagugguugcuuugaguuaagaaggggauggggugagaggaaaguagguguggcuacaaaaaggccucgagugaucuuuguggugacagaaauguucuguaguuugacucuauuaacgucaauauccugguuagugauacuaugcuagaguuacuacuagaggaaacuggguuaaaggcacaugugauuucugcauuauuauuauuuuuuuacaaacauacauguaucuacaauuaacccaaaauuaaagguuuaauuaaaaaaaaaaaggaaauggaaauuucugcacacgaaggaaagaaucuaaaccccaaagaaagaagccuuuuguaagaaggcagacacuuaccuaaacaguguaucugacaagccuagacucaggugggcaaaggaauggaccugauacagauugagugacuuugaugguauaaggaguggagccuuuaaugacgugggcuggcaugaccaguuagaaucuggaggauccuaaaauggagaguuauuuguccccacacauuagaucgccuucauggggcauuuacugaggguacagcaguguagcaggcugagaauggggcuauaaagccaugaaacauuucugcagucucacaguucauacacccuaaagucaugcuaguggaaagaaccaaugaaagacacaaaacucaucucccacccucaugacagcugaaaacagaagccaggugaaaguaacuaaagcagcaaccuaacccuaaacaaauucaacuccuauuuuaucagccucacugcagcuuccugaaaaggaaagaacacugcuucgcuuucaaugguucuuuuauacguuauuuagagcacaauaaaaaauuuaagacauguaaagaaguaggauaacauaagaggaaaacaaucaaaagaaaacccacacagcagaaccacagauguuagaacuauuauagcagaaaagaacuuuaaaauggcaauuuuuaaauacacaggaaaagauguacaaauuagaugcaauaucaaauuuaagagaaauagaaacucuaaaaagagcaaacagacauucuaaaaguuaaaaauacaauaaaugaaauuaagaaaucuaugaccuauucaaaggcugagcgugguggcucaugccuguaaucccagcaccuugagagguugguggaucaccuccugaggucaggaguucaagacagccuggccaauguggugaaaccccacguuuacuaaaaauacaaagaaaaaaaaauuagccgggcgugguggcacgugcuuguaauccuagcuacucaggaggaugaggcaggagaaucacuugaaccuggaagguggagguugcagugagccgagaucacgcuacugcauuccagccugggugacaagagcgagauucugucucaaaaaaaaaaaucuaugaccuguucaagcaaugagguaauuuuaaaugcacuauauucaauauguaagaauuuuucaaauauauuaaauaaaaaugaucccauucuucugucacaugccucccccacacaucucuaaucccucaacacagcaaagacuacuagacaaucacagcacuuucaacuuguuaucagaauucuuagcaaagaccucuagacaccaacaccaauaagagguggcauuggaaauaaaaccuguuugauuuagucaaaacguagguugccuuaaucacagugcuuaugaaaaaauguaaagucaccacuuuguaaugaagcaggggacuaggugaacuuauaaaguaagugaaagugugucauugauuccugccuccugcuuuguccuauuaaacaaaaacuuugugguaagggcucuacaaugugaauuaaaaauccuaccucccagguauauauuugagagaaauuaguggauauguacacaaaaggacuuguauaaaauguuuuacacagcuuucuucauaacaaccaaaaaguagaaacaauucaaauucccaccauggaauauuacacagcaauaaaaaggaacaagcuaccagcacgcacaguaacacagauacugaguaaaagaagccauaauuaaucauauauacugcaugauuccauuuauaugacguucaaaccuaaucuauagugauaugaguuaaaaaaaaaaaaaagauuaucucuggggagggugggcugucuuggaaagagcuaaugggagucuuucuggaguacuggaaauguuuugugucuuucuauggauagugauugcaguuauaaaaaggcaucaagcugcguacuuagauuugugcaguucacacagaaaaaauaaugaugaugaugaaaauaaccaggcugugagguacgauaucugcaaauggccaauaaacaagaaucuuugggaauuauuagaugauguuaagauacuacugaacaggaagaauggcgcuaauaaagaaagcauauuuuaaugacaugcuagcuuuauuuggcauucuauguguccuauaaaaaucuguuuaaaaugauucuuuuuagauauaucuucugcacuagaugagaaguucaucuggggcagggguuagcaaacauugucuguaaaagucuagagaguaaguauuuucagcuuugcaggccauaugcucacugcugcaacuacccaauucugccacuguagcacuaaagcagccauacaagguaaguaaaugagugaguguggcccaauuuggcccacuggccauagucugccaacuccugaucuaaaggaagaacuauaauagccuuuguuuuccguguuuauuuucuacaguacuucacacacaguaggcacucagcgaagcuaaaaggaaucuuuaaaaccgucucuucuaaucccuccacucacggugaaaaacaucaaucagagguuuaaauuugcucaacaguacuacuuuuuaaagcagugccucauuuuaauaaacaugcaaagauuuaauagugauuuaaauuccaaauuuuuuuacauguaaaacauaaguuucagaaguucagacauuuuacauagcauaaacuaaaaauaauuaguuuagaaaaauguaucuuuaccuauaguuugguuauaaguuaucaauacgagcuuucagucacacaaccauaagggaucaaucuaggaaguacuaaaaccucaccauauaaaaugaggagcuaagacuaaacgaaacuuucuccaggacucaaguuuuucuaaaagccaaaaugguaaugaacuuauuuaauaguaguuagcauuauuaggaaacacuugauuauaacuuaacuaaauuauaaggaaaacguuuaacauaauuauacuucaacacaguaauaugaucuacacuaaaaaauucuauuacagguuacugaacauuuuuacguggcagucaaacaaucagccaacaguagagggcagcauuucuauucacuauuaaaaccuaacuuaaaaaauuugaagucuuuuaaaaaaaaucuaaaaaaucugaaauaccuguacugagacuuucuuuuaacauauuuaauaccccuuucaaagcuucuaacauacaauuuuaauacaaccuacaagugaaaguacccuaauauaaauaugaauauuuaaauaaaagauagcuguuuuacccaaaggagucaaauuuuguauucauaauucccaaacugauaaaccaaaacaauucaacaguucucuggugacuuaauuccuaaaauucuaucaguuauguuaaaacaaauuugcugggcacccacuggaaugacaaacauccccacacacgggcauacauuuucuuuacccauauaaagaaucaccaaaagaaucaugaacuuuuggcaaguaggagauucagggaacuguuucagaagacaaggcaaagcaucacucuaaaaucuaaaauaaaggcagcaaaaagaggcugacaaagcagaaacagguauggguaaaagcaucuuucaagcuccuucucuuucauaauccuuuuauuccuaucuccagcuugccuuaaugaaacaccugaacuuaaagaaagacaugauccuauuacaagaaauucugguacuaaaguuacucucagaaguuacuugacagcugggaaaccuccaugcuaaagaacacgaaaugcccucagcugcgguuuaagcagagugcuuuauugcuaacauaagaaaauauaccauauauaacaauaauccuaaaucacucuuguugggccuuuuaugcucugaguuaauuuuccuacagugauuacgagccugacaaaaaugacacuucacugccuggccucuaacaauauuaacuccaccucaacggacauguuugcaaagcagcuagcuaagaacacaagaacuuacaaacacaaaaauaaaucucucuuagacauuauguggaaaagcacaaaauacuguaaccaagcugauuaaaguacauaaaaauguauauaaguguaugaacaauaaucagaaacgcugccaugcuagaaaugcucacuagcaucuuuuugucccacaaaauaucuaaauccagaagaguauuuuuuuuaacucgaagagaaguacauuuucauuuucacuaaaaggcaaaacaaaacaaacauuacacuuggauuuaaaacauauuaaucagaaaaggaauacagagcuauuuaugacagccuuaaauuaguaaauggcauuaauacuacuguaaauggagaccaagauuuggcaguucaguagcagugaugguuuagucaucacaucucacaaccuugucauuugcaaacguuuuaaagucagauucuucauugugaagaacauauaguuaugggggggcgggggggaacaaccaaaaaacuaaucaucauugcuuuagcucaacccacaugccuguacuuaaggguauccaugguagcaaugaugcaacgugccuaccuaguucaccgugccuacacaagugggagagaggggaggcggaugaugaaaaaaauuucacuuggaaagguguuuuaguauuaacaugauaaaauuacaucaacuacacugucagacuuuuaaaacacauauagaaucacaaagcucucuaagaccagaaaagggagaaaagaacaagggaugggguacacaccgcagccuuuaguucaaaagaaaaucaagaauuuugcucuuccugcuagagccauugguuaaauauguucaaaggguuuauuucuaauaauagaacaaauuauuuuaauuuaguuuuuucaaaagcaacuacaaacaauguuuuaggcuucuaauuuccaaccuacauccuucucuauuuuugcuuuaacaguuauauaauaaaaauuuauaaauacuuuaggauaaugauuacaucuaauuuuuuaagcaaaauagacccucuuuugcuaaaagagucaauguaaaaaaauucaaagucuaucaaggaagauggagcagagagaggagauagaucauuucaaauaaccuugcuauaauacuggaaauaaaaccaaaaugaaugaaaugauaaaaggcaaaucacaggggagaaccaacauagacaaccaugaaaaaaauuuagagagggaaaaagcaacaacgacccuguuuuccaggauuaugugcccuuuaaacauucaguaagaauauuucaacaagacaguuuaccuagagguacagagaagacaucuccuuauaaacagggaauggaaacagauaaugggcaugucuguauccgaucagaaacuacuguuugaacuagaacucugagcaacaagaaaagaaaacuaauuuccaucaauuuuccugcuuuuccucuuaugaaaaauaauucauuauacagaaagaguaauagccucuacuuucagaauuuacaaauuuaccuacucuuuuauuacugaauguaauuuuaaaaucucaacaaguuugucuagcaaucacuaugagacaucguaagugcauagaaauaaaaaaagguaaauuauuccauauuuuaaaaaccaauggaugaauuuuaaauguaagcacgcugaaucuauaacaccaucacacaaugucugcaaacuggugcucaaaaauaaaagaagccaaacuuagagauuaagugaagcaugcugcacuuugaacacaaugagcaaaacagacuucaaaacaaguacuuucaaggagugcuuguacaagucuaaucauuuuaaauccacaucaacaucuuucuaaaggcaacacaaucagcacuugacuauuuuccucuuccuaaaaaaacaaaaaauuaacuauaauuauaauagauggaagaguccagaaaaugcucucaaaacgaguuauacuuucaacuagcauggcauguugggacacaaaggggagaagaguagcucugagaauacacugagaagauuuaaauauaaucaggacuuuacagacccuugcugcugggagaaaggcuuccuguaaaucucagggaaaaaacaucugugcaacacgcuuuuggcuaucuaaaacacauuucaaaauaccgcccuuucuaaaggauauaaacuaagcaucacauggauucacacaucuauuuucaaaucuauaacaaugguuacaccuuauuuuuaaaagacacugaacaaagggucucucacaucugucacuaacaaugaaauacagaaaagcauauuauaucuuaccuuugugguuacaaugcacaggcaauccauuacucuaccauuacaauauuuuauacauaaagcaaaacuauuuuaaguugccuaguugaacaaaacauguaaauaaaaauaaauaaagcugugagauaaaaccauaaaugaagaaguuauaacuguaacuagaucucuccaggauccauucuuagagguagcaauuuuucuacuaucuaaaauacaagaaaccagagucugucacgugcccuacaaucuucuuuauguaaucuguaucugaagaacuugaaauuaucccacaaaacacuguggaagaugucaggguuuauuccacaagaguccacugcuucuucagaugcuguuucauuaaucccucuuuucaagauaugagguugacaggaagucaucugaugaaaugcuccacaaagagguucccccgauauaaauuuaaaucugcuucuccucguuagcuacaguuuggauacucaaaugacaaccaccaaaaaaaaaaaaaaaaaaaaaaaaaaaaaaaaaaucacuaaaaauaugcaagcaaacauuucuuccacuaaaccauuucagcaacugcagccugcaaaguaaugacuuucucgagcaguaaugaauggaauauuccaugugguuuuuugagaaggggagcaggaaaaacaaaauacaauaauuuaaaauauuaucucuaaaacuugccuuuuuuucuuugcuaaaaaagugaauaaauaacauuuuaccaacaaaggcaaauuuuaacuuuacugccuuacuaaauccauuucacugaucccccacacaccaaaaaaaaccaccacaaaaagauaguuacaacuauguaaccuuucaaacuccucaagaagucuuuguuuuuaagucaacuaacuuugugaauucauguccugucuccaagaucauuaggacuggagcuagauaggcuaacagacacaggggacauggcagagggauaugcaacuggcuuucaguaucauaagcuuccagccacacuccccuauacaaaugccauagugaaguuagcuacaugugguggccugcgccuguaguccuagcuacuugggaggcugaaacuggacaauggcuugagcccaggaguuugaggaugcagugagcuguaauugcagcacugcacuccagccugggcaacagggugagauccugucuguaaaaaccuuuaaaauccaagaaauuuucuaacaaauuuuuaaugcauaauaaggaagaguauuaucugcaauuuuuguccacaaaguuuccucacaguuuacagauauuaugaaugaccucaaguucaaacaacugaacuguuccuacuugccucuuauaccccauuccuccuccuaacauuucaaauacacauggacugcacuaacaacuuucagacuaaaccacauuucacuguuaagcguuaugaaaaggaguuaauacauagauaccauuugguagaaccuaucaaauaguaagcauuaucaauguuguuauuacuauuauuaguauguaucaaauuacagccuuuuauuuaaagccuaacaggguauacuugagacaggcccaaugggacuuuaccuuacuuuaucuaauggggcuguugugugaggauuaaauaauauacacagggcacuuagaauaaugcugacuuguuaggucaauaguggcaauaaauagugcaacagugcucaguaaaugccagcuacagcuauagaucuauugugguauaauaugaaauauauucggucuuuguuucugucagagugccuaaaacucuuggaaauuccuaaguaaugggaaggucuucuuuuguucaugacaagcccuuuggaucacagcuaaugcuaaugagguaacuuaaagugagaccccuagaaagccucaggaugaggcucaucaccagaaagaccacgggauuagaggauuagaggguuagagggcuggaacuuucagcuccacccaccaaccuccaggaaaggggcagggguugggggcuggagaucaagcucuauaaaaacucuuaacaacaugugaugugcuuuuggguuggcaaaggcaagcugggaaggcugaggacuccaacucuaccaggauagaagcuccugcacuugggacccuuccagaccuugcccuauguaucucuuuuucuggcuguucaucuguauccuuuauaacaucuuuuauaauaaacuaguaaacgcauuucccugaguucuguaagccauccuagcaaauuaaccaaacccaaggaagggguugugugaaccccaauuuaaaacuagucagucagaagcauaggucacaaucuacuauuuccaucuaaaugggggcagucuuguggggcugagcccccaaccugugggaucugacacuauacuucagagacuacuacuaucuccaaguagacacugccagaacuguauuuacguagagacuacuacuaccuccaagcagauagugucagaauugaauuauaggacacccaguagguguccacuggaaaagcuucaccaaaaaccuccucacacaucuagucagcacagaagugugcuguguugagagcagagggaaaaaaugguuuuucuccucucagaccuaaauacauauguauguagcuauguaaaugucaucaugggccaacacaucccuuaucccaugcaggauauagccuggaaauuacaugcucuguugaguacucccuuuuccccaccccaccccugcaauuaucauuugcucccaacaugaaagaguaaagcucauauaaggcucaaggcucauaacucccuaaauaaaguuuaucauuuuuaagcagaauacugaaaacaauggaagugauaucuaaguacugacuaggcauugcauuuugcgaagaaaaauaaggagguauguaaaacccuuuaccugguugcucucuuaguauucugaaguuucucuugugaaauuuuuaucacaucuagaguagucuagcccagagagggcaggcaucccuaaguuuggcagacuucauaauagaaaaggcugaaaaucacuacggcaaguuagaaauaucauucagccuguguaacuuaagcagucauuuucuucgggggggugggaggagggucucaacuuccucuuuuguaaaauaaaaaaacucaaugacuccuaagaguccuugaauuuauaccaugccuauguuucaguuuuuaaauccguuggauucuaagguccaacaggacaagacucaagaaugucucaugaggcugggcaugguagcucacaccuguaaucccagcacuuugggaggccaaggugggagaaucacuugagguccggaguucgagaccagccuggccaacauggugaaaucccaucucuacuacaaauacaaaaauuagccaggcgugguggcgcaugccuguaaucccagcuacucgggaggcugaggugggagaaucacuugaacacaggagguggacacugcagugagccgagaucucaccacugcacuccaggcugggcgacaaagugggacuccaucucaaaagaaaaagaaaaaaaagaaaagaaaugucucaaauaccuaccacuuuauccccaucaucuugggggauagcagggugaccacaauguuugcugaauuaaugaguggccuuucuaauauuuaaacuauaggugauuacaaaauugaaaacagccugaaacaauccugaaaauuagacauuccauuuucccaguaaaaauagaaguuugccaacucaauuacaaaccuguaagaauaagaugaaauagucaaauauccaaauuaaucaguuaacauauaauuacuuaacaacacauuaaaauaguaugucuaauauauuauuccagucacauuucaaagaacaaauuuuaguuaaacuccucacauucaucuccgaugucuagggucaucauaaccacaaccacuuuuuaaugaucuaaucucugugaccucaaacaucaguuuuauacgguuuaaguuguuugagauauggcccuuucugaacuacaacgucacuugaccauuuaucccuaauuacuacuacagauuggguaucccuaauccaaaaauccacaauccaaaugcuccaaaauccaaaaucuuuuaagugccagcauaacacucaaagacaauacucguuggagcauuucagauuuuguuaucuuuuguuuuuugagauggaguuucacucuuguuacccaggcuggaguccaauggcacaaucucaacuuacugcaaccuuugccucccagguucaagcgaugauucuccugccucagccucccgaguagcugggauuacagaugccugccaccacgcccagcuaauuuuuguaucuuuaguagagacgggguuuugacauguuggccaggcuggucucaaacuccugaccucaggcgauccaccugccucggccucccaaagugcugggauuacaagggugagccacugugccuagccacguuccagauuuugaauuuucagaucagggauauucaaccaacaaguauaaugcaaauaucaaaauccaaauaaauccaaaauccaaaacgcuucuggucccaaguauuuuggauaaggaacacucaacuuguagugcucauucacagaagaggaagccacuuuccccuguacuguaggcguguauuuauaaccuucaugauguaacuaaccccuuacuauauuauuuuuuaauauaccuaauaauccuucaaaaaagcuugcauagaucuaauacuuacagguuuuaaggcuguacucagggaaugauuauucaauuuguguuaaauucuacacuaacugcaucuucuguaaguaucuguaaguacccaacuggcacugaguaagguacauuucaagccuauguguucucuucagauggucauuugcuguuaaaaguaauuuagaaaucacccuguaauaugagcuacuuuagaaggacuugaaauauaagccuuuugggauggcaacacuucaccuaauaggcacauaagauaauuaacaguauuuuagaauaccaauggcuuuccauaaacaagcaauugcugccaaccauaauggaauaaaaaaaaagacugacuuucagacacuggacccugugagaagagaaacuaaugaggugaguccuguaaaugcccagaaaaaguuuccuggcuguagcagaagggggaaacucaacgaaacccagcagccuuaaguugaggagaaagcguugagaauaaacagagcuaaaacucacagguaagaguaccagaaaggagagagcgggacagaaaaagcuccagagaucugcagaguuccccucgagucuucagauuaguuuugaucaguacaugcauguaaggaaacuucaaggugaggaaaaaaucuuagaaagcagcaaauggaacaaaacccagagcucacgcaaggccaagaauaaugaaaacucauaauauacugggcaguggggauagccuucuacaaccaaauguugcucagucccacugaaaaagcuuaaaagcagccaggcgcgguggcucacaccuguaaucccagcacucugggaggccaaggagaguggaucacgaggucaggaacucaagaccagccugaccaacauggugaaaccccgucucuaccaaaaauacaaaaauuagccaggcgugguggcacaugccuguaaucccagcuacucaggaggcugagguaggagaaucacuugaacccaggaagcggagguugcagugagccgagaucaugccacggcacuccagccugggcaacggggcaagacuccgucucaaaaacaaacaaaaaagcagucugaauggcaucaaacucuuuccaagucauuuaacuacaucccaaaacaaagcucaagaauauuuaaaagaauaaaaaaauaucuaggcccccaaaagguaaaauucacaacgucugccaaauucauccaaauuaucaagcauguaaagaagcaaggaaacacgauccagagaagagaaaaaaaaucaaucaauaaaaacugacccagaaaugacacauaauagaaucaguagacaaaaacauuuuaaaaguuacuuuaacucugucccuuauguuuaugaagacagagaaggauagaguguguuaauuagacaaaaauaaaaacgaaacuaucgagaccaaccugggcaauccagcaagaccccaucucugccaaaaaauuaaaaaaaaaaauugcccagccuggugguauacauguguagccccagguacuuggggaggcugaggcagcaggacugcuugaagccaggaggcugaggaugcagugggccaugaccacaucacugcacugcagccugggcgacgcagcaagacccugucuccaaaaagaaggagagggagaggagaagagaagagaaacuaaaucaagcuucuagagguaaacugucugaaauaaaaaacugacugagauuaauaguauacuagauacuugagaagauuaaugaacuugaagacauagcaacagcaauugucuaaaauuuaacauaccaacgaaaaagacugaaaaaagauuaaucauaucagugaacugcagacaaagucaaccaaaccaauauacaaguacuggaaucccugaaagcaaaggggaaggaagagaaaaaauauuugcagaaauaauuggugaaaaacgucuaaaguagguaaaaacuauaaacccacagauccaagaaacucaaugaaucccaggcacaagaaagguaaagaaaacuguaacuauaaacaguacaugugagugacaagcaccaaauucaagacagagguuaauucuggggaacaaggcaggagaacgugauuacaguggaaaacacaagagacuucagcuauacuuacacuauguuaucuucuuaagguaguaguaaauacauggauauuuauaauauucacuacaguuucuccaugauuaaaauauuuuuuuaaaaaauaacacaaaaugaaggaaaaccaacaggucaaauaguugccaagaagauaaaaaauuuucaaaagcagaguagagaguagcaaaugccaccaaaaaaucagauaacauaugcgaacagcuucuguuuugcccuuggauccuuuucucuuuuggaaucucacucucccuucauacaaugucuauaaucucuuuuuccaucuugggccucuguucccuucuucacuuuaucuuguaaauauaauauguucacagaggccauuaggagaaagacagggggagaaagcacuucuuaguaggacccuauagcauuccuucucuucuuagcuaagcuucuugaaaacguaguuugccuuuuuuucuucccauucccaauauucuguaacccagauucugacccuccuucuccacaguaacuguucucuuuuuuccuuuauuuaccuuaaaaaaaauuaucuaacuacacagguaauucaggcacaccuuaaacauacuuacaaagacagaugcauaaugcugaagucuuuuuuuauauucuuuucccgagauaaccucuuuuaaccauuugguauguauuuguucagcuaauccuauauguuuauuauuacuuuggguccuacugagaaguacuuuuuucuguuugucuguuuuucuaauggaaucuuugaacauauuuacaggauaaaauaaagaggggaacagaggcccaagacagagaaagagguuauagauauuccauaaugaaaaaggacagugggauucuaaaagaaaaaaggauuaagagcauaacagagcuguuaguauuuauucucugauaugacuuucacauaauugaaaacauauaaaguuaggaaauuuugcaauaaacauguaucacuuuggaaauccaaaaaacaggagaggugaggagguuuaggagcacaugagauaucacugcucuaauacuaaaaauaguaauaagcacagauacagauauagagcaaucaagauuauuuaaaugaugaguuacugaaaaugucacauaaucaaaacucauaauucaaaacuaauugggggugucuucuaggaacacauaagucuaaccaaugugacauacuuaagcuuucacauagccuuucauuuucucaguaacuguguaaaguuuugcugaguuuucuccuagauuaacagcuuuuuuuuuggcauaauaugacaguuguuccacuucucuuauaacauuucuuuuuuuggagacagggucuugauccgucgcccaggcuggaaugcaguggacugaucacagcucacugcagccuugaccuccugggcucaagcaauucucccaccucauccucccacguagcugggacuacaggcaugaaggcaccaaccacgccuaauuuuuuuuuuuuguagggauggggucucccuaugcugcccaggcugaucuauacuaaauuuauagaaaaauguuuuucuuucuucaguaauaaauuaaccuuggcuuacuguaaccuuuuuacuuuauaaauuaaauuuuuuaacuuuuugacucuuucaccuuaacauuuagcuuaaaacacaaauacacuguauagagguacaaaauuuuuucuuucuuuauauucugauucuauaagcuuuuuucuauuuuuuaauuuuuuuuuuuacuguuuaaauacaaacacacacuuuuaaauacuguuaaaaacaaacacacacacacccguuaacuuaagccuacccaaggccagaaucaucaguaucacuggacaguaccacugaaaggucuucagaggcaauagcaugcauggagcuaucgccaccuacgaaaacaaugucuucuucuggaauaccuccugaagggccugccugaggccguuuuacacuuuacuuuuuucuaaaauaaguagaagugcacucuauaaaauaacuacuaaaaguacaguagauaaacuaguaacauaauuguuaauauuuaucaaguauuauguacuguaccuaauuauacgugcuaugcuuuuaugacuggcagaacagguuuauuuacaccagcaucaccacaaacacuugauauacgucaugcuacaauguuaugacagcaaagaugucacuaggagauauaaauuucucagcuugauuauaaccuuaagggaucccuacuuaacauggucuguggcuggccaaaacaucaucauaccacauauuacuguauuucuauagcuuuuuuaaaaaaauaaacguugccuguuacauuucuaucucuauuaaaauuaguucuuucucuccuuauuuuaacuuuauugcaguauuuuccuuugucuagguaacaaguccaauugccaagaaaguuacuaaacaaaaauggaaacaucagucuugaagccugaaguucugaauucuaaucaguuuuucuauagguuaauacugcaacguugggcaguaccaauaucccugaaugacaguuugaucaauucuaaaguaaacacaguauaagcuccacguauuaagaaccaaaaucuggcucaccucguguauguuaggaggcuauagcaagaaugaauucaugcuccucuaacaucccaaauuauuacaauguaugugaugugccuuuuaaaacuaugcuauuugaaaaauaagguuauuauuuuaauccguuccuguggaacacgugaguuuaagaaaggaagacaaagcauauuguauucauuuuaaaauauuaauauuguaaacuauuaauacaauauuuugcauuaauauuuuaaaaugaauacaauaugugcuuucuucucacgcgauauuucucaaauuuuauuuuaccaguucuggggcaaaaggcuaaaguuggaagaaugugucaccugccuguccacuuucuuaccucucaaaaauaacaccucaaagaaaaagcaaccccuaggaauagaaaaauggaaaccaucguuaugcguggauucuaguucaggagcagugaaaacucaaaauaaacuugggaaaauuguuggaaggcaaggacaugcucaaagacuaguaaagcauauccuaagaaaacacagauacuccuucaagugauucgucuagucaaauaugaaguaauaugagcacccaaacuuaaauguauguaaacauuuaguaaauaaaaauuucucgguauacagugauaacuuuguaaagagagagaucaagaaaaagggggaacuuagcaaccucuggaggggauuaucacacaagcuacucaaauaacugaucauuaaaagaaaguaauguaaacuuuagccugucuuuuuagaaggaacagaaguucaucccuaguugaugaagaaaaagaguguuauagaagaaugccaacuaauaacuacaaacagaaugauuaaauuagggagaaaaauaacauuuugaaaccucaaauguagugauuuggcaaugaucaccaauggggggaaacugacucacuacaaggugccaaaguacaaccccauacacacuucacaauaucaacaagaaaaacguaccuuucccguggaagaucuggagguccccaccuuuacgcaauccaacucagcaccacaagagcaacaaccugauauugugagccuccugaugaugcaauaugaaauacaacacuguguaucacugugaggucugcuuaccaaaaacgagucucaucaaccuuuacaccuaacuuccucuuaccagaaauacaaggauuaguggaaugaguuaaauaacauaaggaaacaaaugagacaaauaaagaaugugugauagucuauaaaacaacuggcauggucucuucaaaaagguaaugucauuuaaagggggggaaaagaagauaaggaagacuauucuaucagauuacaaaagacuagagacacuguaccagauuugguauguguauucccaacccauuccaacagucacccccagaucuucacaccuaccuuucauccugagcagccccaggaacacuucaugccuguggcccccaguccacaucuccuccucucacccccucacuuggggcuuuccugauaaaucaccuacacugacaaauccacaacccuaaaguaugggggaacugcugcccacuagaagccaguagauaaauucuuucucuuuccuugcagaguccuaacaugcaguacaaauggcuucucagggaugcaauaccaaggauacaaaaaucagucacacuuaguggcaggaagcauccuuguauuaguuuuuccccuuccuauacuaucuucacacuuucccucacuucugcucucuaggaaugaacucucuaaauaaauuaauagcaccuaagcccucugccucagguucugcuuuuaggaaaacccaguuaaaaacagacaccuaacaaucaaaugcauaaauggcauguguacugacaccuaacaaucaaaugcauaaaugguauguauuugauuuaucugcuuuaucugauuuuuuucaagucccacaaaauagacuggggacaauuuugaauagagauuggagagaaaacugaacaauuauugcuaauuuucucagaugugguaaugguacuaagauaacacagaagaauaucuaacuauucuuacucuuacgagaugcgugcugaaguuuuaauaguuuaagugcaugaugucuacgacugauuuucaaauaguuccaaaaaauacacacauacaggaaaagcaagcacaaucuugucugugagaaagacuaggugaaggcaaaaaacuguacccagaggauacgagccaccuaagaauacacaaaaugcacacaccucagacaucuaccagcgacuuuaguuuaugggaguuuuaugauccacacuccucuacaacuggugcuacuauaaguucucauccaauuucagauagcucccccagcuaacacaucacaguaacucacaagcugcaacucuuugcaacacacuccuauaagcaaagcugaguuuuuuuccaagguaagaugccaaauugauuguaguauucacauauuuauucaccacuuaacaugcauaaacugggcacaguggcucacgccuauaaacucagcuacuugggaggcugaggcagaggauagcuugagcccguuaguucaagggugcagucagcuaugaucacaccaccucacacuagccugaagaacaaagcaagaccuccucuaaggaaaaaaaaaagaaaaaaaaaagcauaaaacugugcuguuguuuuuauuagguuuuaaucucuuuuaauaugucacucacaaaguuuuaaguguuuggucccugcccucauuuuugaaauaacaccugugguuuucauugugccauuuuucauaguguggugauuuuuaggaaaguuaucuguuguuacagcagaccugaauguaaaagaauguucaaugcaacacuaaucaaaacuggaaacaauccacaugaccaucaauggcagaauguguaaauauauucugguauaucauacaauggaauaucauacaacaguaaggaugaaaaaacuuuaccuacauagaugaaaugcacaaauauaagaaaaaagaagcacacaaggggguauauacacuguguaagucucuuuauaugcaauuuaaaagaacgcaaaacuaaucuaugauguuggaaauuuggaugguccucugaggaagaggggauagguaguaaauagggagaguacaaggaagacuucugggguacugguauuuuucuuuuuuaaacugagauaaaauggacaugcuauaaaauucaccaaauuuuaaaguguacaauucagugauuuuugauauuuucauagacuuguacaacuaccaucacuaucuaauuccagaaccuguuagcagucauuccauguucuuuuucuugaccugguauauucacaaugcaguaauuaaucaaccuauuccuuuauuauuuguguaucuuuauguaagaauauuauacaguauuucaguaaauuuuuugucaauguuuagaggacuucagauuaaaccugguacacugaauauauguguguguguguguguguguguauguguguguauauauauauauuuuuuucuuuauuuuuauuuuuauuuuuuuuugagacagugucuugcucugccagccaggcuggaagacagugaugugaucucggcucacugcaaccucugcuucccaggccuccugccucagccucccaaguagcugggauuacaggugcccgccacaacaaccggcuaauuuuuguauuuuuagcagagaugggguuucaccauguuggccaggcugguuucgaacuccugaccucaagugaucugcccgccucugccucccaaagugcugggauuacaggcgugagccaccgcacccggcugaauauauacuuuuaacucuacugccuccuaaaacuccacucaaauuaaagcagauggcuuauuuuaaaauauuaaaccacaaggucaaagagaaagggaaaaguaucccuuaacaccauucagucagaaaacuccccucccaauaagauaaacacugaagggcugaaaggggggacuuguaaauaacaggcacaacuuuuaaaaagcuguaugcaaaaauuaacauaaaaaaaucaguaguauuucuauagaccaacaccaaacaauccaaaaaagaaaucaggaauacaaucacauuuauaauagcuaccaaaaaaaaaaaaaaaaccaaaacaaaccuaggaauaaauuuaaccaaaguaguaaaagaucucaacaaugaaaacucuagaacacugcuaagacaaagugaagaggacacaaaaaaaauggaaagauaucccauguucauagauuggaaaaacuaauauuguuaaaauguccauacuaaccaaagcaauauacagauucaaugcaaucccuaauaaaauaccagugacauucuucauagaaauagaaaaaacaagccuaaaauucauauacaaucauaaaacacuccgaauacccagaacaauccugagcagaaauaauaaaacuggaggcaucacauuaccugaccuacuacaaagcuacagucaccaagugagcaugguacugauguaaaaacacacacagaccaacggaacacaacagagaacacagaaauaaauccacacauuuaagccaacucauuuuugaaaaagaagccaaaaacacacaaugggaaaaggacagucucuucgauaaauggugcugggaaaaucuggauauccauauguagaaugaaucuagacucccauuacucacaauaugaaaacguaacaaaaaacaaaucaaaauagauuaaagacuuaaaucuaagaccugaaaagauacaauacgacacgacacgacacgacacgauacgauacgaaaacauuggggaaaugcuucaggauguuggucagggcaaguauuuuuuagguaaugcuucaaaagcacaggcaacaaaagcaaaaauagguaaaugagauaacaucgagcuaaaaagauccuguacagcaaaggaaacgaccaacagagugaugaaacaacuuacagaaugggagaaaauaucugcaauuuaucugacaaguauuaauaaccagaauauauaaggagcaacaaaaaagcaaguaucugauuuugaaaugcacaaaugaucagauuagacauuucucagaagacauacaaaugguuaauugguauaugaaaaaauguucaacauuacuaauaauacucagggaaauggaaaucaaaaccauaauaagcugggcacgguggcucacgccuguaaucccagcacaugggaggccgaggcaggcagaucacgaggucaggacuucaagaccagcucagccagcauagugaaacccugugucuacuaaaaauauuuaaaaaauuagccgggcauggcagagcacacuuguagucccagcuacucagguggcugaggcagaagaauugcuuggaccugggagguggagcuugcagugagcaaagaucacgccacugcaccccagccugggcgacagagcaagacucugucucaaaaaaaaaaaaaagaaaaaagauauucucuuaccccacuuaauauggcuauuaucaaaaagaccauaaauaacagauucuggcuacggauguaaagaaagggacacucugguacacugcugaugggaauauaaauuaguacagcuauuacggaaaacagcauggucauuucucaaccaccauuuaauccagcacucucacugcgagguauacacccaaaagaaaacaaaccaguauaucaaagagagaucuacaugcccauguuuaucgcaccacuauucaccacugccacgauagggaauuagccuaagugucccucaacagacgaauagauaaauaaaauguagcauauauagacaauagaauauuauuuagccauaacacagcaugaaguccugucaucugcagcaucauggaugagccugaaggauaucuuaugagaaauaagccagacaaagaaaggcaaauaucacauguugucacucauauguggaagcuaaaaagcugaucccauggaguuggagaguagaaugguaguuuaucagaggcugagaaggguacagugaaggaggggaggaagacaaguugguuaauggguacaaaaauacaauuagaaguguucaauagcacaguaggugacuauagguaacaacaauuuauuguauauuucaaaauagcuagaagagaaaaucuggaauauucucaacacaaagaaaugauaaaugcuugagaugauggauaucccaauuacccugauuugaucauuaaacaugguaugcauguaucaaaauaccacaagcaccauauaaauauguauaauuauuuaucaauuuuaaaagaguacuauugaaagcagacuauguguauauucuuccagacaugccuaaccucaugguuuucuuuucacacacagucauacuaugccuccugacauguaaccugcuuucacucauuuaauaacacauaauggauacacagaauauauuuugccugcuacuuuaucuugcauuaaauggcucuaccauaauguguuuauccgaucucuuaccgauaaucuuuuauaucccuuguugguuucuacuaauuaaggcugcagugagcaucccuguacaaauaccuucaauaaucuguggugaaucuggagcauaugcuggaucaaacgauacgaauauaaaguugucuuucaaauuaguugcacuacuguauucucccuuacuaacuguacaggagcuucuguuuccuccuauuuauuuaaucucugacaaucaaauuuguuaaaaauauccuugcugucaauguaauuugcauuuuuaaguguggcugagcauuucuucauaggcuuauuggcccacauuuauuucuucuucuucaaacuacaauacucacacuguuaagucaguuuccuauugaacacgggccuuuuucuuaguuucuauaagaaguuucuuaaguugaaaggacuggaaauuaaaauuaauccuuuuucauauaugugacaaauuuucauccuaauauauaauuuaucuuuguauuauaucuuucaagauucagaaguucuacaaucaaaauuugaagucaaaguccacaaagaaauucuauaaagucagcagcauuuuuaaccuuuuaauuuuugugguguuuuuuggucaugguuagaaaagccuuccuuauuaaaaaucaaaauuuuuauuuuuuuuaauuuuuaacuuuuuuuuucuuguuuggagacagggucucgcucugucgcccaggcuggagugcggugguacgaucuuggcucacuccagccuugaccuccaggacucaagcgaucuucccaccucagccuccugaguagcugggaccacaggagggagccacuacacccagcuaauuuuugcauuuuuuguagagauggaguuucaccauguuucccaggcugguuucgaacuucugagcuuaagcgaucugcccagcuuggccucccaaagugcuggaauuacaggcaugagccacugcgcccagccccaaaaucuuacuuuuaugguuuuuuuuuuuuuaaccuuugaaucucuagucuaguugaaauguauugugauguuaggaguagggugcauccuuuucuacugaaaugucccauuaaaucaggaaauuccuccuacucuuucaucuugccuuuuuuuccagagggagucucacccugucacccaggcuggagugcagugguacgaucuugccuuccuggguucuuuggcaaccuccgcuuccuagguucaugcgauucucacgucucugccucccaagcagcuggaaccacaggcacgcaccaccacaccuggcuaauuuuuguauuuuuaguagaggcgggguuuugccauguugcucaggcuggucuugaacuccugaccucaggugauucaccugccugggccuccaaaagugcuaggauuacaggugugaaccaccaggccuggccucaucuuuuuaagagucaucuauccuuccuuauaaaucaacccuuuucuacugaaauaucccauuaaaucaggcaauuccuccuacucuuuacucuugcuuuuuuuuaagucuauauccuuucuuauaaucucuaaaacuaacucacucuuauuuuagaauagaguuguucuuauaaaaaugauguguuauuuuuuaaaauuaagagagagagccgggugugguaccuuacaccuguaaucccagcuacucuggaggcugaggugggaggacugcuggagaccaccaccaggagucugagacuagccuaggcaacauagugagacccagucuucaaaaaacuguuuaaagaaaugguuuuggggucgggcaugguggcugaagccuguaaucccagcacuuugggaggccaaggcagguggaucaccugaggucaagaguuugagaccagccuggccaacauggugaaaccccaucucuacaaaaauacaaaaauuagccguguaugauggugggugcuguaaucccagcuacucgggaggcugagguggaagaaucaccugaaccugggagguggagguugcagugagacgagaucguaccauugcacucuagccucggugggagagcaagacucugucccaaaaaaaaaaaaaaaaaaaaaaaaaaaaagaaaugauuuuagcugggugugguggugcacacauguaggcccagcuacucaguaggcugaggcaggaugaucccuggagcccccaaguuuugaggauacagugagcuaugaucgcaccacugcacuucagccugggugacagagugagacacaguuucuaaaaaaacaaaaaaaguaguacaaaaaagaaaaaaaucccuaucacucugaaacaaucauuaaacacuaaacaaacauuauuccaaacaucucacuagacauaugcucaaaguaaaagauaauauauacaaaaaaaauuuuuuuaagaaaaugggauacuaauccugucccuuuaaauuuacuacaucagaagaaauagaacaaacaaaguuauaaggucacaaaguaacugacaaaugaccuggcaagaauuagaucagugaacuuaaaaaaaaaaaagacaaaacuggauagcugcuuuaaagaugaagauuugcauuuuaagagaauaacagucaaggcuuugugaaaauugagcaaucuuaacuacuuuuagcaaaaauaauccucuuuuuaguccugcaaaagcaaacaugaagucaaagaggcauguugcaugcaauuuuguuggaaaagauuacuauauccaagaauuaguacacaaguauaaccuaaauucuguuuaagacaaaaugguuuugauuuucaaauuuuucaaguuauaguacaauaaacuuuaaguuuuaaguuauuuguuuugagcaaguggauucucuaagucccuuuuuaguccuaaacaucaugccccaagagucuaaaguagcaaaugaaacaagagaucaaaugaucacuuagccaaguuuuccaaaugaagcaugaauggaugggugaaagggaacaugcuuacuuucucucauagcaccuucaaaaaguagcaauuaaauccccaaacauuccagguuuuuuaaaaaaucauuauaaauaucauccaucaguguguuucaaaacuauuuacauuuucagacaaacauuugucaggauuuucugucaucucuauaagaugguacuuccuacuaacugacuuugcucacuccaguuugauauauacagguuuuugcuacuuuuuaaacaucuaggccuugauggacauaucccaauguuccccuuagagucuauucaugaauaugaacagauuucaaacauuacuacagcauuuuccaugugccaugcgcuaaacaacacucugugaccauauucucuucucaucuacuuuccaaacuaauaagaucugacgcucacaauaugaaaguucuuuuucuccuauucccuugaggugccuuuaccauguucauaauauaucuuucaggagguguagaaaccagagcugcaaauagcguucuagauaugagugccucaucauuuuauaaaaauugaaguguuaccaaugccauuuuugaugaaauucaaugcacuacugaucuuccugaaugaaaucuauauggaaaaaaacuuucagcuuacaaaacuguccacuuuuccaaucuuaaagaauacuuacaguuaaaaauauuauuauugauauauaaugguauguauuuauaggguacaugcgauauuugguacgugcauacaauguguaauggucaaaucaggguauuuagaauauccaucaccucaaacauuuaucauuuauuuguguugggaacauuucaaaucuucuaaaccauucugaaauagacaauaaauuguuguuaacgguagucacccuacugugcuacugaacaguagaauguauuccuucuaacuauuuuugaacucauuaaccauccucucuucaucuuuucccucucccacccuucccagucucugguaacuaucauucuacucuuuaccuccaugagaucaacauuuuuagcucccacaugagaacaugugauauuuaucuuucugugccuggcuuaauuucacauaaugaccuccaguuccauccauguugcugcaaaugacaggauuucauucuuuuuauggcugaauaguaguccauuuuguguguguguguguguguguguguguguguaucacacuuuauccauucaccuguugauagauauuuagauugauuugauaucuuggccacugugaauagugcugcaauaaacaugggggugcagguaucccuuugauauucugauauccuuucucuuggacagauacccacuaaugggauugcuggugggcaguucuauuuuuaguuuuuuugagaaaccugcauacuguuuuccauaauggcuguaauaauuuacauuuccaccaauaaugucaaauauucacuuucaaugguuacauuacuuaaacaaucgccuauaaaaauaaguaaaucgaguauaagaauucgaggcuuuauaaucaaggguaucauaaaucggacaauaaaaaauacuaguaagcaauucaauucucuuaaaguuuaacauguuuuuuacauaagcaauuuucuaaccuagaacuaagacaauaaaugugaaauaacugucuuagucccuucuguguugcuacagcugcauaccugagacuggguaauuuaugaaaaacagaaaauaauuucucacaauucuggaggcugggaaguccaagauccagguaucugaucugguaagggccuucuuguuacaucucaacauggcagaaagcaaaaaguuaagcuaacaugcuaaacuuuuuguggaggcucuuuuuuuuuuuuuuuuuugagacggagucucgcuuaucgccagucucgcuuguugcccagacuggagugcagugaugccgucucagcucgcugcaaccuccgccucccagguucaagcaauucuccugccucagccucccugguagcugggauuacaggugcaugacaccaugcucagcuaauuuuuguauuuuagacgugagacgugguuucaccauguuggccaggcuggucucaaacuccugaccucaagcaauccacccgccuuggccucccaaagugcugggauuauaaacaugagccaccgugcccaagcuguggaggcucuuuuauaagggccuuaaucccaugaaggauggaggaguccucauggccuaaucaccuccuaaaggucccaccucucauuaucuucacauuggcaacaccugaauuuuggaggggacacauucaaaccacagcagugacugacugaagacauuuuaaaaauccauuugaaauagaccucagacuauuauaaaagcaagugauguauuaacccaaagaguauggaaauggaaauuauccuggaaaaagugauggaaaaaaaguguaaagaaaauaaggauauacacaauaaacauuacacuaaucaaaaagaaacauacaaggucuaggauuaauaaagagaacugugaguuggguguuaagaguccugaaauucaaagguauaauugcccaaacuagcuaaauaaagugggucaaguuauucuauuauggaucucaguuuccucaucuuuaacaugaagacaagggaucagaugugcuccgauucuuccugcucuaaaauucuauaguucuguuacuuaaaacugagaagccaucuaacuucuuuaccaaagugcuaucugguugaggccuaccaccacuuuucccugauuuauuauucaccaaacagaaacaucgcauuuuccaggcacagcaccaucuuacacuaacuagaaaggacuagauucaaauucagacaaauaaccacuuucaaaugacuaaugcuucuuaggcagaaucuuuguuacaaacugcuucauaccucugcuauaccauauccaacugggcaacaguauaacacacacaaaaaaguauauuacuaagauaguuaugaauacucaaagaaauaacuuuacagaaaauguagaaaccagugcugauguucagguuuacucuucagucucuagugaguuugaaugccauccuucaagccaauaaagaagagauuccuugagguaaauggguacaacuuagcagcccagaccacaaaacuauauccuauuucuaggaaagaauaccagagcaaaaccaucuuuucaaaguaccauuuccauuuuaauuaccacacagaugaagccuuguugaggucuaucaugcaaagaauuuuuuaauagucuaaaucaaguauuucagacuucaaacauucauaacauuuuaaaacaggggcaacagagaaucugagcuuugcuuuucaaaaauauuuuuaaccccauucucuuuauucuauuauaaauuauacuuccauaacaaaauccacuuguauaaaauauuauuuuaauaaaauaaagaaacauaguaacauaaauaaauugaucaccaaaaaacagcuucagaacacauuuuuuaucucaccucuacacuagggcuaaggcugcuuggcagugucucugaagucacaguagagcuuggaaggcuggaaaucucccaaguauucacagguugaauugguucagacggcuuugaacgaucuauacauuuuggauuauccaguaaggucacuucauaaaauucuugaauaucuagaagaaggaaaauaaaaauucauaaguauuuauauuuucuaacuaaauuaugcaaugcuauaacaacauaacucaaaagcacaauuuuuacucuagauuaguaaaucaauucccaucguauaauguacuuaaacagugaauauuaucuuauuucauuauaucacaaucauaucagaaccugcagggcacaguguaaaauucauaggcuuuuuacacuucaaagucagcacuugauucaaaucccaacuccaucaccaacuagcuacaaguucaggcaaacuacuuaaccucugguaacuugccucuuagcacugugaauuguuucaaggcucaaguauaauacauauaagaugccuagcacuauagcacagaauaggcuccuaacagaugguagcuaauaucauuacugugaauucuacagauaggaguuauuaccguucaccaccaauaucuaagcugggaauguaaaucccucaagugguuuuaauugcccuucuagccaaagccaaagccaaaaaaaaagaggaaauuaaaaucaaagaacuagaagggcuuucggauauccucuagucugaauauuuuauaauaguaaauuaaauauuuuauacuacuuuagaaacaaucaguuaaagucaugacaaaacucuaaaauaaaugauaaauuuauuuauaauagcacaggauaauuuaaaagaucaaaugacuuugcaaucagcuagaauuauaaaaacuuauuaacacuaauuauucccgcuauuccgaagcuguaaguagcaguuauauaacgcuuagauucaccacgcuuaauuccuuauucaccaacuuguauaauuuuggauaagggaauaguaaaagugggcauuacccuguauagaauaauucauaacuguaagcaacauuuagacagaauaacuuagacuucuugcuucucauuauuuuaaaagcauuaguccuuuuaaaaacaaacuucacaaaauagagacaaacuuaacucccuuuucaguuggguuguuuuuuuuuuuuuuuuuuuugagacagagucucgcucugucgcccaggcuggagugcagugguaugaucuuggcucacggcaaccuccaccuccuggguucaugcgauucuccugacucagccuccgaguagcugggacuucaggcacgugccaccaugccuggcuaauuuuuguacuuuuaguagagacaggguuucaccauguuggccaggcaggucucgaacuccugaccucaggugaucugcccgcuucaggcucccaaagugcugggauuacaggugugagccagugcacccagcccccuuucaguuuuaauaaccaguggaauugcaaaacuuuccaaguaaagggcugguaaaaacuaacacuuguacagugaggauaauauuaaccuaccucacaggguguuaagaauauuauauacacacauacgcacacacacauaugugcuaugcauacacgcaaacacacacacaucacacuauguaaaacaaaauccaacuauagcaaaauaaugcuucaaaagucaucucucucaauacuauuuuaucaggaauugccaaauuuacuaccuaguauaaaaugauagucuuucaauaaaccuaugcaaaaauuuaacuugaguacaacucuaaacuuaaaucuucaccaugaaaauguaaagaaaaugggagcacagagggguagucaagagacugccaauagcuacaagugauucuauauucaucugaagauccagaaagcuuaccaaauaccaaagaauugaaaucaccuauuacauuuuuauuuacuacccugcgaaaaauuauuuucuuugaaaauaaugauacacuacagcaagcaagaagagaaaacaagaaaaugcagaaauacuaaaauauguauuaggaaaaaauuagauuuugguugacucacaacugaaaacauuaauuuuguugaaaccuacucggucaaucuuaucacagucuauuccucauuuuccauucauaaucugcaagugcuuucccuguuuuggccuaaacuggguuuccacaaguccgauuccugaacgcagaucuaaacaagaccacacaaagcucuaacauguacacuaagaaaccuccaaaaaucaaacuugaagaaaagcaguuagguccaacagaagaggccagaaucauucuuaucuauuaaaaaaaaaaaaaaaaaaacuggaaaucuccaagaucacacauuucagaagccuucaaauauauaauuuucuuuuacauaaaaauuuuucauuaccuuuguuauuuucuugcuagaauucaaaguuugcaaacaaugggaguaaagggaaagugcagaaucccagaaauacucucaaagggggugaggaaugggagaaagggaacuuucaaauaggcaaagaaacauucuagcuuuuggugacaacuuacauaaucuuaaacagagaaacccacaagccaagaaacauuucucaaacuaaagaaauaaggcaauacuaacuuagggucaggggagaaaaucuaaauacaggcccaagaguauguaauaauuuaacauaauaccggugacauuucuaaucuaugagaagauaauaauuuuauuugauggggaaaagagaaugaaaagauaagccacagacagggagaaaauacuggcaaaacacauacccaauaaaggacuaauauucaaguggacaaaaaauucuuuaagacucaacaauaagaagacaauccaauaaaaaaauaggcaaaagauacagacagacacuucaccaaagacagagauggcaagugagcauauaucaaauaucaccagggaauuucaaauuaaaacaagauacuacuacacaccuauuaaaauggcuaaaauccaaagcaccaacacuaccaaaugcuggugaggacacagggcaacacauugcugacaggaaugcaaaaugguacaaccacuuuggaaggcacuuuuggcauuucuuaaaaacuauacauacucauacuauauaugcuccagcaauugcgcuccuugguauucacccaaacaagcugaaaacuuaagucaacucaagacccugcacacaaacgcucacaguagcuuuauacuaacugauaaaacuuugaagcaaccaauauguucuuuaacaggugaguagauaaacuguaguauguccacacaauggaauauuauucagucauaaaaagauacgagcuauuagguaugaaaaggcauggaggaaccguaaauauauuacuaacugaaaaaagccaaucuaaaaagguuacauacuuaugauuccaauuaugacauucuggaaaaggcaaaacuauggagacaguaaaaagaucagugguuuucaggaguuugugugggggguguagaagugggguaccggagaagaagaagagcacacaggauuuuuaggguggugaaaaacaacagcggucuccaaccuuuuuggcaccaaagaccgguuuuauggaagacaauuuuuccacagaaaagagggugggggagcuucugcagugaaacuguuccaccucagaucaucaggcauuagauucucucauaaggagugcacaaucuagaucccuugcacgcgcaguucacgacaggguucaugcuccugugagaauguaacgccgcuacugaccugacgggaggcagagcucagguggcaaucgcucgccugccgcucagguacaggucuguggcacgggaguuggggaccccugcuguacaauacggcaauaguggauacgugucaaagcaaaaaaugugcacaucagauuugucaauguacaaugcaaagagugacuacuaauguaaaguaugggcuuuagcuaaugacaauauauuaauauuggcuuaucaauuuuaacaaauauaccacacuaaugcaagguuuguuuuugagacagggucacucaggcuggagugcaaugguaugaucaugcucauugcagcuguuaucucccuggcuccagcaauuccaccaccuuggccuccucaagugcugggauuauauacaagagccaccugagcucaggccuuuuuuuuuuuuaaagagacagagucucacucugucacucaagcugcaguacaguagcgccuucaccuccugggcucaacaaauccuccuaccucaggcucccaagcagcugggacgacaggugcaugccaccaugccugguuaaauuuuuuuuuuuccuaagacagggucuuacuauguugcccaggcuggucucaaacuccugggcucaaggauccucccacccuggccucccaaaauguugggauuacaugcguugagccaccacacauggccuacaagauggaaaagggaaguggggcuuugggauaugggaacuguacuuuccacucaauucuucuguaaauucaaaacugcugaaaaaaaucuauuaauuucuuaaacugcaugagagauaaauaaacuuauauuaaaaggcaaucucauacuuuauaucaagauaauuuucaaaugcauuaaaauguuaaagucuugaaagaauuugaauacagguuuuuacaaucuuggcaauagauuauaauaauguuggggcuuagagcauugggaauguuuccaaacguauuaagggcagaaagcaguauauugauaaagaaaaauauugauaaacccaaccauauauauauauguuuucuuuaaaagccaaguuuaaaagcaaguaacacgggaaguuauuugcaauuuacacggcagaguugacaggccuaauguagauuuuauaccucuaagaaaaaggaaaaaggaggaggaaggggcacaaauuaaacagauaauuuacaaaagaaauuaaaauaauuaaagacuuucuuacagcuuuggauauuucuuuaaucaacaaaaugcacaauaaaacagaaaaaugacuaaagguauauuccauauaucagaguagaaaauauuuaaaagauggauaacacucuguauugcuuaagguauggugaauuggucauucuuccacauacuuccuaaaaaauaaauacaacauuccuaagaguauuuaacaaauuaccucaauagccuuaaaaugcacacucccuuugaccaaacaauucauuucuaggaguuuguccuaagaauauaguaaagaauugaaacaaaaaugcauaugcaaauacaauauuuauaauucacaaaaauuacaaaccuaaaugcuccuaggaaaccauuaaaaaaacuacagaaaaucuauauaggccgggugcaguggcucacaccuguaaucccagcacuuugggagccugaagcaggcagaucaggaggucaagagaucgagaccauccuggccaacauggugaaacccugucucuacuaaaaaugcaaaaacuagcuaggcgugguggcgcacgccuguaaucccagcuacucaggaggcugaggcaggagaaucacuugaacccaggaggcagagguagcagugagccgagauugcaccacuacacuccagccuggugacagaucaagacuccgucucaaaaaaaaaaaaaaaaaaaagaaaagaaaaggaaaaaaaaaaucuauauacacagucacuuaaaaugguacgaaucuggccaggcacagugguucaugcauguaaucccagcacuucgagaggcugaggcgggcggaucaccugaggucaggaguucgagaccaaccugaccaacaugaagaaacccugucuguauuaaaaauacaaaauuagccaggcgugguggcacaugccuguaaucccagcuauucaggaggcugaggcaggagaaucgcuugaaccuaggaggcggagguuguggugagcugagaucaagccauugcacuccagccugggcaacaagagugaaacugucucaaaaaaaaaaaaaaaaaaaaaaaaauacauacauacauacauacauacauacauaaaaugguagaaaucuacugacauggaaagacauuugucgauaaacuuuagaagauaaaaacaauauguauaguacagagaaaucauacuauucacacuuauacaaauacaacugcaguauaucuccccugcaaaaaagggcaacucugucuacccaauaagugacugucacaaauaaaaaaaugagaaggaagaagauucuuccuuuagguagucugaguuuucaugugccucucaaaaugugagcuucuugcuauaucucacugugcugagugugauucuauaauuacguguuuuuaguacaagaagucaaacaagccaguugcuucgucuagggcucaagugaagaaaucauuccuuuccacuagaggaaaaaaaacaauugugcuguaauuaacaagagcuaguguuaaauuucugaaggcuuuucagggauaauuuuaacuagaugagguuuuucaccuuacaugcugauuuuaaguaucaauucucacaagggaaauaacuguuuuacuuagaaguuuguuuugcaaaaugaaggugggggguggcguguauacacgcgcauacacacacacacacacacacacacacaaauaacauuccaggauauucaucccauggaugaaguaggagguaaccucuggugugaauauuuucuuaugguauuuuacauauaauaaucugaucucaaauguuuuauauagaacaugcaucauuuuuauaauaaauuuauuuuggaggguuacaggaaaggcaacuagaaagcugaagaacacugaaauauaacccuaccauuucagaggaaaaaaauucuaucaguucauuuacuaaaagcaaguaugauuauucagacaauacccaauugaguaaucaaaauuaacaucaucagugaagggcagaugacauacuaagauaauaccacaauagucaaaucuacucaagcacaaauacucuuucuucuaaaccaauguucauuuaaaaagucauuuuugaccccuagaagaaagaauauccuauaaaauuuaaaaguuuguacuauuguuucacacacuaaagaaaggaaagaugucaagcuaguaggcaaaaauaaaucacuugaauacuuuagauacuauuagacuaagaaucauacaugacucacaagcauauuccauaaaacaagguguguacuaaaaggaaccagagcuucucagagaaauggcugauuccagggcuggggcaggagagguacaagauaaaccuggaacaucuuguuaugccaaaaauuaagaaagugcuccaaaaaaugaugagggcaucucauaaggacacaagcuugaaagggcccccacuggaucacucagagcacaaaugucauuaaggaugguaauaaaugauaagucauugaaaaaaaaacagguaucugcaaguucaugaaagacacgggaaaaaaagaaggaaggcucuuguuuagaauaaaaugcaaaguguuaacugguaaaccuaggaguguuacuguuagaaaucuuacuuuucaacaaccauauuauaaaccgguucaagaaucaucaauggaugcuaaauauggguggaaauuuugcuaaggaguaggauauguacaugguguuaaagugucucccccacauauugccuauaagccacaagggguaaaaaacaaugacuauaggauacagaauucagacaacacccaacuagguaaucaaaaucaguaucaucaacaaagagcagaugacucuguguaccucuggauguacagaauccuaagccaggaauacaaaaccugaaucuaaucacaaggaaacaucagacaaacccaaaaugagaaaauuauauuaaaaaaaaguaagaguggaaggaacugcguuuuucaaaaucaucaaucucagcugggcgcaguggcucacaccuguaaucccagaacuuugcucaggaguucgagaccagccugggcaacaccugucucuagaaaaaguuagccaggcgugggggcucacaccuguagucccagcuacucaggagccugaggcaggaggauugcuugagccugggaagcagagguugcaguaagccaccacugcacuccagccuggguggcagagcaagacccugucuccaaauaguaaaaaaaaaaaaaaaaaaaaaaaagucagucucacacaagacaaagaaaagcuguggaaaugugcccuaaguaaagagacgugacaacuaacgguaauaucugguccaagucuggauucugcacugaggaaaaauaugacccugcagagaggaaauggcuuagaagaaauauuuagaugccuuuacaacucugauuccaagguucuaaagagaauucagccagauucaacauaaucaaaacacugcuucagagcaguaguaagcaaacuaugagcaaagaacucaaucuaauugaaucaaaaccaucaagugagaaguuacuaaaauucuccauuucaggaaguuucagccaacgaugugauccauauccuguuuuccuuacucaaaucuagccuacaaaguuacacacacacacacacacacacacacacacacacacacacaguuagcaagagacuaaaauguaacaucagugggacuaauauaaugcaaaagaaauuuaagaaauuuugacauuuuaccacuauagcuggaagaucucaaacccugauuacuaaacacuguuuucaaaaugugugauuuccaucaucauaaacauaaugcaccauuauaaauauuuuccuucaaagugacaaucauuuaaagauuacuaacccuaaagauugcuaucugucuuaagcaugcuugucauuuaguauucuuuaucagauuaaaauacucaguucugaaaaacaacgauaaagaauaucccaaugguugacggugagaaguaucuauggauucagauuaguugaguucaauuucuggcuccgcaauuuagcaucugaggguccaagggcaagauuggucauuucucagugcuucaguuuuccagucuauaaaacaguacaaacaccucauacaggugaauguacaccucacaggauuacaaugacuaaaugauauauuuguauuagcacauagaaagugcucaauaaauguugguuauuauguuuuacauacacuugaagaggagucauauacucacacuuauuaggauggcuauuaucaaaaaaagaaaggaaaaaaauuaaguaucggcaaggauguggagaaacuggaaauccugugugcugcuggugagacuguaaaaugcugcaaucacuauggaaaacauuauggugggcccucaaaaaauuaaaaauguaacugccguaugaucccacaauccuauuucuggguaaauauccaaaagaacugaaagcagggucuugaagaaauauuugcacacucacauuccuaacagcauuauucacaacagccaggaggaggaagcaacccaacuguccaucaauggauggcuagauaaaaugcgguauauacauacaacggaauauuauucagccugaaaaaggaagaaaauccugucaacaacuacaacaugaaugaaccuugcggacucuacacugagugaaauaagccagucgcaaaaagacaaauacuucuaugagguuucuaacaugaucaaauucacugaaacagaaagcagcacguuggucacaaggggcugggaagugagaggaaaggggagcaguuguuuauucgguauaggauuucaguuuugcaagacgaaaguguucugaagauuuguuucacaacaauaugaauacauuucacacuccugaacuguacauuuaaagauggugaagauggcaaaggggucauacuuuugaaacuaguaucuacaaauaaagauaggguaauguccuuuuauaagggcuagugaaacuauuagauuuuaauagaguggcaacaaaugaacugguaacuaaacucauaaauggacaguauuauuacauaauccacuuucauucugaaaucucugcagaaauaaaacacugcauuagaauaagcuuauuuauugcagacaaaauauacaaaucacaugacucaacuuacucaagucucuaaagccagccuaaucuugggccccaguuuuucucaugcacaaggaaagcagaugaguucucugaucccguaagaaauaacugcagggguuuagacugguaugaagucucuauggacuagcagugucaucucagaucccacacaccuuagaaucaugaaugaacugaaaccacuauggaccugaauaccugggcucugauuauaaucaaaccauaucccgucuacucaaaaaauuuucaaacuuaagcacaaaaaacuggaauacaaaagcaaguuuucaaauugcucucaccuaaaucacagagugaaauuaagcagacuuuaucuuccuuuauacaaaaauaaucaccagguauguuuugggaguaaauuuuaaacaaaugugcaguucauggacuuuuguuaagauacaacuuuaaauauuuagcucuaaagaaacaauacaucagcugaaauucaaaauuaguaaaaacuuuucugcuuucaauaauuuuuaaaucuuuaagccauccuucaaagauacuaccaaguaucuaucagcacuagaccaaugauuucuauauuacauugcgaguaucaauuauaaaaugcacuauuucaugugucagaacacagaaacacugucaauuaaaaaugacauauaccagauauugaaauauuuaacaguugguauuuuagaacaaauauaauacaguacguacaugcuugucccucugaauaauccaaaaguacaggaaccuaaucuauguaucaacuacagggggggacaccaaaccccuagagacucaaacuuuuuuaaaugcaugaaaagucaauauaaacuaccaguucaaagaaucaaucaauaaaugaucaaugcagacugaaaauccaaagacacuuggcaccccaaacagauaacuagauaacucacugcggccuaaacaagugauuuccaaauuaaggaagugaaaaaucuaagcacucaaugacuccaaacagcucagguggccaagaccccuguucuccuuuaauccagugguccacagguaccaacucagaagacagagugccacuuacugagagaaaaaaccuuucaguaaguggcacucugucuucugagucggauuuuucugcaaacacuauggacacaaugaacugguuuagcuuagggcaguuuacaagcuuaaaguacauuuaugacacuguuucaaaacaaugguagaguugcaaaauacaaagaaaaucuuaucagacuaaacauuuucagacuaaguauuaaaaguuauucaggaaacacaagagaauguauuuauuccguaguaucaacaauuauagcauggaaacacacagaaccucuauuaaacguuaucuauuucaaaacuccuaaaaucuauuacuugucuuacaccaaaaugugauauaguaccacauccuauagaacauuaaauauaaguaaauuuaaaugucaaaguaaauucacaaccaaugaaauuagaagauucacaaauauaaacuuaguaauuaggaagcuaacucuaggccagacgcgguggcucacgccuguaaucccaacauuuugggaggccgagguggguggaucacgaggucaggagaucgagaccauccuggcuuacacagugaaaccccgucuuuacuaaaaauacaauacaaaaaauaaaaaauuagccggacgugguggugggcaccuuuggucccagcuacucaggaggcugaggcaggagaauggcgugaaccuggcaggcggagcuugcagugagcggagaucucgccacugcacuccagccugggugacagagugagacucugccucaaaaaaaaaaaaaaaaaaaaagagaagaaagcuaacucuaucaaaguucaauuguacguaagaauagacacauucaaaacaggcaaggcagaauaggucaaaaaugucucugaacacagcaaacccauccccaaucuagacagaaauauaaauguagauucuguuauuucacuaacgauuuaauuuucuuaaguuacagccaucacacaaagaaaagucugcagucuaucuaucugccuaucuauacauauauguauauauauaucucuauacuguugcgaaaaaacauacuuuuuuugcaacaguaacugcaccaaauuacuaggcucaauguugauuuagaaaacaaauaacuaaaaaaugcuuuuugcuguuuuuccagaggaauccaauuugaucauccauucggaccuuaaaccucagaaauucaaauguguaaaaaauguccaucaauguaaacaaaaauggcaaaaugugaauuucuggagcuggguaacaguuaaaaggcaguucauuacacugugcuauguauccuuauguuuuuaaaagucuauuaaaauguuacauuuuucaaaauuguucaggugcaucaaguggucuuuacaaaaaucuuucauucuaaaaccguagagagcauccauuuaucaauaauguaccugacaggacacacugacuugaaaguagucuucaaaucacaccaacaauuauucuaucaacagauagauguaaggccauaucugacuggaaguuacugaagaaauaaauguaauauaauuaaguauaugucuucuuauguuaaaauguuauauaguugauaacuaaaacaaaaaaaaaaaacuucauucuuagaauuggaagagacaaacuuucuaguucggugguuugcaaacuuuuugagguaccuggacaaaagagccagacaagucaccuuguuuuauacauaggagauuauacacaaaauaugagaugaugcuuuuaaaaaugauuuaucuacuuaaaaaaggcuuuaaacccauucugucauuucaacagcuacauucuacagcuaauaugguggcauagaaaagauuaaaugacuugggauauaucauucaauuaguggcaaaagaacucaggacucuuauuuuuccaguucuuucaaacaaugcaccacuucaaauuaaguuacaauuaagaauaaaacuuuccauuuucuugccuguaaaauacgguuacuagacaagaucaucucuaagauuauuuuccaggucuaaaauucugacuccaugaaugccaagcucaaacagaaaucuacauuaagggaaugaauguucuucaacacagcagaacccuucacacgcuuucaaugacuucagagacaugccagucaaauacagaaacaagcucacaguaacucagucauaccuuuuagguccuuaaacaucugugcaacaucuuuuaauaguuaaugcuauuaagaugugaaacaauguucucaaaagccacugaaauaauccugaaaguuuuuugguuacuaguuauuuuaagaaaggacacuggccuaugaaaaacacacaacucacugaagauguucaaguuaccgaaugccucagagaauuaaguacaucauuuucuuaaguuuaaaauaaaugaauugagaggagcauaaagccuagcuggcauaauaguuacgaaguuuuaauucccaccuauuaaagccugaaagagguugcucugaaauauguuaauaacccguucuauggaacuucugagcugucugucuucaguuuggcuuaguuuugaacgauauuccuccaaaaggugcaaugcucucuggguaucugagaagaaaaagcagagccugauuaaaacucucuauuuacaaaaaaaguaucacauacuagugcaaauaauucugcaugacaucuaaauaguuccgcaaauccuucaggucaauugaugucacuauguucauguacacauauuccuuagaaugaccaaaaaauaaaaaaaaaaauuaaagaaauacaagaaaaauuuaaacauauaucacauuagaaaacggaggagagugagcaguuuggaauaaauguguacugguaguuugccaaaguaaaagaucaaaguauuagcaacaguuucagauuaccugauaaugcaaaagcagauuaucuacaauuugucaucauaauccaaauuuuuaacauuucaaaauacaaauucuuaguaucccacaguugcuuacagaauagugcuuaguaagaaugauagagugaaauacuaaaacaccaauucaggguuauuaaggacaucuguugggggggggcuaacugccucucuuaaucacuagagaaauguuaagaaaguuuaacaaacauuuucguguuuccaucuucugaaaugauaugaggcuuagauucccuaagcaauaaagcuaggaccgugcugucucaucaaaguuacacaaacgauucuaaaacggcaaucaaaaaacugacacacggaaaagcaagugacaucgacaacagaguuacggaauaaacucucaccuugcuuccggaccggcauuuuucuccagaaucaggaagagggcacacaccuuuaaaacacacaacggaaaggaaaaaggauagaaucauguuaaacuagcauuuuccccuaucgaaauagaaaacccucgcagccuauuugaaaaccccacguuccaaaguuuuaccaagucaaagaaagagucucaaaacgcagcaguugucugucaacguggaaagcuuuuccuuggaguggguaccccuccaaauuaagaacagacagaagucggcuuccaaacucuccucgaaagcguccccuccccaaagagccuagaccugaggccgccucuucccccgcacaaguauccacacuccccaccugcuacuggguacgggcgggugaagcgcuccgacccuuggccccugagccagcagcggccgcagagcgcugagaggggaccagcgggacuggccgcccgcccugcucgggcccccuccucucgcuugccuuucuccuugcucgcugccuccgggcugcuccagcgggggccggacagggcagcggccgcucuccgcgacgcccucgcgccccgcaugcacaccuccgcgggcccccacaccugcggcgccgccacaaaguuccggugagcggcgugcgcucggaacuggggugcgccccggccagacucggagcagcuccccagcccggccccgcuccacguacccccgccccgcccggggcccgcggagccgagcggagggggcgaagggacgggggaggagcuccccugggccgccgcacccccgcggccucguccuccuucucggccgcgccgccuccucgcucgccgcggccccccggcccgcucgcccaguugcugccgcacgccccacccccggaaccucgccuccuuccgcgcccccaaccgcucucccccgaaacuuuccgccaagauggcggcccccgagcuggccugccgcgcucccacgugaccgcuuucccggcgcucucagccaaugggaagugaggaggcggcucgcgccgagccccgggcuccccgcgcugcuaccuucggguuggaagggggaggcgggucgggggagggcaggggaacggaagggguacccggggagcauccuaagggaaccucuucgcuuaaaagggcggccgcugaaguggcucugagaacaaaggaguuaacacucggacuccacagguggcccgggguggcccuggaggagcccgccuuuaccuugcccuagcccaccggcgcgucccgcaguuccgaacuaaacgcgccaggccgggaaggcucgggcugucugaagagaggcgugaccucgccuacaccagauccaaggcgcacauaccgagacaccccucaaccucacucagcagugccguuuccaac

SEQ ID NO: 192974 - RNA, 290586 nt, Homo sapiens
ugcuccuccaagaauguauuuauuuacaugaaaacaccauuuuauacaaauugaagacacaucuuaaaagaaggguuuguccaggcaugccuuccucauccccuuauauugccacuuccauuuucaucuucuuuuguaucauaaaugaaacuucagacugguuaaagaaaauugaaucugccucuucuccccacccaaaauuacuucgauuauuuaaugucuguagucauccuucaaagaaaagucuugcccgggguuauuuuauuuaauuuauuuauguaauacaguguagaaagcgaucaugucauaagcaaugauucuguacaaucauccugcagaaaauuguuuuggagaauucuugguaauugaagaccagcagagcaccccuccccacccgccccguaaaagugcuuacaaugaacagggauucuuuucuuuaucaaagacccaaagauacguggacaaaaaaagaaaagcuugaagucucaaugccuaaugugugcacauaaaacaggcacgaagaaacaaacguguguauccucuuaauuccuauaucacaaauauagcagaagcagcaaucuguacaguaaaaugcagucauggaaaaaaaaucucucuaaagcaucugaaauacuuaaaaauguuuaacuuuaaaaugcauagugaucaggaaaggaauacuuaggcaagagaagcagcugaacucccacguucacaugaagcaucccccaucgauucuuaaagcauauguaaaguaggacuuaauugggucacaaaccacaagaauaauauacaacuggcuaaggggcuaugugauaaauaaucaggagagaaucuauucaugcacuaguuugauacagcuaaauucuuuacaguacacaaaacccauuaauaauguaguauagagaccaaaauguaaagagagauagaauacauuacugauguguggauuaauucaaguucaggcaucuacuuguguuacagcacagcugucaaaaggcgauaaugaguaaaucauaaaacggguuuguuucuucccacauuauucuauaaauggacaccgauggguagugaagcaaugguuuugcuguccaacuucagaggcugcuguggcgggggucuaguucugcaucugcucaaagaacuuguagguuggauuuucguagccguucugcugcaucuuggacagguggcgcuccucuggggugacagcggcgucaaccugaaaaacaagaggagagcugaguaaaaaauaaaaaucaaucuuuuaagggugaacauggagaagcaguaaaaagauaaggaguacaguacucuucuuuugccaagauugcagaacacccauaauuuucucccccacuuugacaucuuggagcagaacgccuuugcccaccaguuacacagaugcugugcuccaucuagccaccagguggcgguggaaaccuugacgcgcuugcaacguguccagugguuguuucugguuccccaacuccacaguaaguggauaaacccagugcaaugguauuuuuuccuccccuguuggguccauaaaggacaaacagagucaacggaagccuguuuuacguggaaguguuuugguaaaauagauaaaaccacaagaguaucauggagggagauucagcaaaguauacuguaucuugggugacacucaaaucuguguagaaaaauacucgauuuccuggacugcugaauuuagucuagcccauuucuaucaaauuuuauguuuguuaaaauguuaaggagagguuugagaaucaauuaaaacaauaacauauaccaaagggggcuauuauuuggcacaagaaaaaaggaagagcaaggacgacgccauucuagaugauguaauuuuuuaaaaacugagaauuaagauacuauagaaguauguucagcucaaaguuuaaaaucagacccucucuguuaauauguugcuuuaccucuaaggucaggccaguaacugaagacguuuuucucccccugucacuguuagagcuguguguggcauuuacugucugcagguugggcaggguacuuaccccuacaacgugggcaguggcuguucuuguuuuacuauauuuguuauaccucuccccguucgcagaagagaggagguccuuaacucugcugaaugaguauguuaaaauuccucuuuuguaaaaccaugguaagaugaagagaauaaauagaaagucaucagaaugaagaggcauguuuuccagagaaaaguuuggauguaccauagagaagauauuccuucaaagggauauuuccuagaaugggcugcucauucaucucugggagaauacugcaggcccauucccccuuguugaguguugccaagugacauuccucccuuaugcagcuuuucccccuacacaccccaucuggcauggaucugagccuacacagcaaugccccugaagccaaggaagaaaaaguaccagcgaggauguagugucagcaguaagacaugaggucucgagauggagcuagauaugucaugacuagaccacacuggcugauaacaauucagacuaaaagaucugucaauauggccgggugcaguggcucacuccuguaaucccagcacuuugggagccugaggugggugcgucacuugaggucaggaguuugagaccagccuggccaacauggugaaaccuugucucuacuaaaaauacaaaaauuagccaggcgugguggugcacgccuguaaucccagcugcuccacaggcggaggcaggagaauggcuugaacuugggggguggaguuugcagugagccaagauugugccacugcacuccagccugggagacagagugagacuccaucuccaagaaaaaaaaggccaggugagguggcucaaaaucccagcccuuuugggaggccaaggcggguggaucacgaggucgggaguuugagacacgccuggccaacauagugaaaccccaucuuuaacaaaaauacaaaaaaauuuagccaggcacaguagcacgugccuguagucccagcuacuccagaggcugaggcagaagaacugcuugaacccaggaggcugaggcugcagugagccaagaucgugccacugcacuccggccugggcaacagagggagacucugucucaaaaaaaguaaauaaauaaaaauaaaucugucaguauaaucagguccccuguggucccuucggauagccccacuucaugaagugauugacucuuuucagucugggagugagguggaaugacuaccaguggcuaaucccaaggcagcuggaauagguagauauacagcucccucaucccuugggacagaauguuccauccauuaugugcccauuuuuuuugaguuggagucuugcucuuguugcccaggcaaucucggcucacugcaaccucugccucccagguucaagugauucuccugccucagccucccgaguagcugggauuacaggcacccgccacuacgccuggcuaauuuuuguauuuuuaguagagaugggguuucaccauguuggccaugcuggucucaaacugaccucaggugauccgccuaccucggccuccuaaaguagcacuaggacuacaggcaugagccgccauggccaugugccccgauucuuacguuuccauuuauggaagagacugugcgccacugugaaucccucccaucuaccacccuguggcucagagcugccugaguuccccugcauccaaacccucagcuuacuccaaugacagaccuaggcaucuccccuuagcacacucccaccaacaagcucugaccaaggccaguacucagaggacucugcucaaauggaugcucagcuucacuguccuucugggagcaaaucacagauauuuuccuuauccucuccucuuuccuuugcugugcacuguugucaacaaaugaggucaccuggcuuuaacugguaacuguguaauuagccuccaacuuguaaguuaaaaaccaugguuaaagauuagcaccaaugaaugagagauuucauucacucuguaaaucugugugccaggagacagccuaucugcagcaguacgccauuugaacuugggcaucauuuuugcuccccaucaccucgaaacugagaacucaaagaaugcccagguuaaaaaaaauuaucuugcuuaggagaucaagcacaaagcugcuauguuucugauuguagaaaaaagccacaaugcugcuugauuguuggaauauuauacuuuuauuucuuccaggaggcacaucuaccaucacacuggcugucaacaaucauuugcaugcaucaagggcaggggaacaccuggcaauuugauagguuuaucuccucuucaaacuccaaagccuaacgcuuaagagugcccugcuagagaugcgaggcuccaaggcuggugcacaauccagaccucuaacucuccugucuuuucuuggcuucuguuuugcuacuugauaauccuauuaccuuuugccacugagaggacagcuacauuuugccauuccugccauggggcagcuuggcccucagaccuuagagggcuuaggagcuacagaagaagggauuaucuugacaaaagggcauccaaggaguauggauuggaucuuuaaucuccagccccuugaaagcuagaugcgaaaaucugaguacucaugucuauggauaaaggaggagcaccaaguaaggguagccuuccucuccagcaggcucaccaaucucuuccucauggcuaagcuacagcaguggcaugggccaccaugugaaggccagcccuaccacgacccugugcagacagggccucugcacagacacaauauuauuucccuuaaagcagagccagggaggguuugagcccauggugcuuguucuggaaggaaugauaagacaaugaagucagaauuuccauuuuccaacugggcaggaacaucugucacuugcugggaugaagacacacauacauacaaccacugaauauucauucucuucccagacugccuggauuacacagcagcaggaaaugaucugaggucuucaugugacucucgguacgcugcaccuuccugagaccuggaccccugcacugcaugguggcauggcuucaacuggcugcugccuaugacacacgcugaaaagagcugagcccaaauagccugaccagccuuguucuaaaauagcuuugaggagaacguuugacacucuuuggcuaaccuccauacccccugacccuuuucucccugaacuugauucauuggaaccauuuaguccuucacuguauccagaguaauuuagagcucagcuauccgccugcagggacaagauucuauuugggugaccuuaguuucuaggucuccuccuauugccccuagaguauuuacaugcgggugugugagcuuggaggagaggcaggaaacaccacguuuacauuuuauuauguacaguaaccagcaggauguggauuaauagauguccuuuuauacaagggacugagucaggccaaacgacagaauccugucauugagauggaccagacgaguaaaggaggguaagggaacuaaggcgaacaauacaacaauagugugacacaucaaaggagccacaagucugcggaaaaaaaaaauaaaagcaaagaaaauaggaaguuuucaagcuagugacuuaucccucguaaccucccaguaacugccugcuaccuaguuguauagaugcuuguuuuccuaauuuugaugccaucucucuauaguuauauauaacuagaaggcaguugacuauguuuauggccaacaucaagcaauucuucaggcagguucaggaacuccuuugcuaucccuucauaauuuuuuuuuuuuuuaagacagucuugcucugucacccaggcuggagugcaguggcgugauuuuggcucacugcagccuccaucuccuggguucaagcgauucuccugccucagccuccugaguagcugcgacuacaggcgcaugccaccacgccuggcuaauuuuuuguauuuuuauuagagacagggucucaccauguuggccaggcuggacucgaacuccuagccucaagugauccaccugccuuggccuccccaaaugcugggauuacaggugugagccaccacgccuggccugugaucauuuuugaugcuuuccuuugaucuuccaauuucucuuccugcugcucacuguaagccacuccuagguucugcacccccccucacuuuuccuuaucguggcuuuccauucaaccugaccacucucuccaacuacucuacaaugccaacgucagugcgucuguauccuggugggucagcuucuggccgggaagaaaggaccucuaaggacaucuuuuuauacagucaccagugugacagcauauuacuuagaaaaagucauaugccauaccuccauaaaagccaaauaaaaggaacucucuucuuauuuagaucauuaaugagauaaccaggaggugggggcggggagacuucugguguucaagugaucagaucugugagaggaaaacuuuuucacauccuauaauaaagagaagcugugcccccaacuucuccuuauuaaaggugacaugucuggggagaguagcagaaagagcuacaauacguauuuuuaaauauccagugucuauguaugugaauguagaaaaguaccgcuugcuacuaaacagauccugggauuagugggcuuugcaggaacguccuaaaacaggagcaaggugguuaauucagcuagugcugagauuuccagccaccagagggcuauucugacauggagggcacauuuggggagugguaauaauaaagggcuauugcuucacugcuugaagcaccaauaaggcacaguuaccuccuugggaaagcguggccaauggcucacagagugacucucuggccuuauggcuaaguaaauucaguaagucaauauuuccugcuuauuugaaaaaaaaaaaaaaaaaaaaaaacaacaacuagcaagugcucauuuccaaaugcuaacaacucuaccaauaaaaauacaguuaugggccacauaaugacauuuuaguccacgacagaccaaacauaugaugguggccccauaauaccguauuuuuuacuguaccuuuucuaguuuguuuagauacgcaaaucccugccaguguguuacaacugucuauaguauucagugcagcaauaugcugcacagguguggagccuaggagcaauaguuguagguguguagcccagguguguagcaggcuauaccaucuagauuuauguacauguacuuuaugauguuugcacagcgaucaaaccgccccaugccacauuucucagaacguucucuccagugugaagugguaugugacuguucuaggcuuguuucauuuauacauuuguucucaggaguuuuuuuccuaggguuccuaucucugugaucuucugcgggcauuuuucacucuaaaaacaaaaaaucuccuggaaaccaaagcuuucaucaugacuucuucaggcacgaugguauguaaguacaaugguauucuguccugagugacugaggugaguccaacuggaaauauugauguacucauuuuuguucuuacugaaguaggguuacugauuaaugaagguuagccagagccggaaauaaagguauuuccauguacuugagggugagagugccuguuaagguaggaagaggauguugcagaagcaucacuucugugggugcagacgcuggaaugcuaagaaaaauggugcucugaaagcccaccgugcucucucaccugggaacaucccuaggcuggguugcaacucccuguguucagguucuaccaucccagcuaaacuacaucuuuuuugaggacagaaaagcggaauguggucuauuucaacauugcuguacagacacacuauggggcugcacagagggcugcuuucaggaaggacagucacaaaggucuugaggggaaggagcugagaggaaauaaacaaaacaaacacgaaugagguggagccccucaucuagaaaggcuuccaguugcucuccaguagacagcaaaaugaggagagaagagcugaacagccauccuucccgauuuugcuccugcaaggauaccuccuggcuuaaaaauuaaugucagaaucugggucaaagugucaacuucuccucugacauuuuaaguccaaugagacacugcuugguaaacugacuaaaaaaagagcguuuuaauucaggcagcuggaagagcacuuaaaaggcaaccgguuaucugggaggugagagauaccauuuuccacucccugaggcuugcgcggagaacuaaaaggaaggaguguuaaaaugaugugucagggauucucaaauccgacugcacaucucauucauuuggggaaauuuucaacacucagauucgcagccuccuauuuggggauucuuuuuccuuaggucugagguaggaccuggucucacgcacagccaggggaaggagcuccagguggaggccuugcuuuuaugcucagcaucacuggggucuguuacgggcuaaaacgugucccccuagaauucauauguugaaguccuaagcugccaguaccuccaccugugacuguauuugcagauagggucgaagagguuauuaaaguuaaacaaggucaucaggguugauccuaauccacuaugacugguguccuuguaggaagagguuaggacacagcagaaaaacagagugaaggucaugugaagauacagggagcagacaggcaucugcaaaccaaggagagaugccuggggaggaaccaaccuggcugauaccuugaucuuacacuccagaaaugugagaggguaaauuucuguugcuuaauccacccaucuguguuacuuuguuauggaagcccgaggaagccaagucuuuggccucuggcaucaaagaaggcaacuucaacggacagaccggcaacaaagagaauuauauuaaauaaacuaaaaagugcucuugaaggccaggcaugguggcucaugccuguaaucccagcaccuugggagguuggggagggcggaucacuugaggccaggaauucaagaccagccuggccaacauggcaaaacccugucucuacuaaaaauacaaaaauuagccaggcguggugguaugccccuguaaucccaguuacucaggaggcugagagugagguaggagaaucgcuugaaccugggagguggagguugcagugagcggagaucaugccacugcacuccagccugggugaaagagcaagacuccaucucaaaaaacaaagaaacaacaacaacaaaagaaaacaacaaaaccaugaaaaaaaccaaaacaacaacagcagcaaaaaaggggucuugaauuacucaaguaugaagacaucuuuauuugcucaaauauggaauuaaauuuuuuuaaaaauuaauuugagcagaaaugaaauaagcugauacuaaugaaaaccuaucuuacacuguuuugagggacauaagcuuagauacuaucacaaaaggugcaauggccaaacaugacaguggggucauugcuuuuaugugcucacacucugaucuaugggucaguccguuccuuuccacccugcugccugcuguucucuugguuuccuuccucacacugcucauccacgucaguaugaauggggaaaugaggcuccaccccaauuuccaucagcagcuucuguuguagucugcagagguuuuaauugcugagcaaaaugaaauuucuggcuucaccacaaauuucauuuauuuaaacucugccuguccucuucuaaucaagaaugguuuagagcccauuuccuuggggauaguggaaucuucaacucccuagaaacaccuggacuuuucucugauggaaaaagcaaugggggccagacgcgguggcucacgccuguaaucccagcacuuugggaagccaaggcggguggaucaccugaggucaggaguucgagaccagccugaccaauauggugaaacccugucucuacuaaaaacaaaaauuagccgggcaugguggcgugugcccauagucccagcuacucaggaagcugagacaagagaauugcuugaacccaggaggcagagguugcagugagccaagauccagccugggcaacagcgcgagacugucucaaaaaaaaaaaaaaaaagcaauggggaauaugaggggaaaucuggacucugagcuugaccuugcauaauuugaacccuucugucucggccucaguucccucaucuacaagaugagaagaucaauuugauuggucaucaucaauaaaucuuucagcucuaaaaauuccauaacucuuaaaauaucgcaauuaaaugucacacaaauuuuucaguuucccugugcauauaaaaguuauguuuacacuauacucucugcaagacaguuuccuaaaaaguugcauauacugugagauuuuaacacuuuuucccccauccaaauggcauuucaaaugcauaaaaauaacuuauucguaaauuuucuuucucucuuucuuguuuuaguauagcaccuugaaacuaagauauuucagguggaagugcaggguaauagguugcagaacucucaaauaacaaucauguauguuuuggugggccauuugguauagugugauuuccugagaaacuuuaaagguaagagucugcacugaaaagucacauuauuuacuauuaccugguuguauugagaggccagacuauuuaagacaaaagaaauccaagaauaaacauguuuaguuuuuuuggaaaaagcaacuuccuacuucuauuuuuauuuuuaacuucuuguacugguuuuuguugcuuguguuugaaaaaaaaaagucuaagaguaaucaugcuuuuuuaaagucaugcauuaucauuuguauuauuuugauaacuucaacacaaauuguaaguugagauaacaacacacacucucaauaccuugagcagaauauucacgguaaguugcaaugaaugaaaaccaaaacaagaaagaacaacuguaacccaagcaucauggaagcacacugauucguuuuuuaaaagagauacuuagcuaguucuuagcaaaaagcuaagccuaauucucucauagucuuaauucccacuuggaaacaugcagucaaguuuaccuaccuccaccacaccaugaugaauggauguguacuguuucuucuucagcaucaccaaggugaugacgaucacugucgcuaugacaacaccgcccaccaugaguccaaugauugcaccuuuguuugaacccacaucuucugcaaagaacaccuugaaaacaaauuaagaaaaagaauuuuaauuucuaaaugcaauauaauuuacaauuuauaaacgcaauuagaagaauuucauuucuuaaaugcaggggacauuuggaugagguuauauaaaaaguuucaguauauucucugcccaacugguuggucaaauauuugaugcuuacuuuaaaaaaaaaaaaaaaaaaagaaaucacauauuuuccuacuaagaaugauaaucauaguuuauagaaggauguacaacauguggcuuccccaguucgaggaagucuacuuuccccacaggucaaaaccgaagucugcagggaccugaaacccuuugacagguggaacauuuggugaguggugggaagauagcgcuuggaucuaucaaaagcuggaaaggcacgaucauacuaaugaaaggaggucagcauuuuccuagucauagcacucugagcccugaugugugacucuaagugacugagacuuagguguuuuucaacucugcagauguccuaauuuccuuggagggacacuuuuaaugcacaggaauaggcauucugaaacaaaggaguuaaacaauagaaaaaaagauaucuuguuaccuacuuuuagcuauaguaauucugcagaauucuaauuaaccuuuagcaguguaaugcuuuuuaaagcauaauguuauuucaaagugaaguacaggcaacaagaauuuuaagucacucauaacucaugcuuucuaacuauugucuccagaaaccaaaaucugaaauguugcuuuauucuugcucuuuauuuggauuaaacauaaaaauaauuuugagaacauuguaaagaaggaauaaaauuucauuuacugcacuacauugcuucauacuguuuauaaaagcaagucauuauuuuucaacuuuaucuacuugaaugaaauuauagaagcacaccacaacuuuuaucaucuuguuauauaaggaguugaucuuaugccagaugaaguaaaacuaaagcuaaauauuaccacguuugcucugcaacuuaaugaaaauacaggcauacauagcuuuauuguacaguagugcuuacagauaguauuuaaaaaaaaaaaacaaaaagguuucugguaacccugcaucgaacaagucuauuggugccauuuuuccaacagugaacacagguucacuucaugucugugucacauuuugguaauuauuuaaauauucaaacauuaaaaauuauuauaucuguuuggugaucugugaucaguggccuuugauguuacuauuuuaauuguuuuggagugucaugaaacaugcccauaaagacagcaaacuaaaucaauaaauguuguguguguucugucugccccccaaacuggccacuccacccccucaacucccaggcucccuaucccuugagagacaacaauauugaaagugggccaguaaauaacccuacaguggccucuuaaguauucaagugaaaggaagagucacaggucucucacuuuaaagcaaaagcuagaaauaauuaagcuuagugggcaaggcauauugaaagccaagauucuugugccaguuagccaaguugugaaugcaaagaaaagcucuugaaggagauuaaaagugcuacuccagugagcacacaaaugauaaagcaaaacagccuuauugcugauacggagaaaacuuuuaguugucuggauggaagaucaaaccaaccacaacauucucuuaggccaaagccuaaucaagaacaaggcccacaacugucuucaauucuaugaaggaugagagaggugaagaagcugcagaagaaaaaaaaguugggagagguugauuucaugagguuuaagggaagaagccaucuccauaacacagaagugcaaggugaagcagcaagugcugauguagaagcugcaauaaguuauccagaagaucuagauaagacuccugaugaagguggcuacacuaaauaacagauuuucaguggagaugaaacagacuuauuuggaagaaaaugccaucuaggacuuucaucacuagagagaaguccugccuucaaagcuucaaagaacaagcugacucucuuguuaggggcuaaugcagcuggcgacuuuguuuuugaagccaagacugaccauuguaaaaguccuagggcgcuuaagaauuauucuaaaucuacugugcccaugcucuauaaauggaacaaaacugggaugacagcacaucucuuaacagcaugguuuacugaauauuuuaaacccacuguugagaccuacugcucagaaaagacucauuucaaaauauuacugcucacuaacaaagcaccuagucacccaagagcucugaaggacagguacagggagauuacuguuguuuucaugccugcuaacacaacauccauucugcagccuguggaucaacuuucaagucuuauuauuucagccucuuauuauuucaaaauauauuucaaauauauuuuguagggcuauucacugccauagauagcgauuccucuaauggaucugggcaaaguaaacugcaaaccuucuaaaaaggauucaccauuccagaugccauuaagaacaucugugauccaugggagaucaaaacaucagcaauaacgggaguuuggaagacaaugauuccaacucucaugggugacuuugaggaguucaagacuucaguaaaggaugucacagcagaugugguggaaauaacaagagaacuagaauuagaaguggagccuaaagacaugacugaacugcuaccaucucaugaucaaacuugaauggaugaggaguuaccucuuauggaugagcaaagaaagugguuucuugcaauggaaucuacucuuggugaagaugcuaugaacacuguugaaaugacaacaaaggauuuaggauaucacauaaacucgaugaagcaguggcuagauuugcgaagacugacuccaauuuugaaagcuguucuacugugagcaaaaugcuaucaaacagcaucacaugcuacagagacaucuuuuugugaaaggaagagucaaucgaugcagcaaacuucauuauugucuuauuuuaggaaauugccacagccaccacaaaccucagcagccaccaccuggauuagccugcagcagugaacaucaaggcaagauucuccacgagcaaaaagauuaggacuugcugaagacucagaugaucauuagcauuuuuaguaauaaaauauuuuacuaauaaaaguaaaguauauacauggcuuuuuuuuuuuuuagacauaaugcuauugcacauguaacagacuagaguauaguguaaauacaaacuuuuuuuuuuuuuugagacagagucuugcucuuguugcccaggcuggagugcgaucucggcucacugcaaccucugccuccugggaucaagagauucucuugccucagccucccgaguagcugggacuacaggcacaugccaccauaugcagcuaauuuuuguauuuuuaguagagauggcauuucaccauguuggccaggaugcucucgaccuccugaccuugugauccaccugccuuggccucccaaagugcugggauuacaggcaugagccaccgugccuggccaacauaacuuuuauauguacugggaagccaaaaaauuugugugacauuuuguugcaaaauuuguuuuauugugguguucugaaauuuccaagguaugccuguaccucccuaaaaaauucuuucaauuuagccucaagguagucaaaugacugauuuuucuaagcugaaacuaacauacuagcaaucuggaaaggcaauauaaaauauagcaaaugaagcaacuucuaaaaguguuuuacucgugguuuauaacaaaaugagaaauuguucauaauuauucccuuuacuaaacaaauaugcuagcucaacauuuuuaugaaaagcaaaucauuaauuagcuaauauacuagugugagguaaucaggaauaaauacaagucuggacauaugccugugccuuuaagaaaauacuguaauuuuguaauauucauugcacuaauuauaauacauuaucuuaacuaguccaguagagggagcugauucuccuaauugcugccgcugccauuagucacugucgcauuauaggcguuaguguaauuguggggaugggcuuauaugacacaggccccaggccccgacaaaugcaaaucuguacauuaaucgucagcuuucuaccccaccaacucuucaacucuuuagugguuccccaguuuuuauuaaccucuucagcaacagccucaucaagagaaacccugaucuuauaacaacugauacuagauuaucuugccaaugaaaaccaugcuucaaaaagcuaaaugucuuucuacaaaaaaagaacuaugggaguuaagaaugcaaauccaaaucccaagucaguuuuuuauuugcuacaauuauuuggagucaaguaaggcauaaauaauaauuuggagguguuucuuuuagagauuaauacuaggauuuaucaacuuuaugaauauugaaaagacauuuucugcuuggaaaaaaguaacacucacacacacacacacacaaaacaaaacaaaagaagugccugagauaacuuuaaguauuauugcuauggaaauuuucuuaccauuuuucuguccaccacugaaugugauaaaauugucgucuucauuaauuuaacccucuuacugcaccuacugauaagauggaacccuaacauaauccacgauuugauuuaucuccauuucuaagcuuuugguaaaggauuuuauauaacuacuagagcugaccacaaaggagauguggcuuuuugauuuacuccaauucuaacauuaggggggaaaagugauuucaucugaaaaggaagcugcugucuucuuugcacaaaccuuuugaugaauaacacuaucgggaacaucaugggguccugcucacuccaugaucuuacucuugcaagagaaguuaaaucaugggagguaggggagggaaugaaaagaaagagcugggggagaaaugaauggguaaaggaagacaguuccggaugugaauuuaagccacauaaaguguucuguaaaaccaagcaguguaugcauguguuugauccuucaaauaaaccuauuguaaaccuauuuucccagaaaacacaguggaagucaaaguggcugcuauauugaaauuaauuccacuuuaagucccgagucaugcacgaacuuugcugccuuguagucugaaagaacuauacauacagccucuuucuuuucuuuuuuuuuuuugggauggagucucgcucugucgccuaggcacgaucucagcucacugcaaccuccaccuccuggguucaagcaagucuccugcgucagccuccccagcagcugggacuacagguguuugccaccacacccagcuaaucuuuuuuguauuuuuaguagagaugggguuucaccauauuggccaggcuggucucgaauuucugaccucgugauccacccgccuuggccucccaaagugcugggauuacaggcuugagccacugcgcucagccuagccuauuuauuuucuucauguuuucaugguaauccuauaggcaagcauuguauuuuuaucuuuuccuuaauuugauuucuagcacaggaugaaccagaguuaauaggucauuuggcaagacaaacaguaguggaaagagguaaauuauuuuacguaccaauuuuugaugaugaacuucauauccugagucaugucggaauucugcauccaucuucacuucagagaucuccuccgucuugauauuugucaacccagaaccuguauuacaucauaauuaaaguaugcaggacaaccaauuaguuuuacucauaaauaauaacacuguaagacaaagccuacccaaaacuucuuucuaggccugaaguuagaagaaaauugauaaaugacucuuaaagaaaaaugauacccuauauuuaaaacuucaauuacuaccuauuuugaacaaaaagaaaugaaaggguaagggaaaccugaaaguaaggcuucugcugccuuuaaauacaugcuauaauuuuugaaaaugggggaaaagcagaaguuaaauccugguugagagguuggcaaggauuuguuccuggaauauguuggcuuggcuuacgggcuuauuguuuagccuauuaugugucuuuuuccaugugcacucauuacuucagaaauaauaauaaaaggcuuuaaaaaugagcauuaauuaccugguagaacaaaacugcuacuuuggggcuuuguuccaauuacaaauaaauuauguucauguaucuaugcagugaagcguuguaaaaauuauauaauuuuagucaaguguucuaguuacacagauuguaauugguucgucugcugaauaaagagcuauaguacauaauuuuaaaaaugcuucuuagcaacuaacagaauuuauaaccuacgaacucuuccuuuucuauaaauugcuauaugauucuuaacacuaauuguucugaugaauuucauuauucaaauaauaauuugaagcuuaaaacaaaaugcagagucauuuaaaaaccaaaaacauaaguaaaaaauguaaaugucaguguccaugcuauaacauuuaauuaucaaacaucagaauuuuaggaugaaaagggcuuuugaagucaucuucucuaccguguucccacccaggggcagauugucaguuccuguuugaacauagaggaauguaucaauuucccuccauuuuuugauagauuugccugcccaaacuguccuuuuuuuacaugaagccagaaucagcuucccuguaacuuccauccuuugagccugauucaacacagagcaagccuaauccucccuuccacauuaaaaccuugaacagguaucacgacccuaaggagaggcauguuccugcugguucuugucuuacuugggcuacacauucccaauuccuuuggcucccaggggaauucacuuccugcucuuggccuaaucacucuuucaaucuugucuacgagauucugggaaacuugugacacaucuugcugacacugaaaagcacaauguccacagcauaugaugugccagucuaagagcacagccuauacaaggagaagguaaggauaaucugacaaaaccuaggaaauccacgcugguugugaccuagcaccauuuccucauccaauuguucaaaaagcuuccacuugauaaccuauuugaaaagagacccacaaucaaugucacucuauaccuggcuuacagauugugaagcuaucuucucuccuuuuugcuauucagaacuucauuuuccuaucccuaccuucccagcuuuccacaaagaccacaggcaauggugcuacuuccccuucaaguucucuuagccugcaguuggucugggucauaagaacuuggacuuggguagcaagaugucauaguuuaaaauauauccacaaauuugcugauacuccuuccuucaagagggagaacuugauucccuuccuucgaauguggucgggauguagugacuugcucuagugaacagagcaugauagaagugaugguguaugacuucugagacugggccaaaaaaggcacuaaaacuuccuuaaucucuuuccuggaccucuuggugcaggggugcgagaugccauguuguagggacgcucaagcagcauuacagaguucacaugguaagauacugaggucucuuaguaacagugacgugagugagccacguuggaaacagacccaccagguccaaucaaaccuucagaugacuuuagcucaggcagugucuuaacugcaaccacaugacggacacugugccagaaccauccagcuaaaccacaucccaaauccugaccuauaaaaacuguaagaaacuaaugcuuguuguuuuaagcugcuaaauucucgcguuauuugcuacguagcaauagguaacuaaugggcuagggcuuucuuuucucauguugaucuaucucgggcuuuaauuuccuuucaucagaaguucauucucuuuaauauagacauaaaaggcacaauggaagugggacaguuucccuuucucauucuuuaacucugguccucucaaugaccuaacccucaacccccaacuucuugcuacgagacccacagaguucucuauucuuauuuauuuucuuacuuuaauauuguuaaguauuuuuugguuaaguuucaacucauucugcugaaacgaaccuuucugacacuuauuuuuauaggguagugaugcuaaaacucucuuaauucucacuggcuguauauuuuaaucuuucuauagcccuuuuaaaucugagauccuuauauaaccagugauuucuuuagagcucacuccuuuucuguuauuaagaucuggcaacgugccaagcacgguggcucacgccuguaaucccagcacuuugggaggccaagcuggguggaucacuugaggucaggaguuugagaccagccuggucaacauggugaaacccugucucuacuaaaaauacaaaaaaaaaaaaaaaaaaaaaaaaaaaaaaauuagccaggugugguggcgggugccuguaaucccagcuacuccagaaggcugaggcauaagaaucgcuugaacccggcagguggagguugcagugagcugagauugugccacugcacuccagccugggugacagaaugagacucugucuccaaaaauaaauaaauaaauaaaagaucuagcaacacaauagguuagaacuauauuucugagauuuuuaagaaaacuuucuugaacaguuugaagagucuucccuuuuagauuuuggagccaaauauuuauacugaaaaauaaaaguaaagaaugagcucuggccgggcacaguggcucacaccuguaaucccagcacuuugggaggccgaggcgggaggaucacgaggucaagagaucaagaccauggugaaaccccgucucuacuaaaaauacaaaaaauuagccggacgugguggcaggcaccuguagucccagcuacuagaggcuuaggcaggagaauggugugaacccaggaggcagagcuugcagugagccgagauucgugccacugcacuccagccugggcgacagagugagacuccaucucaaaaaaaaaaaaaaaaagaaugagcucucggccaggugcagugacucaugccuguaaucccagccuuugggaggcugaggcgggcaaacaguuugaacucaggaguucgagaccagccuagccaauauggcaaaacucugucucuacuaaaaauacaaaaaugagccaggugugguggcacaucccuguaaucccagcugcaugggaaacuuaggugggaggauagcuuuagcccaggaaauggggguugcagugagcugguaucaugccacuguucuccagccuggaaacagagacaaauccuguuuuaaaaaaaaaaaaaaaaaaaaaacaaaaccaagagcucuccacuaaaaacuuuacaagcccacacuacuuuugaaaugauacugugaauacuuuuggugguccaaaaaaaaaaauucauauuaucaagucagcaugacagauaaauucauguuuacagcucaauaguuugagaagcucuuggcagaagagcucuugcuauaauaguucauguuuguuuagcaugaauagucaucuagggaagacuuuuuacauuaagcaaaucuuacuaaaagacaaaaucaguaagcuggcacauagggaaauauucauaauaaggugauaaugcauguaauaaaaugugaugaguaguuucaaauaaauggcagggaccuugguuugcaggcuuacuuagaggucuuucuugaguugugcugauuucacccuaagcccuggugacuccagcucucucuuccuguaagucaugaugaguggacagagccuuuuguucaugugggggcuaagggagguauguccuucaugacaccucuugcauggcucgggucaaggaccugguuucccuuuauuuggacugcagaaggguggugaugaauuguaacagaaaggguagcuuucuacccuaugugaagagcucgcuaauguguuuuucuuuuuuauucuggucaaacuguauaauuaguccuucagagucuauuuuuucuuuggaaguaagccaggaggaggagcuauaauggccacuaugcccccaaaucaccacuguuauuacaauggucccuacuugacacugcaugcuggaagcuaccauauucuguuuuuuuagauaugagaguuaaggagaagccauuuuccucagucaugauuauaaagcacugggugggggaaaaacaaaaaccuuuuuuuaacuuguuucugaggacaacagugauuauucaaaaacaaugccaucacuugaacggcaugacaaucuugggaaggcuuucuaaguuuggaaaggcuaaagauauaauucggcacauuagacucaaguggguggucucuaaaaugugaagaagaaccaaagcuaugcuacaaaacacggggaaauuagcccaaauguuugauaaacuuacuacaagcacaaaaacagaacacacgcauggcuuaauacaugugcaguaaauacugcuauucauagacaaaccuuaacuagaaucuuccucacuucauaucugagcauucuuucucaacuuuagccaucuuacugggcaacccaagccuacgcuguguaugaaaggaagcuuggcuuaggccacccucucuucugaauagaauuguucccuucuucuuugccaauccaggugccucaaaucuuucauaaccucucuggaagcccaucuccaguaaguucucuacuuaacaugccccuggguuaguacuccaucuccucccaucacagaacauucuuguuagcacuuaauguugcuuuguauuuccuugucuuccaaauuccaucucauguuuccaaauaugcaaaauuccuucuauuauaccucaagcuccugagagcagggacccuaccguuuaauuucuuucaaaccuagaaagaauuuaguggauugaucuuugugaaauccccaagugacaucauauucuuacuguuaugagaaagguuuuggaugguuuucucccaccaguguaauaccauuaacuauucucuagcucuuccuuuaaaacacacuguuuuuguuugacagcguuuggagguguccuuuuuguuagauuuagauuaaaaaaaauuuuuuuuaaaagaauaggccgggcauggugcuuaugccuguaaucccagcacuuugggaugccgagguggguggaucaccugaggucaguaguucgagaccagccuggccaacauggugaaaucccgucucuacugaaaauacaaaaaaauuagcugggcaugguggggcgcaucuguagucccagcuacuugagaggcuggggcacaagaauugcuugaacccccgaggcagagguugcagugaguugagaucgugccacuccacuccagccugggggacacagcgagacuccaucucaaaaaaaaaaaaaaaaaaucaaaaaacaauuuuuuuaaaaaagaaaaaaacauugacugguagugucaccugguccuggauguuucaauaguaacauauaggcucuccuggcccaauguagaaauuugauaaaauugaaugagucgaaugagcgcuuucuaaguuacauuuuaugcuuguagaugaagagcaugucuuuuaaagagaagcaccaugaaaaaagucccaaggcaaaugaccaaccugagcuggcugugguugcaauuagaacugaacugacccucagcccgaggccuuacaaguuggcugagcagaacaggaaugucaacuccuggcuccuugagauucccuuacaugacauugacaauaaggaggacauuagaagaacugaaacugucucugacucacuauaauuuaaguuccccuuaaaagccuacagacagaaauucauaaaucaacgagaccagcugucaagacgugucacacuacugucucugcugccacuguuaaucacagcauaaaggcaugaagaugccacaggcagacucucagucuucaucagugaccgugcuuggaggcagucauggcucgagccugugguggaagugugagggacagggugggucuccuggucugcugcugacuguaucugaaccaggcagcaaagguugaccucuguguauuaauaucuucaaagaaaguuaauucccuguucuuugacuaucgccuggggacauuaugaggauaaagaagaaaauaaauauggaaaaguauguguuauuugggauuaaaaucucccuggaauacacaaauuugucaauucaauaacuuucuuccucuuuuugauucacugaaagcacuggcuacuaucaguugggugagguuguucauagaguagacaccaggcacauauaugcuucugcugugcuaugacauuauucauaaaauaaaaauguguuucuucuuaauguuugugaaacuguaaaaaaagaagugucuauuucaguguuaaugggauuuuuaaguaauacauaaaaaaagggcuuaugugcaaaauuaugcauccacaucuguuguguuacuuuagccacucauugagaauaaguacauacaacccacaaaacagaagauguauuuugggcucuggaaagaaaccaauucugguauuuucaggaaaucaugucuacuucaguaacugauugaaguuugagcccaguucaguuagaaaauuacccaucuggacaccaaacaagaaaggagagauguucacacugguauccaagucaucaccugagagucuacaucuaucugggcuucuguuuuuaaggacaggcuguauauaaucgucucuguuuuuguuuuguuuuguuuguuuuaaagaaaaaagaaaaaaaaaaacccaaauuuggaagggcucucuuuuagguuucaaagggaaagcucagaaacaaaaaaaaucauuucacucggaacuugggaaaugaagaguaaggaauagucaaggggaauuuuuaaaaguuugguuucuaaggucacuucaaauucuacucugcaguaaguacaauugagagaggcuuaaaaugcagaaaggagacaacgucugcucgagcuuaggcccaagaugcggagaggcacaagucaagcgguucugauaccuggucgaguggucaguccucggucggcagcagggcgggcaucaacaggcucaacugggcacaggaagcaagggacacagaaagcaaacaagacaaaucaagaugguaagucguggcucccaaacauagucgagcagggaaaaaagcauaugcaauaaacaaguuacaaaaaaggagcagccagaaaagaaccacagugaguuaaucccgagcaucgaggaccaggaggggcaccacuuuaaauggcuuaucgcuauugaugugccaguccugcuccuuaguuuucuaauaaaagcccucaccaggauacgcagcaacaucaaagaagagggguggggaggguggauuucccucugagcuaguuuagagauaguuucuuggcuuuugauuagaaauaaaauauucccagccuagcagaaaaccuuaaagauacuuccuuuuacaacugcccaaucuuaucuuauuuuacaguuaauuaacuacaaaaggacucuguuaaauuuccaggggaagugcaaauaugaauuuaucaggagagcaaaguuuuacuauauaaucugccauuuagugagugaaucaaauuuguccuuaguaugagggcagaagagggaaaccgcagucuuuuucucacuuuuucaaaaaggcuggcuuccauuugacagaugacauacagcugaaacgugugaaaugaggauauuucauuuuauauuugccauuguucacaauuuucccuuuuuauguguucuggguccgacccaaagaaagcaguguggacagcaugauauuccucaccaucaucugaccuuuccaaagcacuucugaugcucagaaaauacuuccuuguuuuacgcuggcguuugaagaaacaaggaauggggacaaaagugaaguuuuuaggauuaauaauggucauaggguaaaugaagccacggagguaggugcagggggaagcugcuuugguaagguggcaaguguaaagggaaaaagguaagacaaagugagcacaggugcugaaggagacacggugugcucgaugaaauggcuucuaacaauuucagcaaaaccauccagcuuacugaugcacacaggccaggcauucaaaggugggauucucaguccaaaucgauuuuggaugccacauguuaauagaaacagugagggagaaaaaaaguggcaguaagccaagucuccaaaauauaagaaaauauuuccgggagcacuaggauauuuggaugaaauaaaaauuugguccuuucucauguagagacuggcagcaugguggagucaaaaggagggugaggcaucuaaucccaggccugggcccaacauuuacaaugucuguggccuugggaugcgccacuucuguggcuguuucuccauauggaaacagaaauguuaacaucugcaucuucuaauuauggugaggaacaaauaaguaaccuuuaaagccuguuugagacccuaccagauacuacagaacugcacugauuaaauauccuaugauuaaauauuccauaguaacuacugaugcgagagugacuauucucuaguauuucacuagugcauuagaggaagacauaguucacuuccuucugcaacucccaaauacauuucgacaaugagguuugguuuuucuauacuucauuuuuuuuccuauuugcagcaaccuguaaugaguaacuguauuacuccuuguaaaaugcaguuaguugaaaggucauuguacuuugugagaauuuccugaugaugagggacccaauagugcuucaacugcaguuaagaacacaacagaccacaugcacgagggcaaacgcguaccuugaagugguggugagcacauacaucaauaguuacguuauuagaaaauguauaugcaacucggggcaguaaguuaaguguaccugugguuuaaaugcaggcugaggagcugguagucccacgggccacugcuaaugucaccacuuacuuucucugugaucuggggcuaaucacauucuuucugaacuucaguugugucacaaaguaaaugguuuuuccaggguucaaaugcguauacuuaugugaaagaaacuuacaaaugauauuguccuauaaguuucucugccucuccccgcucuucuucuucuucuucuauuuuuuuaaauaggcauguauuauuuaaaaacaauaauaaaacccuaacccuauuuuuuaggaagauuaaacaaaacuaguuucagugacauaaacccuaaucugcuuuaaaagauugaagcugauuuaguauaaauuaaugcucaaaaaauaaguagcucagggagcagacauuaaaaguuuuuuaaaaggcaauuaugauaucauugccgaaaaaaaagaauacacaccaacaaaacaaaguaguguguuauuucccaauccacugcaaauacuuuccaauuuuuccaauugaccuuuacuuaaccagacaguaacuucaucaaugaagugcuaaaaaacaucuuacauuggcuguuuaguaauuuaaaaacaagaaauacauuaucuuagcuuuaacuuuuaauagaguuaaaauaaaauguaagcagaaaugaguuauucucuugcucucaguagcuuugaaucaaauccuuugcuguaagaggagagaaacagaauggucagaccucugggauuuuugagucuguuacuucugguauucuuuguaauaaaccucaacuauuaaccgugcugccuuguacaaacucucuaccaggccaaagguaaugaggaaucagcaguacaccaguuuuacauauagauaagaggcugacaagaacugguuuguaaguuuaaugaaauauuuauuuaaucuaaauuucaacauuuaaauuggcuuccucauugccucuauaaagcuaguuaaaaauauacuagaaggcagcuucacauuuugcaaauacauccauacaagucuuauaagaccugcuuugucucuuuaaaaauauuauuuuaucuacauauuauaucuagguauuaucuacaaagaggcagacuguuggccacaaagacuugcuggcagucacugcaugcuaugcugcucuuuguggcugcccuucucaggcagucaggaaaaaguagaacaaacacaaaugucaucaacgcuaaugcuuccagccagaucauuucacgaucugugagcacaauucuguaacaacagcuucauuucagccuagccauucauuuagguuuuguggaugugaaaaccaaagaauaaaaaauuguuaaggcaaaucacagcacauuggaaaacucugauaugcuuauuuucuucaauguaaauuuaaaaaaugggcaucagaaccuccucuggauuucacugauuguucuuaagaaaaacaacaaauuuuugguaagcauuugaaacuaugauaaugaggacugcaugaagaacaaaaggaaauccuuugagaauuuuagauauuuucaguaguuggguguaugugugugugugugcacaugucuguacaaagaaagacuaacaaguuucuggggagaggugggagacgguguuagaagagagacggcuuuaggacuguaucucauuauauggcuuauuauauucauuauuuuaaggauacauuguugaggccauaaggugauucaucuugagacaggcugauaaagucucucuaauaagauccuggcuccauuaaaaaaaaaaaaagcuaccacugacauuuacuacguuccaggaauuuugcuaagagcuuuuuuaugccuucuuauuuaaugcucauacuauaccucugaguuaggaauuauugucaaccuuauuuuacagacgaggaagcagccagagaggcuaaguaacuugcucagaagcacauagcagggcuggaauuuaaacucgggucuguaucauucaggaguucagggguaugggguaguauuuaauauccuaugagaugauggccgucuauuuuauuuaaaaaccaauuggggccgggcgccguggcucaugccuguaaucccagcacuuugggaggcugaggcgggcggaucacgaggucaggagaucgagaccauccuggcuaacacggugaaacccuaucucuaguaaaaauacaaaaaauuagccgggcgugguggcggguaccuauagucccagcuacucgggaggcugaagcaagaaaauggcaugaaccugggaggcagaguuugcagugagcugagaucgcgccacugcacuccagccagccugggcgacagagcgagacuccgucucaaaaaaaaaaaaaaaaaaaaaaauugcuuaaguggcuuuuuaaauuguuugcuauaaucaauauauauaugucaauguugggacugauaaugaagaguacugcaacucaagacucugacacugcaaguucuauugccucccaaaauuguuauaccagauucuacuguucaaacagaaucauccaacaagaauaucagcucuuuucaugagaccuaggcaauguaauagcugcguguuugucaaguauccagaaguacuuaaucaagggcuuugcucaaauggacauccuggcaauuaccaaggguucacaguguauguguguguguguacauucacacgugugcacgcagauuuucuccuaaggcugaugcaacaagguaugcuguuaguaaaagagcaaauuuagcgugcauucaauuuacaaaaugagaucggacauuuuucacuaaaaauucucauuagagacugaaugaagaggaccuucaaugaccaaaaucuaucuaccuguaaagaaacaaaacaaucugcacucaauacauuuaacaggacaguuuuccaggucuuugauaaugaacugucccuaaaauuguuuucuucuaugugauuaagaauuauuuucauaaaugguaaaguuuuaauuauuuuuacauugucaguaacaugcuguuugcuauuacuguaaggugcccuuuuucaaauuaaggaaacaaauuuggggugaugauucacauugugaaaauagucuauauauuuucugcaaugguucuuuagaaaaaacuuguccaguacacuuaaggucuaauauuauauuuagauuuaguacuaauugcauguuauaagguauauauauuuuuuacuuuauuuauuuauuuuuuuuaaauuuaaagucucgcucugucacccaggcuggagugcaguggugugaucucagcucacuggccacguccgccucccggguucaugccauucuccugccucagccucccgaguagcugggacuacaggugcccgccaccacgcccggcuaacuuuuuuuuguauuuuuaguacagacgggguuucaccauguuagccaggauggucucgaucuccugaccuugcgaucugcccaccucagccucccuaaguccugcgauuacaggcgugacccacgaugccuggccuauaagguauauuauaaauaugaaaucuccaucaacauuugcugcuuugauaaagaaaaucagguaaagugcuguuguguucuuaaaaaacauguuauuuguaucuagaaaucaagguguuuguguguaauuguauacuucugaacauguagaaaaagauaaaagaagcugaaagauauucuugccugaacagguguuucugcuaagaaaucccugugaaaaaggaugccaucuacugcucaaauuuguugauagagaagaaucuuacuucucugagguaccaaaggaaaaaacauuuagagcaaugugcuccuuaauuuuggcagcugccuuaaauuuaauuuucuaaacacaaauuaagucuuaagcaaaauuaaauuuuauuuauauguaguucucuaucuuugccuuuaacauuuaauucaaucugaaauuucauguaagaauaaguagccagugaagacuacuuuggugccugucaaaucugcaucucugcaggcccucaaaacuccucucuguugguaaacuguaauuuuuccuuauuucacuaucuaucugcuuuuuuggaagguggcauucuaggucauuacgucauaaacacaaguugaauuuugugcuuccauuccagagggaacaauauaccucacaguuaaaaaacauuucuaaaaaauuccuaccaaaagucaucacuuaagaacuuagucuccuggugccuccauuuccucauuugaaaaagucauaaacauaauaauaugauauacaguacaugcucuuuauguauccacuuuuguuauauaauguaccauuuuauauuaagaagaggaacuggaaaauaaaaauuagaagaauguuauugccacacauuuuccuugugaagaacugccucuucaauaauacacuguggcuccccuucguccgggaguguucacucgaaggauaauauucccuagaaugcaaaccuggacaugugcgaaacaagaggcccuuuaccugcaaauguuauguaaaucauuaccauuuuguuuugccaccuauacaauggaguuguugucuuuuccaacaauuggcaguuuacaugcuuugcagcauaaaaaauauaaagaauaauuuacacagauauauuauuuuaaugacauaguaacuccuaguauuuacuuuuuaaaguaaaauuauaaugaaaauauuuaugacuacaucaaaaaaaauucaccacucaagaacauacaaaagauaacucucucucuugcacacacguuauguauguguauauauaccucccagaacgcccuugcuggcucaggggacucuuaccuucguuuucuguguuggcuggcacagagucagccccaaaagaaugccacggcuggagaucguccaggcugaacucuccauucacgggaaggagcuccacggugguuuucguuucggucaaagauggcaugagagcaucguuuccguaacugauccuugguucacuaaucauguuggccaagacgucaucugaauaguuuugcucuuucugaagcagcucaucuaaaccaaacaaaaccaucucuuuggugaguaacaacaaucacaacagcagcagcagcagcagccaccauuuacuucugccaggcaagacuucaacugcuuucacgugcaugaucgcguuuagagccaugacauagguaccauuaucaucucccuuuuacagaugugaaaacugaggcacauggcauucaagcuacuuaugcaaagucgcagcucacaagagcugcuggcaggacugcaggcaggagcauggcagccggccaaugugcugcagcguggcacugcuagaggugaaaggccacaggggcucagcugccauuuccuccugacacaguuagacgucccuaguauacaaugaucgcacaggaauaaacgccaggcuuugguguggcggcaguaagugaggcacaaucucauucaagcugaaagacaacagacaaucuccugucuugccuugcacacuugcaaggauaagaaaagcauuaaagggccaguaguuugcuaccuucuugaauaguuuucacugucuugccuugaaaaaaaaucugcauuuccuaaaugcuccucuugugcugcaugaccuaugcucugaggcaacaaggaaacuguucccuugcccuuccagauguagcccugcagacagacauccagccuucucuggacuuaaccaccccuggcuccccguauuucccaaugugagcagacaccaaauauccugccuuucuccucuguugcuucccuuuccaaagaaugcugucagugccgccuacccccccacuuuaaaaauugauuaaacaagaaucagcuuuauggaacaucauugacuuaucuuuucuuacuggaaaaagagagcuuagaauauaaucuuguaucauguguaauuacugcuuuaaaaacugaccccaggauaugaagauuugugagucuucucuuaugucaccaaagauucaccauguuuuucucugauuuuuacaaauuagagaccgacagacagcacugcacuauuaacaauaauauuugauuaaccaaaaugucucauuuuccaaucauagcugugucaagaguuugcuguaguauauauuucagacacaucacugguuaguuuuauugcuagagaaaaugaaaauaagaucaggauuuaaauuugauuuguaacauuuuacaaucaucuuucaaauucucuuuucuauugacaaaaaauguaucugaaaaauuaaaauucuguucaaauauacccauuaaaauaauuugauggaauagcauuaaagcuugugauuaauaucuuuucauguagucaguuuuauugcaagugauuuuaaaugauggaagucccaagcaaauuaguccuuuugaagucuaaucugaguuauaauauaucccuauucacuguggcaccguuucuaaaauucaauacuugaugcccaugaugaccuuucccuuacagauaaaagacccucauuagauuuccuccaacuuuuucauguuuuacaaagccauagguagcggcuaauaacuuagccaaugucugauuaaauaaauuaaaugagcauuucuuuuauauaaaucuuuugcuugugacuguuaagcacuuacuaugcuaaagagaggauauucuggaauacuaauaauuauuggugcauacacauucaucuugacaggaaauaaccuuugccagcgagaaagcucuugaacuccccaggggcuacgcuguucuugggucugugguaucuacuaucacuuaccauguccuuuauuuggaaauguucucacuguuucgcauacacaguacuuaucuucuucccugugacaucucugaauaacucuuuuuacucuuuuuuucuccucucuucaucccugucauuuucuucuuguaucucuuuccaucucuuucuacaauucuccccuuuggaaaucccaucgacucuugaaacucuaaagaucuccuaccuuugggugaaucugaaauguacuuccccagcuuugacuucucccucccacucaaauuuguauauuuccaacaguuugcuggagauaccaacuuagggcucccuccugauccaugcacuugguagguacacaacuguacucaaggucccuggcuuucccuuccaccuuuccuguuuucuaaucauggcagaaccauucucccucccagucacaggcuugaauccuucagagccauccaggacucccuguauuucuucguguccaguacucacacuaccgacaaauccuuuugcauucuauuucugaauucucucagccauuuccugcuugcuuuuccacaccacccucaccgccccuaggaauaugauuacuuuucgccuggauaauuacgauagucuccucacugcuugcuauggucugaaugucccccaaagucauguguugaaacuuaaaucuccacugugguaguagugagagauggggucuucuggaaaucaagucaugacaguuccaccccgugcccccgaauggacuacugccuucuaaaagggcuagaggaaaccagcacaggccccuuuaugugcaucugccaugugagaacaguuuuugcugccucuggaggaugcagccacaaggcgccuuuuuuuuuuuuuuuuuuuuuugagacggagucuugcucugucgcccaggcuggagugcaguggcgcaaucucggcucacugcaagcuccgccucccggguugacgccauucuccugccucagccucccgaguagcugggacuacaggcgcccgccaccacgcccggcuaauuuuuuguaguuuuaguagagacgggguuucaccguguuagccaggauggucuccaucuccugacuucgugauccgcccgccucggcuucccaaagugcugggauuacaggcgugagccacugcacccggcuugauccugggcuucucagccuccagaauuguaguauuucuauuguuuguuuauaaauuacccagucucugguaucaugauaacagcacaaaccgacugagacaauggucucccugcugguuuuuauuuuacguuugguuccugaaaucuuaguuccugacacacaagaauggcucccucuuuguuucagugggucuucauuuucuaccgaauuaauuccaacuccuuugccagaugcugaaggcccucuguggucugggcccaccccguauuucuagccauggaacucacagcuccagcugucuacaccacaccucucucucaggcuaaauagcuugggguauucccacaaaagaccaugcauacccauucugacacuuuuguuuucuauuccugcuaucuuggaagcccaucucugcucaucuacguuauuugaacucuuuagagcccagcucaaaugcccucuccuguaugacucuccucucccaaggcaggcauuauuaaucugaugggacaaggagacugaggcugggagaaaggaaccaaucucuucaagacccaauggccaguaagcaccagugcugaaauccaaguccugggcuucauaacaccagccuucccauguucagccccuaucuauuucagccucucguauuaucacaaaaguagcuguagaaauuaggcauuauuaagcaugucuguuccaauaucuuuagcagucucuuccacccuuguggauuuguaagcugacuuaaucaccguuaguccuauggaaugguuauugcuuuuggucaucaaauaagcauuucucaggcaggggcagcuggaaagggcccugugcccaucuuagcccuuggcaguaaaaaggcagaggagcaaaagaucacagugagaaaucuuacacuuguacuucacagaacagucaggggagguugagguacgcuguaguacccuuuucucuuuucucuguuacacuguugguagaaaaguuccuccaaauggccaccagcaugcugagccccauggugguuaauuauauucauuuucagaaaauguaagugaaaaagugacagauucaagaaaagguacauuuuuagcagagugaaacacacuuagccuucguuuuuuuuuuuuggucguuguucaaaauaggaagaaauccacauuccuaucuuaauucaacacagaaaauuuagaaauaaccaccccuggcuaugucauucagaacaacgaaccucugccuccuggguucaagcgauucuccugccucagucccgaguacugugauuacaggcacacacuaccaugaccggauaguuuuuauguuuuuaguagagacagaguuucuccauguuggccaggcuggucucaaacuccugaccucaggcgaucugccugccuuggccucccaaagugcugggaugaggcgggagccacugcgccuggccgucaguguaguuuuaagagaaaaaaagagguagacaugauggauuaccauuaucagaaguggaauucaauuucgucaucauaaaaugucuaaggcagccagcuaccuguagacaugacuaagggcucaggauuuuaccaguggcuuacacacuggcacugggcaauugagccuaugacaaaauacccagagacaaauaugauucuuucauuguucauucugagugggacuuucuuugacuuccauggugagacuaaucacaccgaaaccacacuuccacuacauuaguggcccugauggauuauccuuuuaucugaauuaauuuaauacuuaauuacaacacucugauggccugcaauggggauuuucagaacuuuuaagcaucuauauuugccaaccgcuauauuaaacuaagagacugcuuauuuuccucccaagacuuauuuuuuccccuucuaaaagcuauuuguuaugacccaaaauuguagcguuuaucuuugaagucaaauaucuucuauaauauccaagcauuugaaccuuguaguuaacaguggaaauauuuaacugaguuuaguggugauaauauuuaaaauauggcuucaucaauaacagagguauuuaauuucaaauaccaaacaccuaaugaaccccaucaccuugcucuuuuacaaaugcuucgagguggccaggcgugguggcucacgucuguaaucuagcacuuugggaggccgagguggguggaucacgaggucaggaguucaagagcagccuggcuaacuuggugaaaccccgucucuacuaaaaauacaaaaauuagccgugcaugguggcggacgccuguaaucccaccuacuugggaggcuaaggcgggagaauugcuuaaaccugggagacagagguugcagugagcugagaucaugccacugcacuccagccuaggcaaccgaguaagacucugucuccaaaaaaaaaaaaaaaaaaaaugcuuugaggauguauacgaggcauacuuagaguaacagagggaagaagcccuaccacuuaguuaucauuguaaacacuuuaaagaaaacaacaucaaaagauaauaauuucaucuucaaacagcuaaauauuuuguuuuuucuuagauauucaugaucauucauuuugagaaaaauagccuuauaaauaaaagaacugcugaauaggaagcagaugaauucauccaauauucuuuuaauuauuaauccacuagccaaaugucuucuaagaauuuaacggucacaucuuacgauuaaagaaaauaaaauuuaugggcauuaaaucaaucaguuauguguuacaagugucaguuauaauuacugaacagcuucuuccauccacugaacacaaguggguuggagaagaacauuuucuucauauaaaggaggugccacucagccuuuucccuguaaagucuggcuguuaaagcucugaucugaaucuauccaucugacaaaggucuaauauccagaaucuacaaggaacuuaaacaaauuuaccagaaaaaaaagaaaaacaaccccaucaaaaagugggcaaaggauaugaacagacacuucucaaaacaagacauguauguggccaacaaacauaugaaaaaaaaaaaaaaagcucaucaucacuggucauuagagaaaugcaaaucaaaaccacaaugagauaccaucucacaccaguugggauggugaucauuaaaaagucuggcaacaacagaugcuggcgaggaugcggagaaauaggcacgcuuuuacacuguuggugagaguguuaguucaaccguuguggaagacagugaggagauucugcaaggauauagaacuagaaauaccauuugacccagcaaucccauuacugggaauauacccaaaggauuauaaaucauucuacuguaaagacacaugcacacauauguuuacuguagcacuauuuacaauagcaaagacuuggaaccaaccaaaauguccaucaacgauagacuggauaaagaaaauguggcacauauacaccauggaauacuaugcagccauaaaaaaggaugaguucgggaggugggagccaagauggccgaauaggaacagcuccggucuacagcucccagcgugagcgacgcagaagacgggugauuuccgcauuuccaucugagauaccggguucaucucacuagggagugccagacagugggcgcaggccagugggugcgugcaccgugcgcgagccgaagcagggcgaggcauugccucaccugggaagcgcaaggggucagggaguucccuuucugagucaaagaaaggggugacagacgcaccuggaaaaucgggucacucccacccgaauauugcgcuuuucagaccggcuuaagaaacggcgcaccacgagacuauaucccacaccuggcucggaggguccuacgcccacggaaucgcgcugauugcuagcacagcagucugagaucaaacugcaaggcggcagcgaggcugggggaggggagcccgccauugcccaggcuugcuuagguaaacaaagcagccgggaagcucgaacuggguggagcccaccacagcucaaggaggccugcuugccucuguaggcuccaccucugggggcagggcacagacaaacaaaaagacagcaguaaccucugcagacuuaaaugucccugucugacagcuuugaagagagcagugguucucccagcacgcagcuggagaucugagaacggcagacugccuccucaaguggucccugaccccugacccccgagcagccuaacugggaggcacccccagcaggggcacacugacaccucacacugcaggguauuccaacagaccugcagcugaggguccugucuguuagaaggaaaacuaacaaacagaaaggacauccacaccgaaaacccaucuguacaucaccaucaucaaagaccaaaaguagauaaaaccacaaagauggggaaaaaacagaacagaaaaacuggaaacucuaaaacgcagagugccucuccuccuccaaagaacgcaguuccucaccagcaacggaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcgagaagggaaguuuagagaaaaacgaauaaaaagaaaugagcaaagccuccaagaaauaugggacuaugugaaaagaccaaaucuacgucugauugguguaccugaaagugaugcggagaauggaaccaaguuggaaaacacucugcaggauauuauccaggagaacuuccccaaucuagcaaggcaggccaacguucagauucaggaaauacagagaacgccacaaagauacuccucgagaagagcaacuccaagacacguaauugucagauucaccaaaguugaaaugaaggaaaaaauguuaagggcagccagagagaaaggucggguuacccucaaagggaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcacuaaacaugcaaaggaacaaccgguaccagccgcugcaaaaucaugccaaaauguaaagaccaucaagacuaggaagaaacugcaucaacuaaugagcaaaaucaccagcuaacaucauaaugacaggaucaaauucacacauaacaguauuaacuuuaaauguaaauggacuaaauucugcaauuaaaagacacagacuggcaaguuggauaaagagucaagacccaucagugugcuguauucaggaaacccaucucaugugcagagacacacacaggcucaaaauaaaaggauggaggaagaucuaccaagcaaauggaaaacaaaaaaaggcagggguugcaauccuagucucugauaaaacagacguuaaaccaacaaagaucaaaagagacaaagaaggccauuacauaaugguaaagggaucaauucaacaagaggagcuaacuauccuaaacauauaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauaguuggaaguaaaacucuccucagcaaauguaaaagaacagaaauuauaacaaacuaucucuccgaccacagugcaaucaaacuagaacucaggauuaauaaucucacucaaagccgcucaacuacauggaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaaucaaugaauccaggagcugguuuuuugaaaggaucaacaaaauugauagaccgcuagcaagacuaauaaagaaaaagaggagaaucaaauagacacgauaaaaaaugauaaaggggauaucaccaccgaucccacagaaauacaaacuaccaucagagaauacuacaaaaaccucuacacaaauaaacuagaaaaucuagaagaaauggauacauuccucgacacauacacucucccaagacuaaaccaggaagaaguugaaucucugaauagaccaauaacaggagcugaaauuguggcaauaaucaauaguuuaccaaccaaaaagaguccaggaccagaugguucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcuugguucaauauacgcaaaucaauaaagguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaagguauucaauuaggaaaagaggaagucaaauugucccuguuugcagacgacaugauuguuuaucuagaaaaccccauugucucagcccaaaaucuccuuaagcugauacgcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuuaaaggagaacuacaaaccaacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacgaagcuggaggcaucacacuaccugacuucaaacuauacuacaaggcuacaguaaccgaaacagcaugguacugguaccaaaacagagauauagaucaauggaacagaacagagcccucagaaauaacgccgcauaccuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucacguccaaaacaccaaaagcaauggcaacaaaagccaaaauggacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcaaaggacaugaacagacacuucucaaaagaagacauuuaugcagccaaaaaacacaugaaaaaaugcucaccaucacuggccaucagagaaaugcaaaucaaaaccacuaugagauaucaucucacaccaguuagaauggcgaucauuaaaaagucaggaaacaacaggugcuggagaggauguggagaaauaggaacacuuuuacacuguuggugggacuguaaacuaguucaaccauuguggaagucagugucgcaauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaacuggaaaccaucauucucaguaaacuaucgcaagaacaaaaaaccaaacaccgcauauucucacucauaggugggaauugaacaauggagaucacauggacacaggaaggggaauaucacacucuggggacuguggugggguggggggaggggggagggauagcauugggagauauaccuaaugcuagaugacgaguuagugggugcagcgccagcauggcacauguauacauauguaacuaagcugcacaaugucacauguacccuaaaacuuaaaguauaauaaaaaaaaaaaaagauuugaauuugcaaauacaaaaaaaaaaaaaaaaggaaaaaaaaaaagguugaguucauguccuuugcagggccauggaugaagcuggaggccaucauccucagcaaacuaacauaggaccagaaacccaaacacucauguucucacucauaagugggagcugaacaaugagaacacauggacacagggagggggacaucauacaccagggccuguccagggguggggugaaaggggagggagagcauuaggacaaauaccuaaugcaugcggaguuaaaaccuagaugacggguugaugggugcagcaaaccaccaaggcacauguauaccuauguaacaaaccugcaugcucagcacauguaucccagaacuuaaaguaaacaaagaaaaaaaaaaaaagcucugauuuggacaccagugagaauaugaagucccucggcuugcuggauuuucuucugucuaggaucgaaccuccacugcuauuacuauuuucuuuccuuuuugauucuuuuggaucccauggaaaaauauuuaucugcaacuucuccacaaaauggaaauuuguuuuuaaucuuaucuaacaggagauucgcauaugaccaauucuuaucuuuuaaauaaaaauuuacuuaugugccugccugaaaggacugaagaucauaccucuacgcucucuuccauguccuuucuucucucuccccugacacagcugcauuggaaguagcuguaaaugggauggacuaauuuucccuacccaggaggcccacuguaaaucaagcggucacccacuuccagcuaggcauuuugccacaccagggcuaugagaaacagauuuaauuuuccaaucagcaguucugugcaugucugauucuuggcucaacauacaacugcuaugcuguuuauuauacuucaucucuccauggccucugaaacuccccaaggcucggguucgucauccgcaaaaucgugggaggcugguuccaugguucuugcagucccuucgcuuugaauccuuuugucuguacucuugcuacauggguguucucugggaguuuguuagacaugcagaaccucaggucccacccagauccagggaaucagaaucugcauguuaaugugauccccaggugacucucaugcauguuaccaucugagaagaccuacccuccaccacacugaccacagccacgagcuguaccaagacaccaccacacaacagccucgguuaucccuucaugaaagaaaaacaaacauaauggcugggcgugguggcucacgccuguaaccccagcacuuugggaggccgaggugggugguucacuugaggucaggaguucaagaccagccuggccaacauggugaaacccgucucuacuaaaaaaauacaaaaauuagccaggcacgguggugugugccuguaauccccauuauucaggaggcugaggcaggagaauugcuugaacccgggagguggaggcugcagugagccgagauugugccaacugcacgccauccugggcaacagagcaaggcucugucucacaagccaaaaccaaaaacaaacaacaaacaaaaaaacaauucucaaaaacaaagcaaacaaagcaaggcaugagaugagugugagccaagaaacaauacugccaggggaauauugccaaaacaccagagucaugccuugaaguuucuuaucaucagggucacauuucugaaccagaaagccacaggaaaggaaagacuggucacagacuuccuucuucccuggaccauuuguuacgggaaguucucaggaaacaggucaguaaguguagagggcaucacaggacaaacuucauugcuggguuucccagaaaagagcagcucuccccuacugaagacacuuuuagcagacgggccuucacuagugaguaaauauacuaaagaagcauggacuuacuuguaggucgguggagcagcugauuugggagagaacccaugagaucuuuaaggacgguagggauguucugauuagcauauaugcuacagccaucugcgaugccaaagccauacugugaugggacuaugccaguuaugacaccuucauaaccaugagaacugcacucauggccuuuucauacccaucugcugauuugauaaccacaauaaucuuccuuagugggaucacuacucccacugacaguugaacaaacugacauccauccugagaaguauacuuaaaacuagcaaguggcagaacugaaaucugaacccaaguaucccaauuccuaaugcaaccuucucacuguuccaugaaaaguuccauuuuauagaggacauggcuauauuacuuggauuagaaacuaauauuaaagaagcauaucacgccuguaaucccagcacuuuggaaucaugaggucaggagaucgagagcauccuggcuaacauggugaaaccccaucuuuacugaaaauacaaaaaaaauuagccagauguggugguggcacuguagucccagcuacucgggaggcugaggcaggagaauggugugaaccccggaggcggagcuugcagugagccgagaucgcgccacugcacuccagucugggcaacagagugagacuccgucucaaaaaaaaaaaaaaaaaaaaaaaaaaggaagcauaaacccaucuaucaucacaagcacccucuuuuucauacauuucaaauuuuugauagguuugaaaaagaaugaauucgacgguaucuuuuagaagccaggauaaaagagauuaaagcaguaguccaaggucacggagauuccugaugguggagcagggcugaaaagcucccucuucuagcuaagugaggccugccugucacuuugcuuggacagcccauucucaauagcacuuuccucccagaacacucucccaagucuuuagguuucccuuucucaggaugaauacgauggcuacgugaauggccagaaguuucaccaacucuaagucaaauuguaguguagcgaccuaggcacuucaauggucaagagagauacagcccuguaugacgcggccacauuuuccaacuuggggaagaauuuauacacauauuaucacaaaguaaaugcuguaccauaaauccaguuuuuaucuugaccuccagaaaauuaggucaguuauuuuuagcuacacuaucaaucuugaaaaucucccagaguuaaaacucagacuacaugucuaaaucgggguuuauuuuuguuuaaaaauaacaguuuccuggccacacauguuuaaaugaagcaugcuuuguccccuuaugguaacaaacugcccuggaagggacacaaacaaagcuucacaucauuugugaaaauauuccuuauugcuagggacauuuuccugaaauaucacuugucuggcuuagacugaggguacagaagaagucccuuuuccuuuaaaacacauuuccuuuuggcuuucaaacaucauagaucaaagaacuuagaccuaccaguggcaucagucaguaaucaagauaaagaccagccaggcucccuggcaucuaaaagcagauuguagggcuccuuuuucccguuuaccuguagaacuugugccaaugugcugaucugauuuccaacuacauuagggagucuugguccugccuggguugucaggaacuuaaaguagagacuaaaaaacaacuuuauggccaggcgcgguggcucacgccuguaaucccagcauuuugggaggcugaggugggcgguucacgaggucaggagaucgacaccauccuggcuaacgaggugaaaucgcgucucuacuaaaaauacaaaaauuagccgggcauggugcaggcgccuguagucccagcuacucaggaggcugaggcaggagaauggugugaaccugggaggcggagcuugcagcgagccaagauugugccacugcacuccagccugggcgacagagcgagacuccaucucaaaacaaacaaacaaacaaacaaacaaacaaaaaaaccaaguuuauauacuacagaaauaaucucugaaagaugcuguauuaagauuacaacacacacacacaaacacacacacacauaucuucuuguuuugaggaaacguacagugaaguauuuagguguaaagggccauuaugucugcaacuuccuuuaaaaauuuuuaaauauauuuuuagaacuuuucuaagucuccaauuauacuaaaacaaaaaguuuaguacuguaggcauugucagcuuuaauuuauacauauuuggaugucuuccucugguucgauuuauagugaaauuacaucauaugcccauuaaugugauacaaacugcaugucuucuacaaacaaaaauaaaaauagaagugaauguaauuuugaugccuuuuuuuuuuuuuuaacuggagacagagucuugcucugucaccagguuggacugcagaggcguaaucucggcucauggcaaccucggccuccugaguagcugggauuacaggcgcgcaucacuacgcccggcuaguuuuuguauuuuuaguagagacaggguuucaccauguuggccgggauggucucgaucuucuaaccuugugauccacccgccucggccucccaaagugcugggauuacaggcaugagccacugcacccggccugaucccucauaucuuuuaaacauaagucaauuauuucauauggucuuuaagccaagaaacagcuaucucuucacucuucacaugcuggaggaaaaacuggcugccuggcugguugagagauguguacuuugauggcugaccugaagacauuucaaggugauuguuacgugaaauucucucuucaaaucugacuugaagagucuaaccucugcagcauauguuaugacuucacugugagucuucuuuuauuaauaaaauauaauguuuuuacuaauuauaagaguaacauaaauuucaugccaaaaauguagaaaaaaggaaugagaauucauuuacaauucuaacagcagaaauaaucaagaguagugguuuuuuuuuaaugguuuuauucuuacagcauuauuuucgucucuuuaucacuuuacuaugcaauuuuuaugacuaugcuuaaggagaguaaauuuuucgaaguuauugaggcaauggagagucuuuggaaugaggauaauuaggccugaggacacagaggaaucaugaggaagaauucuccaguuucauuccuuuuucuggguacaguuuguuucuccuucuaaguaaguuccuagauauagaaugaauuggaaaaaaugaaacgugagguuugcuacgucuauaacaguaucacauuucauuuuuuaaaacugccaaugcuuucagugaggaccagaaaguacagugagaaaaaaaaauuccucaaauauuaguuuucaugcucuugcacgcauuuuuauaaaggcaaaagucauucuggugccuguauacaaucuaaaggcauaaucuccuggagccuucagugcugguuuugggguuuucuggagaucaauccacagugucccauuuuuucugcuggagcucugaacccacuaagagagagcaagaagagauguaaaccucuccuuugcuucugauaaagccaagcccuuacuaguccacaugaugcuuucucuggggagugagucacauacaggagacauggcuuguccagcugcgugcuggacugaauuucagcuccaaccugaaccuuccaacaggacaagggagggaggagaaugggccguagcaagacuugcccacagcauugccauaacagcugugcaggcuguggguacaacucuaagagcagcacucauuuuguaguuucagugagucgugucccuaaagccguguccugugugaccagccccgucucucaagcucaugagagaagucuaucugaccgggauaagaaggauccuggggcgggcccaagcaaaugaaugaauugggaaacagugccgcucccggcagccagcaaaaacuccgccaugcugugaagaaagugcauucuaauugauucauguugauacaugcugaauugauggaauuuuauacuucaaaggaugcaaagaauugguuagcaagucugaugagcucaugguagaaaggaugauuuucaacauccauacauagugaauuucauucaaagagccuaaaaagacuuaugcagauaauuauaaggggaucaggcaaguguguaauagcacaaauuauauauauauauauauguaaaaucacaacacaggauuggguccuuuucccacagacagcacaucauccuuguauauaugauagcucauuugaaauguuuauuuaugcagauuuuaaaaagcacacaaacccuguaagcacuucugcacaguggccuacucguguuuucuuuaacacaaaacuugcuuucuggugaacaauucuagauauagcaaugguucuuucuccucugcuuuagcuuauucacaagcuucuuuaacuucuuuaacaacguguggggaaaccaagccuggcaacagaaagcacuucacauggggggcuuggaaaugaauggaaagcgucugucuucaggagagcauucacgaugcacaggagugagagaagcugaaaagagucacuuuaaaagaaauaaucugcaaccaagaaaaucaaaccacuuuaucauaaacuagugagccccucccucccugccugccuuccuuuuuccaggggagugcuagaaauaacuucaucaauuucuuuucacuugaagggcucaugguucagaagaaaagaugggcauaaaaauaauuacuauuacaaguguuaugguagggauaccgacagaaugacaaagaaacaagccugggcuuuagggaugugacuagugauauuacaguggggccccagggaaagagaucauuguccuagcagauacaagugcauguaccgaggcacagaggacaagcugcccaggaucugugacucuucuggcugcugugguacaagggaagugaaaagggaagcagcuuagccaagaggcuuucaguuugugggauacagagggcagaggaauacacugaccuauaccaugaguaugcaauuagcaaaaucccagccuaugggaauucuacgggucaagugaccugcgcuucaugaacagguaaacuguaaaaaaaggauggaggagaagccuggagauuauaaaagacuaaccagacaaagucagcaguaaaaaauggccaaaagcauagccgauaaggaugcacacaagagugauacagccagaaagauauuucaggaacuggcccaaggaaaaacagugggcauuuugguggcgguauuugggauagggcgagaugcuaucgggguggaggauaaacuucuaauucuugaccugaguuuaaucuacgaaaagagaaaauaugggggagaaagguucuguuuacacauguugaguugcaaucuuucagaauauuggguggagccaauggaaacauggacccagagagcucacuucuaugcugaaacagcccacagggaagcaucagaaugaaaauggaaacguucccaauacuagcagaacuccacaggcgcuuugaaaaaaacauccacauuagauuccccaaaagggauuuaucugguaauaaauucugcuagacaaugaacaguuccacccaugauaaaauaacauguuguugcugcaaauucuuuguauugucuaauugcagugcuuaacguaauaaaaucaggcugguguuauuguuaagaacuagagagugaagcauuuuuuauccaaauaaagugcaauggguuuuaaaucaaaucauuuuagaauaagaauccuaugagauaauaauaaaaugcaacuucaucuuuuccugccgagaacaaagaagaaaauaguguaggagaugaaaaguaaaguagacccaaccuuuuugcuaauuuguuuuuagauacguacuccaugcagacaauggugaagugaagugaagugaaggggugucaucuuauucaccuagagaaccacaaaucuuggugcuggaaaguacgauccauucgacaugauggacuauuucccacccggccacucacucgagaauggauaaccuguuuucccgccugggguaacugcuuuccauggauguacagcuucaggccucauacgagaggaucucacaacaaucucuucaaacuuuuucuaauccccacacuuuccagucuuggcacaagaccucauccaggcuucugagucuuuguugaaaauuuacacaaaauucuagaaauguauuuucuuuaagauaguuacuuuaaaaauguuauuuucaucucagcacaguuagccuuuccuuaucuguucuuaaaauguuucaacuugaaacuaaaaaagaaaaaaaaaaacacauuucaucucaaauuaugauauacuaaauaauuauugacuuggccccaaacauuucuacucuuuucuucuuacacaaucagauuuaaaaauguaacuaccuuuucuaaacauacaauauuaaagcauacucaacuucaguaacagguaaugaauguaccucaaaagucagagccucuacguuaaguaccauagugcuccaacaucguuuuuuacauuuuuaaaauuuuauuuuuuauugauacauaauagaugugcauauuuucagauuauaugagaaaacuuaauauauucauauaauuuggaaagaucaaaucaguauaaugggauauccaucacuuaaauguuuuucuuuucuuuuugcuuugaggaagggucucucucugucacucaggcuggagugcagugaugugaucauagcucacuugaaccuugaacugcugggcucaagugaucuucucaccucagccuccagagcagcugggucuacaggcaugcaccaucacaccuggcuaauuuuuaaauauuuguuuuguagagauggggucucacuaugaugcccuggcuagucuugaauugcuggggucaagugauuuucccaccucggccuucccaagugcugggacuauagguguaagccaucgugcccagccugucuucuuuacgcuagaaacuuucaaauuagguucuccuagcuauuuuuaaauauacaguagauuacuguaaauuagucaccuugcugauaauuaaauacuaggucuugcuucuucuaucaaacuguguauuuguauccauuaaugaaccucccuuuguaaguaugauguaagcaauccuuacuuggcuacacuauaagcuucaacaacaaauuaaaaaaugauucacauuauagagcauuuauacaugccuuuucaucuuccaagugugguaaacauuaauuaacccuggcuaauuaaaacagccacaguugacacauuuacucauuaaucagccucaagcaaaugcaaagcauuaaacucuuucacguuuugguaccaauuaaauguuauuauuuuuuuuuuaaugaagaggucauaaauuuaagacauguaguucuuagauuuaaauuugauagugguugaaaaaauuugacaauaguucacauucuuaaaagucaaggaaaauaaaaacauaaccgcauuauggguugaauuuucccccaaaauauauguugaaguccuaaugccuacaccuaagaauacagccuuacuuggaaacagggucuuugcagauauaagauugaggucacaauggagaagggugggcccuuaaucauauuagagaagacacagaaacagagacauggggaguaacaccaugugaagacagagguggagauuggaggggugcauguaccaaccaaaggaauaucaagggcuggcagcagcacuagagcaagcgaaaggcaugaaacagauucuccccuagagcuguaagaggcaguguggcccuggcaacaccuugcuuuaggacuucuaaccucuagaauaaugagauaaugagaguauauuucuguugguuucggccaugcgguuugugguaacugguuccagcagcccuaggaaucuaauacacugcccauguaagugaauauuagcuauuugcugauaagacaagaauuucugguuauaauaaauauacuggaauagaaugugguuucuuuuuuuuugagauggagucucgcuccagucaccaggcuggaaugcaguagcgugaucucggcucacuguaaccucuuccucccagguucaagcaauucuccugccucagccucccgaguagcugagacuacaggcgcccgcaaccauccccgacuaauuuuuguauuuuuaguugagacgggguuucaccauauuggccaggcuggucuugaacuccugaccuugugauccaucugccucggucucccaaaguguugggauuacaggcgugagccacaacacccggccgaaugugguuucuuagugaguccuuuacucaaggcuggaauuaaacaaaggagaugaaucacgagcucuaugauaauagucuaauagucuaaucuagcccucuuaagugcagagauguuuucccucugaacacccguguguuucagcucuguuccucuuccaaugcccuuccacagggaacaaauccuuucuugaccaccaauggcugcaugacuuauccugagaagaucauggggauuuuggaugccaggucaacccuuacacucagcaaggaaguggaagggccucaguuucaaacacuuuguaaacacagagguuaggucauuuccucuccaauaagccagaagcugagcugucccuggcagcaaacugugugucaaaugccuggcggguuucagguuuuacuaacuccagagugacgaaacaucaccaccucuaaugccagaaagaagucagcuguuguaccugugucacaacuaaauuuacugaagucagggcagcugaaguaaucuauaaaacuuagcaugucaauuucaauuuagcguucacauucaacaaauuguguauuuaaaaaaaaaucuccaguagucuaaaaguuuucauuuuauucuuguguaaaaucuggaagacuggaauagaauguuuuaugguaugaguguuuaguagcaacauuagguuaacugugaccuuuuggcucaagacaugagaaaauauagcuaacaaugcuugguuauggguuugucacacuauacuuuguuauacuauccagcaguauccaccugcuuuaacaguguggauacacuaaaaacuaauuuaaaaaaaucugggcugggcgcgguggcucacaccuguaaucccaacacuuugcgaggccgaggcgaguggauuacaaggucaggaauucgagaccagcccgaucaacauacugaaaccccgucucuacuaaaaauacaaaaauuagcugggugugguggugcgcgccuauaaucccagcuacucaggaggcugaggcaggagaaucauuugaaaccgggaggcggaggcuguagugagccgagaucgugccacugcauuccagccugggcaacagagugagacucugucucaaaaaaaaaaaaaaaaaaaaaaccugucaaaucccuccauacaaguguaugcacuucacauaccaaggaggucuaggauuugaaguucaucaaggccgaguuuaggcugccagaccacaaccucguuuuaaugccuuaggugcagaaacaggagaaauaauaccuuccaugccuccccugacuagcuuuaggauaaagaagcugugcacuaaauagacaguagcugaggaacgaugaagaggaucuacccaaaguaugaauaagccaacugcuauggaucgaacugugugccccugaaaauucauguaucaaagcccuaacccucaagggaccuuuggagaucagaccuuuaaagagauaauuaagguuaaaugaggucaugggggugugacucugauccaauaggacagguguccuuauaagaaaaggaggaggccgggugcggggcucacgccuguaaucccagaacuuugggagggcaaggcagguggaucaccugaggucgagaguucgagaccagccugaccaacauggagaaacccugucucuacuaaaaauacaaaauuagccaggcaugccuguaaucucagcuacucgggaggcugaggcacgagaaucgcuugaacccaggagguggagguugcagugagccaagaucgugccauugcacuccagccugggcaacaagagcgaaacucugucucaacaaaacaaaagaagaagaggaagagacaccucucuuucucucugagaaagaccaugugaggacaugaugcguagguggccauuuguaaaucaaggaagagaggccuccucagaaaccgaccugcugguaccuugaucuuggacuuccagccuccagaagcaugagaaaaauaauuucuguuguugaaggauucagucugugguauuuugguauuuuguuauggcagcccuagcagacuaaugcauuuaucuagucacacucagacaaaagaaagagcacaggucagaauagcuuuuucuagaggauucuguuuucuuucuuucuucggcuucuuuuucuuuuuuuccugaaggcaauagcugaaucugagaguaacaaggggcucaccagggaugugcaaggaauuucuuguacugccccuuucauggaaaugacaaggaagugauuuauuucagaugugacucaguucaggauuugaaagcacaugugacaaauggucaaguaaagaaaaagcuuuucuuuuucuuuacuugaccauuugccacgcaaguucccaaguucuuccucccuaucuugcuucauuacaggcagugggaaaaauccaaacagcuucccccugugucugggacaucuccagcucugugguguauuuacuuugaaggaacaaaaaaggggauaguauaugacuuccaucccaagucacuauaggauauacuuuaagaaacaagggaguuuaaauugcucugcuguauaaccugcaaaauucaucuccuacugcagaauagagugaguugcuucucaggauucgcaccuggaguugguauucagcacauguuuucuuuguaacauuucugucaauucucuaaaaagaccacacuuuuugagcuggcacuaggcucucugacaaucuuccaagacgaagcuuuuacaguccaucauuuacaaugcugacaacuccaggcacauuuugucaauuuucccuuucaucucuuauuaaaauaaaauaauaucacuuuggauuugaagagagccuaaauggauaauucuuuaagcagaaugucaguaucaaugauagaaagggaagaaucuaagagggagguaaauguucuauaaguagagaaguagguucacaauuucugaaacagcaaaucaaacagcaaaugggggaaaguuaugaaaggcagaauuuugugacucaagcccaucuuaugcuuauacaguuuuuuguuuuuguuuguuuugagauaaggucgucccucugucacccagccuggaguguaguggugccgccaggccucacugcaaccuccaacuccugggcucaagugauccuccaaccacagccuccugacuagcugggauuacagguguguaccccuaaacccagcuuauuauuuuuuugacuuuuuguagaaacagggucuccccauguugcccaggcuggucuuaaacuccugggcucaaaugauccuccugccucagccucccauagggcuaggauuacaggugugagccaccaugccuggccuuuuauacuguuuauucccuuuagauacaguuaauggacauuaauaagcaguuuaugccaaucccuuuucauagcuaauaagaagucuuaucuuggauaaauaaaaccuagccacuaaugcugccacacccaaauaaacucucuaugcaucugaacuucuugagguuaauaaugcuucauuguaauauuuuauaaaaucaccacuuuggaagugaacaccacuagaaauucacauggccaguuuauagauggggacugggggaagcagggaggaucucugcaauccaguaguuaggcucugccagaauguauuuagaguugucucuaaauacauucugagucucugcuucauuuuuuuuuucaaugaaaaugacaaugucugucaucccauguucaagacaaauauaacaaguuucuaagaauccuuauauuuuuguuauugcauauaagcaugaguuuuaaaaaccucugaauguuuaaaggaucaccugggggaauaagaaaaaugcagaucucuguaggucugagguagagcccaagaaucuguauuuuuaacuagaauuccucuaaauuacugugcuucacuuggccccaauuacacauuaggagacaaugauuucaggaugacaaucagccuuuuccauccaaggacuuaaagcagcuaaaccgaagacaccgacaaauaccagauacuuuucucagucuacuggcugauggcacaaaagugcagaagucacguagggcaguauggaaagcucgagcuaggacuggagucagcgagagacgcuagcuuccccuguucguggauuccgaagccucaagcccacauuaacaaggccuuagacgacaguaaacacccagacucaggcuccuacagagggcccccaguucugcucuaauauaccuauuuuucuuuaaauaaaaaacaucugauuuuugcaccccagguauuuaaagacacacuuugauuucugaaaggcuuuugaccacacaugaggaacuccuugggccuugaccauuuuuagcacuuucacaguuucugauuuugaucaagccacuuaaucacccaggauucugaaucugaaaaccaggaggguuuaauuccacuuucauguucccuugaggagcuguuggcagcaggaugaaggcagguccauacagaacaugggaaggaagccaggaagccagcuuuuccuuucacaucaaagagaucuagaaagcaaaaccugucucacauuugcauacaauauuagacuuacauauggaugccaugucugucaaaagacaggcuaauuagggcauuaguuucuuuaaugguugcgauuuaguaauucacaaauagucccacuuaauuuuucauccuauaccuaaaggaucuacuucacacuugaaguuuaagaaggcuucucccuuaagauagaaagaaggcauucaaguaucaaaauacugguuuccugccaaaaaauaagggaugagaaaaagcagacacuuagcuuaucaaucaaaaugcuggcagggaaagacuacuggauuaccaaguucauuccccuagccugcacugauuccucuuuuucucuaaaguuucuuauuuuuucaguuuuucucaugauacugacauugccaaccagcagucuggaaacuguucagguugauucuuagcagaaaaucgaggggcucuccuguuacuguuaauauccuuaaaacacuuaaauuugguuaguuugcuucaagcauucucaguauauuacaaaaaaaaaaaguacucaagaauuucuagacuuuauuuugacugacaucagcuacccuaaugaacaggaggggacaacagcaagguauauuaggagcaucuccuuccuuuuuaaucagaauuauauaggaauuaagaacucuaaggccacaguagaguauaguaucuuggaagaagaaagcggagaaugucugacauuuucacugaucguuuaggcugauggcuuaaaccauuuccacccaaguuucuuacaaguuagcauuuccagccaacauuaccuacugcaauuucucuauaaucuuaaggguauugagcccccaaaugagagagagaaaagagauguaaacuaaacaggagucagagaaggggaaacugagucuguugcacaucauuuacccuuuaacaugauuuuaaagguaauaaugcuuauaaaaauauuaguaguaguaagggauaucaggugacaagcagaagugccccucuccacagauaugccaguguaucuguagaaauacggugcuaaaauuagaaaagacugaacauuuuaauuuauuagguagacccaaauagucuaaaagguuucacccauauacuuagcaauaguuuaugaaaguuccuuuucaccuauccuuaucaugacaaggcauaacagauuuuuaaaaaacuaccaauuggccauaauuuuuaaaaaauuacauuuucauuggguauuaauaauaagaaguuguucaccuuuuaaucuacaacuaauuaucagauaugcaugcauuuuuuuucuaugaauugcagcuguuaaauuuuugugaauuaauccaaugcaucaauuccuuuggguuuucaccuuaaacauuuuuguggcauacaauuuguauaaugugaauuuagaagauaauagcauaggugacuggggugcuacaauggauucucaccuauuuauuaacuuuuuaaugaguugauuagucucuaaaucaguaauucgcaaaguuuagcauuuaucaaugucaccuggacagcuugauaaaauacagauugcucagccccaucccuagcuuugcugauucaggaggucaggggugggaucauggaaugugcuuuuccaacaaguucccaggugaugccaggcgaugcugauguugcuagacuaaggaccacacuuggagaaccacagcucugaaauauucccugggcaugguauuugcaauacauacuuuauaccuaauaauuuguuucaggacacacaaaugcacaugagauuugauacauacucucaaaaagcuaacaaucaguuaagugguaauucacugacauguacacaucaaaguaauguuagacacauguaauaggccaagauuggggaugggcauuauaggcagauggaauaacauaaauaaaugcauccagggcuauggauauaagaucagccuggcuggcaaagucagacucaugaaggagauuaaugggaaaaccuaucuguuuugucugucucagguuauuuugaggaucaagugaaacuuagaaacaauaacaacaaaaaaagcaaagucugugaucaagaagaauuacucuguugcaacaauauaaacuaagaaaaaaauacgcaaaauucucugcugccuugggagaugaucucaugauguguaucauuuacuuuuaauauuuuuauuuauuuauuuuugagacggagucucgcucugucgcccaggcuggagugcaguggcgugaucucggcucacugcaaccuucgccucccgggcucaagugauucuccugcuucagccuccugaguagcugggauuauaggcaugugccgccaugccugccuaguuuuuuauuuuuaguagagaugggguuucaccauguuggucaggcugcucucaaacuccugaccuugugaucugugcgccucagccucccaaagugcugggauuacuggugugaccgaccgugccuggccaauguguaugauuuaauagccagcagcaacaggccacuaacaugccaucugcuaacaggggcucuagcuauuaacaucaacagagcuaaaaacucuuaugucugaucccuugcaaauggcgaagaccuggcugagaauuauuaucucaugcuuucagagaaaacuuugcuuguccugcacugaaaaaucuggcugcaauaaucacauggaagaagguauguuuguuggcaugguucaugggcuggcuuaugacuucuaagcagaagauacaaaauaauauaaaauuccugcaacaugcacaauguagcugauauucauguucucuuuaaauaucuuaacacugacuuacauauuuaaggguguggagucuuugagcuugggaagcaucuuauuacugagguacaaaugcuaaaagagggacauuucuucuaucuaccgcauuuucaaugaaaagaugcugaaggugaauaaacagcucugcaaacccaguuuuguuuaacuuggcaacagcaguaaguaaguaucacuggacacagagacacuggaauagauucagucuuuagucuuauucaucacgucugaccuugggcauauuacaugguuuuccugagccuaugaaaucaugcggcugaacgagcugaaaacuaagauucuuuccuuugcuaauaaauuucagcaaacgauaggaguaagaacggcugucuaacgagacuaccaaaugcuacgagacgcagcaagcaaugucccuuuaccuaauggauacagcuucuuaacuguuuauccaaagucuccccaagcaaauucuaaauuauucuaaauuauuugaguaacaaagauugggcccuuauaccugugacgugucuggcaaugacaaagaauguggaacaugggaagcauuuaauacauauuuauugaagauccuguguccuuauuucuucaaucuccuugcuauucacaauggcgaaugauaugaauauacauauauauauccuaucaugguaaauauauauaacauaaaucuuacuguuuuaaccauuuuaaguguaacgcucaggguauuaaguauauuucacgaugcugugcaaugugauggacgaugcaucacggccauccaucuuccccacugaacuauuuucaauauugccaaauugaaccucugugcccuuuaaacacuaacuccacagucccucauccucucagccccuggcaaucagcauucuacuuucuguaucuaugaauuuacuacccuagguaccucauguaaguaaaguuccauauaaaacacuuuacaaaauuugcaugucauccuugugcaggggccagguuaaucucuuuaaucauucuaauuuuaguauaugugcugcuaaagcaagcaucauauauauacuucuuuuuuuuugagauggaguuucgcucuuguugcccaggcuggacugcaauggcgcgaucucagcucaccacaaccucugccucccagguucaagcaauucuccugccucagccuccuaaguagcugggauuacaggcaugcaccaccacgccuggauaauuuuguauuuuuaguagagacgggguuucuccauguugaggcugaucucgaacuccugaccucaggugaucugcccaccucggccucccaaagugcugggauuacaggcgugagcaccgcacccagcuuuuuuuuuuuuuucucuuuugagauggagucucguucuguugcccuggcuagggugaaguggcaggaucucagcucacuacagccucugccuccuagguucaauucuccaaccucagccucccgaguagcugggauuacaggcaugugccaccaugcccggcuaauuuuuuuauuuuuaguagagacaggguuuugccauguuggccaggcuggucucgaacuccugccugacucggccucccaaagugcugggauuacaggcgugagccacugugcccagucuaucacauauacacuugugaaaacuucuaagacuuccuuacaaauaaaaguggugacugagaacuaagccauauaccuagugauaucucaguggugaugauaaaguuaguuuuuauuugacaaaaucuauuugcuaucagaauacuauacuuaaaaaucauaagcuuuaacaauuaaaucgcauguauaaaaauuuuagagaacaugcagcuauagcaacuucaaugcuauacaggaagcugaagacauagguccacaccucaguaucugcccucaggggaugggcagacaaauuucaaugcccccccccaaccaaaagcaaagacacaaaaggcauguacaagacaauacaaguuguugccaagcacuguuucaaagaaauaagauuuaacucaugcuuuuaggagcauauguaaauacauaauaauuaucaaaagacaaacacauuaaacaggcuuuuuuaaacgcacuaucugaagucaaugaauccaucaacaggagcugaaauuaaguaacgcccuggccuugacccucugaccccguuucaugcucgaaguccaaagccucuucacaaauaguguuuaggugcacaccaagucaacauuccuuuggacacgucucauaacuuggaaccgguuaauagauggauccacuauuuuugaugagauauuauaacuaaccuucuaugauuuacuuucuaaagcagcccauagugcauacggcaggaaaacuguuaacuaauaauggcacuuacucagaaaauacaugcaaaauuuguuucugaguugaacaccaacaagcaaauuaacaugucuuccaaacuccgucucacaugaaacaaacucaugucauucccaguuaguguuuguggaaacauauuucaaaauuaaucucaaaauucgggaaacauauuucaaaauuaaucucaauuuggauucaucuccauacucaggguggcaaacaucacugauuuuuuuccccuccucuuuuaaaaaaugaaccuugaaggcagaugcuugugaaaaacagaauaaccagcccuuguuccagucuaaaaucauugguuguucccaagacucuacaaaaaaagcaggacacaucugcucuaguguuccaugccaggaaguaguuccacagccaccacuguggucugacuucacuucccaaucauuuuaauuuggauuucuuuuuagauuuuguuucaaauuacagggccauacaaacgagcuggugaguugagaaaauagcuuuggaacugcauuggaucaucaaaagaaacggcagacuuuggcgugggagaccaugccucaggcuccauccauuugguugaggugcccacacaugcacaaaaauaaaagaauggcauaaaaacagacaaaaacuacugacaugucagucaucauggcuuaaggaaaagcucacaaauaauuucucuggaaucucaccaaaauuuggaguaaaagaugauagcaugcuaaaucaguucucuugcuacuucuaaaauacuaacguuccugaauggggcucaagguggaaucauuucgaggcaaauaucaguucuaguagauaaaaguguuguuuaaaaccucauuaacauuauauauaaauauuccccaaaaugaucuacagauccaaugcaauccgcacuuuuuuuuuuuuuuuuuuuuuugcagaaaugguagugggggcagggggugaggaagaucuuaaaauucauguuguaaugcaagagacuccggauacucaaaguaauauugaaaaagaagaacaaagauaacggacucacacuugcugauuucaaaauuuacuacaaagcuacaauaaucaaaacagugugguacuacaguaagcacaggcacacagaucaaagaaaagaacuaagaauuaagaaauaaacccauauuaucuauggacaauugauuuuguguaauagugccaagaccauucaaugggggaaauaauagucuuuuucuuccuuuuuuugagacagggucuugcucuauugcccagguggcgugaucaaggcucacugcagccucagccaccccaggcucaggagauccucccaccacagccuccugaguagcugggacuacaaauagauguuaucaugccuggauaauuuuuuuguagaaauguggucuugccauguuucccauucuggucuugaacuucugggcucaagucaucugcccaccuuggccucccaaaaugcuggaauuacaggcaugagccacugcaccuggcaagaauagucuuuuucaacaaauggugcugggacacuggauauuuauaugcaaaagaauaaagucaaaccucuaccucacaccauauaugaaaauuaaaaugaaucaaagauuuaacuguaagagcuaaaacuacaaaacucuuagaagguaacagguauaaaucguuguaaccuuguuucggacaaugguuuccuagauaccauaccauaguaacugccacaaaagaaaaaacugauaaaauagacuucuaaauugaaaauuuuugugugucaaaaggauccuauuaaggaagugaaaauacaaccuacagaauggguaaaauauuuccaaauaauguauuugauaagaauuuaauaguauccagaauauauaaaaauucuuacaacucaauaauaacagcaggccgagugcaguggcucacgccuguaauccuagcacuuuggaaggccgaggugggcagguugccugagcucaggaguuugagaccagccugggaaacaugguaaaacccugucucuacuaaaaauacaaaaauuagcuggaugugguggcaugugccuguaaucccaacuacuggggaggcugaggcacgagaaucgcuugaauccguaaggcggagguugcagugaacugagaucaugccgcuucacuucagcccgggugacagagcgggacucugucuccaaaaauaaaaauaaaaauaaaaauaaaaauaaaauuaagaaaguaagguaaacaacccaauuaaaaaauugggcaaagaaucugaacguacaucauuuauuugaacugaacaaaauaauccauaacaaaccauugcaaucgcaugaagaaaacacugugguugauauuuaauuccucaaauuucugccagcguccauuuggagcacaauaaacaagaucaauauacugcacugaauuauacauauuaaggucaacaauuugucugccagaaugguagagagcgcaauauuuuuuuaaaaaaggaaacuuuuuuuacauucauuauuccuagaaaguguauucuuuuuaauguagcuaaaaggauuuacuuuuuccuaaaauuauggaguagaaauacauaaaagaaaguaucuguuugccaaugguaaaacuauaaaaaucauucaggaaaacggaugcuguauuacaugugaauuuuuaaaggucauuaucaaugacuuccacagaucaucuggaugacauaugcacuauauuuacagauuccauaauuaagcuccaaagcaagaaaaagagagcuuaccuaauaucacaaccaaaaaaggcauagagagcuaaacguauacaaagcacucuacuaaccaccacuauggggugaguucgacaccugcaggucuguaaccucaagucugcagacagaccaguuggggaccuaagguaugaaguguacuggcauucacacauuuguaucuugcuguguggagacauuucaacauggcaguccaaaugucagaaaacuaggaggcugucuuaauaguauaccguacuuugccauucauuugacaaagcauuuucauuuauaaaugagugguucuauuuugaaagagaaauugucuugggucaaagauauacauuuagacacaggcagcuaaacuuacaggccucaugucuguuacuuaauaacacuagggaaaauaugaauaaggagcucugagacuauuaugaaaccaaugggggaacaaggcuuugguuguugauaauauguauaaauguucuuggccagaugugggggcucacgccuguauucccagcauuuuggggggccaagaugggcagaccaccugagaucaggaguucgagaccagcuuggccaacauggugaaacccugucucuacuaaaaauacaaaaaaauuagccaggugugguggcacacgucuguagucucagcuacuugggaggcugaggcaggagaaucacuugaacccgggaggcggagguugcagugagccgagaucacgccacugcacuccagccugggugacugagcaagacuccaucucaaaaaaaaaaaaaaaaaaaaaguucuuauguccaaauacuuaagucagcuguaaaccauuaaaucuauauacauuuaaaagucauuucuuaugaaaaacaaagucacaccuauguucuuauaagaacaaagugacagcucucuauuugcuguuaugauuuuuuuuuuuugauguucauccuugacuaacaauuacacauaaggauacuugaaauucucaauaacauuaaauuucuauuuuguugggcugggaagugcuauaaauauucuauuuuaaaccuagucuacuuuggacccacuaaacccccaaaucaacaggcuuauuagaaacagaauauggaaacacugucuuugaaauaaccaugcugcauuuuuccugaagaguggaacauuuuaucaagaggccacaguaaaauuguaauaaaaaauaagcauccuuucauuauugcgaauuucuugauuccccgccauaucuuucaauccugccccauucacuauggauuuauucagccagagaucuuucccgcaucugguuuauaauaauucauguuuuuauuaauuuugaaugcuagaagaaaaaaaauggguaugaaacaauuaugccuuuguucccucuuuauuuccuacugccuuucucauaaauugguuauuauagcauucuguaaaacagccaucucugaaaagagcuacauuuuuagccuugagguagcugcaaagagaagcacacuuugauaaauaaccucagugccaauacaaagaguagaauagaauccuuuuagcagagauuuaaggaagauuacaaaggacaaagaaaacaccaucauuuuuaaguaacaauuugacaaagcaaagguugaaaggaugaagggauucugcccuuuugaaggauuaauaaauaauuaaagcagaauaugaacacugaagaggagccauaguuucacugaaauaaugauuccaucguuuguugaaugaaaaaauauuaaugaagaccuacauagugauuuaaaagaggagauuuuaucucuauacaaacaaugccugaggccauucuuugcaagaaaucuucauaaucugccugaaaauaacuuuuuaaaaaauaaaaacauuaauaaaugacugagccugggaacuugcacauaauaauuaaaauugaaugaaaaaaauaugaaauuauaaaauaaaacacgggccuuuuauaacacaacaggacacuugaaaauucacacuuauuugucaugggaauagcuucagacugugguuggcggucaaacaggacagcacaauuaaaucaaguagaugaccaaauagcagagggucaugguacaaagaaggaccauguuguaaaauuuuauuaauaaagguccucagaacccugauuuaugcuuuguuaucuuggccaaccacauccauuuaguuagcuugaucaaucacagcuuuagaggaugcuguggccuaggaaagaaauuuguuuuguguggugcuuacgcuagaugucaaggaaggaguuuuggucaggucuuuaggguuacggaggagcccacuucaucaguccaaguuaaggagcaucugccuuuuuauccuggggacuggcuucaaccuuauauuuauaauuacuaauaucuaaaaaguaccaggguccuugcuggaucuugaggaggcaaggaugaccaacauauaucuggaagaguucacaggauggaggguuaguagagauauaaacaaauaauuuacuccaaguuagaguaugguauuggagguggauacccagugcuuucacauugagguuaaguaggggaaaauuccacuucagagaggaaaauaggcagcagaaagaacacagauuuuggacuucuggcaggucuuggcuuccaccccacuuucaucacuuuacuaucugggcugggcaaguuggcaaacucucuuagguucaaaguucaauuucuucaacuguaaacuggggaugcuaucacugaauuuccgaguaucuucacuagcccauaugcugccuuugugugaaaugcaagaacagcccacuuccagugggugugcacaaugccagagggcuuggcuccuugagugggauguagaauaaaauuaucagucuccacucuuacccuaaaccaccugccacugccacaucucuauauggcgguccuguaccucaacggggaacauucauaaagaaagaaugugaccaucagcauuaucacaaagaggcacucauuaguugguuacaugguugucacucaaaugccagcucuuuucuccguucucuaugcaaauuagaaaggguuuauaggacuugggcauuuuacuugaaucuugaaaggugcaacuuuucaagcaaggaaaaaccacaagcagcuuuuuuuuuuucuuuuuuuuuuuuuuuggagacggaguuuugcucuugacgcccaggcuggagugcaauagugcaaucuuggcucacugcaaccucugccucccgaguucaagugauucuccugccucagccuccugaguaacugggaauuacaggugccugccaccaugccuggcuaaucuuucuauuuuuaguagagaugggguuucaccauguuggccacgcuggucuugaacuccugaccucaggugauccacugccgccggccugcagcuguuuuuuuuguuuugucuuuuguuuuuaagggaacuugcauaguuccgaaaaggaggaauugaagugggagggggccaaugugagauaagagguagggugacuggcugggagucuaaugacacugaugagaggacaggaucucagguaaguaggggaugugcagagauuucacaugaacacagaaggccaaauauacagaacuugcaacuaauaagaaauaaugggugagggagaggaaggcaucauggauaguuuaggccaaccaagagaacucagaauagaguguguaaaacaaguaaauuuccagaaggacaugaguguuauacacauugauugcagguucagaggcacaugggauauuuggggucuggaauauggcacugggauucaguacgcuggcuguggcuagacccaugaauuugggauucacugaaguuagugggaaaguagcaugaacagacaggaugccucagggaagcacaauggaagauacaaggccagggccagaacucacaagcaugaugaacccuaugcucuggucacaguuuacugcucacaaauuuaaugucaauuuuccccuucaccgauagcauuccuucuucucagcaugacuccauucuuccucauuuucacccauaaaagagaauucuaauuggaagcauaauuuacugaagcagauauaccucucccacuaaagauacuggcaguuccccagacuggugaaaaccucuuauccauaaagcaacuguuaccauuauuuaauuaaaccauuguaucucucuacagauguuugacugcauuaagcacauccuaauugcuuguauuuauaagcacaaacuucuauacaaaaggcaugcauuuuuagggacuuuaaaauuuucuccuuuugccagugucucugaauuuuaguaugcuauuuguacugaacugacuccaaaucuaaaauuugauuauauacagaaauagcaaauaaaugcaacucagacuaaugacaaagcauuuaaucagagaauauuagaacgacuacaagacauaaccuggaaaaaaaaucuaugaagaaccuauuuagaaaguaagcuaaaagcaacacuuuuuauuaugagaaauuuuaaacacauacaaaaguaaaaagaauaacaugaggaaccucuaauaacauuuggcuuaagcaauuagcaccccuggccaaucuugaaguuucaacuauauuccuacuaaaaagggacguauuguuuuaaauguuccuucaaaugaaaaaggacuauagaugacaacuagguucaacccagaaaagcuauucuccccagcaaaccacuucuguagcuuugacacuagcagcucagauaguguacaggguucguuauugcaaacuucucuuucuauagagaacagucauuuaaaaauggaagcacccaggauuccaaaugaaagguuuuuaaaaaagauuaucuuucagaauguggcaucugguauauuuagaaugauauauaugucauuacuuaaaaaaacccaacuaauggguggauugagagcauauuacauacauacacacacacacacacacacacacacacacacacauuaagagcacauacguaauauguucuuuauuuuuauuauacuuuaaguuugaggguacaugugcacaacgugcaggucuguuacauauguauacaugugccauguuggugugcugcacccccuaauauguucuuaauccaaccuaauggcuguuuuuuuuuuucuuuuuacagaaaaagauuccaugauacuaguuaucuaaauauccucccugguacugagauuugaaguuuauugugcugcccuauucuugggcauuucguaauauucaagauaucugaaccaccaucuguucuguggaagugugacuaauuaguggcuaauguuuucaguaguauagugccaaauaaaaaguucuaauaauuuaauuauaaagagucaacaauaauugcugggugaggguggaauauuggucaucaacuuuuuaguccuuuguaauggcuuauuucccuauaguuauuaccuaugccacuucaacugaagucacaugugaaaacaggcuuaagauagcuguaaaaaacaaacaaacaaacaaacaaaccauguuuucuagaagauuuuagcuucaguucauuaagacugauaaauuauuucauuuuguaccuucuacaacuuuuuggagaacuucuuuacacuuauuuaauacauaguauuuuaaagguuccuuacugaugucuauucuccaaguauaccugaaaaguauauuuguuugcuaaagaaacuugauacagugaaaaauuaauuggagaucucuguucucaauucaugguguagacuaaaaacuccaccuccacuaucuucauaaauucuugcucaacacugaguugcuccuucugaacaaaagcuuggcacacuaugaaguugcuuuuuuucucuucuuuuuuaaauuagagaggggguuucaccauguuggccaggcugguuucgaacuccuggccucaggugaucugcucaccuuggccucccaaaguucugggacacugcaccucccugacauaugaaguuucuucugcaaguuauguagcucaaaguauaauuucagauuccguccauuaaugugcaguacugaacagaacaucaucacuugacacaugccaaauauuucacagcaauacaaacaauauuuacaaggccacauaaaucaggaaagaaugagcagaauaacacuggcauaaaaugggaaaaagugagggccagcuguucccuugagcgguguuucaggcacuucaaagucggacuuacuguaauggguacauccaucuacaacauccugggugcucugauuccagaugauaaccuguaucuauuuccaacccaauuaacaaaggguaggauucuuuauggggaaggauaugccagauacauauugcuuauauguugguagacuacacacuaaaucuccaguauagguacauaugcuuauauugaaagaugcaccaacauaaucgucaucuauguaccuuugugaaguaaguuaaacaguuaugggcauuuuggcagcugacagagacucaugugguauuugauucucuuuccaagagaaacagaaaugagagaucuuaaaugaaaucauuagucauuaggaaaacuagggacauaaaagacagugggcacacaaggucaguuuccugguuuugauaauggacuauaguuacguaagaugucacuggugaggcaugugggugauggaugcaugagaccucucuguacuauuuuuccaaguucuugugagaguacaauuauuucagaauauaaguuuaauagcccacuaucuuuuaaguuuaaacaaugaugugguucagagaacacucauggcuucccugcucagccaucaaagagaauugugacuuacugaauauaacaauaaccucaaagucacaagucacaguuauguguuuuggcugugcuacuuauaaugcaugugacacaggccaguaaguuacucaaauuuuaaguuugagcuuuuucauuuguaagauggaacaaucgugacacucaaaagaugaagaaugaguuuuuuuccccauuaauuguaaaguaccaaagcaucauaauuugagagccauaacaagauugggcaaauuagaaaaaaugcugccacguauaauucaauaacaaguguccaauuauuacaaaacuauacccuaagucaggcgacauuccuccagucuuacaaguauggagagguaagaacugauucaauugcuaaggcuaguaagcuaguuccagccugacaguuucaucguaaaaggcaagcuguucuauuaacuuccauauuccucaaacagauaacucacuuccucaauuuuccucugggggaaaauacauguccaugugcagcaucaaaagaacagcuuacuuaccaacuucauccugaaucuccucggccacugcaggcacguuguagagcagggagagagacugauucaugcgcucauaaaucacacggaggugugucauaaccugcaucaaaggaugacaacuccaggucaacaaugucuggggguaggaaugguucuuuuucuuucuuuuuuucuuuuuuuuuugagacggagucucgcucugucgcccagguuauuuuucuuaccaagcacugcagguagauacaaacuuccaaaagaaaacugacaaaacacugcuacuguuaaaaagguugaacugaaagggcaacuuuauuuuucuuguucuccuauuucuguucucuaacuuuuugagcucagguuuaagacuugaucuugaaacuuaccauuaucuuguaugcuuauaacagccaauuaaaaaggcuaccucugccaccucugauuccuaauacugaggcucucuuaacaggacccucaugccuaaauacauuucuuugcaaauuucccccuagaaaacaacguauuucaauuugauuggcuauuucaugcuauauauauuuaacucuuucauucaagaaaauguaaaauuucacauuuccuaagguagaucccaguuuucagccuuugggaaccggggaguauaaaauacauuauuacugggcuucauuuaggcucacaugaaaucucaacauuccaguagguuuaugauugccugccauacuucaguugaaccaguuuucaagauuuuaguuuauacaacuuuuguuuuucucauuuuagucauugguuuuaaucaguuccuuagcaaucaguuagcaguagacuaagauuuuuacauuuguuauuuucauaacucagaaaaugccaaaccacauauugcucuaagacaagcuuuuagaauuuaccagaaguuaaagagcucuugccauagggaaaacaccuauaggugcucggagaaugcgugggauccugucaccaacccaagaagcaagaauccuggauugucaaagcugcagaagaugauuauaccccacgcuuaccugggaccggaucugagcggcuuucuugggauccaccaugcgcacaugcucgaaaugcuuuagggugugcugucuguccuucuguucugcgcggacauacuucuuuagcauauugaacacgugacgaggcugugggaggaaaaugaaaaacucuuuuucaaguuugugcaaaacacugcuucuuccauuggcgauggguuagagguuccacuaaugcauccggucaugugaacguacugugagucaccuuuuugcaggucugccuucuaaacauuucuccuacuccuuucuuaauggguaauuacuuagaucggcugcuuuucacuuccacaagagcauuuaacauucucgacauauaugaugacuguccuccuuacucaacauuuucuuuuuaaauaggaguacucugcuauagaaagagaacagauuugaggucugucagguuaaguuagguccuucucuuuucgcacccaaggggcauaugugagacuacauugcuacguguacauuuugaagaccagagguaaugucacacagauaaucccaucaccaguaacauguaacauacgaaaucaaaaugagaaaaacaggaaauuuaaccacuauuuuguaagccaaggaguaacugaacuguaagagacauuauauuuuucuaggagaaaggccauugcuaaacuguauuuauuuuacucugaaauuuaauuaaguucuuucuaagcuaucagauucuaauucuuucagcaacaauuacauuucgucuuaagugcuccuauuuucuuucuaauugguuccauuucauuuuuauuuuaguuuuaccugaaaacauccauccuaauaaaaacuaaggacaaagauucccuggucuucaacaauuucaucacuauaugcauuccacuacaugauuuuguaagaugauuuccaaaaacacaacauuucuucuucauuaaaacaaacaaacaaaaaaaccaguugugaaaauucauguugggaauagaauuuuggucauuugggcaaaccuagcuauuauuaacccaugugucaugaguacccugaaaaccaguuggaagguacaaaauuuauuccagagaugguguguguggugguggggcgggugguaauggagcuuuuguuguguuauccauauccuaugggaugugccucuccuuccccuuuugcuuaguuaacuuaggagccaucucccugccaucucagguggaacgagguacccuuuuucugugcuccuaugaaauacugugcaaauccccauuaauguaccuaacucauuaaauuaucuaugauucuuacuccccucuuuaaugugagauccacagggcuggauuuggucuuuuuucuuuauuuggaaccccaauaacacagugcuugacccagagggugcucuguauuugcuuggugaaugccugccacagaggccaugcuacuguacuugagaaaacaaauacauauacacaauaaaaauaaaacaacuugggcucaucugccuucuuuuuuccuaaaagaaaugugcuucucuauaauccccagaaagacagccaucacagcuugcaacaguucuuggcaacuuauuacaacucucaucugaacugugaaaucugguugaauuuacaaaucagaggaugaccuuuuaaaucucagaagaaaaguaguaaaagagguaaugacugauaagcuauaucucuauauauugaaaagaggauagguuauacaugugaauuaaaaaaaaagaacauuugaaaacaucagagauuaaaggcugacucuuguugauugugaaggauauuugauaugcagaguugugugaucaggaucuugcacaaccacccucgaugcuugcuuguuauuaagcaccaaggucuuagaaaucucucuaguucuguuaccauuauucauccaagacuggagacagaaggggcugugacuaaucgcauuuaaccaugauguuccuuccuggccuucauggaugcuuucuuaguugcucuauuucauuuuucucccuuguaaaggauuuauuguuuugaagaaaaugggaugaauuuuuaagaguuuaaauaagaaaaaaaaaaagcacuucaauuaaaaaaguaaggauugcuuugggagucugaggcaggaggaucacuugcagccaagaguuugagaccagccuggacaacauuacaagaaccugucucuacaagaaaauuuuaaaaauuagcuaggugcagugacacaugccugcaguuccagcuacuugggaagcuuggucaggaggauuauuugaacccaggagguugaggcuguagugagcccugauugcacgacuguacucaagccugggaaagagaauaacugccugucuuuuaauuaaaaaaaacaaaaaacaaaaaacaaaaacaguaagaauugcuuuucaucauaacuucuuuuuuuccaguuagucaucuaugaauguuuuuguaagauauuuuguccuaaaaggacugucaccaacaagcagguacaccaggaugccauggccccaggcuggccuuggcauuacuacuucaagcuaaauuucaauuuagagaagaugcaggucauuucugaugaccaacaucuggaucuccccuuuucuucuccuaucacaacaaacagcauauauucccacuaauuauuauuauuauuauucuuugagauggaaucucgcccugucucccaggcuggagugcaguggcgugaucuuggcucacugcaaccuccgccuccuggguucaagugauucuccugccucagucuccugaguagcugggacuacaggcacgugccaccaugcucagcuaauuuuuuuguauuuuuaguagagacgggguuucgccauguuagccaggauggucuccaucuccugaccucgugaucugcccgccuuggccucccaaagugcuaggauuacaggcgugcgaccagugcacggccaauuaauuauucauguuaacauacauuuaaaaauaagcacaaaagccuugacuuuucccaccuaugcaauucagauggcaguaucuuucagauaguauuugcagauuaaauguguucagugauaguuacccagaaugaugcguaguccauugcugauacucaauacacauuuauuucuuucacucaggccuuaucuauaaaucaucgaccccuuucuuuccucuaaguaauaagaguucaauguguauugacugcuucugaaugagacaguauauuaaaugcuuuuugcugguaacucaucaaaucuucgucucagcccuaugacagagucauagcagcucuccccaccuuauuggugaggcaugaagcacaaaggagauugugguuacauaggcuacaucccuggcccaaugguuacacagcuaguuaguguuagauuugaagaauggguuagucucacugucuuggcuccagagccuccuucuccuaaucacuuugugaucuggcccuucaaggagaaucuaaaauagaccaaguuuaagauaguucuacaaagcaacuuacgaaguuaaaaacaggccaggcgccguggcucacgccuguaaucccagcacuuugggaggccgaggcgggcaggucacgaggucaggaguuccagaccagccuggccaacauggugaaaccccaucucuacuaaaaauacaaaaauuagcaaggcaugguggugggcgccuguagucccagcuacucgggaggcugaggcaggagaauuguuugaaccugggaggcggagcuugcagugaccugagauuccaccacugcacuacagccugggcgacaggacgagacuccgucucaaaaacaaacaaacaaaaacaaaguuaaaaacaaagaaauaagugcaugguuagaaaagacagucuguuccaggaguacuugccugacuuucuaguuuuuacaagugcagguaauauucugugggccaugcuaacaucagcuccuuuaauugugcagaagguucagauuuagcuuguucagucucucaauuacuguccuagguuucuggaguuccauuauuccuuagcuaaugcaugaaauuauuuagcuaauuauuaagcuaauguguggggagaagaaagagcaagauaggaauguccucuauccauguggauaaaggauuaggauuacuggaaagugauucaagguauuaaaguuaggcuuuugugacauucaugguuucuagugcuaaauucauccuuaucuucuauugagauggguaauuaaauggugaauguauucacauguuuucaauugcugaucucauuuaauacugccauucuccuucaaaauauauuccuaacuuauccugaaaauccccagaguuugauaauaauguucccggacugaacugaggguugggcuacuauaccucacagcccaauaacgagaugcagaugaacugggaggaagagaguuuuuauuuuuguaaccuuuuacagggagauggccuggaaauuagugccagaccaacucaaaauuacaaaguuuccagaacuuauaugccuucuaagcuguaugucuacguguaagugugcauucaucucaugacagaagugauuaacuucuuuaauccauaacuaaggucugaguccugaagaccuuccucuggagucucaguaaauuuacuuaaucuaaaugggucuaggugcuggggugauuacucuuaucuugucuccugcuaaaucagggagguuugaggaguuccugcagaccuccaguaaacuuguucuuggaggccuguagaguuucuucagacucccaguaaaacuuguuaauccuaaauggguccuguuaagaauuccuugguuuugccaggaaaggccuaggcaaaacucuuggugggcuuuuguuacauuccagccucuguauaagggcgcuggcuuuuuuuuagcuuuuaguauuuaacugaaccacucagucaguacggaaacagcuguuacggaggccugcauuagugagauuuggccugccacaauaacagaguagcaaaggaggcucugaggacuccccaggccucagcuccuccagggauaaugagaccugggaaaccccuucacuguuuauguaagcugagaugcgcauuuugugugcaucuacauaaacacaagccuuuucuuccuaaugccuauuggauaagcaaagccugggaacaucagauaauucaggaagaccuuaggauaucucccaauaaaugaauuugcaggguucugcuucauugauuuggccaccuaaacacaucucuaggaaucaugcuuggaaaugaaaacaaaaucagauuaccuucuuuguuggacgguaggcaaauaaaucauaccaaauaaaaugguaguuaucucuaucccucagaaacaaauacuauuuuuaguuaagaaagaaaaaacacagguguaaaaagaaaauaauucuuggggcccccaaaucacuaagcuaaagggaaaagucuagcugggaacugcuuagagccaaucacccugauugucuacccuggagaggcuaaucagaaacucaaaagaaugcaacuguucaucucaccuaucucugaccuagaaggccccuccccacuucgagucuuccugcuuuuuguuucaagcugucucgccuuuccagaccaaaccaauguacuucuuauauguauugacugaugccucaugucucccuaaaaaugcauaacacuaagcugugccccaaccacuuugggcacaugucaucaggacuuccugaggccgugucacaggugcauccucaaccagggcaaaauaaacuuucuaaauuaacugagaccugucucagauuugcuggguucacauagauaacaguucccuauacuuuuauauuuuuguugagguuaaaaaaaagaccucccuccuuuugauauaugauuccugcauauuucacucaaauaaauaaauaauugcccucacaacuuuuggccaaaauacaaauccuccaggcuuaacauuuguuauuucuugagcuauaauaauguaucuaagaauaacaagguguccugauugucuagugagguuuauuuuauuaugcuaagacaaagaugaauuucuuaaaauuuuaauuaaaaacacagaaaccuucauacaggaaugguagggaaaaaccccucuguuaucucuauagaaacauauucucuuaaaguaauugcuauuacuauugucacaauauucauacuuaagacggguuauucauaugaucagaaaaacaaaagaauucaguggcucacgaaaaggauauugauaaagagaguuuaagaaacauuuuuuuuuuuuaaccugcaggcauauaauccggaucacccucaugucuuuaaaucuucuguuacuagcaauaauuuuucuguguauuaauacuacagucugguuauauuggcauuagauggcuaaucucauuauuaaaauauauggcaaagaacagaggaagagaucugucccaggaggacuaauuauaccgaauccuauuuauugucacuacuguuucugaaacaguguuuagcucauaauuaugugcugucuguuugcaacugaugugacauuuuuuaauuuguacuaaacucaccucacaaucacacugccuuuuaaaaaaucauucaaaauaauuuauuaaaggauuaagaacaggcaccaccgaaauggcuuagacaucauuuacagcaagaggaaagagaaacauaagauuuacauuuuagaacauuacucauuuuccucucuggaaacaagagcguaauguauuucuaccucuaggcacaguuccugccacaauuugguugcuaauaaauauuuguuaauuaaauuaaugaguaacuugcagcuagauacaauuucagaaauaggcccaguagugcagaauauccuucauagucuucaaguagaaaacaaacaccucucuacucagaauaguggccuucccaauuuucaccgaaauacugacauuaauaaaccuacuugauguaucuauauagugugcuuggguacuuuagaaaguaguuuuaacugggaacucuucccagaaaauauuuaauggacuucauagcgugcacaaacucgucucaaagagaagauucauuucauuaauuucaaaacaucucacauauuguguucuuauaguuugaugucaaauugauguagguaauauugaagaaaauuuaauggccuuuccugauaaaagcuaacacgguuuuggagauggagucucacucugucgcccaggcuggagugcaguggugcaccuccaccucaacucacugcaaccuccaccuccuggguucaagcaauucucuugccccagccucuugaguucagcugggauuacaggcgugcacccucacaccgaccuaauuuuuguauuuuuaguagagaaggguuucacuauguuggauaggcuggucucaaacuccugaccucaggugauccaccugccucggccucccaaagugcugggauuacaggcgugagccaccgccccuggugcuaguacauuuuuuauugauuuccccauuucuuagacguauuuacuuuuucauuuuucuuuuauacgauuucucaaauuugguguugcugggacuugggaaaagucucauacauuugacuaauggcaggaugacucaaugccagucacgucugaauauguagcuuauuacuugacaguucacgugggaaguguauuaaaauuauuaaguccuauugucccacuccacagcuuuaugcuugaucuagaaaucuggcaucuuaucauaauagacacuugugcccuaaacccguuucuuauggaaggcagugaagugucaagagcguuuaaaagcccugggcauaauccugccaagaaggaaguaaaugacucacuguacgggaaucaccccaaccuuuccaggucacagaaaacccucuccuggagcauuaaauugcacccuggugguuuccaaaacugaacaaagcaauucucuccugcuuucauaaauagguucagaacuauuauuuucacaguuuuacacccuggauuucaagaaaucuugagcauauaaaauguagaaaauuuccgugugcagguuuaaaaaucacacuuuagagaguuaagucucucugugcuugagaugaucuuaguuaaacguaauauuuggggaaacugccauggggaccucugaaucaccaccuuuauugucuuuaaugccaggaguugagcugaauuuuuaaagucuccugcaaaauuuauccaccuuccuuucuucagaaaggcaaacaaaugaucuuuguaguuuaaggugaguauaaaagggcaaaugauaaucccaugccaagguggacacagaagucuugaaugaagcaauggagaaaauggcaguagauucucacacucucccccuuugguguuucuuaaguuuuaacaauauggauccauuagauggaaggauauugaacaacuaaucucuauuaauccacuuagucauaaggccagagcaaaacuuuuguuuauggccaaggaguuaucccaauguuccuucccaggguauccgguuugcugaugcggcucugauuuuguacugaacaugacgcaggagcaucuaggagucaucuaucaucuguucucuccuucccguggaagcagaucacuuccucauagggaugugucaccaaagccuccauguacuuccucuaacaaucuuucuccucuuacggaggaagacaucuuccuacuucacaauuuugucucaacuuucaaugaauccuuuugauuuucuaauuauggcuaacaaaagcuaaaacaacagaaauugcagaaagaggagaaaaauuaacuccaauuugcagacggaauaggaggaaucccuuuauuaaaucacuugcuccuaguuacagguuauaaagauggcaaaccugggaaguaaagacaagaguuuauguuauaaaagguagaaaauaggagugguuuuaauucucucaucacuuagugaccuuuuuucuuuucuuuuuuuuuuuuuuuuuucugagacggaguuucacucuuguuauacaggcuggaguacaauggggugaucuccccucacugcaacccggguucaagcgauucuccugccucagccucccgaguagcugggauuacaggcaugcgccaccaugcccagcuaauuuuguauuuuuaguagagacaggguuucuccauguugguccggcuggucuugaacucccgaccucaggugauccacccgccuuggccucccaaagugcugggauuacaggcaugagccaccacgccuggcugaccuuuuuacaaaucugguagguuucauaaauuuuuuccaggguauuuugcuaguucucagaaauaauuuauuuugguuguucagaccacagucauaaauuagugaaggcagcauauagaacugaaauuuagcacccaacacaaccccaugauucaugcuuucagacaaacucuagcacagaauggauaaagagcuaagaucuucugaccugggaauacagaaaggacagaaaauguuuggacuuguaugucuucaagcuuuguuuagucaaacagugaaacauguguacacuuaaugaugaacagaauuaguaauacaacccagaaggcaaagcgcacaguguugcugaaaucauaagcaaaagauauguucgacuaacucggacccuugcagagauuugucaaacggucugaucauccgaaaaaugccaacugugacauauucuugacuuuuuaagagagauuuacagcaaucugcuuuaauuuugcauauucauacuuggacuauggugguccugcuucauacauccucuaacugguuagccuauucaaagaaaaguacauuugcauuucuuuuaauuuuacccucuccucuucccauaccuaggcaguguuaugaccuauuagaaauucugaguuuuuuguugauauuaaaacauuuauauaaggaaacucaaggugaugauacuuaaaagccaaacaucaccuggcaucuuuaaacugguauccauggucaaccuucacaaaaugaaugaaccccuuaaagcuuaugcgagauuguguuugcguguguaugcguacauguuuccagggugaggauucuuugcuacccaucuguucucuaucagucauaccaggcaggugaauaacuacuggaucuuuaaaugugcuauuugucuacaaaaacuaaauauuuauauuuucauaauacauuuucauucucaaagauaaaaugaacauauauauuaacauuaaaauacguagguuugcuggaagaaagcagagcguaaaaccauacggugcuauggguuuuaauagcauccugugaagaccuauuugcauucugaaggcagugacugagcagugcuccacuguggagggaaucugggugaugaauauggccucaguggcaaaagacagcuuuuaagcuaaugccuucccaacauacuucuuaauguucuauguaacuuaauuaaacccagaaaccacuaguaucucuuguuacauacuucccauuuguauguagcaagauuuuaucgaacuugguaaacauucagaagguagggaaguaauaguacugaguggcuuuacugaaagagcauguauaccauucagcauaguuuauaagauuuuguucacuaaaugcuaauucucucauuuuccuucccauucacuaucuguuauuggguuugcccuuaggagugcccaagcuaaugagucccccuuugcucaccaauguauacagaacucaacuaaaaauaaacggauggugaacaaauaaauaauaaauauguaaguauagagcaauuauuuacuuuucugaaagaugaucuuuuuggccuggcagucuuucaacuuuuaauuccauucugauuagcuucauaaaauuuugguuaaauucaaaaccugcugguggaaugccuuaaacauuauaauauucaucuguccacauaccaagaacucagcaaauaauuuuuaacuuacuaucaguuacauugagguacagaugucccauauuugcuuuggagauauaugcuauauacauauauuuuauaagauaauuucuuuugcaacgaaaagugauggguagaaauaauugguuuguugggugaagggcaauuagcgguaucauauaaaagcucaaguuuaguaccacaauuucuuuuuugcuuuagaaaagaaagguacaccaacacccacauugguuaaaguuugguuuaguuguaauccacaucauauaguggcgaaaaauuuauuuaugaggugguuuaaaccuucucaugccaucaccuguuuaccugugacaaaccucccauuaaugucuacccuuguuaucuccaaugacggcuguuucuuguugaacauuuauugcucuucugcuggaauuuaccaaauagccuugagcaaaaucucaacuuagugaugaaaccgugcucuuuaaugaagagucucacagaauucauguucuaucaaagaauuaugugaagaaguuuccagagaucucagcaaaauuuaacauguggcugaaccauucaaaaaugagaaaccaaagaaggaugccgaugcuauagaaacugccaacauuuuuuuuuugcucaauuaaacugauagccugaaugugaagcagcagauagaagcaugaaaugaauuucaguauggauaagaugguuucaaucguuaagacacugaaaaaauccaaacaacacaacugggauagauaaacagauguacaggaaaauguuuccuaauucucacuucccuuuagaaaaugcaguuguugaagucagaauaauaaucaugauaacugucugaugaaagauuuagacuaaguaucuguaaaaacaccaaaaaucucagaauuacaaagaaagcuuuggcuguguaucccuuaucuuuaaaacaguucaagucuuacaaauuagggggugcuaagguuuuccaaaccuaggccuacaauagaaaguugauugaaauaaaaaaucccuaucuggccuuugguuuaacuguacaggaucacauuaagucuaauuucucuucaacagucaggacauaucaucaucuucugucuaugaaggauaagcagaacgcugagaguuacaaggggaaaggcucagacagcauuuaguuccuguuucaugaagcuaugaauaguuugaguacgagcccugacaaaguaaaaagcaggaagugcaugacuguagagggcagguuaagaaaugaugaaugcuuagcuuuaaguauuuaaucugguagcuugcaggccuccaaaggugguagaaguuaaccuccugugcugcaguucuggagaggcauuuaauucuuccagggggaaaaagugcuaacuccuugauuuuccaaagaaagucuaaggaaaguaaaaaggugaagggguugguguuuagaagagucacuagccuucaacagaguaagaguuuuuucugagugcaaagacacagcucugcucaacuuuuuuuucccauggggaaaacaacuauuuuaauaauuguaauauuucaaguauuuaucucauuuuuuaacuuuuaauuuuggaacagcgucuugcuuugucauccaggcuggagugcaguggcaccaucacagcucacugcagccuugacuuccugguucacacucacaccucagccuccagaguagcugcgacuacaggcgcgcaccaucaugccuggcuaauuaaaaaaaucuuuuuuuuuuuuuuuuuuuguagagauagggccuuucuauguugccuaggguggucucaaauuccugggcucaagggauccucccaccucagccucccaaaaugcugggauuacagcugugagccaccacaucuagccuaaaguauuuauuuuaaauacaugugccuauauauguaugacucuaaauaugagucaaacaaugcauuuuuagguugaccauucaguguauuugccuauagguacauaacuaaaucagaaauuugaaacauacaguauacucagacacagggacucaggaaaugaaauucauuaguagaacaaggaauucuagcugcacaaaaacaacaucucauaacacuuccacguuuagguuuaaaaacugaguaaaaguaugauuuaaaucugagcuucaaagaaacugaaaacaauccacauuguuuuggaaucccguguuugcaaagucugagaauauacgguagaauuuguuaaggguuagacagguaauuauucuaagugguaacaucuacagaaucuauggaaacgacacuuuugauuuacuuauauucaaauaccauuuacugaauacaguugucugcauuuuccaggcacggugguuaaguaugagggagaucucagaaauauuuauguaugacuccuauuacaagaugugaucuuuuucagacaaccaccaguaagcucuggauuuaugucuucaagaggaagguauaaaaguccucaagaaggcauuuaauuacgccugcaaucucagcacuuugggaggcggaggcuggcggaucacgaggucaggagauccagaccaaccuggcuaacacggugaaagcccgucucuacuaaaaauacaaaaaaaaaaaaacauuagccaggcaugguggcgggugccuguagucccagcuacuugagaggcugaggcuggagaauggugugaacccagaaggcggagcuugcagugagccaagaucacgccacugcacuccagccugggcgacaaagcaagacucugucucaaaaaaaaaaaaaaaaaaaaaaaaaagaagguauuuacaauuuucuugugccugccaaagugcagaccuaagugccaggucaagccauacaacauuaaaacuuaaaugaacaccuaaagaugguaacuuaacaaaaauggcaaguaaugcccccuagacuccaggccugugaccacccagccacauuuuauuacaaaggaaagauuuaaaggugagucaugguggcucaugccuguaauaucagcacuuuaaaaagccgaggugaaaggaucgcuugaggccagaaguucaagacuagccuggguaacacagcgagacccugucuuuacaaaaauuuuuuaaaaauuagccacacaugguggagcuucuguagacccaacucucaugaggcugaggcaaaaggauugcuugagcccaggagguuggggcugcagugagcuacgacuggaccacugcaugccagccugggugaaagagcaagacccugaaaagaaaagaaaagaaaacaaaagaaaagaaaagaaaagagaaaagaaaagagaagauuagagaagagaagaggggaggggaagagaaaaggaaaggaaaggaaaggaagggaagaaggaaggagggagggagggaaggaaggaaggcaggagagaaagagaaacagagaaagagagagagagagagaaaauaaauaaauaaauaaauaaauccgaguuaagaauuuaacaggaauccuuagaucaaucaacaacagugaucugauuuuugacaguaaaauauuucuuccuaauccaguuuuuaauuuuuuuuucaaaugaacauguugccuaauuccauaugaagcaaugcggaggcccacaauaagcacgauuacaaccacucuaaaauuauccccuuugauaaaagaugacacuucggcaaacauucuugccacugccuuuccugugauggcugaugagacuaaacugagaguuuaaauguacauuuguuaaagccuccauucagcccucagcuuauuuuuagucccaucaauguccauuuagcaaagaucuuacuuuagagauuggacuuucagcuggaacgcuucacaaguuucugcuauaaagauucuggucucagcacccaccagccuauccuucucuggcaaaugaucacacggcuccucuccugaaagcguguucuccaaaaaagagaggaaccaaggaacuuuuguucugcagagauauaaaaaaaaauuuccugacaagugccuugcuaagauagagaauuuuggcaaauagaaaaugaaaacgcuaauaugaauauucuuuuucaaaagcucuuuguuuagagaggaagcucguucuagugagaaggcaccacagugacucgcggcucuacccucucccuucccagcagugucacccugaaccagccgcuccaucucccgagguugcagugauaucaucgguagaacaggguaaauaguaucuuacgucuuggaagaaugccacgagcucuuuaacggcuccucauggcuuucugugcacuguaacuuuauccauagaaagaaaaaucaaaauggugaggaaaaucggugcaaaugggugacuuucugguuaaguugcauaaaaugcacaaacaauuccagccaagauugagugagaagaacuggauuuacccuccugccugaaccaccaauaacuggacaauauauucauauacaaacagcguuucuuuuuuuuuuuugagauggagucuugcucugucaccacacuggagugcaguggcacaaucucggcucacugcaaccucugccucccagguucaggugauucuccugccucagccuccugaguagcugggacuacaggugugcgccaccacaccuggcuaauuuuuuguauuuuuaguagagacgggguucaccauguuggccaggauggucuugaucucuugaccucgugauccgcccgccuuggccucccaaagugcugggauuacaggcgugagccaccacaccuggcauaaacaacauuucugcaagacauuagacaucaggugaaggacacugauuccugaaaaggggaaacaaaugaggacuuacagcugccaaacucauggcccugaauuuccaggucaugguuucagguggggaaacccacacagagccuagaggacucguggaguggaggacaugaaguguguggagagaucaagguaguuguaauucacaggacaggguauuggugaggagagaguugcuccaaaagagaauccagagaugugcagagugaucccugagaauauagcugaguaaugauggguacaugcaugugaaagaaacugaagccagggggaaaaucaccaaaaagaauuagcauuaacagugcuugguguucacacagggacaggaauaaugccucuucccacgagucaggugagaaaacuuaacauucaugguagaugacugagaagggucuugccucacuaguaaggaauaacuaguccuaggcugauaacugcuucuaucccaccuaacaaaucuaaaaaugcaaagcucaaaaggaucaaacuguuuccaaguaacucaacuaugugacagaaaaaagcucaagaauauuacaaaaacaccuagcauucaacagguuuaaauucagcguccgacauuuaauaaaaaauuaugaggcauaaaaugauacagggaaaugccacauguaauaauaagcaaucaaaauugauucaaaguugacagagauguuagaauuagcaaacauggauauuuaaacaguuuucauauaauaacuguauuccauagguucaaaaguuaagauacagacgauauuauggguguuggggguagcccagguuaaauuucuauauacaacaacuacaguaugugaggugauaagaugaaaaacggccagauggaauuaagggcagacugaaugauaccauggcauaucaaaauuaaauuguuaaaaaccagugauauagagaaaacuguaaaaacagaaaaaaaagacauguuauuuuuagagaaauaaagauaaagauaucaacacaaauaagacagcagaguaucaucuuucaggcagugaaagagaaaccucaauccaguauuuuuuacccagcaaaaauauuuuucaaaaccaaagguauaaaagggacauuuuuggucaaagccaaacaaagauuucaucaccaacuuaugugcacucaaacuuuuuuuuuuaaagagacaggaugcccuuugucacccagaugggaguacagucaugcaaucacagcucacugcagucucgaacuccuggguucaagugaucuccuaucucaaccuccugaguugcugggauugcagguacaagccaccaagcccagucucuaagacauuuuaaaggaaaucucucaggcagaaggaaaaugauaccagcuggaucugcgcaaagaguuuacagcacccaaaaugaugacuucauggguaaacauguuguuuuuuuuuuaaauuuacaacucauuaaaaaauaacuguuuaaagaaaaacaucaacaauguaguaaggaaaaaguaugacaacaaccgcuuacagagagagagagagaugaaaaauggaaguacuuuuguaaaguacugucuguggagugguauaauaucauuugaacugacauaacaucaucgugacaaguuuagaauguuuucuauaagccuaaagcaaccaguaaaauaacaaacuaguuauaacuuauaaacccacaaaggagauaaaccaguaaaauaacaaacuaguuguaacuuacaaaccaacaaaagagauaaaauagaaucauaaaaaauuucuaauuaauccaaaaaaaaaagaggaaaaaagaagaacaaggaacagacuggacaaauagcaaacaaauaucaagaugacagauucagugacaaccauauccauaaccucauucaguguacauggucuucccaauccaaaggaaaacgcaagacccaauuacaugcugccuacaaaaaauacacuucaaauauaaagacaaacaaggucaauaagaguauaaggauggaaaaaugcaccacauuaauauuaaucaaaagaaagcuggaauagcuuuauuaauauuaaaguagauuuuggagcaaaacauuacaaaggauaaaaagaucauuucauaagaagaggcucaaggagggccuaacagccuggaacauuuacacgccuaaaaacacagccucaaacuauacaaaauaaaaacugauagcacuguuuagaaaaauggcccgguccacaaucacaggcagagcuuucaauaucccuugcucaaugacaaacagaaagaacaaauggcugggcauggugguucacgccuguaaucccagcacugugggaggccgagguggguggaucaccugaggucaggaguucgagaucagccuggccaacauguugaaacccugucucuacuaaaauacaaaaauuagcugggugucguggcucaccuguaauccuagguacuugggaggcugaggcaugagaauugcuuaaacccaggagacagaaguugcagugagcugagauugcaccacugcacuccagccugggugacagagugagacuccaucucauuuaaaaaaaaaaaaaaaaaaaaagaacaaguggacauaaguuacacacucaugcucagaaaguuccuuccauuccaaguaagcucucccacagaaugccggugaacacaucuaugccuguaccacucaacaugccuuuuuggggcaaugaucacugaaaaccaugaauaagucucaucauugcuaaugucaugacugacaaaugcuuccccacagagaauauggccacugcucugagauggaaauuugaguucuaauucuuucugguccacuaaaaauucuuacaacucagccaaaucucaacuuuccuugaccuuaguuauauuauuauacuuacaugaugagggggcugggcaagguuacuucuaaaauccuuugccauggucugaauguuugugucucucccacccccaauucauauguugaaaccuaagccacagugugaugcuauuugagggugaaagcuuugggagacaauuaggcaugagggcagagccuucaagauugacauuaguacccuuauaaaagagggcccagagagcucucuugcccauuccaccauaugaggauacagcaaaauacaaacaaaaacaaaaauaaaauaaauaaaagauaaacaaaauuuaaguucuaugaaccaggaagcaaacuuucaccagacaaccaaguaugcugaugucuugaucuuggacuucucagccucugcaacugugagaaauaaacuucuguugcugauaagguacccagucuaugguauucuguuacagcagccugaagggacuggaagacauccuuccagcuuuuguguucgaacuugaacuaugccaucaauugucaccaccucaggaauauuaaaucaagucagggcuugcaaugugagucccugggaguccugucuggcugcucuguggggaagugugaguaccugcuguguagagaugaccuuguggagguagcugcccugugacccuuugaccuucaagauggaauggacagggguugaaccucugaauaacagugcucaaggcauuucuccucauucuuuuuguauggcuuccaguucccagugccccacccuuacugucugugcugugaccugaagugugaacucggcugcagcgagaccuacccgaggaggaacagccugcagagcggugauguaguucuccagggccaggcggcggcggucauugagcauggcuuccacucuggccaugugugucuccaccagcugcugucucucguuggcugcuuccuguuccaaagauuccacuuucuccuggaaaugcugccaucauaaacacauauguccauggggacugaauaaguaggaugaagcagcaauuucaagucuucuaaaaaagacauccuauuccauuuucuucuagugcuaaaaaguauccuaaagacugcauagucauuccaacauugacuaauucuacguuuuauagcuuacuucacuuucuugcacucuccaacccucaucaaaccuacuuucucauugaaaaucaguauuucauaggcucucugaaggcugauuugacuaauaacuuuggauaaauauaugcacucuugaaacucuuauauuacauauuaaaaaaaaaucccucucuuacuaacaguaccucaaguaauugaccauaauaaacuguugguuuacuuaagguaauuuugagacugguuuccaucaaaaauucaaauucucauaauuuuugcuggagggagaagcagcagaagauuguggugacugaaaagauguauuauuaauaaaaaguagauugcaaguuacaaugugaguuuuauggcaaugaauuauaacuugaaauaauugggagcaaauauaaggcaggauuuaaacaacucaauuacuagacaaugauuaagaacagcugaaguucaugggacuaugaacaaucacacgugaggugcuggcagauaaagguaaaccugcagacacucauuaaaaagacugcuggcaugugauguuugguaggaaauggguucagguuuuaccuggauaacugccuucuuaucagcuuuaggcaaguucuuugcuugacguucugccucuucccauucucucaugaccuauaaauuaaggaaacauuugaauuuaaaaucaucaguucauccuuugaauacagacuuaauaggauggaugauuauguuuuuccucuauuuuugucauuuuagauauuuaaaaaauuuauuacauaccccuuccuaucugaagaauauuugaccucccacuaggauauaaauaauuaaucacagcaguauauuaaacauaaauguucauauuuauugcaggaauauagcuuuuugagucaagguuggucuuuuuuuaccccgagaacugacagucauuugauuugaugugaacaaauaccaacuauucauggaaggcacacauuaacugaacaaggucuuccaauauuaaacugaacaccuaaguuuuacucucuuaugaaagcaacugaaaccauuuuaaacuguauauuuugacuuuaaagaaaauaugacauuuuaugugugugugugucaugaauacaaugccaaaaagcaguacauaaugggggaagaaaaagaagacuucugcugucuaauauccuaagaccuaucccccuuuaaagaacugauggggaauuaaggcccuuugagcuugccaaccuaagucaugaacagcaaggauuacgcuaaguccuuccaaaaacuccaagaaaacauguaauauucugaaugcagcaaacauguauuuuuuuacaaguagcacuaauuuaguaaccaacugcuaugguuugaauguaaccccuaaaaagcauguguuggaaacuuaauccccagugcaacaauguugagggguaaguccuguaagaggugauucagucucuguccucaugaguaaauuaguaucauuauggggggaguggguuuguuauugugagaaguggguuguuauaaaacucaguuuugcccuccucuugcccuucuuccuuccaccauauaugauacagcaaggaaguccucaacagaugccagcaccauguucuuggacuuccccaccugcaaaacugagagccgaauuuuaaacuucuuuuucuuuacagauuauccaggcugggguauucuauuauagcaacacaaacugacuaagauaucaggugaauguguuuuguaggaaaucaaugcuuccugcucucaacuuugauguucaccuggauuucccugagagaaguucacucauuaaccugauacaaaaaguaaaagucugcaccucuguauguuguucaaagaaaauauuaacuuccuaccaccuacagcugccuuuucaaguguaugacaaguagaauuuguuugaagugcaacucugaacuagguaaaaugaagaaagaucaaggaaacaaaauauugguuuggugccagauguguacuugcauacucuguguacucccaaagcaugagaaaacuugauuacuguauuauaagagccuguuuuuuguagguacuuagccuuaaggaauagacucuucuaacauacuucaagaugggaaagaaaaagaggcuuggaauaaauaacuauagauagaagacuucuaugagacaauacuauaucaaaucaccauguggguuccuaauuacagauuuuauuguccauuggcauucauucuuuguauaugauaggcaauuagcuucuucuuguuguuuuuguaaaaccauggaggaaacaagauggaauaaauauuucauuacacuugaaaagcauaucaaaaauaaucucaagguucacagcaaaauugggacaaaugcccugcugcaaugaacaagaauagaacauggaagaaaagaaacauauugucccaucugcuuuggugcuucuaccacguuaauaaagggaaccugugggcaagggggaaauggaagaccaucuuugcuuuauagaugagauaagccuugcaauauaaauauuucaauuuccugcuuugggaauguucacaguggugguacucuaccaacaauucuucaagcaaggaaucucaaaauuaguuugagauagaaguucaauguucuacugcaaugugagaacugauuucccauauuacauuuacauuuuuuccauuuuaccucauacacuuuaagaaacuggacuuuaagcuuuaagcugggggaauccaugaaauaauuaaagagauuuauuuagcuaaugaguugcaaauaagcauuacuauagaaauuaacucacauuuugauuuucagaacaauuuaacaauauccuauacccccacaaauaaacaaaucaccugcaccaucccacuaagacucuacugcaaaugaauacacacuauauguaggcugaccaucucccugugaacagugaauuucacugugggacugauaacaaguagcauuacugcugacccuguauuaagagcuuuacaaaaucuaucuaauuuaauugauuccucacaacagcuugugagauuagccagggccaucccauuuuacgaaccagguuaagguaccagcucgaggcuaugcagguaaaaaagggagagggaagaauauaaaccaagaucucuguggcucuaaagaucauguuuuuguacccugugguacccaauuuuuuauuauaaaauaaaaaauucauuaggugagcuaaguuuauuuauauuuagugacaggagaaaggggcgcucuuaaaauguugcugcuuaucuuaaaaauaaaaaccuaggccaggcacaguggcucaugccuauaaucccagcacuuugggaggcccaggcggguggaucacaaggucaggagaucgagaccauccuggccaacauggugaaacccugucucuacuaaaaauacaaaaauuagcucggcgugguggcacgugccuguaaucccaguuacuggggaggcugaggcaggagaaucgcuugaaccagggaguuggagguugcagugagucuagauugugccacugcacuccagcugggugacagagcaagacuccaucuccaaaaaagauaagaaauaaaaaccuaugaguugggucagcuuucaauuugaaggacuucauuuuaagcauauacuaaaaguaguaaguuuauaaguaauaaaagugcucacacaugguucagcuguagauuucuauuugacuagaugcuagucacgacauauagcaacaaaaaucuacagguuuagcaacaaaaaucuacagguuuagaguuauacuccacaauggcaacaacaaaccaaaauaugaaaaaauuccaaaauccucuguauuuguaagaaaacauauaacaaaaacuacaauaaaacuuaauuuaaaaaaccgcacaauuuuuaaaauuuaaaauucucaggaccuggcccuugcaguggcucuauggauucuuauaaagcaauuuuccacugcaggcacaaagguaucaauuucauuuggauuuaucaaucuucaaagacuuggcuguuucaugcagagaaaaugacuacuacuaaguagagauuuaagaggcaggcaaguuuaaaguugaaaagucccuagauuucagcaccacagacuaugaagauacauauugauuucaggugucucacauuccuaugaccacuggaaucuaguagacaacauucucugcucugggacaacaucucuuagguuauaucagauauaucugaugacuaaaagaugaacaaaaucuacaaaaucaugaacuaagucacaaguuacacagaugugcuaaaaguuaaauuauuauuuuaaagaagaccugucacaucuaaaacuaacagagaauuugaaauaaguuuucuuaauaaggucaaaaaugaacaagauauacuaggagaaaaaauccaggauuaaaaaaacacacauuaaaaaaaaugcuacaguggguccacgaugaaugcagguagcaggcuucaugacuugaggucucaagguuucuauccagcuuggaaagauaaugcagguguguccagaaaucacuaacaaaaccggggagcaaauauuuagaauuaaaugaaagguaagagcaaugacugccugucucauucugaguaugaagugggguguaaggaaugggugagaugugucagcgugaagaagagugggagggcauuuccagaagaacucaaugccaagggcaaagggaagcccaagaugagaugaacagacgaugagcagaguggccugaucagaacagcagcuuaacgcuguacagaaagcaaggguagcaguugagaaggaagaggugguaggaagaccagagucaggguacagugguaggcgcugaaaaugacaagcugagcauucgguguuuauuuuugucauuguucuuuuuuuacgacuucaugugcccagaaguggauuugugagggcacaggaagccucugaaagcuucauaaagaagggagauaggauguaaauucaaaugaggacauuucaguggcaauaaguaugauucauaguccuccaaugcuuuccgaacagugccugugucuuuccuaaggaaagaucugauuuucuuggcaucaggugaaaacuuaauaauucccuguggcuagcuuucuaguucaauuagcuguuagguuuucaucgugggcagccacuagaacugcacauuauauuccagagccaaaaguacugugauuauaaggcuuuuuuccucuuuauguuauuauaccaaaguagauccaaguauuguuauucaucuuaaggcaaaacaaacaaacaaaaaacaaaacaaacaaacaaaaaacaguaccuguguuguaccuuucuagauaaacuauuaguuuuauguuuucaaggguagauuuucuuauuauucaggugaggccaagaggucaggagaugauuaucauggaaaagacaguuuguuacucagcucccaagaagccgguacaugccacuacaugcagggucauaugggaagcaccaggguuggucaggaggggaaaacaugagcaagagccuuuuauugugguuuucauggaaagaaugagcgaagcaggguaggcggguuuaggacugauuaguucaaauaauggugauggggcaugagguugucccuaguggucugguaccugguccuggggugauuagagcaggugaauaguggcccagaguauaagaaggugguugggaguaaggagcuuuugauugacugguuugcaugggaaagacaugcucaggggccauucauuuggcccugggagggaggaaucuuccuggggucagcagggacccagaucagaaauuacaggaaagauuaauugucuacuaaagacugacugugaucuuagaaaauacgcagcagucuaauucauaaauugcauuuaaugucucucaagagauuaagcaucugugcuaagacaaaaauuucuccuaucuucugauauuugccacagaauauuaacacuaaaaaugaauggcuuacuuuaaccugagaucuuuauucauucacuuuuauguccuacuucuuuuccccccacauucacuccuagguuuguagacuacaaaucagaaaagugacuggaaaauaauaaguccauauuuguugauugaaugaaugaaugaaugaggaaucugagcaagggcuaaaauccuccauauuaucaaacuccaauacaacauccagugccugguagcagacauagcuucaauuguaguugauaguauauauggauuagccauguuuuagacauaaguuauuuuuuaauuugcuuaauuaaggaccugcuaaaaaaaaacaaaccaaaccaaaacagguuuuuuuuuuuuuuuuuuuuuucagcaaaguauaaugaaaggaguacuguacuaggagcaagaaaggccuggauucuaaauguugucucuggcucacugauuuugcuuugugcuaaaaugggaagccacucucucgaaccucuauuccacuauguaucacuuaggagacuagaugaaauaaucacuaugguucagcucaguuuuaagucucuaugauuuuacagacuguaaacaaucguagguucacaauuauaacagucugggauuuaauacaaaaccucaucuuuacuaaagagcauuuugauggauuuuaauuuacaacauguugauuacagguacuacauauacacagaauaauaaugccaaguaccuuucuucgccagagagaauguuacagacaucauuuaauuugugcuuacaaaauccaacuauaccuggauccuuccuaggcagcauguucacggaggaugcaaaaaacccacaaacugugcccacacaguaaacauuuaaaauuagaacuuuacaucuuuaaagaucuugauaaagccagcaggccuguggggagacugaggcagaggcaagcucagguuucccaauaucguagggcugaaugauggaagagccagacuuaccugggacauucucucucggugcuuggccucaagccucucuuuggcuuucuggaaaugggcauguucauucucauccccaggugucucgagauacuugucaacggcaucagggguacuggcugcuguuguaggaacuauaaaguagaagagaaggagguuugagaaaaaaaagccaacaacaacagaauaauccacucguuuaauagaaagccguauuuucaguuauuucucagaacagagaauuuaguaaagcagcgcauacaagacguuaaugcuguuuaagagaacaccaugagacacugugcagcacaguaaggaugucuuucaccacucccaaguacagaaugaaggaaaaaucuuuaaaaugguccauuuugcaauuauagcauuagaguucuuuacgaaacaagcaugcaaagagcaaaaacaguuggugcugaagacauguuuuuccaaauccccaugcuuuccuaaauuacuauuuugcaauuuugaaaguaaaugaugauaucaucaauaucauacacuaagacuccugcagaaaccacagauaucuguaauuagccuguuguagaauaacggcaccccagggaaaagguaaauguaugauguauuuagauaacugaauuacgaagacaaccuucaugagacaguauggaaacacgacaaaagauauauaaacaucaauaaacacauuuuugaaucacaaaaggacuuuucugucuucauaaauuugacaauagucaaugaauucauuaugcuaguugucaaaaagaaagugauuucuauuuugaauucaacuaauacugcuaagcaauauuugaauugcaacauauacugcuauauuauguaacucaugagccaagugaauuauaauaccuauacaagcaauuuuccaaaagauuagugagaauucagaguauuuaugagcuuaaaagcaaaaagaaaaaagaauuuugacuuaagaggaagcauauuuaacauaaaaaacaaaaugagacguuuucacuaucuuuugagaucaaaucaauuguuucauucaaaagguuauucaaauaucaccaauguuccaaguauuccuauugaauuauuaccuguguauuacauuugggauauaauaucucaaagaggacuucaaugagaagaauugauagcuaagucauuuugaaacuaaacuugaaguuaaauacguuuucuacauccuucaagaaaaugucuggaaucuuaauccaaagucuucaaagauauuaacuaaaaccggaaggcuguuaaauaauuaaacaguaucuuucauuuuaaaaagaaacauucguuuugauuuuuucccuccacuucaauccugauuaauaaucauuuuucaaaaaauaaaagcaguugagugucuauccagauguugcuuucaaguggaaggaaggaggcagggcauauuccuggugccuuuacacagcugccccugucuucucuguagcaaaugagggagugguguuccuucuuacauuggcagcaacgggggaaggaaggaaggaaggaaagagucauguggggauuugcaauuaagcacauuuggauuugaaucccauuucuuuuucagaucagcugugaccuggggcaggaaacuuaagcacuccauguuucaauuuuuuuaucaaguggugauaacaugccgcaggacaugauaggagagcugggaaaaugagauaccauaccacauguaagucauccggcagagagggugacacacaguggagcucauacauguuaguggccuucccuccuccucugcuuaauacauccuguucaaaucucagagcuaaugcuaaccacgggaaaguucugauacuuuuauucaaagccacugaaaauguuuugguagaagagugcaauaauaaagaaaaaaaagaaaaggacaaguuuuaaaauuuuaaaaauugagaaaaagaaacaaaagaaaauacaaacuaacaaaaaauaaauaaaauagaaccacugaaaaugaauuacacacaggaucacaaagugcaaccuacaggaaaagcaguauguauuuuucaaaaaauguuagguguagcccacauaaaaaaggccgaaaguaucaaaaauaaguaaauuguuaauuuguaagauugaaacaauaauuuugaauauuaagaccuuuuuggaaaaaagguaaauguuuuucuccauagcuucaagcaaaccaauaugcaaguauuuuuaacuuaaucauuaaguuaaaaugaauaaaugcuaaauaccacguucuuacugacuuuaacuuaaugauuaaguuaaaaauacuugcauuucaaguucccaacuugaaaugaacaugguauuuagcauuuaaaaugugcuucccuagcuuuagucaucuucucaucuuaacugguagagcucaaaugagaacaaguuaaaguaaaagcagaaaauaaaacaguaacauucuuuugcauaguccaaucuggcagaaugacauguuuaggcaaaccauauuuuauguuugaaacaaaugaaaauguauaaauauuugggguuauaccugcugaugaagauagucaucuggcuguaacuguuauaaccauaacauaagcaccccuuuggaaaacuggaaucauaaaacuuacuauauaagaaggaaauuuuuucagcuccuaugguuugcgaacacugucuacuguauaaaggaaagaagauaaacacuauaaucugaaucacuauaaucagauuggccuaaguagaaaugcacuuagcaacauaauaagagaauaaccauggaacaugaaugugagguauguuuaauaggacugaggauauuaaaaaggauaaaaaccuucuuuuuaggcacguggaaaugaauaugaauacuauauuaccaacuuaauccauugaauccagaaauauuucugugguaauuaauuuucugugccaacuugauugggccgcaaggugcccagauuaaacauuguuucugagugucuuugugagggugcuucuggaugagauuagcaucggaauuggugcacucaguaaaguaaaucacccuccucaacaugggcaggaaucacccgaucugcugagggucugaaaacaaaagggcagaggauggagcaguucacccuuuuuauuuccuggcugccugagucaggauauuggucuucucuucucccuggacugaaauuuacaccauugucuucccugguucucaggccuuuagauuuggacuaaaucauaccaccagcucuccugggucuccaacuugcagacaacagauugugggacuuagccuccauaauuguugugugagucaauucugcagaaucaaucucuuccuauacauauauauccuauugguccuguuucucuggagaacccugagcaauacaauuucucuucaaguaaaucuuuguuaacagucccaguuauuucccauaguugaggaagcugugucucuuuuuaucuuuaacucaaauuuuucagccauucauacaaacuccccaucucaauuagugugagugaaauuauccuauauucauaccaaccagcaagccagauuacugucuagucaagcagagaaggauagcauaugcugauauuguuaaaugaauuuaauaguucauuacuacugcucugcagcuggugaggaucccggaaggagagagcaauuuuaagguggaguauguccagagagcucaacuucuauuucgugaauauccuuauauccuaaagagauuaaauucauaggacugacuaccauuuugugauuauguccacagaaggccagagacacgugugcccuauguccucacccaucaagguacuuccuuuugggaagggaguggggcucaaggaaugucaggauaugucacaggacacagaggaaacaggaagcuguauaucagcaggucacugauauauuuaagguacuuaaaacacaggucacuguaaccacuuagaaaguggaaacaaacuggcuuuaggaggguuuauuucugguuuugcauuuuaaacuaccauaaagcaguuuauccugcucacagaccucugagauuccacggaaccucugauaaaggcuaggauuucggccggaugggguggcucacaccuguaaucccagcacuuugggaggccgagguggacggaaguuugagaccagccugaucaacauggagaaaccccgucucuacuaaaauaaaauaaaauaaaaaaauuagcagggugugguggcgcaugccuguaaucccagcuacuugggaggcugaggcaggagaaucgcuugaaccugggaggcggagguugcggugagccgagaucaugccagugcaccccagucugggcuacaagagcgaaacuccgucucaaacaaacaaacaaacaaauaaauaaaggcuaggauuuccauguuggcacuccgucucaaauaaauaaauaaauaaaggcuaggauuuccauguuggccaaaugauaacagccucuuuucaucagagcccaccaugcuaggcauguucuguguucucguuuaauacaugggaagaaaaaauuacccuauuuuauugcguagaggcaaaacacuaucauuuaacauacccauuugcaucccuaaacacacacaaauaaagucuguuaagauuggguaagccauaaaaaggcuguaaagcuaauuuuuagaguaguaaagggccaauccauccacaugcuggggcacuguaaaggguuuuuguuguuuuguuuuguuaaugagcagcacaacuuggcaaaacaaccauaugcuuuguuaugauguccguuggcuuguuuucuaugaaacagcuguuccugccccaaacacuaucuggcaaauccuucaacagaaguugggucauaaagcagggaucaagugaaagagcccauggagcuagaauauggaggacguucuggccuugggucccuccuucagccugcucacucaugccuucugcaagcaagcuggcuagguauguuccccccuccacaaaaaccuagacuuaaaacgagacaaaacacaggguucaauauccuuagcucuagguuuugaccucuagaugccuagucauuagcagcaauaccaacaucacaugcauaagcuuuuaacuuuuuaaaugaccuuuguauuuuagucuccuaacagagccuugaggggcaugguaggauauauaggcuauuaccucccuuccuuuuaauagugaucauguguaucuaaacacucauaacaaaugaaaaaauguaacagaaaagcaguucuaauuccuaguacaucacugcuucaaggugaauauuugcuuccaaauauacaguggcauuuuggaugacuaacgccuucuacauaagccacauccuuauucuuugccacccugggaagucagagguaucaaagcagcugagacagcagcucugacauggacaaacuauccugccuuuagugcgccuguucauucuuuuauuccuccagcccaccaacauugcagcccuuauuauaugugaggcacaugggagaaaccaaugagaaaaacaugaaggcccugauccugguggaauuauauucuagggaaagaaacaauuaccacaagaauuuuuuaaaagccaguaagucauauuguuaauaugugauuuguauuauggagaaaaagaggaaaaagaaaaacagagcagaguucagaaggaucgggagagcugaggggagaggggaaagguagaccgcaguaagugagcgaccaggcagagucuuaagugaggaggugacauucagaucuucccagcuggcugcuggaaggacauggcaggcagaugacaaaacuagcacggaagcccuaagaguugaagcuggcuggcaaauuccacgagacccgcauggccagagcuaaagaagcaagagaggaaguagugggagaggcagggaagaaaugggggacaucauguacagccuuaaagccacaguaaggauucugagggaccagcgugggcuguuugagggggaguauaugugauggggcguuuuguugaaggaucacucuggcugcuaugggacaaaaguagaaggaagaucuuuuaagaggaaaagacaggcugggugcaguggcucacgccuguaaucccagcacuuugggagucugaggcgggcagaucaccugaggucaggaguuugagaccagccugaccaacauggagaaacucugucucuacuaaaaauacuaaaauuagcugggcgugguggcaggcgccuguaaucccagcuacucgggaggcugaggcaggagaauugcuugaacccgggaggcggaaguuguggugagccaagauugugccauugcaccccagccugggugauaacagcgaaacucugucucaaaaaaaaaaaaaaaaaaaaaggagacaaagaugaagguggcuuggaccaggguggcugucacaggagguuguugcccucagcccccuucccacacgagaagggucagauucccuucuuucucucacaccaaaaugcuguauuaccucagggaacugaauaugaaaacgggagaaacugcuuucacaugugcgugagggcucauuucaauuuuaauacugauacacgcaugcuugucacaauacugccacuucacacugugaucuauucucaauaccugccagagcucuguuuucuggggugaaguaacacagguuagcuuucaguuuauucauaaauggcgaugcugcacccaacguuccuaucacaaaaugcuccuccaucacuggggccaagacaccaacgaaacauuuuccauaccuguguuuccucugagaaaacuguuagcauuugaagggaaguuacuuuaaaacaggggaaaaccugcuaauaucuucaggaugaggcagacgucacucuccuagccugucugaagacuccuuagaggauaauccauuaaguugaacuguacaugcacugauuucccucauuuuaguucugauuuuguaaucauugcggagcacuccauuucauauucauacuaaugugguacuucacauucauauaagaauguggggucaaaauuaaaggcacugugaaagauugccccuaucauuuugauaugcauuuguuuccucaggcuucuggggugacccauaauuuuacagucacaauggacucaggacacaaaagaagaaaugacccaccuucaaacagcaaugaccguggccaucuccaacaggccagaaggcugaauguuucccuaaaccaaggcuuaugaauggcauucagucgauauauuaauauuagauucuaacaagaaaauuggguuagucuccuuucaucagcagaaaagcaauuuaucucuacagccuugguaacagaagauuaaaacaaauuaagaccuauauaaaucauugccuuaucauugaaaaugcuauuugauaccgacccagcaauguugucauuugagauggcuauaauuuaggaaaggagacaaggaggaucauuuauauaugagugaaauauaaacuuguuagcguucaugugaaacuuuaaucuugaaacauggcagagcuuuccgagugccaugcuuauuauaacuuaaaaaaaaagugucucuaaaaaaaaaaaaagugucucuccauuuuccuaauuucaaaaauaguuaaaacuccuaacgcauucuacauucaaauauuuauccuaaccauuaaguccaagauagaggagccauuuauaacaagaaaauacaguuugugauccuccaguguaauaccagacucucuuaaaaacaaaauaacaacaaaagaaaaaacaaaggcauucucccccuaauaugcccuuguauuacaauuuuauagucagugcaaucauaguugguggagaacacuaucaaugcaucacauggacauaagguaauaaaaauauaaucuaugauguguuuacucuagucaagcuacauuucuuuuuuauguccauggacacauacugacaugggaauuuuuucaaauauaugaacugaaugugaaggaacgaaugcuggcauuauuuuuuuauuaacaucuauucucuauucagcacaucacacuaaaacuuaaaagcaaccucaaguuugaaucuaaaaaauauaugugaagcaauagcaauaacuggcguccagaauggguuaaccuuagguuauuguuuuuugucaauuugucagaagcuauucuugacuucguuaauggaggcacauaaagaaauaaccugucauagcugcucaacacucaauagaugaguucgaaaagucaaaaucuucaauauuguccaguuucauauaaacuguagcaguaaaaggagaugguacaguuaaccucuauggaggucuuaaggauaaagcugauuucauuuuaccccagccuuccagagcaaucuucuccuacacuucuauauuuccuuuauaugguuauuuaccucuacggcauaucugggucucaacucauuaauaaaauuaucagguauugauagccaguacucagauuccuuugcuggugucucucaaaauaccuggccucgcacauccuggggucaaaaauaacugcugcacaguucacaacugcaaagauacggaaccaaccuaagugcccaucaaccaaugagggauaaagaaaaugugguguauauauaccacggaauacuaguaggccagaaaaaccacaaaauaaaagucuuuugcagcaacuuggauggagguggaggccauuauucuaagugaaguaaucaggaauggaaauacaguauguauucccuuauaaauugggagcuaagcuaugauuaugcaaaggcauagaguggcauaauggacauuggagacucagaaugaggaagagugggaaggaggagagggauaaaaaacuacguauuggguacaauguacacuacucagugaaauggggacacuaaacucucagacaucaccacuauacacuucauccccguaacuaaaaccacuuguauccccaaagcuauuggaaaaaaaauaaaaauaaaaauaaaaaaaccugcuguauuaaaccaaggaucagcuugcuggcuaccuuuuuuuucccccuugagaugaagucucgcucuugucccccaggcuggagugcgauggugugaucucagcucacugcaaccucugccucccggguucaagugauucuccugccucagccuccugaguaggugggauuacaggcgcccaucaccacgcccagcuaguuuuuguguuuuuagcagagaugggguuucgccauguuggccaggcuggucucgaauuccugaccucaggugaucugcccgccucggccucccaaagugcugggauuacaggcgugagccacugcacccagcugcuggcuacuuuuauaaaaguaguauuaucggaacacagccuugucuauuuguuuacuuauugucuauuguugcuuucaugcuaccacugcauaguuaaguaguuaugacaaacugcaugaucuacaaagccuaaaauaucuauaaucuggccuuguaugaaaaauauuugcugaccacuuuauuaaacgauccacuuacccucuuuuggcaaauagcuaaacaacagagcagagacauaaugaacauucuuuuaccacagguagaacaucucuaaucugagaaucugaaaugcuccaaaaucugauaauuuuugagcacugacaugacaucaugguggcugggauagcaacaccuuuguucucucacagugcaacguacagaaacuuuguuucaugaacaaaauuaucaaaaauacuguauaggccaagcgugguggcucacacguguaaucgaaguacuucgggaggccgaagcugguggaucacuucaggucaggaguucaagaccagccuggccaacauggugaaacccuaucucuacuaaaaaacacaaaaauuagcugugugugguggcaggcgccugucauucauuccagcuacuugggaggcugagacagggggaucucuugaacccaggaggcagagguugcagugagccgagaucacgccacugcacuccagccugggcaacagagcgagacuccaucucaaaaaaaaaaaaaaauuguauaaaauuaucuucagacuuuuguauaagguguacaugaaacauaaaugaauuucauguuauuucaucaugaauacaucaauauuccgaaauccaaaaucugaagcacuucuggucccauuuuagagaagagauauuuaaccuguauucaaaguagauggcccuucuuuuuaaaaaaugcugaguugcuaagcaauccaguuccuuucaauuuuagggucaucucuaauuauuauggcuuugaagaaaaagccauucuuccuaucuaagcauuuccagauaccaaagauuuagcuuuucacacuuguuaaucugauagaauauacuggcacugacgugacagguaguuuaauucaccaucacaucuuuuaaugcuuuaaaauuguucucccucccuagguugguuggggagcaaaguguaaucccagguugccuaaucuaauuuggcaguuuuaguuccaaugguauugcagaaugugcuaaugggaacuaacauuugcuacugcacagugaaaagaacaagaauagugugauuaagaacaauaguucaaauuuggccaaagauuaaauggccuaggcauucagacuucugucuuauggcuccugucuuuacaacgacccugggguuaagguggcauauuccauugaaaggcugcguggugugaguuuucuacgauuugaaaauuaugagcuucugcggcaacaaacuuggaaccuggggauggaacuuggggccugacuuguuaaguuccaauucuuuucauauucucuguaaguguaccagucuguuucaugucaucuggaccauucugaugugccuagaaaucaaucuuuuucccucccucaauccugcauggggucaggccuacaccucugcacaaacuauaaggccaucaaacauaauccuaaaguacaaauaaccuguguagcaagacuauaggacaucucuacagaugguuguccuccagcauauccugggauucuaggaaacuaagaugaaacagagaggagaaagggguggugcauaggugaaccaaugacuucaaacuaagggauuugcugguuucucuucugcugccacaguagcuuacauuagagcaggaaaacuacgagaccuucaauacuauagucaggacagcaacagcaacuuccacuuuaccuugcaaauauugagagcuuggacaauagucuaacaaauucaauuucaaacaucugucgagaauuggaugaugcugacauucuaacauuucaacaugcccccaaauuuguggaaaguacacguguuuacaccaggagaguucuaucucugagucagauguggggaaacuacuacucuagaacaggauucucaaccagaaugugacccccugggcacauuuagcaaugucuagagacauuuuuaguuaucacagcuggaguuguguuaauggcauuuaguggguaggggucagggguacugcuaaacacccauaugccuaggacagacuccuaaaaauuaauuauuugaaucaaaauguuaauagugcugagguugagaaaccuugguuuaguuguuuguaccacaugucagcgcaaaugaaggagccugagaugggacacacuuuggccagaucacauggugcaaucugcugacuaaaaauuggcaugaugcucuuugagagauuaaaugccauuaaggaguuggucuguuugccuuuugggaugcagucugauggagacagcaccaggaaaaaauggucacacucucauauuuaaaauauaaaugaauccacaaauauuuauauaauuuuauugucuacaaauacuauauuuugaagauuaaaugugaaaccuuuugcacuguccuaaacccaaaugggcaggugcaaaacuaaugucagaaauuaacucagcucucguaagauucuuuaucccaaaugagaaaggguuuuuuuuuaaugauuugaauuccuauguucacgaauaaaaugaaagcucucagccuuauauuugugguuuagauuuuuauuuaaaauaacaacaauaaaauaugucccuaaaauugcaaugcucaaaauugguuuuuaugacaaaaguuugaaaccuagaaaugccugauuuauggcaaauuauuguuuuuauaaugcaaaccaucauacauuuucucccuaaguguaaucuuuuaucaguucaacugaagagcuuuuucuaucuccuuucacauuuguuauuugacuagaagcagcuuagacugagcaaccuguaaaaccaaccaccuuugugcagaaauaucauccaacuggcucuagauuguugaaggagcaaagucaaguccaaguugcccagucuaacaggcuugcuuaccuucuaguucagcuccuuuucucugaauugagucugccaucugaauuugaccuccagaugaccaugacuuuuucaaaucaaaugugcaguuugcuauaaauaagaccacauagcugcacaggcuauaaauaacuagaaauuauauguuuuuuuccuugucuguuuguacuagcacugcaaaacccuucacuugcugugauugaauagucucuguaggcagacaagaaaauauagcugcccaaagcacuucauccuccuagaauggaaaggugucaggaucccaaauacacugcaaguagauggagaaaauuacugggaaggagaaaauuacaaaagagacuuucaguaucuguuuggaacaguggaugaugaaagugguaguuacguguacagcaugaaaauaaauuuaucagacaaugaugcuuguuuccaucaguuauuaaaaauggaaaaauagaauucuuauaaaugcuaaaaugaaacaagagaaaaauaaucacuguuuuauaaaagaaugggaaagacauuuaauuuacugaugcgugcucuauucauggcauuuaggaaaaaauguuaacauucuucauccucuuuucacuguuuucuguauucuuaaaaugugcuucugaaucgcaaaugugauuucacuaaccggcaaaacaaugucagaaccaaugcuuagccauuugguguggagugcggccaaaacgucauuuuggguuucaaagccugguccugccauguucgauggcuugggacaagucacuaagcucuugaagccucauuuuuucucguauguacaaaaggaaugaggaaaaugcccacaaaguguucugaagaaaaauuaaaugaucugugaaaaugcucgguacaaugcaacucaacaugcguaccuaugucaacacuauaguggaauagcuagagcuuuuuccuagucugucaacccacuugcuguacuuacaguguuuuuagagaaaaaugcuuuuuucacaacagcaaaagaaacguuuauguugcagcaguacaaaccacauccuucaaaaguuauacauaaugugaauuauucugaauauuuuauggaggccauuaaaaaacuuuauaguuuaggaugcagucuuuuuuaaaauaccuaauccuucaucuauaauuuaucaucuuuaaaaaagauaacuggcuucaucaguuuugagaugaggguuuuuuuuuuucaggauaauguacacaaaugcuaauuauaaaauaucuaaguuacaacugaaauugugccucuucuuccagcaaucauaagcauaaauggcauauaucaucccuaaccuaacacuggauaaaucuauuucuggauggaauccaaauucaaauaugaguacuaaaaccacauuuuaaaacuaaacucgucugauauuacaacugaaauaaaaacaaaacauaagacacuguaaguaaggccugcaguggcuggacaaugcauuucuuuauaggaggcucuuucucuacuuccuagucaaaaggugagcaccucuaaccuaccauuaugccuucugggagaggagaaagagggguuccuaaugucuaaaagugacccuucaugucuaaaguugaaaccgggucuuauaacacacauaaauugaaaucugcguguacgaauuaguccauguacuacaauaccaugaauauuaaguacuuuuucugaggaaacaaguuacuuauguauuauagucucuuguuaaaucauggcaucuugauguaaccgaguacucuauuuuaaagaucuuucuuccuuucuuuuccuuccaguuuuaguaaugaaaugguaaccuuugcucucuuucuucccaccaggcacucccugcacagcgcuuccauuaucuaauuacgcuuauaauuauuauuaaaauuauuaaugcuugcuuagaaguuccacugacugacuuaggcaccuucagaauucucccucaucaggagaucaccucaaggcugcaguuaauuuacaacccgauugugcgggaugcgccagcccacuuaccgaacuggauaauaacucaagucuuuggaacaaguccuguauagcagcaccuccucaccccuccuucaugcccugcauuccaagcuccccuuuuuaagccuuuguuuuuuaauccaaaauuugagaugguugcuuugaggcaggagccuggaccauuuccccauugcuagcuuugcuaaguaaagucacuuuccuuccacugcaccuagcccuuguucuucaguucugcaaaagcagugagaggcuaagccugcucucaguuacacugauagcuuuuaggaaauaaaauaguaauggcaaauacaauacaaugauguuguccauauaauauucaauaaaaccagacuaaauaaaaaggaaauuggucagaaauagaagaaacuuagucaaugaugcucuuagcccaacaucucaagcugucuggcaaaaucagauguaauuacaagcaagguaaugggaagaaacauuuuacuaagacagguguucaagaaacacaaaaccaugcaaagaaggugaugaugcuggaguuaugugaaccaagcagcauccuccuccccucuucccuucccucaggugaaugacaacguacguuuaacaggaucucgggcaagagguuccuggguagucuugaguaaacuuugggacacuauggaaaaaauaagagaacauaacuaaaaacaaaaagagaaacaugggaaugauggcugaaaugcacgaguccacugacaaaaaaacaaccuaacaaacaaaaucacucacuuagguuuggucccuccaacaaaaccaaaaugaacauauaaacauaagaucuauuuucguaagaaguuaacauuugagaaugcuggauauuuugucucugauaguauauccgaguaacaacagguuucuuaacagaagaggauuucuugcuccuuuugugccaaauauccccaauucccuucgaugcauuuuuucacaaaaacuccauuuauuucacucauucauaggacagcauguggcucucggcucuggcuguuugcugaggcuuauacucucuacuuauucuuguccacccaucuaacugaucuucagccuuugccuucuucauacauuauucugucaccuuuccccucuaaaaucaggcauagcuagccucaucuaauacaucucuguugggagcaucgaccuuuugcaaaacccucagcaaacugugugccacccaggacaccuggacaggugcccacuggucacucccagcccaaacugaucaaagggagagaguguuaggugaagggauggcaguacuggggugagguggagagaauuuuaaucucuugaagcaaauucaucacugcuaauaauuaaaaccaaauaaaucucuuauuaccaaaaacuauacaugauauuucagaaaaugaauccacccagggaaagggagaaaaaaguugcaaaucugccaggaaaccucucccaccggcuaaaccagugagaaucacuguaacaaaaggccuuuguuccaaaggcugcaggcaacagaauucuccauuguguucgcaauaccugaccuaauugacugcuuuguuugaaacugaagaagggaguccuuugauccagaagcugcaaucauccaaucagagccagaaaaaaaaaaaaaaaaagcccuugagguuaucaguuccuacaccuguucacacaugggacugaagcagucaucucauucacuggcgauggcaggagaccaacaggagcuuuuccauuacauuccucuuagauccugggcuccuuuacaguggggguauuaauggugcaggcccuucuguuguuuugcuuaauccuaagaucuugcugcaaaacaauuuauauaaucccuaggaaucucaggcaggaaauguggcugccacccuugcaacacagcggagaauuaggcaggagucucucaaaaaaguaauacacaguuauugaguuucauuuuuaguuaucaagcugagcugaauaauuacuucuugaguaguucauacuuccuacucaugaacaacaacaacaaauaaauaaauaaauaaauaaauaagcacaauugggaauuucacuuggaagucuguuaacgacauggaagucucacaucugguacuggaccuccugagaauuaccucuuuggggaaaauuucaucaugcacuuaagucaucaugacuucauauuuuuaucccccggaauuaugaaaagcuuaauguucaagagaaagacuuugaaaauuauguucuggcggggugcaguggcucacgccuguaaucccagcacuuuggauggccaaggcagguggaucacuugaggucaggaguucgagaccagccuggucaacauggugaagccuugucucuaccaaaaauacaaaaaauuagccgggcgcaguggcaugugccugugauccuagcugcuggggaggcugaggcaggagaaucacuugaacccgggaggcggagguugcagugagccaagaucacgccauugcacuccagccugugagacagaaugagacccugucuuuaaaaaaacaaaaaaaauaaaauuauguuccucgagccuuaugucauugaaaguuucucacguuaagucaaaaguuuucuucuacuuucaagagaagaagcagaaguuugaccuggcaaaugucugugugcugagcucggagggggcaagacgggcacuucuacccuccggcauuugagaugcaugagcucaauucaaucacauucccucaucagcacaauaaaagacauguuaugaaccaacuuaaagguauucaucacagccauacaccuuaucaaugcaacucaagcugcaucagccaggcuuccagugguagacaguaucugcacagguagugcacaugcauaaacaugaacacauauguacacggacaaacacauaaguaugcauuugcagaaacggcuggcugcagaagacaaaacagccacuccagcuuuguuuaaaagagaagcacucaaaagucccucuggauugcaagacauaugugcuacagcuaggaagagaacacauccauggccaugcuuuaucagggaaagacggagaggugugcucaugauugaacauacugcggagacucugagcaauuagagaaguggacagaaaugugguuagugguagcaacaggcccauucccaagaaccaggaaaaucaaucuguuacaaaaagcagagucaguggcgagagagacgaaagguggccaggcucgaagaaggguccacuuacuggcgcugccacacacggccaugcaguacucuucugugucaaaguuguuccgguugccgccacauccgccguaaaagaauggggcacacuucccuucagucacaucaaaguaccagcgggagaucauugcucggcacggccccgucucggcuuguucagagcacaccucuaaucagaggagauguggggaaccacauuuagcaugaaaaggcacugucucucuguucauguauacacguuuacuucuuuuaauccucccaguggcaaccuggacugguuuauuaggcagcaucuaccaaacauuuacugaggaauuuaacuggccaccaggacuagagauuuacaccucucagagcaugcacugucaucugguuuaaugagugcaggacucgguagcaauaaaaggauuccggccaaaggugaaaagaucauuuggcugcuuuuagaugaguaugaaaugacggaagguaucugcacaucacaacaauccuccaucauaaaaaauaaacuucucuuuuuaagaagucaacuuucauguaaggaaacugcuuugguuaugaagcgaaaguuuaagcccucacaaacaucugauugcuuuccuuaauaaaugauugccuuaacucaaauauaaaauuaauugcauauauuuugaauguuuuccaguguuggaagcugucuguccauugacuuuaucuggaaacacaugucauaucuguaaaugugacuuauacucaaugacauuaacuuaagaccauucauuuguauauuaagauauguacuaauauaaacggucuuaaauuaacucugauuuaagaccauuuuauuuguauauuaaaauauguauuuauauauuauacauuaauaauuuaauuacauaugcaugaaguacaucuauaacaacguauuauuaauucugcuauuuaauugauauuuauauauuaaaaaucuguauuauuuguauauauuuacauacacauuaaguacaacuauaacaauguauuauuuaauuaugcuacuuaauugauauuuauguauuaaaaaucuguauuauuuguauauuuuguauauuuaccugacccuugggcaggaauguuccaaacaauaaaacgcagucaaucaacuccaacugauuaauacacaccacgcacuguuauacauuaaaacacaucuuaccugucaacaugucuugccacccuccccaagaucaguuucacucaucccugauugccucaaagucaaucagugacccauccaauugcauguauaaagucaauccugaguagaauuauaacucuaccucccauguauaucccauuuuuauuggaagugaaacaacagcccaauucucucucuggguuugugcccugcccuugcuagacugacgccuuagcacacacagaugucuucuuaguuuuacugacagaggaaaaaacaccuuucuaaaagaugaaagccacgcaucacccauuacuuccaaguuaggaauauucaacagauucuuuuuuucuuuuuaugagacagggucuugcacugccgcccaguggcacaaucuuggcucacugcaaccucuaccuccugaguucaagugauucuugcgccucagccucccaaguagcugggauuacccuuguaccagcacgccuggcuaauuuuuugguauuuuuaguagagaugggguuucaccagguaggccaggcuggucuugaacuccuggccucaagugauacaccugccucagccucucuaagugcugggauuacaggcgugagccacugccacugguccuucaacagauugauucuaauuagccaaucaaagacaaggauccaucacaucuaggcauggcuuugagcuucacaggccagaagcugcucugucaguaacucagaggggauauggucccuagacccaauucacuuuuaauaaaucagggugccaguccuuuaauuuuggaagauaaauaaaauugcgaaguagaugggauacuuacgucaacaaguugguuggguuucauccuguaagaguauuguguacagaaauccaauuugcuuugggagcguggacuuugaaagcagcaguacugagugagauggccuuaaugauggaugauaaugagguugaugcuuucguagccacguuuccaucugaaaaccacgugaagagugucagaucaucuucauguccguugcauggcgcauuucuccugcggaguguuugacaccuucugggcuuagugcugacugucccuccuguugacaucaucgugaugguagccaccucugguuuuaccaguacuuuauugcaucuacugaaagagcaacguguauagggaaguaaaacaauaguuaguccccauuuguauugacauuguggaucccaucaacuauagccagcaguggucucugcucccagagcuuaccuucaguuguaacaaacaucuacagcuucacuuugcuuuccuucucuguaucuccuucaccaauguguacauauucaugucacaugcucuuuaacguuucuaagacacaacaauacccauuauuaaucucuuacucaggcaguguuaauuccaauaagacugcaaggcagcagugccuccagagccugcacugugccgggaauuggcacugggauugcaagcaccguggucauugcuaccaagggaggcacagaaucccuucaccccauagucacgggagcauuggcaacaaaauuuaccaugccuuggcaauuuaugcugacccucacauuuuggcauuaaaaaaaaguaucaucuuagaguaccaaauaugugucuucuuauagaugugugccacgggccucgcagugaacaucacagcucugcagaugcacaaaccuugucuuuaugagucuauauauuaaauaaaagugguagaauuuuggaugggugcaagucaaguaaugggauaaaagaaugaugaucgaaggagaugauucaugauaacuaugugcccuuaugugaaaccuagcaacaauuucuuacuuaugauaaaggcacaaucuccccaguccagaaucuaaauggcauuauauuaacauuuuccuauaccacuaauuaaacauaaugcuacauucauuuuauuuucuucugccucauucuauaacagcuaugaaaccauuuguuauagcuaauucguagaagccaggcuaaaugagcccuaaucaacuagaacaagcauucagaacucaaaauccauuuacauguuaauuaaguaaauaguauaagcuacacguugagccuacaacucuugcuggagucuccagcuguaagagccuuaacuccuuccuuucauaaaggccaagaaaagagugaguuagucccuauucggggaguguugguugguucucccaauccuguuaggggcaguuggcacucuugacuuugaacggcccccaagaguuucacugccuugguggaguccaagugggcaucaugggcaauagcaacagaucccacaauacucaaauacaaaaggcuaccugagauaaugcggucaggaauggguguaacaguguauguuaauuuaaugucaaauacauaauguauggagaagauguacgugaggcuggaagaacaggacugacagugugcuuuuguuacuucucaaucucuaagagacagcuaccuuguccaacugguucucaucugcugacauggaggaugagcagauaggccuucucuuaacaugcaaccccucuccuggugaaaaagagcuucucguuauaauucccccaauugucagcaacccugauuccccaucaccucaacucucacuucccaacacuuucccucagggaaauaaugagaacagcaacuuccuacagcagugaagcugacuucggagaggacugggaaaggaauggaacguauccucuaucacucauaauuauauuccuacucuacuacagggaaagggaaugcaacuguuuguuuucucugacuuuuuugcuaacccuuuauuauuccagaacaauuuuccauguaguagaaaagagaaucuuagccuacucugggagaagcugggacugaggguagggucagcaccagcgauguaugaugcuaaugcuuuuacacaaaguaugaauaagcacacaagaaauggccagugccucucagaagugaacacggagaagcagcagcauagacuuggguuaaagcaguguuaagggauuaaugucaauuuaauaguugugauacuguacugagugaagacuaugcagggucucuuuguauuaauucuuuuuuuuuuuuuuuuuuuuuuuuugagacagagucucgcucuguugcccaggcuggaaugcaguggcacuaucuccacucacugcaggcuucgccaagcuccgccucccagguucacgccauucuccugccucagccuccugaguagcugggauuacaagcacccgccacacaccggcuaauuuuuuucgauuuuuuaguagacacgggguuucucuguguuagccaggauggucucgaucuccugaccucaugauccgccugccuuggccucccaaagugcugggauuacaggcgugaggcaccgcgcccggccucuauuaaaucuuucaacugcauguaaaucuacaauugucucaaagaaaagauuuuuaauuuuuuuucuuuuuuauuauacuuuaaguucuaggguacaugugcacaacgugcagguuuguuacauagguauacaugugccauguuguuugcugcacccauaaacucgucauuuacauuagguauuucuccugaugcuuucccucccccaaccccccacccccccaacaggcccuggugugugauguuccccgcccuguguccaaguguucucauuguucaauuuccaccuaugagugagaacaugcagaguuugguuuucuguccuugugauagucugcugagaaugaugguuuccagcuucauccaugucccuacaaaggacgugaacucauccuuuuuuauggcugcauaguauuucaugguguauaugugccacauuuucuuaauccagucuaucauugauggacauuuggguuggugucaagucuuugcuauugaaaagauuuuaaaaagcccacauaaaaaaaugaauauaggaagccaggcaugguggcucaagccuguaaucccagcacuuugggaggccgaggugggcagaucaccugaggucaggaguucaagaccaacguagucaacauggcgaaacccugucucuacuaaaaauacaaaaauuagcugggcaugguggcgugcacauauaaucucaccuacucgcgaggccgaagcacuggaaucacuugaaccugggaagcguacauugcagugagccaaaauagugccacugcacuccagccugggcgacagagugagacuuggugucaaaaaaagaaaaaaauaaugauaauauaggaauauugauuuuucaguuugccuaagaguucuaaccuugucucuuuacuugacucagagauuggaagauuuggaaaucucaguuugagaaaauuuccuuuacaucccucucuagcaaugggauauuaguaagagaucuaaccaaucaagaugcucaccaaguagaagaguuuuagagcacugagaccugaaacacaucuucaauaagccgcaucuaguuucauggaagauaaaaauaucucaagagagaguucaaaugcuuauguuuacauuuucuauuuuucucaauagcauaauuucuuccuuccuaaucuacugaaacuucuaaaaacaucagcaaaaaaccuguuucacauuaauuacuauuaucacucaguggaaauuuauaaaucagccacuaaauguagaggaugcaaaauuagaccuuauauaacuaaacccaaauaagauuccugugaaaauuaaaaccguaucuucaaaauguauacuauauguaauuauuaugucaauuaaaaauaaaguugaaaagaaaacaaauuuaagaaaaaacaaaaaacucuucaucugccuucuuuguucucuucucaaaauguaaaauacugagaaaacuaacauuuugaaaucauuuuugaaaucaaacuuauuuuuugauuuccaauccaccuuucuguucaaaguaaauaucagagauaauaauggagaaaauuuguucagaaaaauaaaagcaagaauauuuccuaaagagaaauguuagaaacauaggcaaagacuuacauggcuaucuaaggaaccacaauccuuuauugauguugaauuucuuacacuuucaagaucacaaauagcuuuucugauauucacuuaucugaauucugcuggcaaggaagcauuaugccuucuuuuguaacaacucugcucacucuucaagacaaaaugccauuuacuacacugaaaugcugguguauacgaaacacaaagcaaaaucaugugcuucuaauaaaacuccacgcauuuuaucuuuguaagguaggcccuugcugagauuugugcucgugucaacgcuacauuccauuuucuaaaaaucaguauaacacaaaauaauacagaaucuaagccagagcucccuggauuauacaaaaugauuaugcaauucauuguucaaaaaauaaugcucaaccacaaaaaauuaguucugaauagauauuucaaauuggagugaaauucuuuguggacaaccaagguuagaaagcugauuuuacauauuuuaauaaauuuagaaugaacacaguugugaaacuggcaaccagaauggggagaaaaucuccacuuucaaauguacgauaauuauaaugccuucuuaugaagcaaaguuaacagauuagcaaauaauucgcuguaaauaaagugguaaauaaagaauaaagcugguuuuagaauaaagcaaagcugguuauuauuauuucauuuuuaaucauugaauuucaaguauucucagccuacuggaauguaugugaaauaaaacuauauuccaugugauguauaaauuuuaaauuuacaaauuuugggaaagcagucacaaucaaacuagucauuuagagagagcuaggaacuauauuuucugaacuuuuuuuuaaaaggcaacauuuuauagcauuauuuucuccauacucuacaagaauaucuacuuaaacuucacauaauacaacuauuucuccuuucugacagaaauucccuaucuugaacucuuuuucuccaauuuuaaguagaguaaaaagggcaaauguaagacaaauauaauuuauuuuuguaauaaguuacuuccuuaauguaacaguggaauaaaaugaaaacgacauaaauauuaaaauccacuaaguauacaaaacuucaauauuucaaauaaacguuauaauuuauaaauauaauuauaauauauuagauuauaauauauuauauaaaaacuuuauaauuuauaaauauaauuuauguauuauauuuauaaauuauauauuauauacuauauauuacaauauauaauuauauaauacaauauacaauuuauauacauuuuauauaaauguuuacauaauacauauaucugucugagcucaauguaguucauaacaacuuuauuuuuuuagccuaaguuauugcuguaauucuaaguauuacuacguggugacauuucaugagccuaaguuauuaaaaucaaacuuguauucuguugaaaaauaagcagacaauauuugcauuugauucuacugaugaaaaaauuuuaaaagccaacacaauagaaaacugguuauuuuuuaagaacgugauuuucccaauucuggaaccauguacuuuuaauagaaaagaacauuuuucaagugcuuguacguaguggcaagcagucgucaaaaaacauguuuagaaaauuacucuaauaaggcaauaaauuaucaaauauuuaugaccuaguaaucauauuuuacuaaauagaagcauguaaaauuaggcaagcaagcuugaacugaagucuuaugacaaaucucacuuaagcuccaaauauggauugaaauacaaacaaagaugaugcaaacagcugugcaugcuaaugaaagcacugcuucaguacaagaggauggugcuaauuugucacggaaguaacuagaagauauccgcaguuggcuagccuuuuuacugaauugcguuaauucucucaggcuagccaauacaucugucauucuaauuauaccugacccaauucucaucucuccaugaugaaagauuguuuauaaaaugccaccugaaggagauuuacuuguaaaguauuuagacuaaucaggacucccgugacgguguuagggaacacucacaaaaggguaccacugugguuuuuccucaaccuuuguuuccuguuuguuaugggaauaaacuugcucuucacugagcugcgugguuagcgugcaacaggcuauuaacaagaagcucaaaacucgggauaucauguccuguauuggaaaauaaggggaagugcuuugucuuacugaaugagagacaggaguaugcugggaaacuggcacugucuagaaaaacaaacaaauagaacacucuugaguuacaguguaugccaacugccaugguauaaauacucccaccauugguauuucaagcuacuaauggcuauggcuuacaaaauuccucuauacuguaauaauuagcuuuuacaggcuagcaggaguuggcuacacuaccauguuaaugacaggaaauaggggcacaagugaacacauguagggagacuguaagaguuuuucgguuuccuuggucuugaggugugaauuuaaggaaagaaaagcucaguagguagaugucucaggauugccucauacuuguugguaucuguaauauaccaagaacaauaacaccaaagguaagaaugguuuuccuuuucaguuucuuacuuccugucucaaugcugcaaaucugcaccauauggaaggcaggagacgcuacuagagucuacuacucaaaauaggaucauggaccagcagagucaacaccaccugggacucaggccccccauacagacucaacaacgauuguuuuccaagggccuuggauaacucgaauggauaucucaguuugagaagcagcaugaucaaccuuaucuuuuaaaugcaauagauaugucaaaacgugagacauaagauuuaaucauuuuccaaaagaaguaguuagggaagaauuaguaaaaguugcauagguuuuggcuuauuaaaagaaguacacauauauuugggaaaagacagauacaacaaaauuaguagucuuaagauucaaauauacagcucaacaacuuaauuugaacagauugaacagauugucuauacacauuuauuuuacucugaaguucuguccuaucucaagcaacauuaaaacagcuucgauaccucugccuuagauccaguaccaagaucauaauuuucuuacucauauuaagacuauugaaauaccagacuucuuagaaagcugaauucaagugguaucauuccuauaauaucccagaacaucagaaauaucaaaguuuuuauuuuuacuuguaaaaauaaugaagaaagccaagaucaauucaagggcuuagaauauacuuccuuuuucuuuucuuuucuuuuuuuuuuuuugagacgaaucucgcucugucacccaggcuagaguacaauggagugaacucggcuuacugcaaccuccgucucccggguucaagcgauucuccugcuucagccucccgaguagcugggaccacaggugugugccaccacgcccggcuaauuuuuguauuuuuaguagcgagggguuucaccauguuggccaggcuggucucaaacuccugaccucaggugaugcacccaccucggccucccaaagugcugggauuacagcaugagccaucgugccuggccagaauguacuuccuuauaccacuucucuguaaagaaagaauuagaugauauuucuguuccgguuuaaaaaaaaaaaaagaaaaaaagaaugccucuagauguaggucauggguuggaaggaugguccuacuguuucauguccuuuucuggggaagacugacauguacaccucuccauguuaacuggcuucuugucacaaucucuagcaggcaaacaaccuacagauuccagcugggaacagcagugucucugguuacagcacagaugcuaaucaccauuugcuauuuuauaacaguggacaaggggagagugaauuccuuuugaacaaaaaaaaaaaaaaacaaaacaaaacuaggaaagcaguuuaccuccauaucucacugucuacauggcaaauaugcauacgcaauguuucaagucaacauuuuauguuguuuucuguuucuaaauaaagcuacuagacuacauuacacauuuuaucaaauacuugcuuuuaccuuacuaaauguguauuuaucauauuugcuuuggcauauuuuuguuuauuuuacuuuuucuuauacaauaaaaaauguucacugguuaucuacaaugugcaaagcagugauacagaaguuagagcuuacauuaaaaugagaccagccgggcuugguggcucaugccuguaaacccagcacuuugggaggccgagauggauggaucacuugaggucagcaguucaagaucagccuggcuaacauggugaaacccugucucuacuaaaacuacaaaaaaaaaaaauauauuagccgggcgcaguggcaggugccuguaaucccagcuacuugggaggcugaggcaagagaaucgcuugaaccugggcagcagagguugcagugagccaagacugugccacugccuuccagccugggugacagagugagacuucgucucaaaaaaaaaaaaaaaaaaaaaagcaaaaaacaacaaaacaaaaaaaacacacaaaacuuagcuggucuuggugaggcacaccuguaaucccagguacucggagacagaggcaggugaaucgcuugaaccauggaggcagagauugcagugaacugagaucgugucacugcacuccagccugggcgacagcaagacuccgucuuugggggaugagacacaguauugcacggguauuucucuguucacuuuuuuauuuuuauuuauuuauuuuugagacggcaucucagucugucugccgagacuggagugcaauggcacgaucucagcucacugcaaccucaaccucccagguucaagugauuucuuugccucagccucccaaguagcugggauuauaggcacccaucaucaugcccggcuaauuuuuauauuuuuaguagagacgggguuucaccauguuggccagguuggccucaaacuccugaucucaaguaauccgcccaccucagccucccaaagugcugggguuacaagugugagccaccacgccugggcuucuguucacauaucuaaagcugcucaucacugcagaucucaacaccauagcccaguguuuugcaaccagagagagucuauccccuacuccucccaggggacauuuuugauugucaucacuugggggugcugcuggcaucgaguagaggcuagugaugcagcuaaacauccuacaaugcacaggacaaucauccgcaacaauuaucuggcccaaaacaucaauaguacuaagguccagaaacccugccauagcccaagcaaacaccagaaggauucgugaugcauuuuaguaacuuugcccaccaagacuacugggcagcagucaccagcacuucagaaauccuggguaacaaaugcuaguaaauuuccagaacagaugcaaucauaagaauuggcaagcaagacuuuucuuugcuccuaucaugaaacauaagaaccuaaagucacgugcaagcaacauaaaauugccauccauauucugugauacuugcauauucugucuagaaauuauacccaauaagaacauauauaaauuuaagaaagaggcaacccuacucucauaguuaaaacaccugaacagucuuaccauuauuaucaacuaaauauagcguaaccuuuaacauuuccucugccuuaaucuuuuuuuuuuuuggacagggucucacugucaccaaggcuggagugugguggugugaucacggcucacugcaggcuugaccucaccugggcuccagcgacccucccaccucagccuccugaguagcugggacuauaagccugugacacuacagccaaaacaacaauuuuuuuuuuuggucucccuauggggcccaggcugcuugcaaacuccuggggucaggcgaucauccugccucagcuucccaaagugcugggauaacaggugugagauaccaugccuggccuguaaacacuuuuuuuuuuuuaacacuguaaaagucucaauguuuacaauuugggcugcugucuugaaaauuaagggauucucuugagcaucauuuuuauaugagauucauucauucuugccuccccuugacuuuuuacucuucuacuaacagaaucacaaaaagucaggcauauuggaagaggugguuggaaaccaaagaugaauuuucaggagggcaaaaugguuaaaggcugagagaagcagcugguuaggcuguaagccacucugcuuuuggaaacucauuguucugcaagggaacuaaagaucuccauucaaauccacagcuuuguaaccugcucaaggaaucugacuguacuuaaucagaccuauggcuuggcuaaaaacgugugcccgguugggugugguggcucaaaccaguaacccagcacuuugggaggccaaggugggugaaucaccugaggucagaaguucgagaccagucuggccaacguggugaaacccaucucuaccaaaaauacaaaaauuagccaggugugguugcacacaccuguagucccagcuacuugggaagcugaggcaggagaauugagaauugcuugaaccugggagacggagguugcagugagccaagaucgugccacugaaucccagccugggugacugagacuccaugucaacaaaacaaaacaaaacaaaacaaaacaaaacaaaacaaacaaacaaaaaggugcacccagcuggugcaguggcucacaccuguaaugcuagcacuuuaggaggccaaggcagguggaucaccugaggucaggaguucaagaccagccuggccaacauggugaaaaccugucucuacuaaaaauacaacaguuagccaggcgcgguugugugcgccuguaaucccagcuacucaggaggcugagagaggagacucacuugaacccgggaggcagagguugcagugagccgagaucgcgccauugcacuccagccugggcgacaaacaaaaacuccaucuuaaaaacaaaacaaaacaaaaaaagugugcccauguaaauguaugcauguuuaaaugaaccugaaccucugaguugcuggauuucuucuuugagguuugauuuuuuuuuuucuuaauugcaaauucuugaguugaguacaguuauugugccugaggcaucugcacacuuuuuuuuuuuuaaagcaacugauuuggggaaaauaugagaaagacuaauauucuuuaaaaaucuaguuucuggccuuuaauuaaauuggacuaaaauuuuauuuuuaauaaaucuagauauaauuguauuaaaaugccuuucacugauuacuucugcuauucuauuuuuuuuuaauugguaaagccagguucucacuauguugcccaggcuggugucaaauguguaucuuugugaauauacuaaaccacugaauucucucucacacacacuucuauauggcucuauucccuagucucaucacauuuuaagcaaccuaauuaucugagugggcuuucuagauugagaccauuaaacuacacggaaagaugcuuguccauguccugcuucacucugccucuaucaaaguguguaucaaacaccucggaaucaauggcugccaugacauggggcacaaaauaacaggcuguuaccugucacaucuauggucagugcugacacuaguucucuugacaucauuagcaagcaugcuacaacccgggcgagaguagaagugcauccucuccaucuucaaaacacaaagguaaaggccugaggcuugcucuauaaggaggagccauuacccuuuugcccuguucccaaauacucccuggagcuuuaguuucauuuuuguacagcaugcuacuacugaggccuccaacugaaguaugugaguucauguucggguucacagcaaguuaaguucacaguuuaccccaagcuuuguggagaguuaaauauuaaucauaaguaaaaaucccguuagugaauuauaggauaccuuguaagugucauguccauuacaaacaaguaacaacagaggcaugagaauuaagcuaagcuuuguuucuucuccccuugagaucaauacaagcuacucugauuuacuucaaguauguauugcauucauucuauuuggugcucuaucacccaguaaaucccuauucuuccuuuauaauuacugauacgccaacuucucugcaacauaguaggugaaaacuuuuguuccgggcugagcacuuucucuucuccaugcugccaaaauuccuuccuaggcaggccugagagacucaucccucucaaggacaaugcagauauggcuagaagcaaccugagcaagccacuuuguuccuaucucugugcccccagcaaccaaugccaugucugguaccuacaagugccuuguggauauuggugaaauguauagcaauaaaucaaaugguacuucucccagauuaauugucaccagaagaagaaaaauaauuuaauucugccaaggucaaucacuuagcccaauauaagcaauauucggaucaaaccuuuuagcuuuuaucaucacaugagacggugaaagagccaucuguaucagugucucuaucuguucacuuaacagaagaacucccacaaggcuuaaaauaccugcaagaaauaaaacucuaucuugaaaugcaguggcaucuaauacuaucuuauccaauuuucagcuggauuuaaaauuuaagugcagauauuucaauauacaguguauauucacacaaaaaaaauuuaagcaagaaauguuucuuuuaaucauaacauaauguucucucuaaauaucagcuuuauuauaccaauagauauggauagguuacauuuaugccuuuuauaauuaaaagucaacuuauugguuuaccuuuaacauuccucauuaguaguaaacauuaguuugcuaauguuucaaaugcaauggaggaucggaaugaugauauaaccauaacuaagagagcaacuaagguuaauugagcaguuacuguauaccaggaauuaugcaaaguguuuccuauaaauuaauuaauuuaauccucacaaaauaguuaaauauuggauaggucuuauuaaucccuauuuuacaaaaagaagcaaugaggauucaagguuauuugauuuauacaaauuuacacaguuaguagcuuguaaggcaaagauuugaaucuggacagcuugaguuuguaaauugaacacuuacugggcaugaugguaagcguuuaacauaaguuaccuaaagucauucuuacaagaaacaugcaagauaacauuaccaucuacacuacacacauaaaaaacagguuacuuaacuggcccaaggucauaaaaauucucucaaacacuauacuagucuaucucuaaccaaaaaaaaacaaacccuaccucaaaagaaaucaacuugauauggcaguaugugaaauagaaagaacuucacagucaccgucuuauagugagaaucagggguuagcaaaugguuuacugaaaaggccagauaguaaauguuuucaguuuugcaggcaaaacaaucucuuuugcgauccucaacucuacuuccaaaacaugaaaacauccauagacaauuuuuaaacaaaugggaugggcugugccuaauaaaacuuuuguguagaaaacaggaaaacaggcuauuuuuggccccaauuugcugacccuugaucauuacucuuauuuguggacccccgaucauuuuucuauuuuuuuuuuuugagacggagucucgcucuugucgccaggcuggagugcaguggcgcaaucucagcucacugcaaccuccgcaucccagguccaagcaauuccccugccuuggccaccugaguagcugggauuaugggcacgcgccaccaugccuagcuaauuuuuuuguauuuuuagugaagacgggguuucaccauguuggccaggcuggucucuaacuccugaccucaggugaucugcucaccucagccucccaaagugcugggauuacaggcgugagccacagcgccagccugaucacuucaaguaaaaauucuaaaaauucagaaaugcacaguguaaaauaauagaugaauauaugccuauaucaaagguauaugcauuuacaagggaacacagguugaaaugaauuuguguguauuuauaaagaaaauaaaaaguguaauuuugacaugaguguagcagaaauauccuggccuaucuagguccaaauucugauuucaucacuuaaccaguuaugugacccaggacaauuuauuuuauucuuuuuuugagacgaaguuucgcucuguugcccaggcuggagugcaguggcacaaucucagcucacugcaaccuccgccuccuagguucaagcgauucuccugccucagccuccuguguagcuaggauuacaggcgcaugccaccacaccuggcuaauuuuuguaucuuuaguacagaugggguuucaccguguuagccaggauggccuuaaucuccugaccucguuauccgccugccucggccucccaaggugcugggauuauaggcaugagccauugcgcccagcccaggccaauuaaaaaaauuuuuuucggccacgcaugguggccuguauucccagcacuuuguggggggcggggggcggggggcggggggugccgccaaggugggcagaucaugaggucaggaaaucgagaccauccuggcuaacauggugaaacccugacucuacuaaaaauacaaaaaaauuagccgggcaucguggcaggcaccuguagucccagcuacucgggaggcugaagcgggagaauggugugaacccgggaggccgagcuugcagugagccaagaucgcaccacuacacuccagccugggugacagagcgagacuguaucucaaaaaaaaaaaaaaaaaaaauucuuggccuuagagaucuuggcuuuaaacggggaaguaaaauuuccaccacacagcauaguuacaagguuuaaagacagagaaucacugcuuuaaagcacaagaggccuguuuucccggcuacuugggaggcugagguuugaacucaggaguuugaauccagccuaggaaacauagcaaaaucccgugucaaaaaaaaaaaaaaaaaaauuuaaauuacauuaaagggcaagaguggugaccgugaaaaucuauaucugcaacaaaggcuucaaaaaucugccagucucccaggagguaaaaugcugucugcucugccccaacgaugccuuccacaguagcaaagagccuagccaucagcagggguacaacgaauaguugcugaauaaauggaacauaaggaagaaauguccaguuccucuggacagggcacaauuggcuagauuaaauaaaagauuaugccauuuauuacaauacccauuucaaucagaauuuagaauuuauggcucaaucaaaacuacccugauaucucugguuucugaaguacaaucccuucuugaagaacagaaaauuaggagcaaguaucuaaauacaccacuguuguacucaaaucgguaauggcuuauuccacuagaccaauaaccaauaauauccaaguauuuuuuuaacaaccaaagaugacaauaagcccccaaaaccagauagaucuugcaaucgugugcucacuuuuauuuuuauuuuuuugagacagggucccacucuguugcccaggcuggagugcagcgaaugugcuuacuuuuaaacaauaauuuuauucuacuggaaucagugacagagaacagacaucuucucauuuggguaucaucgauucuaacacaauauggcagagaagauuaugacuacgcuaaaagugucuuauuuuucuucccuccauuucuuuccgguuuuaacggguuaugaaauuauugaguuuuuuaugaagcacauuaaggacugguaucaguagcaauauguugguaaugaugacaauuuucuuagaaaggauggcuguaaaucacauuuuguuccagguacugaaacacuaacacugaaaacaagauuguaagccucccugcaguaucucaucuuugcaagucacuucuaauuuuuauguugaacacagaagcaaccuacuuguaauuagaguuuuacaaaaugaguaaucaccuauggcguugccauugcucucaauuagggaagaaccacaagucaccuuuuguaacagugaggaggaggaaaaggacucuuugcagcugaccccuuuaacguuacccucuaaaacaucuacuucuuuacuggaauuagcuacaagcacaaaaaaauuaucucgcaugggcacaacugaccauaacauguuucuguuaggcccccuuucccaggaagacuugccucaauuagagcuuuuguucaggaguuugagguggaaugaauggaccugcauuaaagauuccucuauuucuggggcauuaacaguugcuaucucucaaugaccagguaucuugcuuucagaagguugcuuuuguugcucuucuugccaacaaaauuauuaacuuguuauuuuuuaagguucauuucuuuuuugccuuuagccuggaguguuuuguuuaugaaauucuuuuaacugccuucgucuuucuacaggaaauaaaacaauacaacaucucuguguuccgucuuaauaucaaauaauacuaccugcaaaacucaagcaaaaagaacuggacuaaugcagacgauaaugagaccaauuuaucucaagcaaauugucuuguucuagaauaugggccuaaguuuauguggcauccucucauuguacugcauaacugaugucacuccuuguucaccuguuaccucaacaguacuagcaucaaaacaaaaucucuuuauugucuccuggaaaaaucugcagcgcacaguagcuucugaauuaauauuuguuaauuaaucaccugcaguuaaugcccaucuuugccagccuggcauugaaggucucuauauuuuggucccaaccuaaaagacaucugcucuagcuuaaauuggaccaauccugucuccuaaauaugccuuuccauggcaccacauuuguuuugcuaguccugaugacucuacagcaaaauccacugguagacacaccacccacccacacuuuuggcucuaguucaaaugucaugcucuccauggaaccuucucugaucaauccagaaguucccucuuacucucggaggcagguucuguguucacauuucuuacaacacagauggcuuuguacuucuuugacuucuauuuccuaagagauuuuaacauccacuaggguuagcuggucugugugugcucaucauccauuccacauggccuagcaaaauggcuuguaccaagcaggugcucaaaaucuaauguuucaaguaaaaugggacacuaaacugguucuauuaaacagcccagcuugauggagauucaccaaggacuuucagucccacugcaggcugcuagcugcuguaauuuguauucacacuucauuuagguuucgagaagagaagcccugaaaagcuguccuucccugcuacaggcaucaggcuaacaaguucauuugaccagaucugccauaguugguccuaacaguuguaugaaaaacacccugagaaagcaugucucaguauuugaaaaauggugguuuaaacaaaaugcgcauuuacuagcacauuuacuuaugugcuaaagugaguaagaaacugucauuaaguagggaaugauaaacuuaauccaucuugcacucuguucuuuuuuuucaaagaacauguaaaacuuucaauaaauuuuaagcuaacgcugaguguuuaauucagaauaaucucaauuuuaaaagcucaaguuaaagaaauguagaaccucaaaaauacuguguuaagugaaagaagucggacacaaaagaccauguauuauaugaucccacuuauaauaacaguccaaaaaagggcaaaucuauagagacagaaaguagauuaguuguugcuuggggcuagaggugaguagagggcuuaacugggagugaguaugugugaucuuacuggagugacgaaaauguucuaagauuagauuauggugauaguugcacagcuuggcaaauuucuuaaagccgcugaauuauauacuuaaaagcaaaugaaacuuauauguaaauuacaccuuaauaagguaaaaaaugcaacaaagggaagaaaauacuauagugacaacuaugaauauaguugagggagacaaaauagcccauguuaagcucuaauagaacaauaaaucugaaaucauuaaacuuuagcaaaaagugagagaaagccacuuuuuguaaaugcuguaacauuugugguugaccuuuauaaguauuugcaguacauuaaaauucagucaaguacauauucauucaaucuagcucuagaagcaucuuuuacuaucugccaagcagauggcagauaugaaaugcagaacucuuuaaggaacaaaugcauacucuuuaaggaacucaauccaacaguuuacucguuucuguaacauuuggucauuuaauaucaacugaauguuuguuuuuauuucauggagacaaguaugaccuuuaguucuuuuaguucacaauauuugcaacacaaacauuaauucaauagagaaagucuaagacauuaauacuauauuuacuucuugaagaaagcacugccguacuucccaauaaaacaauguaaacucaacauaaaucaccucuguuaaaauucauagcauaaaauaaugcgauacucaccaaaucuuuuuuuuuuuuuuuuuuuuugagacaaucuugcucugucacccaggcuggagugcaauggugugaucucagcucacugcaaccuccgccuccuggguucaagcaauucuccugucucagccucccaaauagcugggauuacaggugcgugccaccacgccuggcucauuuuuguauuuuuaguagagauggguuuucaccauguuggccagacuggucuugaacuccuggccucaggugauccgccugccucggccucccaaagugcugggauuacaggugugaggcacugugccuggcccaaaucuccuucuuuaaugaaaucuaaucacaacuacucacucaacuaagauuuaucgaaacuacaagccaggcacucugugcaauacugaauaaaaucaaguccuuacccucaaggagcucaucgucuaggugguaacagacaauauuauauaacaaacacucacugccaaaggaauaccaaggagucaccuaacucaguguuugucaaauuagaugacuaccugguugggcggagucuuguagaauuaacuugggauuugccaagcagcauauacaagguacaaaacaaacuguauaauaaagauuucacauuauuugaaauuguuugcuuguuaaaccaaaaaaauuucacaagcauaagaagccuuuuggaaaaaaaaacauguuuuugauuggggaaggcaguggugcuaggguggauauuuccaacucugguauuacgcuuucuuuuccuuggggguggggggaauccaagcaaaugguggauuaccucgaaccaccucuuccacagacucuguggugguggugguggugguggcaaugcuggugguucucucuguggcuucuucguaggguuccucagccucuuccucuaccucaucaccauccucaucguccucgucaucaucggcuucuucuucuuccaccucagccacuucuuccuccucugcuacuucuacuacuuugucuucacugugaaggcaaacacaaauaacagaaaaagucaauuaaacacauuucagggaaggaaaagaaaagucguccauauggaauuuuggcaauuugagaagaaacacacccaaaacuucaauucagcaggucuaaguauaaaucccagcucagugggucugcaaaaauuuuuauccuuggggacaguucuuaguuucugcaguugcuaaaaggggaugccaugagucuaaccacaggacauucuggaaaagggaaaauuacggagacaauaaaaagaucagcgguugccagugguucagggggaguggggaagggaugaauagguggaguagagaggauuuuuagaaacuacucugcacgauacugucauaaguaauaauagauacacagcauuaagcauuugucaaaaccaagagacuauacuacacaaaaagucgccucucauguuaaaacaggaauacugguuaauaauaguguaucgauauugguucaaacguaccauacuaaggcaaaauguuaauccaggggaaacuguuggggaguggggaagugagagguagagggaacuuuuuguaguuucugcuugaauucuuuguaaaccuaaaacugcucugaaaaauguaguccauuauaaaaaguggggugguggauaucaaaacugaguuugccguauuaugggaauuacuucucauagugcacauacaagagccgcaacgcauugcacgguagcggauacucaguauaugcugguggaaauugguuuaaaaacugcaacugagagcuuaaacuggacacacagguggaagaugaagcugacuuaaguaaaccugcaaugcccuguggucagggaugccugcuggaacucacacagguggaagaugaaacugacuuaaguaaaccugcaaugcccuguggucagggaugccugcuggaacucacacagguggaagaugaaacugacuuaaguaaaccugcaaugcccuguggucagggaugccugcuggaacucacacagguggaagaugaaacugacuuaaguaaaucugcaaugcccuguggucagggaugccugcuggaacuauuuaguugcguacccuaugguuacuaacugcuuauguuuuguagaaaaccaaauauuucagugguucucaaauuucagugagcaucagaaucaccuggaaggcuuauugaaacacagaucaccuaccugcuaaaugugguggcucaugccuguaaucccagcacuguggaaggcugaggugggaaaaaaccuagaggccaggaguuugagaccagccugggccacacggugagacccugucuccaaaaaaauuaaaaaaaaaaaaaaaaaaaagccaggcaugguggugugcaccuguaguuccagcuacucagaaggcuggggcgggaggauugcuugagcccaggaguucgaggcugcugugagcuaugacugcaucacugcauuccagcuagggagacaaagacacugccuccuuaaaaacaaacaaaaaccagccaggcaugguggugugcaccuguaguuccagcuacucagaaggcuggggcgggaggauugcuugagcccaggaguucgaggcugcugugagcuaugacugcaucacugcauuccagccagggagacaaagacacugucuccuuaaaaacaaacaaaaaccaacacagaucaccaggugccuguggcaguuucuaaugcagcuccagaguuucugaaucaugaggccuugguggggccugagaaugugcauuucaaauucccagguaauacugaugcugguggucaggggaaaauauucugagauccacugcaauaugcugagaauaauggcaagagauaaccaguaacucagugaaauugggaagaggaucagaaauauuuaugguauuaaacauuuacaugcugaugcaucauaguuuguaaaaaauaagcaaauuuggauggcaaaagaagggcaugucuagaacaaaauuaaaaaggccuauuaggaaauccuuguggaaaucauguaccugucaaggcaggcaugguugacagcauuugaauaucuaauaguaaaagccuaucguauaccaccuagcaggacuagaggaauagauguccuugaucagaucacaaaaccaauacaggagaaagaccuagauguggcaggggguuucaaccuuucuggggcaacuaccacaggucuauucgagaaguaccauaguaauagaauuaaaagcugcuaugcugacauuauaauguacccagaaggaaaaaaaaaagcgagagggagaaagcagaagggaauuauuaccacagagcugauucuggccaacaaggagaagcucaucauugggaaaagugauaggaacccgggauuuguagccacaggaagccuuggacucguagugagagcacagcauuauguaggaaaucagauuccaaacacgugagacaagcgaacacuaugauuccaugaucuacgacaauagaaaggaagacuccuccauaaaccugaaaggcuuucaaagucuaacaggaccgccauaaguaguuuugcugagagugaaagggaaagauauguaaagagauuaauccaucaauggcaggaauucucugauuaccucaggauuuaaagcauguguuacacaaguuguauaaagauguguaugauccccauggaacaccugacucugauuacguaggauacaagaauaguauaaagggcguuuauaaaaguuucaaaaaaauguguaugacccccaaguggaacgccuuucuaacucugauuaaauaugauguaaggauauuaagugaagacauccgaagaaguuuagcauguggcuaaagaauaaaaagaaacugauuaagcagaauaauuuauuaauagcaacuuacucauauguuaauaaaugaaguguuaauacagagaaaauccuaaucaguuauuguaacauuuccacaagacuaggacgaaauaggugaaaagagaaacagaaaacacuggcacugaaaaucagauguuggaagccuuuaucuccucguagaaauaaaugaggugaaauaacugacuuuuuuuuuugacugcccaaauuauugcacgaaaguuuacuacguggggcuacauuucaaaagaauccuuaacaguugcucagcugcccugagcuucugccuuugcauuuuucuguaggaucucacuguuguauuacuggugaaucaaagaaagaugaccugaugcaugucaucaguuaauuuaccguguuugagaucucuuacuuauucaaucaaaucaugggcacuaacuagcgcuguuuuccaauuuaaguggaaaauucagggaaagucaggaagaaaaaucaaaccaguauucucuuuaaaucaugauguauacacgugaucuugaaccaugacuggaaugacgauguccaaguguaccauccaggguuuggacagcaccguguuuccaggugggauggugaaaacaugacccuggguauccccagguuccuucuccaggcuucuuuguuauuacuuggauguggcccuuaaagcucugaauagaaaccauguuuguaaaaacagcuguuuagugugaucugcauucugguaugugucuagccgugaaaaagagugaauuauaugcccaucauccaucccugcaucugccugagcaauuuacuggcauaauaaccaggaacggagacacguaauaaauaguucaaccggcuaaggaauuaaauuacuuggccuaagagaacucagguccaaguucuuauuaccauagcuuugauuucuggaauuaaauuuagauguccaugaauucaauuauucauuuggacacuauuuaaaacaagagcacacgguuuuguuugaauaaugcugcaucuucccaaagaaugccaaacacaacaacauuacaacuuuuaacugcaguuuucaugaacagcuagaaacacugaaaggaaaaaaaugacuuuuccaccacuucuucaaaugcuggacagacuguuguccuguggacuuguuuugaaaagcucaucacaguuuaaggaguugcaagggaggaacaguuuauggaaauauaaagcugagcaucauaaaacaauuuccuuacaaacaaucaaauaacaacucacaauaaaauaaacgcuuggcaacauaguggaacauucauaccacauucgcagacuuuaguggcuaucaauuuauaguggguggcuuuuacagcuuuuaaacaccaauaacaaacauuuuuacagaacaagggaaccaucugaaaaugcugaccauccccagaguaucugaauuuaauaaggucaaagggacauuccuacgaggaaauaaaucacugaugauaaaauuuuaugugucagcaugcgagauuuuacuuggaugaaggagaaaugacaucacaaaggugacucuccuucuguuucuaacuaaagcugaccuugauauaauuccacaugcaggugccgccugauaagucccuuuacagagugaaagauuuugauucacacaccaauuuucauuucuguuuauuaaagucaugccaaaaaagucaccauuuguauuuucuaagaaagccauaugacauucuagaaauggcaaaauuauagacaguaacagaucaguggcuuggaaagguuaaaggcaagagagggucgaacaggaggaacacagaggauuugggggauaguaaaaguacucaguaugacacuacaaugguggguacaugucauuagacaguuuuccaaacucacagaauaaacaaugcugagagaaugcuaauguaaacuauggacuuugggugauaauaauggugucaguguagguucacugauuguaacaaaucgcucuaagggggacgcugauaaugggagaggcugugcaaguguaugaacagggaguauaugggagaaucucaguaccuucugccuaauuuugcugugaaccuaaaacugcucuaaaacaauaaagucuauauuuauucuuucacagucucuguuaagacggacuuuuuucuucuugcuacagauaaacagggaggaaaugacagagagaaagcucugauucucaugguuaugugaauauggacuaucaugagauccaaccuacuugcacugaugagggaagagggaagacaaccaaugucaguuccugaaaugcaaccaaccaggggaaagcucagcaggaagagguucagacucuuccucuguggauaugaaaaugggaaaaaagagucuagaggcucccagagucagaagagagagaaaauacaguaguuuuuuucaagaagauaaacagacgguucuccuucucucugucucaacucuccaaacugccagagucuaaacuggaagguacaauggcuggauaagucaguuuguccgaaaggaaagcaguuuuugaaauuacugcuacuaaauuaggaaaauguuuccggggagggagggcaaaguaagaaauagccaguacuucucccgcauaaaggcacuguuagaagcgaaacacaaggggacacaucaccuaauucuauuugaauuaaauaugaaaacaagcaaacugcaggcaaauagaacucaggggaaaggccaguaacuggcaggggccaggagagaggauucuaggggccagcaagucucuguguucugguccggaugcuggcuaucuaguuguguggucuuaaaaaacuuugcuuacuugcauuaccucuuauguguacuucucucuaaauaaaucaguaaaaagguugaaaaggguuucuuguuacuugcagcuaaaggcauaagcccaccuggggcccuagguuuaaggccuccagcuuuaggaagauaaccacaugacuggacuaccaaaaauucaugacucaggccugaggagguggcucaugccuguaaucccagcacguugcggggccgaggcaggcagaucacuuggggccaggaguucgagaccagccuggccaacauagugaaauuccgucucuacuaaaaauacaaaaaauuagcuggacgugggggugcacgccuguaaucccagcuacuugggaggcugaggcaugagaaucacuugaacucaggaggcagaagcugcauugcacuccagccugggugacagagugagacucugucucaaaaaaaaaaaaaaaaggaauaaauaaauaaagucaugacacagcugauuaagaaugagcuauaaaucacaaucuugaucugaaauuaggcuauaucaucauucuuacacauuuaaugaauacuuauucugagugagacaauucacacuaacugcuguaugaguaacagacauacugcagauuaaacgcuucagaaauucaacagagaagugauuguugcgaccagaggcaucugaguuggccggaagugauagguggcuguggggaugaggcaggaauauccacauaaugcacaaguggaauaagaaguaaauaaaauauaaugaaauuuuacacaggcacugaguuuuaacagugaggaaggguaaacugcagagacacggggauucagguauuuuuuuucuuuagccaauggauaaauauuugaguugaaaggcauauguacaaauugaugauaaugagcaaaaaaguggcaaugcauucauucauucauccauugaaucauuccauuaaguaccucucuaagccaaccccuaguaauucaaucaacaauauucgcugugcuuuaccaagugccaguacuauuccagguagugaagauaaagcacucaauuucuuggaaucuaucuauuaguuggggagguguaauaugagcaagaaaaaaaauuauggaaaaguacuauagggaaaggagauggggcuaauugcuaaugaaugacuaugauagaugugugccagggauggguagcauuucaaacaggguggucagggaagggccccacggaagagccaugugaacuaaaaaugcugaagucgggcacggcaaaaccaagagagugcauggauggcugaggcagggguaagagcaagugcaaaggcccaggugugaggaagagauuagcacguucagcaaaaacaacaaagggccagugagcuuagggaguagcagaugagggaggaaguauaagaucuggugguggagacagacaggcauaguguuacccaguacgguuacauuucuuacagcaacuggaacgacucaaugagauuuaaguugcaaugaugucucuggcugcugggcacagaauggucuccagggaaaacaugaauggaugcugggaagcuggacacugggccaggagcuagggguacacuggaaagcaaagguggcucacaaggcaaguagccaaaggccagacacugaccucagcaccuguauaaaugcaaaauuacugcccugauaacaauuacauacagccagaagacccaaaagagugagugcuagugugucuagugaggcagagauuccaggugucuagugaggcaugacugaaaugugacccaaagaagguccgaagugaaugaaguccaggggccaaagauagcucuccacuaggcaggguggguagagcaugugcaaaggcccggugacaggagggagggaaaccugagcaccugaaagggaauuggcugacaagaacagaaagugggcuccaagaauggcaagucagcaguggcacagagcaggucuuggcaaacugcaacccgcaacuuguucuuguacauccugugagcuaagggugggcuuugcauuuuuuaaaggauuauaaaaagaaaagaaaggggguaaaaaugacagcaauaugugacagagauuguaugcgaccuguaaggccuaaauacggauuguaaaaaugaccauuuaaagucaaaccaacuucucucaacacaugcuccuguaaacccugccccacuuacguuagugaauuagugaauuucuaaaaaaaaauuacugaaacaagcaaagagauccgagaagcacuaaagcccagcuuuuguguaaaccagcaguuccugggcagaaccuuuaaaagacaaucucucuuuacucugcuaucucaguacacacuuaggguaacaugaauauccuagcaauagagcaacaaucuaaacaauaccccugggacaugauauaagacaaauccaaggaguggacaguuuauaggaaaacugguacagcuucuucagcaagucagugucaggauauaaaaagugcuauucugaauccuaagaauuaaggauguaagaugcuggcccuggugccggauaggaugugaaaugcauaaccugugaaggaccuuucuggaacucagggagaaucugaauauggacaugguauccaaugguacuaaaaauuuauguuaauuuugugggugagaugguaucaucuggacucuguagaaaaauguucuuagauuuuagagacauauacugacaucuuaaauaugcuuccuaucugaacuuuucuuuaaaauaucuuggcaucauaaaaaguauguuuaaagggggaaaaugauauucuggcaagacuuaaauuuggaauauaauuacaguaaaaggcuaaauugcuuuuuuaaaggcuaucuuggaggcaagaaaagucauauauuaucaaaagcagauuauuguucugacagcuuuaugaaccaacuagaauuaaggagaagcaccuaaggucauaaaaaguuuuggagucauuuuaaauucuugauaugugaaaaaguuugguuaaucagaugcuaggccagaaaacugugaacgagcaaauuccucauguccaaagguuuagcugcuacuaaggaugggugauccauauauauuuuggguggagaguuggaaguauaugaccuuuggcugucuaacaaauauuugaguuccagggucugcucuggagucuagggaugcugcagagaauaaagcagacaaaauucccugccuuccugguauuuacauucuacagggaaggaaagauauaagaaaacuaaaacaacgauguuacacuagcacauuacaaggugacaaguguuacagagaaaaugaaagcagcaaagcuaggggugggcuggggcugguaguuggccgggcuguugcaguuucuacagaagaugguaaaagaagaugcccugaaaaggugucaaugcagcaagaacuaugugccuggcaucuccuuccacuguguccauacacaugagaacuacuacacagcuauagguggucuguguccaaaauggcuacaaagcaaccuaggaaagucacaaaguaagagaaaagccugguccuuuucuuuugggggcacuuugugaagaccuauuccuuagaaagaagagagaagcugcaugcuucugggcuucucccccucuuuuuugggaaaaaauaauugguucuguuaaggaaguguaucagucuguuuucaugcugcugauaaagacauacccaagauuggggagaaaaagagguuuaaugggacuuacaguuccacauggcuggggaggccucagaaucauggcgggaggugaaaggcauuucuuacaugguggcggcaagagaaaaaugaggaaaaggcaagagaaaaaugaggaagaagcaaaagcagaaaccccugauaaacccaugagaucuugugagacuuauucauuaucgcaagaauaguacagagaagaucagcccccaugaaucaauuaccuccccugggucccuccacaacaugugggaauucugggagauauaauugaaguugauauuugaauggagacacagccaguccauaucaggaagcaaaaacaacaaacucugcuccuccuuccagcacgcuccccaaaaugcagcaauaccuuguccugccccagauucguaaguggagccccauuccuaggagaaaacagauacaucugcaccacugauccucaguggcagaauaugccagguaucuguccaggagaagaagccauguggcucaggcuacaggguuuauagcccaaggccucccuugccucugugcucugagggcuugaaguaaguagaaaaguacuuuaaauuguaucauaaagguaaagaugauguagcuucuuggguuagccacaacauuuaggaaaagcauguucuggagagguaagacuuuuaguugauuuuccauuagugagcuaacauuuuuccucuuccaacaagcccacuuucuugcauugguaaguauuaaguaucuuuuuuuaaaguaucugugguugguuggcaucugagaaaucuguagggucaaauaucaaauagacaccccuagcacaaugccacaaaugcacaagggaugaggcuaugaaauuugugaauucuuuuccuuucucaaggaacgacuacacuuacauauacuccaguuaauuguauguucuaguuauguagauccuagagagaaggucuaguguggugauuaauggugacuuuccagagcucagccacguggguuucauucucagugcugccaccugccagcuccaaugugacuaugaacaugucacuuaggcugcugugacuugguuuccucaucuuuaacaugggauggaaauauuaaccaccucaggggauggugugaacagccaaugauguaaauaacacacuuggaacagcacaugauaagaguuaaauacugugccuauuuacuguuuuuaacuacagcuuaaauguauacuuaugacauuucuuuucuuuuuauugcuauuagguuuugaaaaugguauaaaaauaucauuuguuuuucacagguaauguuuuucuuggggcuuauuauuuuagaaaaaaaaaaaauauauauauauauauaaagagcuauccuuuacugggcgcuaugccuaguaaguucccaacugcugacuauaggcucagagcccugcagagaugggauguaaacaagcauaaaacaguguuuucagugaagugcauauuaacaauaaugggcugaacaaagaauguucauugguggaguuugggagggacagacugaagaauaaucuguugaagagguaacagguaaacugggacaugaugaaugaauagaaaucuacaaagaagguagcaaacaggacacuguagaaacagggaauggcacccguagcagaugaagagugauaugguuuggcuguguccucacucaaaucucaucuugaauuguaauccucauaauccccaugugucuagagaaagaccuggugggacggaauuggaucaugggagugguuuccccaugcuguucucgugacagugagggaguucucaggagaucugacaguuuuauaaggggcuguucccacucugcuccucgcucuucucuuuccugccgccuuaugaagaaggauguguuugcuuccccuucugccaugauuguaaguuuccugaggccuccucagccaugcagaacugugagucaauuaaaccucuuuccuuuauaaacuacccagucuugguuauaucuuuauagcagugugaaaauggacucauacaaagagugcuacaggaauugccaauucucaguaugguggaggaggggguggacugcaggaagggagcugacuagcuguagcucugcucuuuuaugaagggcuuuguuucacaggcugaggagucuggaccaucaucuagaugcagagccuaguagaaaagccugaagcagaagaguggcaagguuaguuguauugcaacaaacaugagcuagcagaagcauggaggacagauagguggaggagcgacaguugggaugugaaggcggugcucgugaagccuacugagaacuuggauaaaauaacagcacagaacuggugacuggggaugaagggagugaguaagaggaggaaucugaugcuuugaguuggagaauaguuacuaaugguaacagaggauacaggaggaauuaagaaauggagcuaauggguucagcuuugaucaugguagacuugagauucuguaagaccccgcuggagaggcauacagcagacagcugaaaacaaagaacaaaaaaaucugagccacuaauacacaggcacugcuuuucuauuuccauuaaauaaacagugcugcacuuuguuguuuuuuaaacuaaagagcugccauuccugaaagaccacagauaauagaccagaugcccacucacuuucugcauggauaauaugucccacugugauaccauuauuuaaguagaaacaaaaucuagccuuaugaagucuaauuauaccauuccuccuccuuccuuccccucucucucccugcaagcauaauucaagacugcuuucccauucagagaucuaugugagaauuuuaaaacauuguugcugauuagucucucuaaucaauaaaagaaaucuacuaucggccaggcacgguggcucaggccuguaaucccagcacucugggaggcugaggcgggcggaucuugaggacaggagaucgagaccauccuggcuaacacagugaaaccccaucucuacuaaaacacaaaaaauagcugggcaugguggcgggcgccuauagucccaguuacuugggaggcugaggcaggagaauggcgugaaccugggaggcagagccugcagugagccaagaucaugccacugcacuccagccugggcgacagagcaagacuucucaaaaaaaaaaagaaaaagaaaaagaaaaaaagaaaagaaaaagaaaucuauuaucgauuagauuugauaaaucuauuauugacuagagagaccaaucaggaacaaugucuaaaauuguguaugaaaagccauucacucaucaaaugcuaguggcugcuaagugucuggcauucugcuggauccgaggcuccaaaagggaaaaagauaagcucccuguacucagagagauuacauucuauggggggagagaacgacaacgaaccaauaaaauacuaaaaugugauucauuucagaauggaaguaaauaggcugcuaggauugagaauaaugaagaagggguguuuucuucagaaaagaaugaucagggccaggcaugguggcucaugccuguaauucuagcacucugggagacggaggugggaggacugcuugaguucaggaguuugagacaagccugggcaacaaagugagaucuugucuccacuaaaaauuaaaaaaaaauuagccaggugcagccuguagucccagcuacucaggaggaucuccagagccagggaggucaaggcuacagugagccaugaucaugccacugcacuccagccuaggugacagagcaggaccuugucuccaaaaaacagaaugaucaagggaauucauucuggaaagauggcaacaaaacugaggcugaaggugggaccuuggaacauccauuauagacaaugagaucugucagcccggggguuagcaagcuggggauauugacuugugugacacugagcaggggagagucgggggaaagagaggcauggggugauacugcggagguagggaggagcugggucaaauacacuaauaccuguaaggaauguaggaggucaaaccugacaccaacuacguguuuguuaguuguuacccguuaucaauuauccucagcauauccaaauaaggcuucauuguuuucucucugugcacuugguuuuuaagcguauugguaagccacgaacacaacuuaaauuuggggguuccaggaucugcuuuauguaaauaaacacucuacauccuggcugcuguacagagaauggcuuggugugggagaagaaagcagcgcaugugucagggagagagaacgagagcagagauuagcaggauacggaaauaacuccagcaagaaacaaugggaguuuagauuagugcuggaaaagauggagauaaguggauaaauccagaauucauaggaugugcagaagagacgaugaugaguucuagguucucagcaauaaucccuaggagagggcauaggaccauuacugagauagaauagcuuugagagaaccacauugaggacuggguagcaggggaauuaagaacucucauuuggacauguuaggauucauaugccuaugaaauaacuagguagagucuggccuagagaaauaaaccuuggccuagucuacuuacaaaugguauuuaaagucaagggcauggauuacagcaaucaggaagagcgagccagaaagaaaaauaguauaauaauuguaaagagauagccagugucaggaauuuaauggaugaaaugucaaaacaaaacaaaaucagccaagacaggauaauuaaaaccacaaaggcuagggugggggugggggguagaacuggggggugggcacuccuaaagccugcauaaacaauguguaggaaagacaggcuggaaaugacagugacacacagguuacuagacaaagggcuucugagaaauggcaaagguaaccaauucuaagaacuuacuaaucuuaaggugauuuauagauaaaagucccauccuauaaaugucuggauucuugagcccagagauauucugggucugucuguacugguauucugcugggcagguaaagggguuaugaagagaaguacuaucuuacuugccugucaacuaauacugaugacagagcaaaagcgucaugcacuuuacagucguggucauagccaaagauugcagauguccuagacacaguauuugagacagagaauggaacauacauagccaaguuacuaauauacauguuggguaagaagauucccaaauggaaggaagguaaaaaagcucuguucuaguacaaccauuugaggauaguauggagauuccucaaaaaacuaaaaauagagcuaccauacgauccagcaaucccacuacugggcauuuaucuaaaggaagagaaaucaguauauuaaaagagguaucugcacucccauauuuacugcagcacuacucacaauagccaagauauggaauaaccuagauguccaaagagacuaauggaugaagaaaaugugauguguguguguguguguauguguguguguccgugcgugcaugcacguauaaugaaauacuauuaagccauacaaaagaauaaaauccugucauuugaagcaacauggauggaacuggaggacauauguuaagugaaauaagccaaaaacagaaaguuaaacaccacaugcucucauaugcagaagcuagaaaauguugauuucauagacguaaagaguagaacagaggaugauggaggcugggaaggguagguagaaacugaggauagagaaagauuuguuaaaggauaccaaauuacagcuagauaagaggaauaaguucuagugcucuacagcacuguaggaugacuacaguuaacaguaauauaugacauaaucucaaacagcuagaagcaggauauugaauuuucccaacacaaagaaaugauacaugccugagaugaauaugcugaucagucugaucugaucacuguguacccuguaaauguguacaauuauuacaugucaauuuuuaaaaauaaaaauuuuuaaaaagguaccuuuuaaugaacggucuaugcuuaaaauguugcuagguguguuucaacaccaaugaguuauaucugagguuggaccauaacuagacgaggcacuuagagaugcgguaacuguggucucagcauccuguuccacugcacuuaguuccaccaucauuguauuacaguaaaugcaauauugcuauccugugacuaccuuguaaacauauuuucauaaaaccaaagugcuucauuaccacuucugauauguguaugaguccuuggcuccaauuuuccaauaauaguagcuauacaauuauguugaaaaccauuugaggcuaaccauuaacauucaaaugacguacaaugggaaacgaaugaauaguauauucuaggagauaaaagaucaaaccuuugauauaucuucucuuacuuauuaguaguuagaguuuaagauacaauauuucuucuaaaaccauuucaaaaauauaauuuaaauauaaaauugaagauccuaaaaaaguauagaaguuuuaaaguagaaugacuuugcuauuugaauaccuauuuaaauuucuauuuaaaauguccaaaacagcccaaaucaauucuaccuucauuuuuauagcaguuuucuaaucaugagacaucauacuuucuaguccuuuuugcuucccuaaaauaaaaaaacuccuacauauuuaaauucauaaauaagaauuaucauuacuugauuacuaccaaaacuaauuuuaauaauguucucaaccuuaucuaggauagaagugcuuaaggagccauuacguauuauuauugauuaugauuacaagaccuacaauaauuuuaaaauaacuaauuaaaaagggaacauguuauaauagccaugauuaucaaaccagaggugggagaugagucauugagccccaaggagagucuuuguauucgacagugugagaugauggguagagaagugauuugacuaagaaaaaaaucaccccagcuggcgcggugucucacgccuguaaucccagcacuuugggagcccgaggcaggcggaucaccugaggucaggaguucgagaccagucuggccaacguggugauacccugucucuacuaaaaauguaaaaacuagcugggcgugguggcaggcacccguaaucccagcuacuugggaggcugagguaggagaauugcuugaacucaggagacggagguugcagugagccgagauugugccacugcacuccagucugggcgacagagucuuaaacaaacaaacaaacaaaaaaaacaucccaugcugcuggccugcucccccaacaauuccaaucuacgcauuuuaaacaaguccacuguaaacuuuaccggcuugauaugcauuuacaccaauuagucguuuuggaagcaaauaccgugauacagauuauugcaauuuuccccauguuugagguaaagaaauaggcucaaaaagauuauauaugaggguaaagcacauuuuaaaccuuugaagauauuuuugaagcaaagauuaucuuauuuacuuacaagucuuuucuuuccuugacuacuuggaugcgucuauuacaccugguuucuguuuccacccaaugucuuuuuaggcagguuaguucuaucaucaugaaaucacuguaagugcaauacugcccuuuccuucaugaugucauucaucucuuucccaguuuguuaucuaacacguauuaacauuuuaguauccaacuacauuaaucucaugacuacuagcauugaaagaacugauaaaaagauaaaagcaaacccuuacugccugguuugacaauaaguaacagcucuucacaaaggcuggcaauuaggucacuaagcaaaaaaucuuggaagaccaaauucgaccaacagcaaacaguggucucaaauguaaaagaaaacuuagguuauaugcuacgcuuacaauagcaaauuauguauacugcuugaauuacuauugaucuaaauaaaauggugcuaugcuauaaagauuauuuucaaauaauuucuaauaucaaacuauacuuuugaauacccuuggcaaaucuuuuccagaauuacacauuccuaaaacaaugagccaauccacaggcacguguggccuacuauaugcucaacauucacuucucuuuaaaacaauuuacaugacaaaacaaaguacaacagugaacauucaucaguugcaccuucaaaugucugacaacacaaucagaugaucuguguguccuuuacuuauuaaauugauaacaaauagaaaauaaaauguagaucugaaggaagcacuuaauuuuuuuaauuugcucaauugcaaaaaauuuauuuauauaaauauauaaaaugaauugcuauauuaaaagaauaauacaaauuaaaauacuauaaauaauaacuugacugccuuacaaaaucaauuugagcuacuguauuuacagauugaguaauccuuauccaaacugccugggaccagaaguguuucagauuucagauuuuuuucaaauuuugggauauuuccauacauauaagauauguuggagaugggacccaaguauaaacauaaaauucauuuauguuucaaaaauaccuuauacacacagccugaaggcaauuuuauacaacauuuuaaauaauuuuuguuucagaaaggaaguuuguauacauugaacacauaaagucacauaauuuucuacguuugcugucaugucagugcucaaaacauuuuggauuuuagggcauuucagauuuuggauuagggaugcucaaccuguauuuuaugguaauaaaccgcauuucuuuaaaaauauuguacauucuuggcugggcaugguagcuuaugccuguaaucccagcacuuugggaggccgaggccaguggaucacuugaggucaggaauucgagaccagccugaccaacauggugaaaccucgucucuacuaaaaauacaaaaauuagccaggcauggugguuggcaccuguaaucccagcgacucgggaggcuaaggcaggagaaucgcuugaaccugggaggcagagguugcagugagcccaaaucacaccacugcacuccagccugggcaacagagugagacuccgucuccauuaaaaaaaaaaaaaaaaagcugaguguggaagcaggcaccuguaauccucgggagacugaggcaggaguaccacuugaacuugggaggggagguugcagugagcugagauugcaccauugcacugcagccugggugacagagcgagacucuaucucaaaacaaacaaacaaacaaacaaacaaacaguacauucuagaguuuaagcuaaugaagacuguucucccaguaucucacuccauacaaaaauauauauuaaaaauucaggugaucauggcuuuggcuaaguggcauuagucuaccaccuacaauuuuacauugaaacacuggggauacugcaaauguuaccuaguaaacuaaaaguguuacuuuguaaacagggagggcaaaaaaggaagcuaguuagcucccacuugggacagauuuuguucacucucuaccucuacucaaaggaaauaguuugaacaucucuaaauuauuuucguaauaauugccuuccuuccaaaacaaacauggacuuauaauuuugcugaguuccuugugguaaguuacugguacuaguuuaagccacauggcucccaaguaaagccaacaguuuuuggcuugauaugcuaauauguagauuuugaggccacaguaaaauuaauuaacuaauuaaaggguuauuuuuccaugucacaauggagaguccuaucuaaauuagggguuuuacacugaagauacaaauauccagaugguuucaacaagaaauuaauguuucgguguacuauugccagagaccaguuaaaaucauaagaaucuguauuuucuuccucuuuuccuacuauuuuuaagccagggaauuuguacaguuuaauuaaaagauacuggagggaagaaaagaguccaugcaucaguagcuuaggauccuuagcacugaauaauccaacccuccaaauaacucuuacaaaugaauccuacaguauuucucauucagcaauauccuguuacuggggcaaccugugccauuaggucucaguaagcagcacagucucauugccagauguagcucagacagcagcaacucaagcccugcacuacagaggcaucuccucuuccagccaucaccugcuuggaaacaaaaacagaccccacugguuuggccacacaucuguaaucugcuuaaggcuauaaaaguguuuugcuuuucuuuuugacauacauguaguccaaguuuauucaauacaggaaucgagcauuucuaaauaaggaccucaaaacuggcagccaguucccucaaaagaaaaugcaaguuucugcuauucuccuauucgucauuuucaaaugaguucuccuauuucaguauagacagucagaaagccucacacaguccuggaagcugccaacccagcauuaugacagcugcuucucaaagccaugagccauuucauuaaauccacucuuacuugacucauccacuggcaaagauuuaaagcuuuaauuuaucuuuuguaugauucacuuugcggcccucuaaaguuguuagguuuuuuuuccuugagcauuuaauaucauuucucaaaaugcaaugcagaaaggcagcugaaagauuauauauucaaaaacuuguaacuccagagauacaaauaaaaagauauauagucaaauacagccucucuuucucucucaccuaauuuuaaagacaaaguacugaauagacauaaauucucaugacagccugagcucaucagguaaggcuaugaauguuucaacaucacuagcuaaguggaagaccggcaugugcauaauuuauuacaugauugaaugacaaguuuucacuaacuacaaaucauguauuugugaaaugcaccaucuauaauaccaucugguuauuauuuucugagaaaaguucucagagcacaaugaccauaauuaaauuugcuuuugacuagauguagcacugugccaccuacaaauugagccugugcaagcguuuuaugaugacugcauugauuauuguuaucaagauuucaccccuuggucuggcgugguggcucaugccuguaaucucaacacuuugggaggcccaggcaggaggaucacuugaggccaggaguuugaaaacagucugggcaacauagugagaccccugucucuacaaaaaaaauaaauaaaucaaaauaaauuaggcaggcaugguggcaauguguuuguagucuuagccauuugggaggcugaggcaggaggaucacuugagcccaggaguucaagguuacacugaucuaugguugcaauacugcacuccagcaugugugacagcaagaaccugucuccuaaaaaaaaaaaucacuuuaauauaguaucuggaacauaucaaaugcucaagagguuuagugcccuucauuacacuggaggaaaaaggugacauuuuguaccucugcaugcucagauacaguuuguuuuugaguuggaaauauuucauacuucaucuuuucuuauucuuacaauuuuccuuuauuuauaauguagccaucccucuucugcccauggaaauaaugaaacaugggacccaucaugcuauguuauuagacuccugaugcaauuuuacuuaauuacugcaugucuagaaugauauuccuuaguuuuucuuuucuuuucuuuucuuuuuuuuuugagacagagucuugcucuguugcccaggcugaagugcaguggugcgaucucagcucacugcaaccuccaccuccuggguucaagcgauucucuggcagucuccccaguagcugggauuacaggcacaugccaccaugccuggcuauuuuguauuuuuaguagagaggggguuuuuccauguuggccaggcuggucuugaacuccugacaucaagagaucugccagccucggccucccaaagugcugggauuacaggcaugagccaccaugccuggccuaguuuuucuuuuuuaaagaccaguuaguuuuggugacacuauuaaccuuaaguuaacaugaugacguagguguauguguuugaugugaaugccaaugugauucaacucaaauacuuguugagcaccuaacuaccuaacuuauagaaaauuaugccaaguauuuuccugcaucagguuguacaggccucauaauaaauguaaauucuugguaaguaggauaggcuguuaaccuuuagaauaccaucaggucuuggacacaauuuuaccuuugaguucugagcacuucuaacuacuugugggcugauauucucacuuuauccauucauagagaaaaagaaauuuaaucgacuaaaacucauucuagcuuguacuuaaccaugagucugagauaugguaugaaccucgaucuuuuuccuauauuguguuccuauguuacaaaauauuuaucauccgaagaauuauuucaucauuagccaucaacuauuuaaaaacugugcuaaagaagacaaaauaauaugagcaugaaagaaugauauaauugccuagaaaggugaugcaauagggaaauuaucacauuuuuauugcuguguucccaaaguacugcaucaucuuucaagaugguuuaaaaaaagucugcauagucccagcuacuugggauguugaggcaugaggaucacuugagcccaggaguuugcagcuguaaugcaccauacucacaccagugaauagccacugcgcucaagucugggcaacagagugaggucccaucucuuuaaaaagcaugauaaaaagaagucuggagacucacugaauauagucaaaaaucaucuuccacauauuggcaaauaggaacaacugacagaaggaggcauuuuaccaauuagauaaaccagaagaagaaugaaauugaucacguaaguaaaaccuuaggcuaugagccuucacaugauauccuagaugaauuuucucaagcucaagaauugacaagugagcaauguauuucuuucuuucuuucuuucuuuuuugagguggaguuucgcucuuauugcccaggcuggagugugauggugcaaucuuggcucacugcaaccucugccucccugguucaauugauucuccugccucagccucccgaguagcugggauuacaggcaugcgccaccacgccuagcuaauuuuguauuuuuaguagggaugggcuuucuccauguuggucaggcuggucucgaacucccaaccucaggcgaucggcccaccucggccucccaaagugcugggauuacaggcgugagcuacugcgcccggcugagcaauguauuucuaagaauaaaaaggaaauaugguauucucauccacuuagucauucaacaggaaggauaucaucacucaauauuaugugacaaaaacauuaaccaucauugcuaaaaugaugugacaguauuccuugccauuuuaugaugcuuaugcaacacauuuuaugucugugcaacacauuuauuugauaccauuaggaaguggacaaaugcccaaggcaggaaucucucuaaggugauuagaagagauaaugcagaaaaaaagggggaaaaaaagacuggcuugaucauuuuaauagcuguuuacaaauccaaacuugaaaacauuuuauuccugagggaagauggcuauauucucucuucaauaaaauuaugagcugucaauguuuuaaauaucuuaaauuuuuacaauaauuaaaugaaauugcaaguauaaaaaaaaaagaccaagaaauaugaugaaccuaauagagauguauuugaaauguagaaccaguauuuguaagacggauauauuucagguucgugcauggcaggugauuagcagcuagcugcauuccaaaggauaaugcucauuucagaaauccauaccuucaaaacugggaaaauacagaauaaacauguggguuuaccauauuuaaauucuucguaaaauuaaaauauuuacuauguuaacucuuauuaaaauugcuaauaguuauuucucacuauuccuuuauucuuaguucuguaaauuguuuaccaaauaaucuaaaaauaugaaacaauaauaauauaaacggcccacuguaucuagauagucaauggugcuggccugguuuucugguguaguuagagggcaaggugacgucuugccauaugugacacuccagcaaucaccagaacugaugaaguuuaaacuggguucaauacggaauuguauauuccaaugcacgcacaccugcauacauggccauacgcacccacacaagccaccccgagcuguauuaguucauuugcauguugccgauaaaggcauaccugagacuggguaauuuacagaagaaagagguuuaacuggacuuacaguuccacauggcuggggaagccucacaaucacgguggaaggcaaggaggagcaagucaugucuuacauguauggcagcaggcaaagagagagaacuugugcaggggaaccccucuuuuuaaaaccaucagaucucgugagacuuauucacuucacaggaacagcaugggaaagacuugcccccaugauucaauugccucccaccgagucccuuccacaacacaugggaauucaagaagagaucugggugggaaaaaagccaaaacauaucacugccccccaaaccagagaguaacauuaacuaaccuggccaacauggugaaacccugucucuacuaaaaauacaaaaauuagcugggugugguggugaacaccuguaaucccaauuacucgggaagcugagucaggagaaucguuugaacccaggaggcagagguugcagugagccaagaucacaccacuguacuccagccugggcaacaagagcaaaaacuucaucuuaaaaaaaaaagaaaaagaaaaagaaaaaaaaaaacucuuccaaguuauacagucuuaaugaaaauaagacacggucaaaaggaaucacuccuccagaucuuaagcagcucuuuaaaaaaaaaauguucaaagaaauagaaaaaaaaaaucaucuaauuauccagaaagauacaucaaguuaccucucagcacacgcucaccagugucugcaaaccuaaaccuaaaagaauacaucgauaauuaaagauuguuucuuaaaaaaaaugugaguaccuccucugcaagaggaaaagugugacucuacaacaauuagagggucuucuaacauuucauuugcuuuacgaauucagcaacccccauggaccacuggguucaaucagauucugcaguuccaggugaggagcagcucugccuccagggcuaggcugccuaccuggcuagucuuacaaguuagcuuuccaaaugaauuuucccauggaaaaaaaucuuacccacgauggcuggagucuguguauuauuaacauuauguacguaauuauuauuauuaacauuaugcuacauaauguuaguaacagucuggauuaugcuacauuacagacugcauaaauagguauuuugaggugaucugagaauaugaccauuacaacacuggagaaaaauauacucgguaauuuacacauaaauuucugaaacacuaccuguuuugccuauguuaaagauuuaccucuuuuucauaccucuuuuucaaugaggucauaaaacagagcucauccuacaaggaauguuucucuaaaugccccauuagcgauagaaaaacacucaucuucuaucaaaacaagccucauuaacuaccaaacaacaaaauacugugaaucaaauauuguuuccaggaaaaugguagcucguuucuccuucuucaagaauugucacguagcauccccugaagauguuuuaagucagguacguuaaacuucuauucugauuuuacauuucaagugucaaaaggagggcugguuccuggaacaaggaggcugccaguuggcaggagcccaccuuguguguggaucagugaugcaacaccuuucugguuuuguccacaugaaagaagcccugcccgccugcagggcuacaggaaaagaaguuaaaaaauaaaauggugcaagugaccugauauacuaauuauacugaauccaaaccaauuuuuuuaaauuuuaaaaacaagaauaguuaaaaacaauaauaaaaauucaguggcucagccuuagaaaacauuacuagguuauacaaaccgucugucuuaauggaaaaauaaagagugauaagaaauuucaagucauccaggaacuacacuguccaaauauaguagucaccagccacauguaacuaucaaacacaguguguggcuaguaugaauugagacgugcuguuaaauguuaaaagaaguguuaagacuucuuacgaaagaaagaaacauaaaaaaagaaugugaacuaucuuauuaaauuuuucauauuggucacaugauauuucagauauacuggauuaaauaaaauguuguuaaaauuaaauucaccuguuucuuuuuacuauuuuuaaacugucuauuagaaaaugaaaaaguaaggccaggcacgguggcucaagccuguaaucccagcacuuugggaggcugagguugguggaugacgaggucaggaguucgagaucagcccggccaacauggugaaaccccaccucuacuaaaaguacaaaaaaaaaaaaauuagcugggcaugcuggcacaugucuguaaucccagcuacuuaggaggcugaggcaggagaaucgcuugaacccgggagguggagguugcagugagccgagaucacgccacugcacuccagccugggugacagagcgagacuccaucuuaaaaaaagaaaacgaaaaaguauguggcucacauuacauuuguauuagacaguucuuugcuaaaagaugggaggcucuauaacagggccuauagaaaaaaaaaggcaaaaaaauuucauaauguuuuaagaaaguuuaugaauuuguguugguccgcauucaaagucguccugggcagugggcuggauaagcuuucuacaauauccaaucguggaccaugaaguccuuaccaaaagcuaugaaaaaaaauuuaaaauauacaauuuacuuugucuaauauuuauugaggaccuaugugcaagacauaccagacacauaaacuauaguuuggauucuaacagauaaaaagagauaugacuacaauuaauuggaagauaaguuauggucuuauaagaaaaagguaaagcaaggguaguauagcagagcaaggcaccuguaaagacuuguaaaggcugcaucuuuucaggugaacauuuauaaauauauagauuuugacgggucauaagaaguggcacuuuagaguugacaaauaucuuuaucauacauuaaccccauuugacaaaaaaaggaaaaauauuucagauggggcagaacggugggaaugaaagccuagagaaagaaaaggucaaugguuuuaggaugccaggagagucacauacauguauaaggcugaaaaugcaggcugaagccauguaagagacuucugaaugcccugcaagagaauuuggacuuuucuacagguagaauaaaccaucaaauauuuccuaccaacugucaacaggauuaaaaacacauaguagaaagauaguaacacaugggaaagaauuaucugggaggaggguggaugaagccugggggugugggggagagggagacugaaaaugcaagaaagggagaggagaugauugagaguccagcagaacauaaucauaaaagggaagacaggaaacaaagggauagaagaagguacaagaguugcugaaguacaggagaaaauucaaugguuuauucaacaaacacguacugggcaccuaccaaaugucagguaccauguugcagaaauucacaauggaugacgguggaggggucaucuguagagcaugagagagaguuacgcugggaaccaaggagaaugaaguugggcuggaucaacugcuauggggaagaugauaggucaucaagacagagauaauuaggugcaucuaguaacauuaagaucccagcugauguuacagcaugaauaagaaauggaauuaagugguaagguuacaugacuugauacuuuagaaaucccagaagcaacuaaagaaagaaauuaauuuuuccuagcuauggagaauugacaaaaauauguuuagaaaaugugaaggguuucagccaagucaaggauguucaauggaauagguaagaaugguuauccauugauuccauccugauuagaaaggcaggcagggaaaaagaggauaauggacuaaaagccugaacuggggaggugauuaugagggaagaucaugaucagagaggaauaucaaagcuauaaaccuuaugguacuauuucuaaggaauuucagagucuaaagcaugacuguguucagguacugaaaugggauguaaaugaagguaacuaggaaggagcuggcuagcauuucaacugaauaucaaccuggauagugacaucaucacugaagacuguaauugguggggguaaccauaugacccaguuugccuggauccuucaguuuaugacuguggucccaguguucuagcugauauagacaauaaacucuaugggggcccuaguagcagauuacaccagaaauuaaaagaaaaaaaaacaagcauccuguaguuugccgauuauaaacuuacaacuccuauugaaugugcuguuuggaaaucuguagcucuagggaacaucuaagagaauacugaaggaauaagauaagugauacaaucaucacccuucgggggaugagacagcauaaaaucaaugccugaaccagauggcauuuccaacccaaagauucucauuuuauaauuuuaugauuugaauauagauguuugccuucaguuaagaaugagaaucagguaagaaguaacgggacuaagcucccuaagaaaaagaggcgaaaauagguuucuuuacaaucaacaaaucaaagguaguuaaaaaaaauuaacaagcauuuauuaaugccuuugacuuccacuaugaaggaaaagaaaugauaaaaggccaaaaaaaaacccuuacacauccacacagagaacgcccaaaaucucaaaccaaaccuuuaacgaaaauucaccuuaaacuaaugacugacaaucccagagagcauuuaaaaauauuuuuaaauuaaugaccaaaacagaacgccauuauuauuucaacucccuguuagaacuaccaguaaccuaugauaguuaucagugggauuuugaucccaaguuuaauauuaaauaguuaaaauuaacucugugaugggugacugauauuauuaauucaacaggaugccauaaaaauucauaguucagauuuuugcauaacagcagacucugaugggagugggcagagaccuuuucagugauaaacagaaagauuaauuuacaggauacaaauacuccauacaagauguuucagcaucucugaggcugaacacaaaggccaccuuaccucccaucugcauagucugugucugcuccgccccaccagacauccgagucauccuccuccgcaucagcagaauccacauugucacuuucuucagccagugggcaacacacaaacucuaccccucggaacuugucaauuccgcagggcagcaacaugccguagucaugcaaguugguacucuucucacugcaugucuacaaaguguaaggagaaaacagugagugguagaguagauguguuucauuguaagaaaacuccacauaaaauaaucaacaugcagacccaauauauuaggaaccaauuucacaaaggaaaagauuauuugcuuuuugagugaauuuacaacaggauuuuuuuuagcauggguuacacuuugguacucuuuuuauucuuguuuauuauuuauuuaauaagaccacgauguuauauaauagagguuuauacgaacaacuggaauggaaacuaauugggaaauaagauguagcagucuccacuggugaacagauaccagagaauuaaugccuucuggcuuaauucguguauccagaaauugugcgcauuccagguagauccccagcucacuccuaccucccuuacagauggaaguuuaucucacauggaccugccuuauccuagaaauucugacucucuugguucacuuucagaguaacaauccugggaagagaagaaauuauccccugcagccacuaagaaucagaacuuacagucauuagagauuucuccuugaaugucuuuuugcuuuucugggauuugcuaaauuugcacaaaucuagauuagcauaaaguucugagagcauccacuagugauaaaugaaggaugaauaauucaagacauaaagguagacaaugaaaauauuacagacuguauuuugaccuuaugggagucauuuccguuucuuagagacaaaggauuuuucuuuugaaaacacagaaggaauaaaaaaugagguuaucaaauagguagcuggacuucaaauuauuugguuuguuuucuuaaacucagcaagcucuuaaaccuccaaaacacauuuuuacauaaaaaacauuuuauucuacaguggauccaaauauacuauuuuauaagaggcauaaaauaauacuaaaucuucagugguauuuucugucuaacagcuauaaagcuaugauacaaugguuaagcuaagcuagaucagauuucucaaccccagcacuauugauguuuuggacugccuaauucuuggggguggcgggugguuauccuguugacuguaggauguuuagcagaaucucuggccucugggcacuaucagaugccaguaacaccacucccucaagcuguaauaacaaaaaaugucuccagacauguuccggugagggacaggggaucaaaauugacucaagugaagcacuaugagcuagauaaaggagccuaauucuaguuagccuaagacugaucuugccacaaauaaaccuauauaaauuuauuaggaaaccuaucaaggggacacagcagcugugaagguggucuuaccacacagugaccuuuucaugcuaaguaucuuacaucuuuuauuggcuuagccaaaagcagagguuaaccaagugcucggucagacucacccuguggaaaaaucaagaugguaggcauggccugcugaauauaaaacuggaugguauaacugagaaacugaauucuaacuggagcuuucaggcugguauaaaaaagcuacuucacuguucuaccacuguauucacuaauagauaacaggggaaaaggcuaaauuauuaaaaaauuguauaugacaaaagaaaacaacaggugcauaaaaauaaucugaaggguaaacuuuaaaguuauaacuauuagagauuauauuuuuaaguuauaaggcauggcacagacaacuuauauuuuuaaguugcgaaacacggcacaggcacauaaugaaucuaguucaacuggcccuauuuuugacuuuuuaaaaauauucauggauggggaggcugcgcauguguggggacaggggguacacgggaacucuauuuucuguucgauuuugcugugaaccuaaaaucacucuaaaaacuaaaaucuggguuacggauaguagcacuggguuuuuuucuuaaauaacuuaucaacauagcuguugccucaaaauaccccuaaaaugccauuaagcacguccccaggaaaucuucacuuugcaauaagaaagaauuuaugggcugguaccucuuuggcgacggugugccagugaagaugaguuucgcaaacauccauccucuccugguguaagaauuugcacuugucaggaacgagaagggcaucacuuacaaacucaccaacugaaagaaaggaaaaccacuucccgucauuccaucuguaucacaguguucuuaccgcagaagacaucaaggaaagauagacuucaagacaaguuaaacagccuuuuaaugccuaagcaacccaaucaagacccuacuaccuuuagaauguuacgucuggccuccuuaagcaacuccguuucuugccacuucaaguuugaugguuaaaauaaugccuaaaugcugcaagugaaauugucccuuaauuaaucugaauuucuugcuucaaaauuaauccuaaaaaagcugcuuaacuagagaaccaauuaccauucuacuacaacaggggaguaaaauauaaauauugacauugucuagguaagcauuugagcagaaucaauauaaaucccuacuuuucuuucuuggacauuuuaaucugcuuguaaguaacagaaauuuuagcauuuuucuacuuccuaagcaaaaaacccaaaaguguauuuuauauauauguuuacauaacacacauaagagagagagaguuuaauucaguuuauucugaaaacugucccucagacuuuuguuaaaucuuuaaagaaaauguauauuaugcaaauuauuucuaggcauuucugguauugaagauauaaagauauuacauaaaguccuacaugaacucagucuaaugaagguaaaagauggauaauuaccacauuauauguaagcuguaaacuuaauuuuuguuuacugcaauauucccagcuuuuagcacagauucuugcacauaguaggcaauaaauaucuguuaaugaaugaacaaguuaaauucuguaauagagauaaggaaagugucaggccaguaucuugggugcagugggaaaaaccucaaagaagaaacaauauucgagaugaaucugaauggugagaaguaguaugccacaugggaaaugaauugaacuuccauaacguaaggauagacucugucuugcuugccauuauacccccacaauuccuggccuaguucugucaaacaucaagaacucuauuauagaauccaaauggauggauggauggguagcaaaagacccuucaaaaugagggagccuccugugcaaagacagaguaaagaaccagcaaggcauauuugcagcccaucuggauauggguggaagcagaaagcaaguggcaaagggaguccagaaggaaguagcacuggggaagcaugcuggacuccaauuuuaaagaggcuuagguuuuggaugccauuuuggaagaagcaacauaggccaaaaguuuuuuuuuuuuuuuuuuuuuuuuuaagauagacucuauaauuaagugaaggauagaucagcauagugaaaccaugaaagcagggagaccaccaaguaggucacugugguccuucaggcaaaacaugcaagaauagacauaaacccacaacucccacggagcaaggaauacagaucguccacacagcagcaaagacaggaaugaaugucuuucuuucauaguacgcuauagggcauuuucugaaaugcaacauaaagagggauuaaaagcccuaagaaggggaaggaaguaacuuuucauucucauaaaaggguuuaaacuuuagucuguuucuagcucaaacauguaagauguagcaugauacugaaguacuuauuucaauaaguacuauuuagauaaaaaucuaagcaaaucauaggggagaauaagcacuguaucuugucauuccuuaaaucuuuaaaaugaucaaugaugcccauagcaguauaguguguguugcagggaaugcaaaaauuaugagacaugguaccccaaaggcugcaggugucacuuugcagggaagaaaccagugaguacugagcacacaccccaugcagcuccacagggccacaucacggguucuuuuauaaaccucacuucccaggggaggaaucuccgccaagaaaccuaaggcuaccuaacucaggagauuauaaccuagccccagagauaagcauuaagauauaaauuauaaggaaagaaauaacaugauaaugcaaaugauaccacauuucucuuuuacauagaaugauauaaaacaaaacaaaacaaaacaaaaacaaaaaacacaagaagaccuggagaauggaaaguaaagguaaucucauccaaaacaaauacaccauucccagguggauuucucaggguuucugagggcucucaggguuucugaggucagggacuaacccuagcugcuuggaagaauaccugauaucugaggcaucccaauuuucuagguuacaggaggccagaaguacccuauggccugaagaugcccaccucaucugucagcucugcucagucauauuugcaaauguccaaacuaagaagugaugcuuuucuauuugacaaguaacuacuggaaagauuaaaugccugucauguacaaauaggucaaagaguuuaaaaaaucuaaugcuggcccaaagcuacuaaaucaguucgugagaagagccagagcagguaucagauacacucgaccuuggccugcaagaguucuugggggcauaaaucagacaguaagugccaaaccacaaaaccaaaucaucuuguuuuaucugcccuuagucaaucugcugacgacuagauuauaaugcaaagcuaaaguuaccaaaacauauuuacuuauucaccaaaaggacauguacugcauuaaucuuuuuguuuguuuguuuucagacaaggucucacucugucacccuggcuggaauguagugguuggaucaauggcucacugcagcuucgaccuccgggggucaugcaauccucccaccucagccuccugaguagcugggacuacagcugugcaccaucaugcccagcuaauuauuucacuuuuugcagagacagggucuagauauguugcccaggcuggucucgaacuccuaggcucaagcaaucugccugccucagccucccaaagugccgggauuacagacaugagccaccacgaccagccagucugaacauuuuuaaugaggaguugguaaacaagcuuuucuuaaaagccugaauuaauuaaaaguugccuuggauauuaggaguucauuagcuaaggauguuacucuuacuuucaucuggcagaaaaucuauccaagagaaccauauucuugaacuuguguuuaggacagagguuggcaaacuacuacuuguggaccaagucugcccacccaccaccccccugcccccaacaccuguauuucugcauuagacugacuauaacaauuguucauuauguuuauaagugguuacugaacuuucuaacuugcaaaacauuucauuugauacugccaagauggucuuagcuucuuauauugcacaaagcuaagaaauaugugucccucaaaaugagaaugguuuuuuaaaggauuaaaacugguuacuuaauaagcucucaggacuaauggcaaaauagaaaccucauuguauucuaacauuaaaauaaaauuuagcaguggacagcacugcuuacauuacuuuuaaaauuugaugaaacauguuagaagguuacacaucagaaauuguaagcgauucaaccacaaaaaucuguuuuuaaaaacuuuuaauaagcguuaagagugcuaaaaguauaaugaagccuuuuucaccaacuggcuuagcacgguuuauauuuucucuuuuuaauuaaaaaauauuguacuuaaaaaucuuugcuaggacagcaguuacauggaaacuguacuuucuacucaaacuugcugugaacuuccacugcuuuguuuuuaaaaacaaaguuuauuaauuuuaaaaagccuaugaucguauauaccuggaguuucucuccacagccacguauaccuuauuuuuauaaaugcuucugcuuauuugcuuugaucuuucagguaaaaagaguucuuaacagaauucugauguaagagaucaaagacuaaaacaaauuaaacaucauaaugagaaaucauguuccuguuuacagcaaacuuuaggcaauuuggcaccauuuauuucaaguggauaaauucaucaauauacaguaugcauguuuauugagaaacauacaaccugguuucuugcuaaaacaauucacaauuuauauucaaaacgcaugucacacaccacacacacacacacacacacacacacccaacugaaaggguguuuucaaagcuaaugaacaaaaucugggucuggcuucuuggcuaugaagucuuggcaaggugaacaaggauggcaaauucaauaggagucugcaggccucaaucugcuagcucuuugguggucuuugggaggacugucuagcucaaauuaccucauuuugcagaugggaggaaaagagcucaggucaagugacuugcccacagagccaacuggcagaagaacuagacugaaaauccaggucuccaguucuccauccaagagugguaacucaacucacucauuuaaacucuguucaaaaugguucauuuggcccauuuccuuuggcuuuuacaaaaguaguucacuuuuagacugugaaguacuuuaauauuauaaucuacaauguggucaauuugacaauaaaacuagacuuaaauuagcuagcaagccauauagaacagcugggaaugcagucagcggcagagaauagaccacaugucaaaccguggcuuaaacacacgguaggauuauguaucucaccuaagaagugacacugaagcuagggccacugcagauauuccaugaugccaucagggaccagcguauuccuaucuuucuguacugccauccugagcacguugguuuuauccucguguuuuauggucacagaaauucaagacucuguguccaaguuccagacagaaggcaggagaaacaagacaaaggugaaagguuuucuguuguuguuuuuuccucuaauaaagcuuugcuguuacuugggagggacauacuccucagcaaauuccacugaggccauaugugccauuacugugaucuggucacaugcaccugcaagggaaucugugaaaguauuuucagcagagcacauugucacccugaacaaaaaaaaucuggaauucuuuuagaaaggaaaaaaugggaaugaauaucaaacaggcgaguagcagaggcucccacacuauggaauuuaaaguauauuuuucgauuucuuuauguugucuuuucaaaagacagacagaauuccaggaagcaaacagaauucagaguaaaaaguacugcaacuaaaaccacaguaacuucccaauccaugacauugggaagaaugagaagggaaagauguaucaaaacugacucugcugccaggauggcggcaccugggggugucaucccagcuacuugggaggcuguggugggaggaucacuugagcccaggaauuugaggccagccugcauaacuuagagagacccuaccucuaaaaauaaauguuuaaaauaaagacauuaggccgggcgcgguggcucacgccuguaaucccagcacuuugggaggccgaggcgggcggaucacaaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaauaauaauaaagacauuaaaauaaaaaaaaaacagacugcugaaguuuugagcaucagagugggguugaguagauuaauguaaaagauucuagagccauacacagguucuucaaggcacagauuauuugaauaucagauuaaaagacaauauuucuaugaacugcuggggacuaaaaugauguuggccagaaucaugggaaugaaaggccaaaaaugccugaggucuuuggacuucugcccgaggugugcccucucuuccucaucucucaagagguaaagaugauucaagaaagugggggaaauguucuggcaauguaauuacuguaaaaugccaaagccucgguuuccuugugcuaugggcccagaucugccuugugaagauaaaacaccaguauuguuaguaacucugaacugugugccugccaccacccucaauacuucacgugcgucuucucucaccguccucagaaccacaccaaagcagcuacaaugauuucacuuuauaagagaaggcaagggccgggcacaguggcucaagucuguaaucccagcacuuugggaggccgagacggguggaucacaaggucaggaguucgagaccagucuggcuaauauggugaaaccccgucucuacuaaaaauacaaaaaaauuagccaggcgugguggugcaugccuguaaucccagcuacucaguaggcugaggcaggagaaucgcuugaaccugggagguggagguugcagugagccaagauagcaccacugcaguccagacugagcgaaagagcgagacuccgucucaaaaaaaaaaaaaaaaaaaaaaaaaaaaaaaaagagagggugagacugagagacuauguaacaguccaggucacauagagaguaaauggcagaacugggagaauuaaaugaauuaauaucccuaaaguacucaacuagugcccagaacaaaguugcucaauaaauuauauuaauaguauccuucuccccaguaucuaucucaucaaccacaguaguuucucauaauaauaaucauaguaaucaaaacagcaacagcuacucuucaucauucacuaaucaccuauuucgcaccuacugaagacacugggguuuuauauguucauugcaccaucaccaccuacuuguagccccacagagaugacaugguacuguuuuacaugugaguacugcuuaugauggggugaauacaugacagcaaucaacacagcgggguggagucccuacgacuggagaagcagagaaucugagugaucaacucuuucaacucuugcaccgagugcugguccuggcugggaggggguguuuccuaaauccccucuugcagccacuguccuuuauccacuaacucuucacugcauacuuacaauuaugucucagugcuaagaauacagcagugaacaaaacagauaaaacgauauaugauccuagcggggaagcgauaaaaaauacagauaaaaauacagugucuguuggaugguaauaaauguuacauagauaaagcagagaaaggggugguuuguuuguuuuuucugaggggugaaauuuuaaauaggguggucagggaaugccuacuugaaaauaugacauuucagugaagacuugaggaagugagggaacaaaguauucagaaucaaagggaagaauauucuagccagaggaagcaacaaguauuacacaaagucuugaggcagaugcaugccuggugaacucacagaagaacaaggagaucagugcugucguggaggaaugauguggaagagaucagugggcaagcgagugagugacagccaggacaggacagggacagcugacugcacggggccuuaaacauuguccaacucuggccaguacucagaguaaugcuggaaggcucuggggugguuuucuaagcuaauuauucuugcccuagggggucaagacuagaagugagaagaccaggaagggggcucuggcauuaauccaggugggagaugacaaugacuuggaccaggaugagagcaguagagguggugcguguucucagauucuggaugucgucugaaggucagaucuaaauaaucaaauagaaaggagucaagaaucuagcuuguuucuauuccaacagcuagaagaugcuuuauacugaagaugauggaaaagucuggacaagacuuuccuaauuuuucuguguagauguguagacagguagaacuuuugagaauuauguacuuacuaacuuguauacacuagauauguguauaugaaaaugacagcuacagauaaauguuuucuuaagugauuuuuuauuuuaccauuucagacucuuacuccacaaauuuuuuugucuugaaugugcucauuauaugcuaucuuuuguaacuuucacauuaacaaauaggcugggaaaauuuuccugggaggcaucuguacucaagagacgggacgauuacuucacagaaacagccaaacauuucucaacaaacuuuccaugugauaaaacuguuaugguuuuagcuucagagugugggcaguuacuggguucucaaagaggacaugagggugaauuacacauccuuuuaaaaaguggcuguugccgucaccagcauuucacuguaacuauuaccggauaauagugagaacugacagaugggauucuucagaugagaacuauuugccagaugguaggaacuaaauggaucaagauaagcaaaaaggcaaaagaagugaaaacuaaaaguuuuaccuaaaucaucucuccaacuuuuccaagugcacagauccagccucacauacguaccauauacacacacagauggcagagugaguauaagacagaauagugcuggccgggagugguggcucaugccuguaaucccagcacuuugggaggccgagguggaucacaaggucaggaguuugaaaccagccuggccaauauggugacacuccgucucuacuaaaaauacaaaaauuagcugagcauguuggcgcgcaccuauagucccagcuacucgggaggcugaggccgaagaaucucccgaaccagggaggcggagguugcagugagccaagaucacaccacugcacuccagcaugggugacagagcgagacucugucucaaaaaacaaacaaacaaacaaacacacacacacacacacacacacacacagaauaguguuuaacccaggcucugaauaacacuggucuuaaaauaauaaaaauagugcaaaggauuuacuuuaaaaaagagaaaagaaaaaaaaaaccacgggaacaaaauaaguauuuauggccaggcaugguggcucacaccuauaaucccagcaauuugggaggccgaggcaaguggaucaccugaggucaggaguucgagaccagccuggcuaacauggugaaaccccgucucuacuaaaaauacaaaauuagcugggcaugguggcgggugccuguaaucuuagcuacucgggaggcuggggcaggagaaucgccugagccggggaagcagagguugcagugggcugagauugugucauugcacuccagccugggugacagagggagacucugucucaaauaaauaaauaaauaaauaaauaaauaaauauuuguuagcagucuugcagcuuuuaaaaagauccauauagguguggguuaacaaauuuuuuuauauuuuuuauuuuuuauuuuuuuaagaaagagucuuacucugucucccaggcuggagugcaauggcacgaucacagcucacugcagccuugacuuccugggcucaggugauccucccaccucagcuucucggguagcugggacuacaggcacaugcuaccaugaccagcaauuuuuuuguauuuuuaguagacaugggguuaugccauguugcccaggcuggucucaaauuccugggcucaagcaauccaccugccucagccucccaaaguauugggauuacaggcaugagccacuguacccagccuggguuaacaauucugauacggcuacgcacauauacugaaacugaacaauuaaguacauagaugguggauggagugagaauuuauacauaaccaaggaggagagauauaguguccaugugguaauacguuagaguaggaaacauccggaugaacuuguauuuagcuuaauauagacuagauauuauagcuuaauauaaauacaacuaguuagcuauagaaauauuuauagaucugcauaacauaagggugaacauggacaaauacauugccuugcucuaucaacugagaagucuuaaaagcaaagaaacuccaguggcaacgagcauccuuaacauccagauuuuaauacuauucuccaauaacauuacucuccaauaaaaggaacaagggcuccuuggaggaacagcugauucuaggauuagggcugaaaauaugcaagaugagacugcagcaucuuguaagaaaaaaaaaaaagaggcuaugucaaaugagcauaggaaccaagugaaagggcuucuaauagcuaaagccggaauaauuugagcaauaaaaauuaugaaguagugcuggauuagaaaucaaaguacaauguaaauauccaugagucuaaaugacugaaugaaugaauacauaaauaggaaaaaagagacaaaucuccugcgcagaagaauuccaaauaauuuauguagauacucugcccucaagaaaaugaagcauaauucucugcuccuuaauugugggcugugcaaacugacuuccuuccaaagaguagagcacauaaagugggaagacgaguaauuuucaaguggagaaacucaacaaccaccaccugagccaggugaucaaggucaaugccaacagggcuguaucauguugauaaacacguacccuugauaugaugugaugaaaugggcauuuuaccucuguggucuuccuucuuaaaaccaauaaccccaggcaaagcaugagaaaauucccacagaggggaauccuacaaauuaucugaccaauacaaaaccuuuaagguuauuaaaaaacuagagaaguauaaagaaacugucauagccaagaggaaaggaggcuauggagaccugacaauuaaauauaaugcgccuuccuggauggcauccuggaacacagaaaggacauuagacaaaaacuaaggacaucugaauaaaguauagacuuuaguuaauaaccauguaucaaaauugguuuacugacugcaacaaauguaccauauuaauauaagauguuaacaauagggaaaacuggaugcaaagccuaugggaacucucuggacuauccucucaauuuuccuguaaauuuaaaacuguuguaaaauauaaagucuauuuuaaaaaaauuuaauggcuugauauaaaaguucacauaauaaggugucaugccaaacuccuacugacugcaauguggauggcaccagguucaagagccagaagaggcccagagcuagugaaccguaugucucauaggguuuuacugggggcuugcauacaggguagagaguccaguggugguggguuggacagaggaaccgcagccgcuugcaaaaggcauguggucucuacagcauucucauuuaacacccucccccuaacaaucuccaccuggcaacuuccacuuaacucauaacaaagggucucaauccccggcgaggcccauguuccacagaaggagaugagggcucagauguuccuuacagauaaggaauggcucucuggguuagccacuccuggauuucuuuguuguuguuuuuuuguuuuggguuuuguuguugcuguuguuugaaacagagucucauucugucgcccaggcuggagugcacuggcgugaucuuggcucacugcaaccuccaccucccggguucaagcaauucuccugccucagccuccaaaguagcugggacuacaggccugcgccaccacgcccagcugguuuuuguauuuuuaguagagacgggguuuugccacauuggccaggcuggucuuggacuuccgaccucaaaugauccaccugccucggccucccaaagugcugggauuacaggcaccggccaccccgcccggcccacucccggauuucuuaacucagaacucagaaucaggugcaccugccacacaggaucauugucagggcauguucaagucaagugaucccugucaggugcaucuaccauacauagaggcauaccuauuugauuccacaucaacauucuagccuucaaaaaaaagucuauaaaauuauuguaguugaaaagaacuagaauuaaaaagagcuuaccaacucaggcaucucaucugugguaucuauuaauaacuagacagcgcuugguuugacuuuuuuuuagaaaaaaauauaaguaauguggcauuuaaauuuuuuaaaaauucaagaauuucaaaauuaucacauauauaccgaaaauucuuugcuuuccaaauuuaaccuugucuuaggaauguaaacuaacuggucagagaauucauuccccuuuacaaaugaggaaucuugagccugaugagguuugcacaaagcuaaugacagaggugggcucaacucugaaaaccgacucucauuccaauguucaggaccccaagaaauguuacaguagucuuacuaauuuugaaugacagcuuccucauuaaccaacccaagauaaguuauaggugcuuuuuuguugccucuuuuugacugcacuauuagucauaucuugauuuuaucaauaacaggacuucuuguuacaaguauuuaauaauuccaacauucguuaaaagauggaauuguaagaguaauaguuguuaaagcuuuccagauuagggguuuucaaacucaaaccaugcuucaaaaucaccugggauccugaucagucugcagauucaucuucucccuagcuccacagccuagaucugauuuacguguucugggacgcgccugaaaacagaccuucccaggguggcucugcuucagguggcucauggaucacacuuugagaaaugauauuuggagcagggcuucucaagcuuuacagugccuaugaaucaccugggggccuuguuaaaaugcagguuuugauuggacaagucuagggugggacugagucugcuuuucuaacaagcucccaagugaugugauucagcuguuccuuccggcaguaagggucuacuuaagauaacccauuacaacuaaucucauuaagguuuuuaaaaauuuuaaguuacaaguuauugcuuuguaagacacucuuugcuuacccacuuuuaauuauacaguuuaguguuaaguagauucauaucguuguacaaccaucacuaccuuccaucuccagaacuguuuucaucuugcuaaacuaaaacccugcacaccauuaaacaacuccccauucccccaccuccacuccccauucccccaccuccacuccccauucccccaccuccagaaccuggaaaccaccauucuguuuuccaucuuuuugaauuugacucuucaaauucaaaaagguaccgcauauaaguagaaucaaguaucugucuuuuggugacuagcuugcuguguccuuuuaaaaaauaaaaauuuucaugcuucucuuccauaaaccugcaucucauccuauagauuugucacuuuuggcaccaacuuaaggacugagcgccuuuucacacaucccuaagagccaagcugcuccugguucgccuuuuguuuaauuauagaaguuacaaaauaagguagaaagaguucuagauuugaaaacaacacaaugacucaagcagaucaagugauuuccaaauauuaaaaggugauaugauaaaugccuccuggccagagaggugcacauagggugagagacaagaauaaaaauuaaaacuuaacauaauuugauaagagaucaucucugcuacugcugaguauuacuaaauaccauucuaugcagguccauguaggauacaaaagaaccgagauauaguucuggaccaaaacagcuuggagcagcuuugucucacagaaauauaauagaggccacauaucuaauuuaaaauuuccuguagccacauuaacauaaaaagguaaaaagaaacagguaaaauuaauuuuauuaauauauuuuaacccaguacauccuaaauuucaucauuucaacaugcaaucaauguaaauaauuaucauuaagacauucuacauuuguuuuuuucucccagacuaacuuuuuaauaucugguggguuuuuuauacucacagcauaguuuggacuagccagguuucaaauauucaauggccauggguggcuaguggccaccguugggcaagacagacuuagcaucagauuuuagagaucaauaauauauuucaaggaguagugacuugaauguggacagguugggguuaugggagaaaaucuaaagccaaagacacaaaccuaggcagagaaaccauaauaagcuugaauacacugagacugcaguacaccauuuuaugcgcuaugcuaucuuaacgcauacauuuuagucaaugggaggcauaucacuaggauucuauguuaccaucauuaacccuauugaucagcaaacugcucaucuccccccauuucucuuguugcaguucucauaucauaaauuguauuuauaggugugugauuaauucuaauacagaaauuaauuuaagguuuccuuuagacuugaaccuacuuuagcuuaguucaguccucuguaucccgagagaugagcugaaaaagcagauauaguagagauaauucuaaauucccuacuuuguuucuucaaaauauagguauucucacugguugcuuucuccuaacacuuuccuuucuuucugccuuauuuaaaaaaaaaaaacaaaaaacucaaagccugauagauuuuagagacgcaauuaauuaagguuauauacggggcuuuuuaaaaaccacauaauugccgacaaaauaccaaccagguugguguuccgugaggcaaaagaaccacaagucauuaccaaaaccuuaacucauaugggaagguaaaaauauacagcaugcuguuuucacauaccauacucagaaagccaugugcgagggaggcuauaaucaagacaggaagaggcauuuucacagauaacuucuuaacgggguuguagacugucacucucacgccccucacuuguucuuuccaaccuauuaccaucuggccuugcuccaacaaucugcaacucuucuuucaaggucaagaacaacaaaugccaucagucucuucucagcccuccaguucucugacuacucugccacauucucuuuuuuuuuuuuuuuuuaaagagacggggauacccucugucaaccaggcuggagugcagugcugugaucauagcucacugcagccuccugggcucagacaaccuuccugucucagccuuccaaguagccgggacuaccggcacaugccaacaugccuggcuaauuuuuuuuuuaauuauuuuuuguagagacaggggucucgccacguugcccaagcugaucucaaacuccuggccucaagcaacucuccuagcuucagccucccaauuugcugggauucuaggcaugggccacugaacuuggcccacuuuucuucuuuaaauucaaucuucuccaguuuccaccaaucuaucucaagccaaucauucuuucccucucauuggcuccucuuuucauaauucugauuauaaaguaaggcucugucuucuacucuucuugcuuucucacucagacauaucauccaugccuaagggucaacagccuccuccacucuuucaauucugaccuuucacuuagcauucccagucgcuugcugcaugcuuccaauugcaggguauuaauuacuuuuagcaaauguacuagaaucaagugcccaacugauuaucaaauuccggaaguguacccaaaggacaaugacuaauuccucauugggucaaagucuuuccuauguggaagcaagagaaaggaacagaacuaacacugaacauugugaggagcccaaaacaugacuccugcugaacacauucuauuugguuguagaacccaaccaauauaggccccguugaucgauuuccccacaacaagaggaggucauaaaaaucaugcuuccacuuucucaauagauacuuaucgcucaugaaugucugugaaucagaagaccaugggacuauaacucuacuccacucaaacucuccauacucccaaagcuggaccucaugguccucagaucauguaauacucagacacagcacuccaguaaaccacuuucuggccagaaacucauccuucccauaguuccucucccuuccauccacuacagcuuguucaucaugauccugagguccuggaugcugcagcacucucugcaguuaucaggggaggcuucacugccuucaguucauuucccugccagccuggucuaggacccucagcacacacacucaucacugcacauaucaccaacgaccacccacaugcuuuugaugcccaggcucauuugguccagccuauuucucuccuaagugugagacucaauaaauacacaaccaccccacugugcucuucaagagcuuauuaacugccucuuuuagauucuccuggguauaguccagacuuaaaaugccucacuuugggagacaauguaauuuaaccauuggaggaacaaauguuggucuauauauuucaggcauuuuccaaauaaaaaccuccaagaaaaagcaaacuuguaucuuaaaagaugcagaacuauuuagggcaaaaaguacacagagaaugagaaagaaaaaagaugucacugcauuuaacaaaagaguuaacaauauuguuaacaauaacaagaguuagccaugaaguaauuaggauauaguacuugaaacuggcaccaccuuuuaccaggcauuacaauauugcuaugaguucacaaagcucuguuagagcagaggaaaaagaaggauuugaauucugucacuguacuagcaacaccaccuagggaugaggaagacaauaucuaauagaauaacaaauaaaguaaguauacaugauucaucaagcucuucaauaaaaauguauuuuagaauuuaucaacaucccuuuugaaucauguuucaaaaaucacacaaucuguucaaacacggauagacccccagauaaaucagaaucucucucucuguuaccacgccucuguggacuuagaaaucaccacuuagauuuguaaacaaggcuuaguuucauuauuguaaaucaauuuggcaggacuuaucacuccacagagagcugaaauaauugaauuucuggacuucuaaggaagaagguuuaaguacauuaaggcuuccaaaaggaagaucaccaacucuucuuuagcagaaaaugccccuggagaauuuugaaccauuucuugaucuaguggcaacuggauguuaucaguggcaacuaagguaucugucuacaccugcugaggcucacaaguaaaaacuaaaaaguacugugaaucucugugauaauggagcguaaagcuaccacuuaagucuuuauuacuaguaaguaacggauuuuaagaaaaaaagagauacucaaaucuaucuauagauaaccaaaaaaccaaacaaaacacccagaaaaaucuaagguugaagaacauauauaauuugagacuuuugaaacaaaacacccagaaaaaucuaagguugaagaacauguauaauuugagacuucugaucagagccuuccucaauaauguaaguuuaaaaacuauuaccaaagugacaagaucccaugucagauagcagaaugagaacaaggcuacucuucaacuuagucauccucuuuuaucacuacaacuucaaucauagauguaaauggaaauuucugcuuccuuugcuacuuuucugcuugacugaauuuuauaaugaaaaacgucuguuccuuccaggcagagcacgagugucauucaaauuguacacaccaggcaaagagugaaugcauuuguuuagaugcaaaaaucauuuaaauaugugucauuauaggcugcagcacauuugcggauucggcaguuuaaaauucucuuaagcaauaaagcaaggcaucaaaugaaagugcacucaggcuucaaacaucuucagacuauguuuuccuguuugcacacagcgagccccgccuuccuuuccugaccccacucaaacagaaagcaguggaaccaugcccuagcccauccuauuaccccaaacgucuuccaggucagcaauccaaagucacgugaaagcuccaucuucaguuucccucuccagggagcaaauauuuugaagagcaagcauuccaagcaagcagaaacucagccuuuaaaucaaacuaagcuuaaaaguaagguccugccgcacacagaaggcaacagaaaagugucugaagagauagcucccauuuuauauuuaacauuuagaaaugagaaaacugugugugauuaaugcuuauaauuagaggggguuaacccuuauuucaaauaauguaguuccugucuuucauuuaaaauuauaaagaugacuaaaauguacaugaaaggaaaauuacaguuaggaucugcuguguuuuaacccagaacugugguuuuuugaagaaaaugcuggaaaagauucugauuugguaagaauaucuggauaugagaaucuucuaagaaaggugauuuaccauuuucaggccaaaggcagagaguuucuaacaaugauaaaauuaacaggcuguaggaucuucauucucuaagcuucaggugacccuuuuaaugacuaaauaaaguguguacucaaggucacccacgaggaagaaaaaggucaguucccucucuugagggacccccuccccacucacgcuauuacacagcaauucuagagauucacuucauuuuugguuuauguucaaacugucuggauauuucagggccuucgcuuuuaaguuuccauaauagggcaguugacuauuuauauaagucccuggaaaauguguauuuuuaacgucaucuagaguaggccaccuuugggggaaaacagcuaauggguuaaaaagccaacugguguaccaaguauguacaaaagacaucuuuuauaacaguucucacgugcaaaagaacauucauuaaguauaacaauaaauaacaggcaauaugugcauuuuuccagacccuaagcacuugauaaagccauauugucauuuuacacucauuuuuaguagcuguuuaauugguauuccuguauaggacaguuuuguagguuuccggauuauuucacauucucuucuuccuaguuauaaauuuugguacaacuguaagcucuccucacacuguaauaauuacauugcugagaccacaucuguuuuuuuaaaaaagauauuuugcaaaaaauauauuuaaguugaaguaucugaaauacuuuucaacgucaaacuuugagaggauuaugcuuaauuauauaucuucacaucuuuaaauuguuaaaaaugaaugcauaaauauuuccuagggauuuaugcuugauucauuugauucuuacauacuaguuguuauuuaccggcagagaaagcaaaagcaaaaaaaaagaaagcaaaaacaacaaaaauaguugauucuggugcuaguccagaaucagguugauuucugcaucaauagcaggguuucuacauuaaauucauucaaauuuaauuaguucucugcauaaaaucaagggucuaggagaauuuaauaaaagcugaaaacaauccuauccuuugccugaaacagauuuuuaucccaaaugguacucagcaauaagccaacagagaaaaauggaauaacagacauaugccauguucacgaguucucuguuuaaccuaagaagucugaauuugccauuuuuugauaaggaacugguguacaucuuagaagaaauauuccauugagucugaauucuugguggagcacccgcagaaagagaaccaguaaauaguauguaugaggccuggccuggacauaaugacucaggaaucaucaaugcaggccucugaaaaaccacugcacuuaugagaucuccuagcaaguauguguugugugagaaaauggacaaccccaggguacuccuauuaaacacugauauuuagaauuucugaauucugauucuaaauauuuugcaauauuuggaauuucugaauccuaaauauugcaaaagguggcgcggggaggacggggaagggagccugaaaggaaaauggaggacagcagaaagaaaaucagaagcagcagaaugacaucaguguggggagaaugcacccaucaaccgaugccacugagagacuguggaggacacaacagugcccagugaguccgacaaccagaaugauagcaaagagcucauucccuggagcucaaggaacagaugccugauaacaggugacuguggagggaacuggagguuacgaagaucacacaggaacuucugacuaccauauaaagaagcauaucugugaagagacagagcgaggguggaaguuaaaggaauacacagaguugaaugacuggagugagggaucagggagcucuaaagaagaggaaaaauaugagaaggcuaaauacuauugagaugugaaauuaaauacagggucaguaggccaagggucuuuaugaagucaaagaucagauacaaugagaguaaaggaccuacugaagaagcugugugcacagaugcccaggaauucagacucaccuaagaauuuagaacaaagguggaaaaagaaaacuaagcucaaauuauuuaaauaguacaacaggguaacuucuugacauacugaacaugagccuauucauguuaaauaugcuuggagaauaucauuaguccauggcuuacaaucaauucuaagcuuucaagaaagcaagagcuacaggaccuauucauaaaaauauagcaacauugggaaacuaauuaucuucccagcugauaaagauaccauccaauaaauagggggaucuucagugacauccaaaccuucaaaaaauauauuuuaaaauguuauaccacguucucggaagguaguuaacacuaaaaaagauuugggggaacugaagcugaguaauauucuugaaaauacagguaccuaaucaauaaauaaagagaaugccccccaaauuuuucauggcaugaaaauacuuaaagguuuaagaggggaguaccuacaucuauuaauacaccaaacaccuacugaaacgccacauucauguaaucacuuaauaaagacauuaaaauaggaugacaggaguucauguuuagcauuuauaaauaguauccuaaccuuuaagguacaacauaagaaucugaaauuucuaaaaucuauuaucacugaauaauauuuagaagcagauuucugugaaaauuaauucuuaaggccaggcgugguggcucacgccuguaauuccagcacuaggccgaggcgggcagaucuguugaggucaggagaucgagaccaucgugggcaacauggugaaacccccucucuacuaaaaauacaaaaauuagccaggcaugauggcgugugccuguaguccuagcuacuuggguggcugaggcaagagaaucgcuugaacccgggaggcggagguugcagugagcagagauugcgucacugcacuccagccugggugacagagagacugugucucacaaaaaaaaaaaaaucuuuaucauuagccuuaaaaacuaaggacaaugaaacuauuauaaaugaaucuaaugguauguuuuaucucuaaacacagaugccucugauacacugacuuuuuacuagacauguguaggauagguuuaacccuauuucuggaguugaauguucuuuuuauuaagauccaaagacacuugguuucuucucuucugagaucccuauguuacuucuugguuguuacauaaaaccugcucuuccuuuguugaucaauaaggaguaaguaaaguaaaugauuuugccauaaucucagaaauucuuuuaggcaugugaaauugcugcuccacaucuucugucuuucuaauguuugggcuauucuuucuuuucccuuuccuuuuccaauauuuggcuacauccucaauucauucauuaaaucuauauauuuauuaaauauguacuauguaccagacauguucaagcucugggaauauuucagugaauugacaaaagucucaauuaucgaagagcuuacauuuugaacaaaaagcaauuauuucccaauguuugagcaccgcaggaaaggguuaaccaucagcaucaugcacuacuuauucacaauauagcugcacaauuauuguuuccucuuaucaggcccucaaagccacugauuauaauacuuugucccaaccuauuacccuacaaguuugcuaguaaaauucgaagaugaccaggagcuauuugcaggauacuacaggcuaugaaaguauuacuccagaguauaaucaguuuuuuccccaauccaauuguaucaucuauuaaaagagcuaacauaauaaaaagcuauauccugaugcccagaauuuacagcguaacaaggacuaagaaagcagguaucuuagagguaacuuuagccuauuaaugacaugugcaguacaaauaaaaccacauugaauguacagauauuuuucuggacaucgaauaagagaaauaaucaaaugaauuaaugucuguccaaaucaaaaaucucuacaaguguuccaacuuuaaugaaccaacuuaguucuauucuaauuuucuauuauuauuucucaaggcuaccaacacaaacuacuuucccuggaacauccccaugaauauauuuauuuauuuauuguuuaauuuuuuuugagacggaguuucgcucuugucauccaggcuggcgugcaguggcgcgaucucggcucacugcaaucuccgcuucccgguuucaagugauucuccugccucagccuccugaguagcugggauuacaggcgcccaucaccaugccuggcuaauuuuuguacuuuuaguagagacgggguuucacuauguuggccaggcuggucuccaacuccuaaccucaggugaucugcccaccucggccucccaaagugcugggauuacaggugugagcuaccacgcccaggccccauaaacauuuuuaaaucuacaccucuucauuuucuuuacguaucccucaggauccacaucaugggucuacuuucuuucaaacaacuuuuaccauaugcuccagcucacacuaccaucucccuaccuccuaugcucacaacaaccccucauaugacuuacauuaaaaaguuuacaauuauuaauuaggauuggaaguuuccaacagauuuguagucaggagagacuauucagggaacaugagucuaguuuugaucacauugaguuugaaguuccugaacaaacacgugucacuaaaggagugaagauaaacaugcuucuagaguaaaaacaaucacaaguacaaaccucuacaacaucuuacacagggaaauucagcccuaaagucuaucaaaugggcauaaagguaauuuuauauuuguauaaucuuagguuauagccaagaaaaagcaaacaucuugugaaguugagauauagcauacaacaaacucagcucaauuaaaccacaguuuagcuuuaucuaauucaaaguuaggacgccuuuaacaguaacuugacuugcaacuucuaagcuuaaaagaaauuuuaggcugggcgcaguggcucacgccuguaaucccggcacuuugggaggccgaggugggcggaucacgagaucaggagauggagaccauccuggcuaacacgaugaaacccagucuccacuaaaaauacaaaaaauuagccgggcgugguugugggcgccuguagucccagcuacucaagaggcugagacaggagaauggcgugaacccaggaggcggaggcugcgaugagccaagacugcgccacugcgcuccagccugggcgacagagugagacucugucucaaaaaaaaaaaaaaaagaaagaaagaaaaaaagaaauuuuccagauuaaaacaaaugucuggaaaccuuaaacucaacuucuuccugccaucaaauauaggccuccuugaucgauuucuccauaacaagaggaggucauaaaaaucauucacggccaucucauuuaguugucucuucugcaacuuacucccuaaacucugugcuuaaauaacuauucuccugauuuuuccgcuguaggucuucccacuauggaacaugagcccaccccuuucccuucccaccauccuacugguaugguuuuaccccauauauggcaucuguauugugagucugccagaacgcucauacuuaggcguauuuuuaucuucguaucuuacaacgcuguuauuuuguacuuuuggcuuuucuuugucuacaguuaauauuugccccauuuaaaaaauuugccucauuuucuaugcauccaucaauacuguaucuuucccaaacgcuccaguagaacccuaagaagcaugcuaaguacaggaaaaucuuuaacgcagguaaugcaucaaugccauuuuuuccuggaggccucucuccugcgaccagccucguucgucuccuccaaucuggacuagcugcucuccagacgguugcacagcuguugccugagauuucccuucacuauaggguuucaaagccaaagccuaagacucacugacaggagaaggaaaaaaaaaaaaaaaaaaagacagacacuccugggaugcaucaccaacaaguugaaauuuaucaggggauauggaagagggaauguuuaaugaaaccacucagugacuaauaugauaaaagagaaagacgacagaauuuauccuuucacugaacacugaaacaaauauugagaaccuucuuugucaaguacuaaaaucugaauauuuccuaacagccuuugacacugaaauuaaaauacgucuuaauccagacuguagauucaucuuuaugucguuucuuauauccaugaugcuuauuuguguaccugaaaaaaagcauauucuuuuccucagugcuaauugagaacuggcuuuaaaaauucauucuuuauuuaaucacaaacaucaaauaacuuuuuaaaaauauaauacgugagaaaaaaauuguccuuaauuucauuucaguauucccuucauaauaaguaaauaaacaguucugcuuuuauggguauuaucuggaauuauaaagauaugcuguaccuaauucacaauaguaaacugaaaaauuuuaaguccacaaagaagcacuuguuuaguucuuuuccuagggaagaaauacaucaaaaguucccauaauuuauuaugagaagucuaugucuaauauauuuuacauauuuauauacuauuuuuaauguaguucauuauuuaaaacauaaugaaagcuuggguuucauggcaaaggcugaaguuaauucaguuaaugccauuauuuuauguuguauguaagcuacucuucuaccccaagaaucguaauaauagcugucuguaccacucuaaacacuuccuuaaauuucauauucuucaucuggcuacaauuauccacauggcauaaaccauagagcucucaaucccaaaaucuuaaguuuugucacacacaaauucuguuuucuacuacagcugucuggaaaguuauuuacuggcuugaaugguuaaaaaaaacaucaaacucggcagggugugguggcucacgccuguaaucccagcacuuugggaggccgaggcgcggaucaccugaggucgggagcucgagaccagccugaccaacacggagaaaccccgucucuacuaaaaacagaaaaauagcugggcaugguggcacaugccuguaaucccagcuacuuggcaggcuuaggcaggagaaucacuugaacccaggaggcggagguuggggugagcugagauugugccauugcacuccagccugggcaacaaagagugaaacuccaucucaaaaaaaaaaaaaaaaaaucaaacucaagacaauaucucaagauuuuuauuugcuuuggaaaaugacacgaugagaagaggguucugaagacaaaggggaaaacuguuuccuuucucugcuugggguagggacugauggaaacacagugcuugagaaagaugcucagaagcggcuagaguagaaaaagaacuuugaagaaaguccacuuucuucuuugauuccucaucauaaccauuuguaaucauuuaccucagaauaaaagagaaaauuccacgacaauaaacacagcuugagguuagcuagaaauacuguucacauuaaauuuaugguaaaacagcaagcugaaauggugugggaauuaucuaauaauuuccaagacugaauuacgcagcuauaaagcaacagcagcuguuuacugguuggcccagaaaaguucacauuucagaccaccagaucagacauaacaguauuaauuccucauacagggagaaauuuuugaagacucaacauaacagaaauccaguguucagcugauacguuauuaaaucugacggcauuuuuauggcauuuuuaaacuaugacacagcuucaggaaguccugaaaacuugagccucuaaaggcauuuuugucuuuuuuauacaacauaggugcaaaaagcugaaaaaugugaccaugaccgugugaaauuuaaauuauaccuuacuuuuuauuuuuacuucuguggaugccagugucugucuuagucuguuucucccuauauacacuguauauggaaaccaacuaaaagccuaucuaggccgggaaugguggcucacgccuguaaucccagcauuuugggagaccaagguggguggaucaccugaggucagaaguucgaaaccagccuggccaacauggugaaacccugucucuauuaaaaauacaaaaaucugcuaggugugguggugcacgccuguaaucccagcuacucgggaggcugaggcaggagaaucacuugaacccgggaggcagagguugcagugagccgagaucucaccauugcacuucagccuaggugacaggagugaaauuccgucucaauaaacaaacaaacaaacaaagcagcauccauaagaaauuaacacaaaauauguuuagcuguucauuugaaagcaaaugacugggguuauaauucacuuguaacacuuaauaaucucaaaguuuugauuugugaauuccauuaucucuuggagaaagcuacaacacacauauaauuaguggucuaacucaaauagugcuggaauuuccuauagaaauggcuaagcaugaauaaccaaagucgcaggugauuccuaagauucugcucauuuuuuaaguuuuuuuuuaaguuuuuuguuucuuucugcucauuuuuuuuacaugacugaauuaaaauagcuuuuaaaaaauuuccugcuuuccgccggguugugguggcucaugccuguaaucucaguacuuugggaggcugaggcggguggaucacgaggucaggaguucaagaccagacuggccaagguggucaaauuccgucucuacuaaaaauacaaaaaaaaauuagccaguagugguggcaggcaccuguaaucccagcuacucgguaggcugaggcagagaauggcuugaacucaggaggcagagguugcagugagccaagaucgcaccacugcacuccagccugggcgacgaagcuagacucuaucucaaaaaaaaaaaaaaagaaaaaaaaauccugcuuuccaaagauuacugguaucuuuuacuggaaaaugguuccuaaagaccauaaucuaggugcaguacugguguuuaccgcuacugaguuggucuuuuaggccuuuucauuauuuuuaggccugcagcggacaguauuuauggggaaaaaauguuaucugaaaucuacaacaauauguuauacugagaaaugauaccuaaaagucaaacucaugacuacaggguaucuuuuuaauagauuauauguuacaugugaaucuucuuuuaccacaucaaaauucugauucucaaauacaugggaugauugaauuaaaauaucacacaacuauucacuuauguuacaccauauuacuuaugcaccaggcucagaauuacacacuaauacuaccaccauuaauagaaaaacaguuguuucuuuacccacaucuucuucucauucuuccccauuaaaguuacugucacaacaaggcuguuuauuucaccugggugcaggcaggcugaguccgaaaaagagucaggaaagggagaugggguagggccauuuuguaagauucggguagguaaaggaaaauugcagucaaaggggguuguucucuggggggcaggggugggggucacagggugcucagugggggaguuuuugagccaggaugagccagaagaaggaauuucacaagauaaugucaucacuuaaggcaaggaccggccauuuucacuucuuuugugguggaaugucaucaguuaaggcaggaacaggccauuuucacuucuuuugugauucuucacuugcuucgggccaucugggcgaauacgugcaggucacaggggaugguuuagcuugggcucagaggccugacaguuacagaaucucuuuauugucacagcauguagcuguggaauacuauauuaucauacuuuuuaccaucguugagucuuaguuuuuauguuucuccuuaaugcucauuacccauccuuauaucaguuuuucucuagguauuuuggguaucugaaacuuguucucuagcagauucuacaggaaaauaaugugaaaauaugcccugaguuauuguacguugauauuuauuucaugugaucauaucugaaugucaguuugauugaauauaaaauccuuguuuuggcugggcaugauggcucaugucuguaaucccaggacuuugggaggccaagauggguggaucaccugaggucaggaguuugagaccaaccuggccaacaugaugaaaccccaucucuacuaaaaagacaaaaaauuagcugggcgugguggcgggugccaguaaucccagcuacucaggaggccgaggcaggagaaucgcuugaucccaggaaguggagguugcagugagccgagaucacgccauugcacuccagccggggcaacaagagugaaacuccaucucaaaaaugaauaaaauaaauaaauaaauaaauaauccuuguuuugcauuggcuuucuuugauauguuaaauguugcuuuauuuuccuuuggcauaaagcacugcugucaaaaaacucuuauuaaaauauaguuucuuuguaagugaaaaacaaaaauauuuccugcccucaaaaauuauaaacuuaguuaccaaaaagcaaaaaguacuauguguauacauaaaagcaauauacauucauuaccaucuugaaaacaauuauuuggauauaaacuuuaaaauuauaaaauaauaguauucauuauaaaugaaugaaaacaguaaugauuuuuaaaaacuacuacucuuaucaugaccaauuaccucuucuuuuugaaaagugaacuaguuccuaccuuaaagacuuuguugacccucugucugaauaccuaaaauacaucuccuuucuugccuugaaaucuuauccuugaaaucuuggcucacaaugcuacuuccugucaagucuuccuuaaauuccugagcugaaaucccauccccuucaggcccacuaucaacucuguaagagggaggcccacauuucacccaccuccaggggcucacacacugugggugaucaauaaaacguacacaaugaauacguaacugaccuuuuauuggucaauuuuguaggacuuauuucucugagaauauucaauuaacuacuuccuaagguggaaauuuggaaaagcaauauuuaaaauuguuuaaauagauuuaaauaguaauuauuuuaaauggccuuaaguagaaauuacaggcgcuuuuacucuaucaauaaaaaaaucauagcuaaauguagggguauccaugcuuauguuaaacucaggaucauaaaucaguauuaaaauuuuccuccauauuuucauaaacaauuauguggcgcauauauuuuauuacaccaacuauaagauuugcaaggcauuccgccaauaacuguuauauaaaaaucaacuaaacacaaauuuaucuaccaggauguuuaucacagcaucauuuauaacaacuauuacaccaccacaaaauaaagaaaaccaccuaaaugaccauaaaaaagaguaaacacauuacagugucuggugugaugcuacauuaaaaauuaugcucuccaagaauauuuaauuucacagguagaguauucuaaaaauguuagguguaaaaagcaagucacaaaacaggaaacgauuaaauaacacuaaaaacaaaagcaaaacauacaugaaaaaaauguagacugcaaggaagccaaaugguuuugauuauuuuuagcuagugguuguauuuucucaacuuuguacguugaauauauguuacuuuuguaaucagagaaauuucuuuugagcacacauuugcaauucuuagcauguacuacaaaucagauguccauuagccuugcuauucauuuuucaaagcaauuacuaacaagccuugggacaauaucaugccaaauaagcuggguuucuuuuucucaccuaucaucuaggaccuacagagauagauaaauucugugcuucaagaaaauaucagcaaagcccacucauaagccauaacagcaguuuuucaaaaguuaucguuucuuuuuaaugccucguuacuuaaugacaccugaauacaacuccaguaaagaagacaaaacugaagauguaaugaaguauaaaucacccaugcuauuagagcucuuaucaaucaaaacauuaguuguuaaaagucccagaaagaggacacaauaccagguacaauaauuaaaaugaaaagaaacaaaacuggaaacggagccaagaaacaccacuacgcuuccuucuuuucaaaaugcgauuguuaaaaaagucagucuccucaacucauccucuguccugaguuuuagaaagcaaaucaagcaggagccaaugcaauugaggcaauuauggaacuugggacagggccaaggaagugcugcagugagccauggaggaugaccuaccuagaagggcuccauuuuuuuuuuuuuuuuuuuuuuuuuuuuugagacugagucucgcucugucccccaggcuggagcgcaguggcgcgaucucggcucacggcaagcuccgccucccggguucacgccauucuccugccucagccucccgaguagcugggauuacaggcgcccgcaccacgccuggcuaauuuuuuuguauuuuuaguagagacgggguuucaccguuguuagccaagacagucucaaucuccugaccuugcgauccgcccaucucggccucccgaaguucugggauuacaggcgugagcaccgcgcccggccgaagacaccauuuuuauagguguucuugcuuaaucaaauggaagagggcuucacuuucuaagucuuccucacccagaaggaaucugugagauaaauguaagcucuucccauucuuccuucuggccugaaacaaauguggcugccauaugcaauuuuggagggaaaaaaaauuaaggaagaucaagaaucuuccugaagaaucagugaugauuaaugcugcuuaaauuuuguugaagaucguaugaaugaacguuauuuucuuuuauuuuggcaucaugguguuuucaaaacuaaaguguauuuucccauacuguauguauaaagcucauaaaguacaacuaccaagagauaaaacaaauuaaugaucauucugugucgacuuucaagucuuuugacuuuuuucuauuauccuucaaugguacuacauacaaauacaaaauuauauguacugauuucauagucuaucuuuugcugauuauaaaagcuacucauuuauuauacaaagucauagaaaauugcuuaaauaaaaucaaaaucaccuguaaucccacuguugggagauaaacacugauaagauuucuuuuccggacauguuuucuuuuacuuaguaugcugguucugaagcaugauuaacguugaccauucaaaggucccaugggaaggccacauauaaaggagucugaugucucuccaaggauggcugauuagccuuuccugaugaagaaaugcccagcaauucuggucauuccuuaugagaccaugauguaaacaaucaagaacauucaagaauuugcauccuucuuguaugcagcagcugggcucauuaaauaaugagaaugaugaagucaucauucucaucacagugcauguauaggucccacacaugcaucucccaugacuucaaaauuaguaggauuuccacagugcaggucgguggggagaggaggcgccaugggcaccaauucucuagcacacuggauuacauacggggauuuacaagauccuuaaagucuacaauaaaaauguuuuuccauccucaucgccaucuuuaaaguuuggugaacucucaugugacauuucugacuauuguguuguacugaugugucucaagagaguuguuguuuacauaaauucaaagaauuacccugguauaaaaugucacaguauucaaauacauccuuuccaugcuaaagaagauagcuguagauaauugauacaaaggcagccaagaaacccagaaaacaaggcaugcuuuuccuaaaauuguauuaaaacaauaaaauucaaaauuaauaugaauugaauaccuuucucauuugaccauaucugauaagauuucuggucauuacuacuuacacauuuggaaggucuuaauuacaaaaugaaacagaaugacauuuaagguaaaauucuuucacuuguaauuccuuuuuuggauuaagcuauuaaccugacuuugccccaauaauucaacaguaauuuauuuuacgcaauguuccuugccuuugcuggucagagacaaguacagaaaagugccaauuucaacaguggaucuauuacaccaugaagagcagucauucaaauggaaaggguugaaagcuuugcaaagaaaauauucuccuugaguaacaguaaugaugugcuugaaucacacaugagauaauuaauaaaauguucacaugauuaagaugaaucuuacccucugguuccagagguacuaccaaaagcaaagggugagaugagaaagccaacuuauucucaagggaaauuauccacuccaugggaagaaaguggcaacagcaaccugacauacuuuccccaugcagacaagaaauguauagcacauauguccgaggcaaaauauuacagaaaaauaauccagugccacacuggauccuucaucugauaaagagguuaggaagguuguaugccacacauaacaagcauuuuucucucuucaagcuuuguuuugaauuuuaacacgcuuaauguuuaagauaauuuuauuuuguuugcuaggucaguaaaaaaaaaaaacucuugucuaaaacauauauuuggauacagucaagagauuuuagagcauacuuauguuaaugcugaacaguaauucuuuguuaagcaggaauaauauguaagaauguuaccuacuacuacuauaaaguagaaaacauaucacauggagauuuauccuauacuaggucaugguugucuccucugucaacacaacgauagcugugaguuucuuuuuuagugcuauugucucuaauucauagugaauauuuguuuuaaaacaaauuuuuguguauacuguaaaaaacacuggaccaauaaucaagagagcuuggacuguagugcugacucucccauuuauuugcugugaguuauagcaagaaauucaaccucucuggaucuugguaguuguauagccugugaagagagacgaagaacuaacacugccugucuauuaagugcaaguaaaauguacaucaguuacaccuaugucccuauguuaccuauguuacaccuauuggaaaaccuauguuuuucaguuccuuuuccugaaagacaaggcaugcucuacauacucuaccagguuauuuuaucaacucuguauuauacucugggcuugagaccuuuggaaaauuugccacuaccuaagaaaaaagcagcaccuauauuccuuaauucuaaucuaagguuaauaacaaaguaagagacaacauaugcucuacuugucauauuagggucuaauuucagguccaauggaaaaggaccagugauucauaaaaugagaaaauaugguaaaaugauucaacacgccaaguaccuacaggaaauagcaaaugauuaucuagucccauaguagucaagaacaguuagugucaacgugcucauuucacaucagacacaaccagaacugagaaauuugcuuaacaugucacaagugacccaacuuuuugaauuauguaccuccacaucaaaggagcccagaaucuguucggaggaugaaagagaaaucugauaaugguugauggcaaagccuuggcaggaauaaacuccuucccugagaaagaauuauuuuauaggcuucucuccauuucuccuugccagucuccagccugugcuucacagcuggguaauuaucugucaguggaaugauauauuuucaagugguucucuuuccauaaugguuaaaaacauaaggugaggacaggucauuaacuuuacuaucaaacagguauuugguagaugagauuaauuauuuaaaaccacauuacuuaggcuguuguuucccuaaauggugcauaaugcaguguagcacaacaaauacaaauauuuggacagucuccguguaauuauaauauuauuauaaaaucuucugacuugauauugagaucugagaacaucuuuuauauccuuuauuacuuguuguacuguucguucacuuggagguuuuuuuguuuguuuuuguuuuuuuaagagacggggucucauuauguugcccaggcuggucucuaacugcugggcucaagcaaucuucccaccucggccucuuacagugcugggauuauaggcuugagccaccacacccaguggaaggagagcuuuucagagaugaggaggcuugaagagcaggggcaaaggaagugaucaacagauaggauaaaauagaccugggguucaaaggauauuugcuacaacaacuggcacuagguaguaaauaacaaucuuaauguggauuucaucuuuccaucaacuuuaauacaaaucauucugaauagaauaugaagcagaaaaaucuauguaaaaugauaaguucacuucugaaacaugacugcaguuuugagugucauaccaggagcaauaaugcccauccaaagcccuaccuguucucagugagcuuacauucuaaugaaaauauauuuggaauacuucauagaacagguaaguaagaaccaaaagaaacaaaucauuaacaaagccuggcccaucaaauuaacagacucaugaucuacuuccuaacuuguacugaauuguucaaucucuguguguuauuucuugguguaauaacuaagugaguauaaaauacacaguuccuggggacagaugacuucuauauuuuuuugaguaggaguucuguaucuagaauuuaagugcugcuuauuuucaucuaauuaaacugcacuuuuugaugaaccagaaaagaguugaggccuuauaaagcauauaggaacaaggaauaaggaggaaaaaggaaacucuugaauuaucagauguuuaagaaaucuaguuuucuacacucucuucaucaauuacauuguaaguaaauucaccaggugaaaucuucuuucuaaugcccaguguuuucauuuuaugucucaaauuaugcacaugaaugaacagcaaucaguaugcucuuaggacauucauuuuugaccauauauuacauagaucuccggaaucuucaguaaauauccuuacuuuguaaguuugcuguuggauuuucuuugaaauauuccuuuuaaccuuuauaagaagucaucagaauauacaucaauauuuguccacaaucuccacagacaaucucuauauccuuauuuacaaccugccuacugaugaauacacuuguggaaaacaucuagauguaagauaccagagcaaagaacuugacuucugcaaugacuggucacauaaaaacaacaacuaggaacagacuaauaaccaaguuagauuaaauauggaguaugacaguuuccagaggaaaagagcacgauaccacauaaaacuacucaauuuuuuuaaauaaaauguugagguaaauuugagguuugugacaaaacaaacauuaaacauuaguaaucagacuguuuccuccaguuugauguaagcagaaaaaaagccuucccaauuccaauuccucuacuaucaccaaauaagaggaguaguuauuguagaacagccuuuuuuuuuuuuuuuuuuuuuuuuuuagaaauuaacaaaaugcugcagcuucacauuagauucuuucuucuagaaagucuaugugaagaaacacacaaggccccuguucaugagaaucaucuaugcgauacgguaaaauaagaauucccggauccgcuacuauaggcauuuuucauucaggaguccuggaacuggcccaggaauuuguaauuucaauauacacccuggguaaauucauucugaggcagggaacucaaaaauacugcuccuauagggucagugcacagaauguaacugcaagaguccaaaacacaguacaacacagaguggcaaugugcugaagaacaagucuguguaugugaccuaacaggagcauccucuuuuucuucccucaagaccaggcccccaaucaacaccagccccacggccggccggcucaccuaagcagcgguagggaaucacaaaguggggaugggucuugcacugcuugcggccccgcuugcaccaguucuggauggucacugguugguuggcuucuaccacauuggugaucugcaguucaggguagaccugggagagcacacaaaaagaaucaauuguuacuugaggcaggggcuggcauuuacaagcaucuaacaagccuccacuguaagguacagguggagugucccuuauccaaaaugcuugggaccagaagugcuuucaaggucucugacuuuuuccgauuuuagaacaucugcauuauauacuuacugguugagcaucuggaauccggaaaguccaaaauccaaaauacuccaaugagcauuuccuuugagcaucauguugacaugcaaauaguuuuggguuuuugagcauuucggacucuggauuuuuaaauuugggauacucaaccuauaccacuauccacuaagagucaagccugcucuaccucugaccaagcuaaagaaauucaguacaaagaaaaagauagcaaaugaacaagcaucuagcuauuccauucaaaauauuaagcaaugcaacuuuuuaauuuauuguacucauuuagacuuaaaauauuauuuuuccaggggagcuaaaauagaaacaagagggggaaaggaggauucuuacaagcauggggugauuuuugaugugaaauaaauugguguaggauaauagucuguaauguccuaaacaaacguuacaguagauauggcuggggauauuauguuuaguaaaauucaaccucccccuaucucucacuaaucggacaaacauuuuacaggauaugacacauagaaagcuuucuauauaaaaauccugcucuuauuccaaguaauuuacaugaaaauaacuuaucgaaaaguuaucaagggugucauuuagauaaaaauaaacucaugaauucucuuugcuccuauaacuaacuacagccccuugcuuugauuacuguugugaauacaucaugguguuuaacugagcacuuagaaugaaaugugaaacuugaucaauuaaaucacauuugugaaauaucaaaccacuucuauuuauuaaugaguagagauuugaaagaaaaacauaaacauaaaaaucuauuucgaaaaugugcauucccuugcauaaaccuugcauugcaacagggugguuguuuugccagauaaauaacaacgaauagagaagugacgguauaagcaagggaaugauuagaaugcugggccaugcaaucucaaguggcaaaagugagaacaugaggggaauuagacacagguaaaaggugguagggaccaguggaaucugaguccacugaucacacuccaggggcuaaagaauguauggcgcacaggacuggagaaagugaggugguaauaaguaguacuuggagagucaaauaauugaaauuaaaauuuuggaggaguugcagugauuggucauugcaaggaguauaauaugaccauuguaagcaaugggugauggagaaugaugaaaacaaggucacuggagggaugagaaucaugaacugacaaauuggaauacuggaaggaucauugagaucaauauuaggaucacuuaagaaucagcaaaugaagcagcuacaccugaugacagcaaggcaggagcuaaaaucuucaaagucugaauggugaacaucgaugagguagaaagaggucuggagaugaccaacagguggaggagcaaagugauuugucugaaagcaugcacuucaagcugagguaggggggcuuuuagggaagagaaaggaagagugguuuggaaacaaaaaugaagaggaaaagaggaaaugaagaggaaaagaggacauucccaccucuaggggcaacgcugugaggauuuugagaaaagaacuucgaccugagaaggcuacaggagaaguagugccuuccuuggagggagaacaagguuucugagcaagauaacauccauggggaguuagacgauacacggaauuucacucacaauuguccaugacauucagagggcuugacaaaucuaaauuaauaaucccuuaucuuugaauaaaaguaacugaaucaggcugaauuuacugcuuccauuuuaauaaggcaguaggagaacuaugcauggcuugaugucaauugagcgugacucaaucucugucuaaaaaguugauauuuuguucaucauggaguuuuuuugcaguaauuuugauuuuuaaaaauauuacauuaaaaauucuuaaucucaauuccugacugccuuguuuaccucaccuuagucccagaccccaaaaaaaucaguuaaaaaauaagguacugugaaugaauaaauaacacugugggguacacaccuagaaaauggaaugucauucaacacuaaaaggaaaugggcuaugaacccaugaaaagacauggaggaacuuaacuaauauugcuaagugaaagaagcccaucugaauaggcuccauacuauaugacauucuucccacuauaugacauucuggaaaaggcagaacuauggagacuaaaaagaucagugguugccacggguuugggugguugggggcagggggaggaugaacagauagagcacagaagauuuuuagggcagugaaacuacucuguaugguacuacaaugauggacauaugucauuauacauuuguccaaacccaaaaaauguauaccgccaagagugaacccucagggaaacuauggacuuugggugcuaaugauguaucaauguugguucaucgauuguaacaaauguaccauucugugggggauguuuauaauaggagaggcuaagcaugugugcagguagcaaguauaugggaaaccucuguaccuuccucucaacuuuucugugaaucuaaaacugcucuaaaaaaccgucuauuuuaaaaacaaaaauuuaaaaauaagguaucaaucaguguagcagcaggggauaaacucagugguagagguauaugcuaagagaacacacaaagaaaucucuaaaucagaauccuggggugggugcugagagaguuauucuugaaaccacugccacaguaaccuagcuccaaagggauccugcuauuaauacuucucuuuauuuuacuuuguucuuaaguaucuuaauaucucaaugcaggcacuuuagaucacagaaaaugcucuaaaaaugccacuaaaaauuuaauauucccauggcuuuuuuccuauauaaugaaaggugaaguggcuuuuuguacaggaauauaauucucccaccgucuuuacuuguuuauuagaucacaaagcugcagcacucaugagucauaaacuguaugacaccugagaguccacccugagggacaugacuuuaugugcaguaaagugugaguuacugcaucuuucuaaaggguucuuuucacugaaagacaacccugcugagaauuuccucaggagucaucgguuuucuauaaacccaguggcaggcauauucacaucaugguucccucuauacaacuuaaaaccaacgaauuguuuguaggguacaaacugauuaccaggagaaaaggaucucuuuuucauguugguugcauaccaucuucagauuccuaugguaauaguuggugcaacagggcaguaacugauuagguugacuauuuccaaguagguagaauugcaaauugacaaauuaaaauccaugaagacggggcuuuucccuaaagacuaguacuagaacuuuauacagugaucagccaaacacagaauuuacuuccaguucccaccaggaaaucuagaacaugcguguuauuuucugugcuucagcuucucucucuauaacaccaacaaugacaauuguuaauaugcagauggauguggagauuacaaaauuugaaccaggccggagacaguggcacacaccuguaaucccagcacuuugggaggccgaggcgggcggcucacgaggucaagagaucaagaccauccuggccaacauggugaaacccugucucuacuaaaaauacaaaaauuagcugggcgucauggcacacgccuguuaagucccagcuacuccggaggcugaggcaggagaaucgcaggaacccaggaagcggauguugcagugagcugagaucacaccacugcacuccagccuggugacagagcgagacucggucucaaaaaaaaaaaaaaaaaaauuugaaccacauaaagcccaugcauaguuuuuuccuacuguccuauuaaaauggaagcaguaaauucaaccugauucaguuacuuuuauucagagauaagggauuauuaauuuagauuuuccaaacauaaugcaauuuugcuguuccaacaucaggagguuuauuuaagggggagaacauuagcaaucaagguaacaaaacuucuucugaagcagagcaagacccuuuugauaaagcaacugccacaugcacagccaacucccagcucagaaagcaaacaacgaaacaaaacaaaaaaagaaacaaacacguuaaaauuuaaaauuccaacaaaaauucccaauaucaucccuagguuuuuauuaaauaaccccaguaaacauccagagaggaaaaaaagccuuuuuauguuuacauagauauaaaaauauuuauauuuauauaaaauauaaauauauagcucauuuauaaagauauaaauauaguucauuuauauuuaaagauauaaauauaaauauaguucaacauuuuagacaagaauaaaaauuucaucagaaauacaaauguucucguggcuagauuaaguuccugauuuuuaucauaacuauaguaguccucccuuaucugugguuuugcuuuccauaguuucaguccaaaaauauuaaauagaaagcucuauaaauaaaugaguuuuauuuuucuauuuauuuaauuaauuuauuuuuuuuuugagauggacucucacucugucgcccagguugcagugcaguggugcaaucucagcucacuguaaccuccaucucccagguucaagcgauucuccugccucagccuccugaguagcugggacuacaggcacccacuaccacacccggcuaauuuuuguauuuucaguaaagacaggguuucaccauguuggccaggaugcucucaaucuccugaccuugugauccacccgccuuggccucccaaaguguugggauuacaggcgugagccaccgugcccggccuauauuuaauuuuaagaaagagauagggucauccuauguugcccaggcuggucucaaacuccuggccucaagagauccuccuguccuggccucccaaaguaccaggauuacaggcaugagccaccaugcccagccaacaauaaguuuuaaauugcgcaccauucugagcagugugaugaaaucucaaacccacacaguccagaaagugaaucaucccuuuguccagcgucuccaugcuguacaugcuaccugccauugaucacuucaucacagcgcuuguguucaaguaacucuuauuugacuuaauaacggccccaaagugcaagaguagugaugguggcguagugucauaauugcucuauucuauuauuaguuguugugaauuacuuacugugccuaauuuguaaauucaacuuuaucacagguauguaccuauaggaaaaaaacauaguauauauuggguuugguacuaucuaagguuucgggcauucacugggggucuuggaaguuauccucugcagauauaggaggacuacuguaaguaucgguucaauguuuuaauauuuucuuugcagcaucucaaaucuuacauaggaaauaaagauaaaaguuccuuaagcugcuuaauuugcauguguuuuccaaaacauacauguauugcuaauaugacaagcauugcaaauaauuugcuaauacagcaaacauuagcaaauccuaacucucauacuccccuucuuuucuaaaauguuuuuuaugugaaacccaauuccaacuauuuccuugauuuuccuuuuuaaaaaaggacucgagauacuuauacuuaaagcagaagcaaacccaagccucugucagcuaguagaaaaauaagcuguccucaaguccuacaaauuuuccuaaauuauagccacacagagcauuugcuguauaaauacguacacuguguuccaaacacacucuuaccuaagaucccuuagacuacacuucaaaugccuacgcccauuaggguccccccacauggacaaaccuccucugcacacagugaaauaaugcuaaccccucuuacagaauguuuucugguauuuaucagugugccucacaucgcuauuaaguuuguaucuguacugccugccuggugaaaagaagcuuuccucaagggcagaaaacauaacguggcauguuauagccuccccguggagccccacauccaucaucuuuggcuuucagacuaucaggaggcugcugacccccaacuccuuuuauguggugcucccacccucagcucucugaaggaggacucauuagugacuguauuucaaacucugcagcaccauccccuauagcuuauuagagcccaagaaaaccaaacuguacguagcauucuuucccucaagggcuuucacgaacacacaaaggcugucguuagauaaggaagaaacuugacuggaggugagcauaagucugagccacagguggcaugucaacacccaugggugcaugguggcuugcgccuauagucccagcuacucgggaggcugaggugggaggacagcuuaagcgaggaggucgaggcugcagugaacugggaucacgucacugcacuccagucugggcaacagagugagaccccgccucaaaaaaacaaaaaacaaaaacagaacguaacaaaaaaacaaagaaaagcccccaaaaaaccauggguggacucaaacuaggcaucuggaagaagcaguuaguccaggaaaggaaaacagggaauacucagagagacaagggaagaugagaaacagacaagacuggaucuggcagagaccggaucugacagggccugccugugcccucuaacucuuuuaagucuugggaugugcauuuggauucuaggagaugccuuguccccuucaauaagcccuauuucuaaacauaagcuccuuuaguagcuuuaugcuccuuccaauugaacaaaagccaagaaaaaggcccggcuugcaugcuaguucacuaauucccaccacaugaugcccucaaucucugugcgcagaccauucuguccuaccacugcauccuccacuugccuugaucacuuuaucugaucccugaccacuugcuaccuccuauucugcugaugggcugucuguccuauuagaauauauaauccuugaaggcagggacaauaugauucaucugguguucccucaacaguggcaaacccugggauagcacaguaagugucugauaagcauguaauuaauauuucugguuaaggucagaauccauucaaucagggacuuucaguauacauuaaguucccuuuggguauuauaaaccuaucucuuaaauaagauauucuaaauaguuguuggauuaugggcuuuugagggaaaguaaguaucucaaugccuuucaauauuguucuuccaaguagauauggacagcuuauacaaaucauagcaucugcuauaagcaguagauuacuguaaauaagcacucagcugaggaaggcauuuaggaagagugacaaguuaagcucucacuugggcuaauggggcccauucaguuaguacaggagucugaaaagcagccuaccuaccuggucauacagccauguuuuaucauugaaagugaauguaucaguacaugaaauaauuuuaagagugcauaggccgggcgcgguggcucaggccuguaaucccagcacuuugggaggccaagacggguggaucacaaggucaguagaucgagaccauccuggcuaacauggugaaaccccgucucuacuaaaaaauacaaaaauuagccgggcaugguggcaggcgccuguagucucagcuacuugggaggcugaggcaggagaauggcgugaaccugggaggcggagcuugcagugagccgagaucgcgccacugcacuccagccugcgaggcagagccagacucugucucagaaaaaaaaaaaaaaaaaaaaaaagagugcauaagaaauuccaaauccuaacaaccaggaaagagggggaauagaaacaaucuuagaucauauuauauuaauauuuuuauauauaauaauuauuauuaauauuaaaagcuuaucaucgguagccuaaguaguuuugucuacugaagaaauaccuuaaaaccuggucaccaucagaauguuuuguuccacauuuuaaaaaucugaagucucucuucucacuaucucuccaaguuggaaauauauugaucucagacaagaugacauuuaaguugcuaaauacguaaagcaagaaaagacauugaugauauuuaagaaagccaagaagagaaauguauauauuaaaaaaaaacuuuguaaagccauauguugucagaguccuacagaaacuuugucucuauucccaacauuaagggcaaauggagaaccgaaaagucccuuuuguaaacaggccaccuaagacaggugauuaaugccaaaaguccuaaaaugaccaaagguauuucaaaaacacaaaaucaaacauggcuaacaaaaggcugaaaacaaaguuaaugaacagaguaaauggaauuggaaauugcuacuaauucugaaaacaguuugccuacuuuucuacuuagucauucaauuuuuaaaauucaccuuuagccaaauucuuauuucuuuuugaaaacgcuaaaaauuaugugguacuaauaaaauguuuuaaauauauuaacaaaacgucaaugaguaacaugugaugcuuuagcacaucuuaauuuacaggucacugaaagagaugagcugaaacccgcauguguuuugccaggauugcuggagaaccugaauaguuaagggaaaaaaccugcauuccagacugacucaggaacaagacugacuagauuugaucauuacugcaauucagugacagauagaugggaggguucauuuuacuauucuuucuacuuguacauaugcuuguaauuuugcauuuaaagcacugaaaauuuaaauaaauacauuuaguccagaggaaacagccagguuucuaaauuuauaacugcaugugaaaaaggaaaaaaaaaaaaacccagauccaaauugugucugcaugacugcagcuagcauauaugaauauauacaugaaacagagaaucaaaugcucuauaccaaauuguuucagagauagccuaucuuguauauuuucaucgucucaaagcuuuuccauaccagucccuuuuucaaagaacauauccaagaagaaaguaagaaaaaugucauaacugaggguuuccuaaguaccagacaucacugcaaauguuuuauguguagcacaucauaauccugaguuaguaauuacuccaauuuauuuaagaugaaacuagaacaacuaaaaucgaugccauuucuaagcauucaaagaguauauuaaucauaaauuuuaaacuacucggacuuaggcauauaaaccaagacaaagcauguccuagacaauauauacuucuguuucuggauuucaaugacauucuuuaaauuuuccuggaauacaaagaaauaucacaucuuaaacuauucucaacaaaaauucuuuuaauaaugaggaauacugaaaauacaaucucuaacuuaauugagaaagagaacuggaaaacgaaaacguucucugcuugcaacuuaaugaggcgcugagaggcagcgugcagcugaugaaacgcuacugcaauaaugggagguaucagcaugcuauguuuccaaaugauggccuuauguaaaagcaaaggcgguaaaaugcugcagggcguuagaauauuucccaauaaucuggccaaacucugcuucugacauucuauauaaauauauuguuauauccacacuuucauacucagaguuggaaaauccugucaaagaaccuuguuugauagauaagcuauucuaauuucaaaguguugaaugaaaaacaaauugugggugggagggaagagaugggagagaaauaaaaauaaauaggacaggacacaauugugaaaacacaagcagauguguacacauagccuagauuuuccuauucucucuuucaauguagggcuaauuuucuuauuuuaaaauauccaaacugccuucaacuuuuuaacccuagaagaaaucuacggucaguaaagcaauccuuacauuuauacagaccagaaaugcauaaaauauauccacauauagacagccugaucccuccauucaaaaacugucucacucaauaugaauuugagaucuuucaaauuccaaaaccacaauguauacgugccuaugauuugccaauuuucagccuacaagggugaagggugcccauagcaaaguaauaauggucaagaauguaccagaccuucuaccauaggauaauguauauaguauaccuuccaacucgguaagauuaaaaagacuaccucuguuguuugcuuuuuauuuaauuuuaauuucauacaacuguagaauggaaaaagaaagguugagaaacaauucgugucugggaaucccauguucaguuauguauuuuagaggagaaaguugggcaaaggaaaugguuuugcucaacucaucuaacaggcaguuucugcuuugugcaggcacugcugugcuuuguuugcugauccuguuaaucuauagauuaagcaacuguucauuuaaagccagaagguuaaaaaggcagagaacagauaauguuaaauggugggaaagaaaacaggaaaaagagaaaauacccauaaaccaauaaaagagaugauaaagccacguucaccuaacuuucccaauuggaaaucucugccugcauuugaggcuuaaccuguucaaaguucccuccagagaccugcccugcaguguaaguuaccagagacaucaacaccuucaagaagccccuagacccuagccccuagcuccaagaagugcacugcauguuauuaaaagaauagagaggcuggaagagccuguuucaaguuaucucuuuuuuuuuccuuuuuuuuuuuuuuuuuuuuuuugggauggagucucacucugucgccaggcuggagugcaguggcgugaucucggcccacugcaaccucggccuccgaguucaagcaauucuccugccucagucucccgaguagcugggacuacaggcgugcgccaccaugcccaucuaauuuuuguauuuuuaguagagacgggguuucaccauguuggcuaggauggucuugaucucuugaucucgucaccagcccgacucggccucccaaugugcugggauuacaggugugagccauggcacccggcccaaguucucucuuuaaaagaggaagaauaguauggggacucauccaauuucuuguuuaacugacaauauguaacucuuacaacacuugccuguguguuucuaucauaaagugaggauaugguuuaagacugugaggauacagucuaagacugaacaggcagccuuccuggacugcucgggugacaaagagcaaugaugcccuuaauacagcaccucaggauaucaugaaugaggggauggacaggaugaucucccacaaugcuuuucacacuauuauuuuguaauuugaauuccuucucuccccaaucuaaucuacucuuggaaacaagcuaauuuuucuaaaagugucuugaccagaaagcauucaugcuaaaaaucugccauagcuuccaccuaucuccagaauaagacccuccaauuugcaaccucauucuaccuuugcaauuuucuaaauuuucuucacaauuuaauuguauuaauagauuuauaagguccuuaugggccaagaaugguaucccgccacucagcaacaccugacacaaaaaccuaacagugcccaauaaauauagacuaaauuugccuguauuaaauuugggaagaaauagauucuugagauguagaauugaaguacacuuccuuuauucuucuggaaucccaaagccuuugguuuaaguaaaacuaugugguuuuuuuuuuuuuuuuuuuuuuggagccggagucucgcucuugucgcccaggcuggagugcagcggcgcgaucucggcucaccgcaagcuccaccucccggguucacgccauucuccugccucagccucccaaguagcugggacuacaggugcccaccaccacgcccggcaaauauuuuuguauuuuuaguagagacaggguuucaccguguuagccgggauggucucgaucuccugaccucgugaucugcccgccucggccucccaaagugcugggauuacaggcgugagccacugcgcccggccaaaacuaugguuuuuaaaaaauuucauuucaucccaaagaaacaggacaauaaaaucuaacaauucuaacuuuuagccccugguuuuagaauauguuucaaggggaauauuauuuuuguuuuguucuauuuauauuuauaaauuccucaggccaaaauuuugguacuauaauaguuuauuaaagcaaguggccacuuuaugcuguuaaaugaugaauaacugccaggcacagugguucgcaccuguaaucccagcacuuugggaggccaagacagguggaucacuugaggucaggaguucgagaccagccuggccaacauggugaaaccccaucucuaguaaaaauacaaaaauuaucugagaauggugugggcaccuguaaucucagcuacuugggaggcugaggcacgagaaucacuugagcccaggaugcaaagaaugcagugagccaagacugcaccacugcacuccagccugguugauggagugggacucugucucaaaaaaaaaaaaaaaaaaaaaaaaaagaugaauaauugacguaguuguauucgaguuguuuccauaaugcuaugagagauacuuuuugcuucuaguauaaauaacagaggaaaagcacuguuuucuaucaaagaaugucaaaagaaaauaacaacucaacagucuacuguggucaucuaugauucacacaaacuacccuaaacacuaaacaaaaagaacaauauaaggauuuugcaugcuuaauguguuuggaagcauacuuuguaauauuacaaccaaauauuuuaagucauacuauggauuuaugacuuuacuauugaauuaucauggccuuugcauuugaagcggauaaaaacaaacugaaggcaaaucuggacuacacgccaacauuccaccaacucuugccuaaacaugucuuuagaauucugucgauggaaggcugggugcaguggcucaugccuguaaucccagcacuuugggaggccgaggcagguaaaucacuagaguucaagaccagccuagccaacauggugaaaccccaucucuaccaaaauacaaaaauuagccacaugugguggcgugcaccuuguaaucccagcuacucaggaggcugaggcaugagaaucacuugaacccaggaggcagagguugcaguggguugacaucaugccacugcacuccagccugggcgauggagugagaucccgucaaaaaaaagaaaaagaaaaaaaagaauucuaucaauggauagaaauggucucugcaaaaggaaaguauaggcuccauuuuaugggaagcucucucagcauaagcuggauacagaacuccugcccauuaccgcuccaaucucugugccagaaacuaccauccacaagcauuuaccuaacgacgacuagcgugcucuaggucagagcuaaguguuggauaaaauccacuguaaggcaugaucccuagaaauguuaauucucacaacacuuugggucuguagggcuuuugccuacagaagccacaguaggucuuugucuuagcucaaaaugcugccuuacugugaauggcuuaaacaacaaaaaugucuuuugucacagcucuggaagcuggaaguccaaaaccaaggugccagcaugaccgaguucuggugaggccgcucuuccuugcuugcagacagccaccuccuugcuguguccuuaugugacuucuucguuugagcagggagaaaaaggcaagcucuuugguaucuuuucuuauaagggcacuaguuccaucacgggggcacauacucaugaccucaucuaacaguuaucaccucccaaagguaucaucuccgaauaccaucuccgaauagccugggguuaggguuucaauaucuaaauuuugggggaacacaaacauucaucccauaacaguccucaauacauacuugaaaaaaaaggggggaaaaaucucaaauggugcuaacacaaaauauuuuuuaaaugcauugaaaggcagguauuugaccaaugacuaggcagaagcaaaacuauuacgauugggaaagaggaaagaauacauaagcacaaagaauuuggaagacuugggauuaaacaaagacucaauuuaaaccauaagauccaaguuaucuucucaaucaaacuuuacaaggguuuauaaccaagagcaaaaauaaaagacuguguuuuuacuuuuucucuugaaccuugcccuugaccaaaaccugguucaaagaaucaagggcaaaaaaaacacuaugaaugauaacaacaaaacaacccaguaacacaaaauacaaauucagagaagcaugagacuaugaaaggagcagaguagauaauucacagucaaaguuauguauuuaucaucauguuaagcuaugcaccaacauguauacugcaaagcaauccuuuggaaaaacaaauuaaacaaugaguuaaacuugugagcaaaaagucaaaacgacgugacggugaugaguucuguugguuuuguucuauccuaggaccagacuguuaacagccaccucagacuuagccagcuaguuaucucuaaaauauuuuggucaugagagacacaaagugagaacgcaaaguaaaaaauucauccaccacuauugggagaaaaaaaaaaucauuaaaugaguagcucugucaaugguaacuaaugguuuccacgcauuuuuuucaaaaaaaaaaaaaaaaaaaaagaagaagaauuugcccaaugacagauaccagaauaccgugaauuuucauggugcugaaucaaacacccaucaaccaggaauucuauaccuaaugaagcaauuguucaauaauaagaaaaacauuguucaacaauaagaaugauuaagaugaaagucauccaacaaaacggaaucaaaauauuaauguaauacaggguuugagaugaucugaugaaaagacuagcuguaaacaaugaguccaguuaaagacagacccuaugaaugagaaguauggcaacagaggagaugguaagauuauaacuuugaaaauauaaaaauaauacaacuuauaaaaccugugagaaggaaacgugguaacauugugagaguauucuuuuccuugccguuccuagcaaugaauccaucaauacgguuuaaaaaauaaaaacaugaaguuaaaaaaaaaaggcaaaacgaacacuuuccaacacacgcaugaaaauccaagccuacaaaugagaacuauucauuauuucuaauuauaaaagaaaaacaccagaauagcuacaauguggaaaguggcaggaagauccugaaauaucuauaaagaauguucuagagaauucaagaugcacaauuugaaagaaaaugucaacacugucuaaaacuucugagugaacuugucuccccugccaccugcucaauacuccccaaaaagccacuuaaaauccuaaugcaugaugcacucccucaccucgcccuguccagccuacaagccuuuucuaauccauacccacuguguugcagcacuggggucauucuucuauuuugcccaugccauuccucaucccucuucuggcaacagcuccucuccccacaucacacggccacacccacaaggccaagaugggcuaguccugauacugagucccugcagauacggugguggcuccaagggcagacguguaacucaaagcagugccaaccagaagcacucccugauaaugcccaugggcagaacaaaguugggaugccaaaccaggacuaacacuaccagaggucguggcuaccaacaucccuggucuccuugaggacacccaucuuagcaggagaaaaggaguaaacacacagcaggaagguaagcagaaacaaaagagacccuaauggggaaauucuaggcaguacugacccucgguuccagcaccuagggaucucauuucuguguacauuuuuaagaaauuggguaagcaucccccacacuacgauccuucccaucagugggagaaaauauucuccauauauaaaauacaaauuguuuaggggguuuuuaucaccuggcaaaagaaacugccuaauuaacccacccuaucuccccauucuuccucagaaaaggagauguucccuccccuuuccaagacccaggcaaucacauauccacuggaucuccuuucugccuaguucuuacagaacugaauaccauagucauagcuuacuguaaccuuguacucuugggcccaagcgauccucucacucaaagcgcugcgacuacaggucugagccacggagcucggccaaaaccuaguucuuaagagauaccugcaacuagugcuuaggauggguaucaguccuucccacaguuuaguuuaagcuuccuuaggcccaaauuccuuccauuuaaaaaucaaaaucacaaagccuuuccuuuugucuucaaugaccucaaagcuuuuugccucuaggucuuuccuccaggaguccacagcugacucaccauugacccacguuguuuuuccugcaauggacuacaacguaacuucuccccaugcuauuccacagggucaacaaugaccuucuauuugccagauccuaacaauguuuugucacacacacauacaaauguccaaaaacaagauaugagcaaaagagauugcuggguguccuagcauugaaaugcagguguugucuugcagacccugaggguggcggggaaaggauuaucugauucuacagcauguuccuccaguugacuugcuacuaaauaagcuauuuuacgacuuacacccuuaaaauucuuacacccuuauuacuuacauccuuacaagcuauuccacacccuuagagcuuuguaaagauggauacugcagacaccccauagcaaugcaaguguuccuguaccauggaaauaauuugacgauauuccagauaauuccagaugauuccuguucauagccaugcaacucaagugugcuggggaaggaauuuuaaaucucuccaagucaaaaugaaccauuuuucacaucuuacaguucaucucauuaaugaauugaauaaaauauuugacauguguucagucugcaugacagacaugauuuuaccaugucaaaaacuacacuucaacugcuuuccguuugcaucaugcuugcacucuuaucuuuccccucauuuagaaauuuacauggcuugccuuccagcauguaacgccuccuacuuccuauccuaucucucuggccacugcucaucucccucauggggaaucgucucucuuuguuugccuucaaugcugcaauuccccaaggugcuuucuucgguucuucuccacaggugucacugaguggguaaaaugagugcaaguacuuagcauaguagcugacccuuugugacccuuugugaaugcucaaugcugaugguauuagugucacugucaccauguaguuuuuagauugcuaaaauuaugauuuuacaagcuuuucucccccuuugaagaacaggcccuguguucuguucaucaaugcacccuuaguauccaaagacauuaugucugaggaggaagagagcaccacaggguucuagaaaggcauauaaucaucuuacauccaaauguauuuaaugaaagauguauuuaaaaggaccccaaacaagccuuguucccugacuugcaacaugcagugaaguucugguugaagguauggagggacucauuucuaccucccucucccacuugccagaucaugggaucuaagacccuuacagcucagagucacugguggcucgggauagcacagagaacagcacuguuccacggaaacagaaugcaacugccuauggaaccucaauuuccucacugccacgugaaacgucaaaagaaacaagugaaaucaauuuuaaucacauaguuacaacucaguaacauuuaugauguauuuaacaacauauucaaaacauaacuauuucaauguuaaaccuauauaaaaaugaaugugaucauuuuacagguuuucucacauuauaucuuugagauacgguaucuaucuuacacuuauagcacacaucaguuuccacuagccacauuucaagugccaaacaaccacauagggccaguggcuacaguacuggacagcacacggcuagaggcugcagcauggcagucucugggagaacgaagauauaugguaggggacauagugauaaagcaagaaggugauuuguuuaaaugcaaaucuacaaucacuccucuucucugaaaaaauaaagucuaggccgggugcggguggcucacgccuguaaucccagcacucugggaggccgaagaggguggaucgcaaggucaggaguucgagaccagccuggccaacauggugaaacccugucucuacuaaaaauaaaaaaaaucccggcgugguggcaggcgccuauaaucccagcuacucgggaggcugaggcaggagaaucauuugaacccaggaggcagagguugcagugagcugagauugugccacugcacugcagccugggccacaagagcaagacucugucucaaaaacaaaagaaaaaaaaagaaaaaaauaaauagauaaaaaauaaagucuagugacuuccuguugcuacaaaauaaagcccaaauccauuaaaauggcucacaagguaugauguuuuggcccuuucuuacuuauggcgccuaauguugaagaaucuggcugguguguaucauccaacaagacuuccgugggugggugguaggcagaggacagauaauaccagaauugcaagaggaaggugacagcaaagggcuaauucuccccacucaugguggccaccaacaaucugguaaaguccagaacugggaagaaccacucugugcucaacccuuugauacaguuuggcucugugucccuacccaaaucucaugucgaauuguaauucccaguguuggaaguggggucuggugggaagggauuggaucaugggggugguuucaauguuuaagcaccaucccucgagugcugucccgugacaguguucucaugagauccggguguuugaaaguguguagcaccucucccuucacacucuuucucuuucuugcucuggccaugugaacaugugucuucuuccccuucaccuccugccaugauucuaaguuuccugaggccuccccagccaugcuucccauacagccuuuggaaccgugaaccacuuaaaccucuuuucuuuauaaauuacccagucucagguaguuuauuacagcaaugugagaacagacuaauacacccugggacaaacaacaggcuaagacagaaaguaaagcuacccaggcauuaguaggaucucuaagugaaacgggaaaagagggguguuccuggggucaagaagaguaauuuuugguauggccaccauacaaaugugaaaacaucugguuauucauacgugaaacuaagggaagaaaaacuuagaugcaaacuaugacacauguaucaaaauagucgauucaccagaaaaggacaauuuggucaaugucauaaacuaaauuuuaauucuagccuuuaaaaaaaguuuauuugacacucagaauacauagucuguaugcauauaucaaaaaaaugguaucaaaaacauauaaguaugcacagaguucugauuuauaaaauuuauaacuuaucuacacaauuguacuacaagaacucuucagcagaauguaaauauuauuucuaacauugacacuuuauaaaagucacacccaggcaaaagcugauuuauuaucaauccauacuuaguaaaucagcacacagaauguucuuguaaaaauacauauaauggaccauacgugguagcucacggcuauaaucccagcacuuugggaggcugacauggguggaucacaaugucaguaguucaagaccagccuggccaauauggugaaacccugucucuacuaaaaauacaaaaaaauuuagcugggcgugguggcgggugccuauagucccaucuacucaggaggcugaggcaggagaaucauuuauacccgggagguggagguugcaguaagcugagauugcaccacugcacuccauccugggcgacagagcaagaugucaucucaaaaaaaaacaaaacaaaacaaaaaauacauauaaugaacuuaaguauuagugauuuccacuauucaucauuucacaucaugguucauacuccuuucaagauaaaaauuacuuaauauguaauauauugugauaauguagaugcuuuuugcuucucaaaacaccaauuaguaauuagagcuuguccuuucuuaaacagagcgcuaucaaaacaaauuaaaccuuuuaauaauaauaauuuuaguauuuacaauuuaaaauaaaaggaucucaauagaauaguaauauuaauuaaacaacaaacauucauuauccaaguaggcuaaagaaaaauuucuaguacaaaaaggauuacaacaaaagaaaauguugccaggcuaucugcuguuuauaaugagugucgagaauucugcuuugccaacaagcauaagacuaauuacuucuaauguucuuaagaugcagucacaaugcagagauaacuaucuaagaagugugagauaaaaugccuggaacuccagcuauuuuaaauugaauaagaaaggagcacccuguauaguaacagcaaaaagacuacaaagaauuaaacaaaaaugaagaucuccacgaaaugacaaaggaugauuuccaggauacaaaguuaaguuaaaaaaaaaaaaaaaaaaaaaagcaaagugcagaacagugaacuuuguacuuuuuuuguacaagaaggaaaaauauguauuuucuuuugccaaaaaaauaaaucaggaacaaugaaaauguuuaucaauagagaaugagugaaaagugagcuuucugaguauauuucauagaacuaacaugauagucaaaaaguaaaauuaauaagggaggaaaaaaccaaacuauaauagaauacaaacagauacaaaugaacuaaaauauguaucaagcugguaacagaaaaaaauuaaugcuagcacuuuuaaccaaaagaccuugacuguagagccguggugagauauauacugaagaugaaaggaguguggagggcugagcaugguggcucauacccguaaucucagcacuuugggagguccagccagaggaucgcuugagcccaggaguuucagacagccuggccaacacaaggagaccccaucucuacuaaaaauuaaaaaaaaucagucaggccugguggcaugugccuauaguccagcuacuugggaggcugaggugggaggauugcuugagcccaguaggucaaggcuacaguaagccauaaucuugccacugcacuccaaccugggugacagagugaggaaaaaaaaaagugcugugacaucuuaaacuacuguuuagugauggucauaauacgacaucauaauuuuaaaaacauuuauauguauaucauaggguaaugcaaauaaauauauuaaugguauggugaaucauuaggaaccaagauuuuuacuguaggguuaaaauacugaugcaaaauacaagaaguuaaauuuuuugaaaacaaaugcaugugauccaacgugaauugcuagccaccggacaggacuuacuucuuggcaauacugcaggaugccuuccuugguaucaaugcagguuuuggucccugauggaucugaaucccacuucccauucuggacauucaugugcauguucagucugccacagaacauggcaaucugggguucagccagcaggccagcauuaccaucaguggguaccugaaagaagaagcuucaguuaguuauaguauccauagcuccaaggcagaggcuuggaggaagaacagggauaacuaucaaaaagaguucuauucuugcucauucucaauuaggaaucagcccggucuucaacacuccuuuagauuaaguguuauguaugcuacagauguucuuagccaccuauaaggcaaugcuuucuuuuauacuaaaacagagaaggaaauuaccaauaccgaaaggaauuuauucaugaaaaauuuacacguuuucccauaugagauuuugugguaccugcugaaagguucugacaacaaaauuacacguuuuccuauaauaaauauaaucacuguggaggcuaccgcauucuuauaauaaacuccacugacucacacagagcaugaugccugccaggcccugccugaugaccaagacugaaaauaauauuugugccaccucucagcacugagagcaaguauggcguugguaguuagcaagugacuguauuaugauuuugaacagaaaaauucacuguagaauucaccauccacaaauauaacugaguauguuggcgaucccuccugguuucccccagaauauucucugguuaucagucucaacucuuaacaagucuguuaagagugcuggugucuccucucccaaccaucugcaaggagccaacauuuucucauuuggagcucuacauagugccugcuggguaguaaguaagggguccuagcuauuaccauugcaggcaauagaccacuucacaaaauaacuucaugaaaaagggugccuucuguauuuucaaacucuucuguguacaggcauuaccuuuacaaaaauauuuuuaaaagagaaaauggaaguccugaaauaucuauaccgugucacuuaacagguucugguaucucaaaaagaaaaaaaaauucagcaagaaaugaaaaauauauccacaggaguaaagguguuauuaaaccaaucaauuagaaggcauauuaaucaugauaggcccucccuugucaaauccagcugcuggggaaaugugagacacccaugccaagaagaauuaacuuccagcagaagccauucguucacacacucaagaacugggugauuccacgauaacuuguaucauuccuaaaaacuguccacaggaggaaaaacaccaacuaaaauugcacugagaaauuuucaguuaaagaaaugaaacaguuuccaaacauuucuucccacauaaauguaaaauaagauaccucuggccauuuuagucauuuuuacacauacuucgucaaaacccaacagaggacuuagguccuuacaacaaaaaaacaaaacaggucuuagauugaaccaagucaugagugcaaaagcugcuggcaaaaucucuagagccauguuuucaaguaacuuuuccaauauuuaacgaaauucugccuuuacauugccagaugguuaagucaaagcagccgaugccaaaauauccagaucaucugcagaaauagcuagaaccccucaacuccaucugagccccuugccacuuccugugacuuccaugaaacuggggggucucauucucugacagaugcaaagcagcaggcuaaguagaaugcucuauaaauuuaaauuucacagcuuuccugagggauuaagaggaaauucauugucuugaucuuagaaaucgaaaugcaaauguugucaaucuuacugaaauaaguaguauagauaauaacacugcaaaaacauuaaagaaagucaaauaauaaucagauaccuguggauaaggcccuacaucagaugcuauggagggcccugcccguaaggaauguacaauccacuaauggaaucgccauuguucccacaguacuuuauucuguucaccuuccgaauucauuccugucccaaagauuuccagucuuggcagcauguuguuaacuguacggagacacuaaugagccuuuaccauagcugguaaauauucuguugaaacagucuccuccucugccucaaacucucucuguacuuuuguuuauccacaaucuguucauuacaaugucuaaggaaagcguucuaccuucuugucaauacaaaugcacuugauuccauuuccuccccgcaaggagaggaaauugacaauuucucuccccaggguagccagccuccaagaaggcccccaauagucccugccuccugcuauucauggacccugggaaacuccacaauguaucagggucugucugugcaacaaauggaguacagcagaagugaugaugguguaacuuccgagcauguauauauuagacuuaaagaugcugcaacucuuuuaaaaacaaacccuuugcuaccagaaaggucacugaagggcaugaugauguguaacauccaaaacaaggucaugaagggcaucacaauucuucauugcucucugggaucacucacugugagggaggucaucagcugccauguucugagacauuuggugcuaaaaccaggaaaguuuuuggcaaaauacacuggaucacccuaccugacaaaccaaguaaaugcuucauuuuuuuuuccucuuuugacuuaacuuccuuugauuucuucuauuuuucacuuugucauccucccugcuucuugacuuuacagcuauuuuaaugucaucuguuggcauauguguguaugcugacuaucaaaaagugguaauuuuuuaaacauuuuuuucaaauaaauuuauuaugacccuauaauugucucauguucuugccauuuuuuaaugccaucuguuggcauauguguguauguugacuaccaaaaagugguaauuuuuaaaacauuuuuuucaaauaacuugauuacggcgcuauaacugucucauguugucuucauuuuaacaaugagaguuuagacuagaaaauauaugcuucaguuccugucagguuuuccaccagaugagauuuaauauuaacuuuaaaaauaaauguuuggagaaucgugaugauuaacaugcucuauuuucuucaaguggagaucauuuaauaauuuaaacugcgaauccucaauaauaggguaagcuguugaauuagaaauuguaaaauugguuguguguauagaucuucuuacauuugacauuacaagaggcccuucacaaauaaauaucaacucacaaaagccauguuucucaaguaaaauuuuuuccccccgaaccaacaccagauguguauauggaaaucagagcaauuagcuuggagauacaaauugaaccagaaaccuuccuauucuuacugaagcccaucugcaaacaauuccaugcuuucacuacauaugccugucucccugaauuaaaacaagacaaacaacucacggcauccucaccugcaucaaauaacccauuuaugaaacaaagccugguugcuaagcgcagccacucccuggcauucagccagaaggaaauguggccacauuaaacauugccauccaaggguuaacucccuuuuccugagugaagccuccaagaaaugacuuaauaaaugauacacaggguccuauucaggaucuguuaauauggacacucuuaaaauugaaaucuuuuaagauucaauuuaccugccaaauaccugaaaucuggcagguauuugcugccaguaaaaaagcacagucuuacaaagucauccuaaagauaauuauuccuaauuuuuuaaacauuuuuauuuucuaaaagaaaagaaauauaaauaccuuaguagaugggaaauauaaccacuuaacuacuacauuuuaguucuauuuaugucuuaacacuauucuaaggugaguuaagauuacuuugcaaaaaucuaagacaacauuuaaaagaugagaacugugauauaacuggccguuuguggucuaugcuuuucuaagacugaauaugaagguaauucuuguaaacugaaugacuugccacugacaucauaaaacuggagaugcuuucccaugggaaaacaguguuccugacaaugaacaaaauaaccagcuaaaaacaaugaagcauucauaaauugccucaaaagcaagaggcuguuuaccaagugcucugaacuacagagacguacauaucaaacuuaaaaaugcuacaagucuuaaaaacagaaagaaaauauuuuuguuaccagaaaaaaaauauuuuugagccacaauauaaagaauacugaagugaaauggacuuuccaaagcaauuuuuagaaauggcuuuaaaagaggcuuaaggggauaacauaaacgaauauaaacauauauaccuaaucuggaccagucugcagaugugaaucuggaaacccuacgccuacaguugcuacaauuuucaauuaaaugcaaagccaccuucuugaacaaguucucuuguuguccuuucaaacaggguguucccuuucuccaaaaaguuucucucuguuaucaucuaggagaucaaaauuccuuauagagcaggcuuggcagcauuccuccccaacagggucucaacuaggagggaaaagugaacaaggagcucucuguuuugcuagcugagagguccuguuuggcaaggagagggcacagauccauagcuuaguugcauccguggauuuauguaauuuuaagguuucuggcuaaugaaagccaucuguuuucugcauuugaaccacccgcugacuagucuaaauagcuggccucauauaaugaaguauuugguacuuuuuaaucaguucaaacuucuucgagucagauucuugcauaaucucaguauuuuuuuuuggauacacugucacacuccaccacccagacuagagugcaguggcaugaucucggcucacugcaaccucuccgccuccuagguucaagcuauucuccugccucagccucccaaguagcugggacuacaggccugugccaccacgcccagauaauuuuuguauuuuuaguagagacaggguuucaccauguuggccaggcuggucucgaacuccuggccucaagugauccuccugccucggccucccaaaauguugggauuacaggcaugagccacugugcccagcuuuguagcgauacuauuucuaucacauccaugguuuccugacauaaauacuggauucccuuaaccugggcauaauucaacuauaccccacaagagugcuuuacauuuucauauuaaaacauuuaaauucuccauugucaaauguaaagaacuauuuucuagaaucauaaucuagaaaaucugagugaaccccuuucaggggaauaauucaucuguaggguuuucuuuuaaaugccaaaaaaguauuuccaguguaagcggaacaucugcaguugcucauuucaucacuaacagagaacugaaauuaaaaucagaaucacaaaaguggaccauaagagggaggaaagggcaccagguaaggauauguccaaggccaugggguuauagggacagagaagggaauucaaccuauuccgucaaggguucuguuaaugugaccgggcugucucucaaauuaaaauggaaaauugcaauuuuccaaggcuuugccccugugugugugugugcauguauuuguggugagcaaaaauagagaagcuauuaaaaaagaaaaauaaaaugugaugacugaaacugcaagugguuucuauuuacccuuguggagaguugccacaucuauucacagccacuauuugcuacacaauuauuucagagcuugaguuucggcuuaaaaaaugauuugccaugaaagcgaauaggagaaaaacaauuccuuucagaggaguaaucuacauauuucacuccuggaaaccugaaauucuuuuugggucacuguugaucuggcuucuaauuacaagcuauccucccuugauguuuuucacggccucuguugauauuagauuggugcaaaaaucgcaauuacuuuugugccaaccuaauaccaagcuuuuuuacuacucaaaggauagauguucucaaguugacccaaaacuccuacccacucauaagaaggccaguaagucaugcuugcugcuggugcccaguaggaaaucaagaggucccucaauaggagucuuuguuauucacuacucgugaaauuaauaaccaacauuugaagcaugcauuuaggcaggacccaguaagaguggcaucuacugcuaggacugauauaaaugaauauaaaaguggaauuacaaaaaauagagccuuaugcauggcaaacaaacucuuagccucaaaaacaguuuacaaucuagucaauguccauuuagucuuaaaaggugaauguuuucuuuuaacuucauauauauacauacacacacacuaacauauaugaaaccauacacauacuauauaguaugugaugaaaugagcgagauguaaaaaguucaucucuuucauucugucuuuacaguuuuucugugugucuuuuguuuuguuucguuuucugagacagagucuugcucagucgcccaggcuggagugcagcggggugaucucggcucaccgcaaccucugccuccuggguucaagcgauucuugugcuuuaaccuccugaguagcugggacuacaggcgugcaccacuacgccuggcuaauuuuuguauuuuuuaguagagacggguuuuugccauguugccacuccugaccucaagugaucugcccgccucggccucccaaagugcugggauuauacgcaugagccacaacgccuggccugucuuuaaaguuuuacugacaugucucauacagucaccaaagggaaaaaaaaaugaaaaaaaaauauauauauaguauuugagaucuuuauccuauucugacucucucaauauugccauaucucaucagccuugaccuugugaacaugcagauagaaaaaggguuagaggcaaaaaucaaagaccuacuaaggccuuugcucauuaucucauuugacucagaaaaaccaagauaagucacuuccacaucuauuuagauaaucagaagggcucaaaacccgccuagagucuacucaagaguguuauuccaaagcacaugcuugcuuuuugacagaacaagccagcuggcauuccugguacuagaugucaagcuuuuuuaauucuucaaucuugaauauuauuuucaaguaauuuuucccccauggcaguacuauuuugcaugucuuuguuacuggcuuuuaaaaaaauuacuuuuagagcaaguaaaacgggaagcaaacccacagcuuaaaugucuaauuugcauuucucaaauuuaaaucacuagauguuaauaucuacuaaccucugguaguuuccucuuuaagaaaucucuccugaaaugcaaacacaaauuucuccaaaguuaguucuuuccuuaaaucuaaugcagccaacugaaucugcaaaguagaaguccaaaucucccaauguuccaacuacuaauguuuaucaacccuuacuuuauuuaauguguauuuucuaguuuuucaacaguugacauauaccuaccuauguacauauacacauguauauauaccugcuauacagcuacuuguaugguauguagugggagugcuagaaugaacacacacacacacacacacauauacacacaguuuaagagcucaauuugcacaaaucucaaaugcugguacuuugcuaagaucucauucuagaauuagugcauuuaaguccauguugcuaacaagguggaggacuugguaacugggcuccucagagagagugguuugaauggcauucacugaaauaaauuugauaguaacaaauaaaugauuuuccaguauggcuucuacuuguucugacagcuaggacagauuagcacccagcacagaauacaacaaagaaaaaucaaaaucuauuauuccucuucauuuuugguacaagagauauucuacauauauucaauuucuaaauuucuacuguuuuauaucaaauguagccaagcuaagccgggaucagcugacccuugagcuugugggcuauaauaaaugguuauuguucuaagccacuaaauuuuggagugaguuuguggcuuugcagcauuuuuguggcaaaagaaauuaacacagucauguauuugauaggaauaacuaaaauacuaagugauagaaucaaggcauagauuguuucagaagguagaaacuuucucaaguugccuuuuuuuaggcagcugggaguacaggcccauaccaccauaccuggcuaauuuuucuguagagacaaggucucaguauguugccgaggcuggucucaacuuccuggccucaaguguuccuccugccuuggucuccuaaagugcugggauuacagaacuggucaccaugccuggccauaaauauuuuauauuuaauguauuauguaagguaggaucaguuauggcuuaugaucuauacacuuuggguuguccuagaauuggaaagaaucugagcagaggcaaauagaaugauacuguaaacacauguacugaagcuuuuaaggagaugguaaucaaucuuugcaaucuuuagaucugauugauuuugugagcuucuuuucuccuacauuuuuuagaccucugcaaaugauaaacaauuuguacaaaggcauaguuuuuaaaaaaaauuaaacauauuuuguuuacacaauauauuucuaaaaggaaauauuucaaaucugaaagcaaucuaaugcuauuaaauagaccccguuccugcucauaccucacauguggcuaugugaauacaaaaaucuuauaauuauacuucucccagcaaaggacaugcaaauuucaucaccaaacauucaugcuacugcaaucacacuccaucaagccauauguguugaaaucuguguaacaaaagcagugagggcucuugccacacguaggcucccgcccagcccucuccgggagguagguauguaugcagagaagagagugggcugagaaauggaauucuggcauguugggucaagcagacugaucaugugacacucgcacugagauccuaccaaauuucaccauguggcagagucagcaccaaacaaaucccaaaguuaaagccucaguuaucaccuggguuuugcugcauagaccuagccaaauauguguaagaguuaugagcucuagacauaauuuauuuuauugcccugaaauagaguauccccacauaauuugcaaguuuaauugcaauuauauuccugggggucacuccucauaccugcacaguuaggauauugccagguuauucaugguaccucacacaacaccuggcaguuauacacagauccucaucuuuuuuuuuuggagacggagucucacucugucgcccaggcuggagugcaguagcgugaucucagcucacugcaaccuccacuucccugguucaagcgauucuccugccucagccuccugaguagcugggauuacaggcgcgcgucaccacacccggcuaauuuuuguauuuuuaguagagaugggguuucaucauguuggucaggcugaucucgaacuccugaccucgugagccaccgcgccuggccuuacagauccucaucuuuuaugcaauaucauauucaucacuaaauaacgacacagcauaaaaaugaacuuuuacuuuaucagugguacuuuacagcacuacagugaguuuucuagaguuuaaggcuuacgcuaauaugcuuaaugcacaaguaagugcaaacuuaacagguuucuuucugguucuuuuauuuuuccccucuauuucuucucauugacccacugcaauguugacccacucggaacguagagcaugggcaaaaaaaagaaccaagagaccauuagagaagagaauaagucuuugaaaagcugcaggugggaauauaauggaaaacaagauuccagaagagguagugggucuaccauuuaacuagaacaugcccaguagagccauacugauaaaucugcaucuuagaguugcugauauacuuggacaaggggaaaaagaagcauauuccucuauccuuugucagcccagaaauuuaucccaacccuauuuuccuauacaguuucuaccagcuuucaggcgucaggccauuguaaaaccaacauagguggagagggcaauucaggcuaggauggggagagguaguuagcgggauuuccaguucugggcuauagugagggagucaguauacacugcugagucugguacauacauuccacauuguccauacccuuuaauaucuuuacaauuucuaauaccaaagugguaugaaaauacuaaugaaguuaaagacccuuaccaaaaugcuaauuuuccagguuaaguuaucauauugucuucaaugugcauuaaaaucucagagcagcuaucgggggauaaggagagugaguacccacuaagcuuggaggccagcuaaacucucuagaaagucauuuccaucugacuucccaccagcaugaggcagagcaguucagagcauuuuucaagugagucggccugccguuaccaaugccaaauuuaaagcacuuauauguuuuaucacaagcccaugagcuugugauuucauaaaaugguacuaacugguccuugccaugaguaaauucaaguaacacguaugaagaagauuuuaauaaaauuuuuuauuagaagauuuuaauaaaauuuuuuuauuaaaagauuuuaauaaaauuuuuuauuuuauuaaaagauuucuuaaaggucauuaacgcaagucauauuagaagagaucacaggcaaguagacaaaaagaauuuacuccgugaaagcucacugaaacaggaauucggauauuugacauuuacuuuuguucuugucucucauauguacacaucaaagcacacacauucacauggauguaaagauaguaagaggccaccugcaaucagaacaagugagauuauaaauaaguauauuauauaagaauccaagacaagaauuccuuacuuuuaaggaaagggcaucagagauuuaugaucuuagaccuuuaccuuucuauuuuuagcagauuuacagaaauauugcaggaacagaacaugaagucacuuauuuuugauaagcacaaaggauauuuacauuauaucgucugguuuauuuccuuucaaagugucauaacauuuacucaucagccuuuacugugugcuuauaacucucauacuguugugguuuuauuacuaggauuuuuggucuaggagaaagcugcuuuacaaacauaauagaaauucagugagaauauuaacuugacauaaaaacccaagauaauuuucaaacagcauucuuguucauuguucaaauuguauucuguuaacuuauuuaguuuaagccaagauuacuucuuuuccugcagacuuggaacacuaaagaauacuccagguuuaaauuccagguuauuugcuugauaagccuggguagauuguccuucuuaaauaacuuacaccaaagcacuaucaaagaagcucucccuuuguagagcccucagauucacagaaggaauuuuucgaauugccauuucuauaggaauaaaggcuaucaggaaccacaauacuaggagaaaauaauucugaaggggagguagcagugaagacucuuauuucuauuuucuugacuauauuuauaaaaaauuguugccgaaagaacagaagaccaagagccaaaaaucacacugcagucuuacucuuggauguaauguuacuaucaguuucagugacacaacaucagaggcaaucugauauugacaaugguaaaaauaugcagacgccaauauuaggagggugcaguuaguugacaguagagccuauaaguauucaucuaaguuuucucuguuugaagagaagaaaagagaacaucaaacauuucuaguauauagagcaaggauuccuaaucuuuuuuuuuuuuuaaugugcaaacaagacaaaaguuacuucacugucuagggguuauucccuacucuuuagcacuggccugacucucucacucccacauauaagcauucaauaaauacuuaugccaacaauuaagaaacaccuggcaugaaaaauaauaacaguaauaaacuagaagguagaaaauguaauuauugacaaagguguggaacaauacaaaauaaauuccacuuuagauaccugugaaauuuuuuauuguggcaccaggagaguaauuuccuaacagagaaaagaaaacauagcauccacaccucugucuuuaccaauuccuaaauaccagcuacaguucaacuuguccacggacuucaggcuccuccuagaaaacaagaaggcuuaaaaagcaagacaaccuauuagcuauguugcucaauaaauuucaauguuaauuuccuaauucuuugauaacacauuccugaacuccuuuguaauucaggcaacauuuuaaaaaucagaugaucuaacuggacuccaagaauuacauaaacagugugagcagugagacuucgaaugugcaaucaacuauuuuuuuaauccugcugcuaaaagccuucaguagcacagaacugguugucagagauuucaguguaaccuaacaccuaacgugaaugacugcuguacaaaaauacagcugaaaauacuaugaggaagagauagaaacggauuguugauggcuaagcaaaacagcaaaugcugaugguuaucaaacacaugccguucccacucuacacagauaagauuucaaagcuguuugaguccuagguuaaguuuugggcaaguucuggcuugaugccuuauauucagauaaacauuuuccaggcagugaacauauucaaaguuggggacagugggguaacccgaaaacauuccugaccuugauggacagauaauccaaugguggagacacaaauaaggccaaauuggcuaaccaaaggugcuggaguguuaaugcagaggucuggcaaggguacaccgaagagcucucaggaaagagugacugguuugacuuggagaaggagaaggaaggcagaccaaagaucagagcagaaaacaugcccaggcugaguaugggucggacaggaagcaugaaagguagcacaaggcuagcguccaaaugaccuugaauuuguaauaaacgugugaagucacugggagcugcugccacauuccaaagcaagcaagagcagcaucccaccaguguaugaggaggaugcgggggccccaggacaacuuucgugggccucuuucucucuuaaaaaaacauuaaaagcuauauuuuagggcucuguugauugguauaaagacaacucuaagucaggcuggauucauuauuguauauucaugauuauuaucuuguucuuuauuuuuccuucugauuuuaaaagaaauuaaacauuuuugagggcuccuaaagguacugcacagccaagacuacggucugacuggaagcaccaggaguaacaggaggcaguaaacaggaguggagguagggaagauucuaaggcuuguaaauuucaaggaugagcacauucggugcgguguuuagggggugagucuagagugcuuucauggccaaggucaacaggcauuauuagagugcaccaggcuacagaaugugaguuuguccugacgggggugggggagaaaaagaaggaaaacaaucacuaccucccugauuuauuagcaaacaucccauucugucuagccccacaucacaucaggaguucuaagagucaaucuggcagagcaauucaucuacguuucauugccuugagugaugggaacuuauuuuaauuuucaaaacuagcauauguuuaacagacuugugcagagcugccuaugugaccuggggaaaaaauuaucuggacucucaccaugcagauuaucagcuugaauugcuaaugcauuccuuacccccgacggaugucuuuuugacaugucuacagaggaauaagcccuaaaacacagaaauaacaaacuguacaaucuauaucucgcccuugggcaggagggguauugcacugugugggaaagauuuacauucuaccaaaaaaucuaagcaaagaguauuuacauaagcacaaaaauuuuuucacaaacuuguucaaauaaacuaagagaagaacacaacugugaucgcaaaacagauaacaucacauagauucuggcuucugacuuuacugcuguuguucauagcauguaauucuagauaauaagaauuuuagguaauuagaauagaagugccucuucagaugugcuaaaauguuacgugcauggcuguuucuaaagagggaauaauguugguguacaccuaacgcuaaccaacugugcccuaaugaagguaaauccccaaauauccauaacacucacuuuguuuucuguguacggccaaucuccagucaagagcuccuuuacccugacacuagucucacccauguuguucagcuaugcagugguucuccaacaggguaagcuuguuaacuacauggguccuaggccacuuugcuuuuugagcccuaugaacuguuucuagguagagguucaaaguucuuggcaaagaugauugucacgacuuggguggugcuacuggcaucuaucuaguagguagaagcuagggauguuacuaaacauccuacaauguacaggcagccuccgcuguaggcccucccccacccaacauaaacaauuauuuggcucaaaaugucaguaauucccagguugaaaacuccaaccuaagccuuuacuuagggggaaagagucaugucuuacuguucucuguauuucuauuuguucacagaacaaaauuagcauucaaauauugguugaaccaaacagaguuuccacucaaaacauaauuaauccaacugacaucauauaaaacaauaacuauguaaacuguaaauccuacaaaauacagccucccuuccacagaagcaaaaaaaaaaaacguuaauuuuuaaaagguaguugguguaucaaaaguuauuaacauuaagcaagauaaccccuucaacucaagauuacagaagauugccccauaauuauuucauauaaaaugaucaaaaauaauuuuauuguauuaacucccugugggucaauuuauaauaguaaucuuuuaauuaagaaaucuugaggguuaauuauccagcuuucauuuaaaaaaaaaaaaugaggugguaacuauuucugggcaaaguucaccaggaagcaagacaaugcacucauaacuaggguuccaagaccaagcaagccagucagaaucucucuguagguaaagacuuucaaauucuagccaaucauuucauaaugaacaacuuagacaaacggagaaaaggcuuaaaaacuggaaucucuuugaauaauguauuaacucuacuggaauaacaaauauauacuaauagguuacauaaaucaaaagcccuaugaaaauauauaacuaaaaaaauuauugcuagaaaccucucuaugucuuguaucugcaacuaugaacagggucuaauccaucacugucuauaucucuagagaccucaggggacuuacagcugggucagggucacuguaggaacuggcugaagggacccacacaugaaaguaccaauaugaucuuuggaaucaaaaggcaaaagucaauucuguauuuaguaauuaccagcuguuuggagaaagccaguuaacuuuaccucuugauuuccuuuaucucucaaauggacauaguaacaucccaccucacaggauauuaugaggauuaaaaugcaguaauauacauaaaauggagaguaagcacuuuaagagcuaaucauauugucucaacuuguaucuagcaggaagagggaaaagaaaagaaaacuaaaaugagcacguucguaagacaucuggggagccugaacugaugaauacacagcauuugaaaucuccugcgagcuaucccuacaaagauaccugcuauuuauucaggaacccugagagaggauuuccugcacuaaagaaaaugcugacuauauaaccacauaugacacacugguuuaaagaaugucuuaugccauuuaaaauagacaaucuuuccuuguuuaucugcaagacgucugccugccaaguugucucuaaaagagacaaacugguaacgacacugcaacacgugugucgucaaccccagcuacacgcucaguguggcagaucugacucaccaagucuacauaguauuuuuaaacuaucuaagauauuuuaacucaugcaguuuaauggcaauuuuagcucuuuucagaaugucugauauaagguucaugaaguccacucugacaauuuacuauccgugaaucacaaugauucuaaacagagcuaagaagcaaauuucaagauauuaaauuuuuuugguucauuucuuuagccacaguauuaaauuuguuucuacacagaacuucucuuguguaagaaauuuguuauugcaugcuuauaccacuaaguuauuaaauauaucacuaguaauguauacucaaaauggcccagugagguuuaagacauucguuucgaaguaugaauaaaugccucauuucauaucuaauucaguguucucaaaaacaguuuucagaaaaugucaacaguuauuaccugggaguggggagaauucugucauaaaacacauaugggaaauggaucauucaagauggauacuggaggcuuuugaaaaaaaaaaccguaauaaugaagucaguuuaacuuuuuuaaaaccaagguuucccaaaauguauuugaccgugggccacuuccauugugacacauuuaacaugcuuggaacugaauuugaaaaauguacuaagagauuugaaauggaugaucaagcaaaacuuaaccagaucauucugagugaaacaaaauaaacaaaaccaaaagaagccuuaaagggaacaaaagcaggaguguuaccaagcuccugcagaaaugaugauuauaauaacacaucagauuuggcucuaggcaaaauaauuacaugacaugaagaauugagagcaagaaaagagaggauuagaaugaaggaguguuuccaaaggccuaaaauauuucagaagcaaaucaugagcauucagaaaaugccaaaaggguacaagucaagaauuuuauaaggucccaaugcaguguaaaauuccaggucuuggacaggcaccauggcucacgccuguaaucccagcacuuugggaagccgaggcagguggaucaugagguuaggaguucaagaccagccuggccaagauggugaaaccccgucucuacuaaaaauacaaaaauuagccaugcgugguggcagcugccuguaaucccagcuacucaggaggcugaagcagagaauugcuugaacccgggaggcagagguugcagugagcugagaucacaccauguauuccagccugggugacagagugagacuccguuucaaaaaaaaaaaaaaauuucaggucuuaggucuuuuaaacuauacaggugaacuaaaucauggugguuuguuccaaacuaaguuaaauuuucacuuagcgauauaaacgugagauggcuaaugacaagcagaugcacaaauuuuaucacaucccuggauuccuaaauugcauuugugaaauucaauaaagugacacgaaguauagacaauaagugaauaagaacuaagaacagaaaaaguagaagacauggauaucugcagcaaagcccacacccgaggggagaaaaacauuagugcuguuguuuccaugauacgagcacagguuccuacacugauuucacaauaaaaaauacaaauuacuucuaauuuucccauuuucacacaagugaaagagaguucagcccaauuucugaauuaaauuuuccuuccuauagagggaaggucuuuagaaaaucuuuacaaaauaguacuacacaugccuugugauauuagggugauacggugauaaauuaaaagcaacagguaauuaauaugauuaauguaauacccagagaacuucacuauuucuuaaauguuuuccugagauguuauauugaaacguugugcuaaaugucauuacauaaaauguugagcaucacacaacagcugacaaacuaaccuuccaaaaagaaaggaauagauggucauucacacgaagguuacauuuuacaaacaaaacuggacacacaauaccauucugugauguuuaagauacaacaaaacauguacugcuuuuuuaaaaauugcuguaaugaggcucucacaguuauucacguuuuauuuagcuacaaguuuuaagauaucugugaaagaaaacuucuuuguuuuaaguucuuguuugaagaucaccaagcuucuauagugucucucugaaguggugacacgcugacuuccaggcacaagccaggcacaagagaagcucugcaggaaacagcaaggccacucuccauaaggagacaggcuuggccaugacaacuguggcuuagagcugaggagcacagcaacucacaacuaaugucuuugaauuuuagguaccagcacugagaaucaaguuccuuuccauguuuuaagaaacuaauaaaauccucaagaagaccuguuuuagauauucaugacauuuccuaaggcauucuauaauguuaaaauacuuagaaaugacucaaccauuuggcuaagcuuacgcuaagggcaaauuccuguuucuagaugcgucaggucuggacagcaccaauaugugagcuucaacacccagagacuugacuucuauuuagcaauuuauauuuuuaguaguagccuucccuuccuuccuuccuuacuaucacagaaaagaacaaagaaaaaaaaauucugcuucaaaagccaaagaguucacuacuaagaauaaauucuauuaucuuccuuagacuaugccuauuacuggguaauauaaauauauguuguuggucagaugcaguggcucccgccuguaaucccagcacuuugggaggccgaggcagguggaucacgugaggucgggaguucgagaccagccugaccaacauggagaaaccccuucucuacuaaaaauauaaaauuagcugggcgugguggcacucacccguaaucccagcuacucaggaggcugaggcaggagaaucgcuugaacccaggaggcggagguugcggugagccaagaucgcaccacugcacuccggcccagguaacaagagcgaaacgccaccucaaaaaauaaauaaauaaauaaauaaauuaauuaauuaauuuaaaaaaaaaggucuguugucaaugaaguagugaaaaggcccguaaaacaaaacacuucauuauuuaccaaaggagcaccgagguuuuccagcgaaaugcaaccauuuuauuguucacagugauucuauaaacguuuuuccuuuaagacaauugcgcauagagcaauacacucagucagucacucauauauuuguuggcucuuuuuacuaagccaaaacaaagauuauuaaacucuuauuagagacaacaacaguguaauggaggcaugcuuaaauaagggaaauaagaaaauuuauacuauacugaguauaauuuaagcauugauagccaaaugaccaauacggcaauacuugagaaauguccagucauaagaagcuccucugaacgauaaagccaaacuuacugacaacugacuugaacuaauaccuaauucaagucaucugagagaucuaaccaacuguucucaucagugagaaacauuauauguuaucuauugcacaauaugacugaaagauagucaugucuugaaucucaaaucuucagaaugauaaaccacaaaacucuacuuugacaccuaauguauacagaugaaugucugucuacuuccuacuggaaucgugauaguugaauuaagauuuuuuuuuuuuucacucagauccuguuuucuuaaauaaggaaaaacaauaauaaacuuaccauauuaaacaacuaaaaaucaguuguccauagaugacaaaugugauacaaucuagcugucacuagauaaaagguuaauuuuguaaacagagucaguuaaaaaaauaaacaaaaaaauaagcaauuuaagauaaaaguacuuuggcauggugagacauuacacucacuggggccaggaguucaaggcuguaguuugcuaugaucgagccugugaauagcuacugcacuccagccucacauagggagacccuaucucuuuaaaaaagaaaaaagugaugucucaaauaugguguuugggacucacuaaaaauaacuaaauuuaagggggaaagauuaaauugguauuauauaugccauaugcuuaaauucugauuuuagcucaaccuuauaauuaaaucuguacuuugcacccauuagacauuucagcaaacugaaguucauucaaaucaaaaucuacaaaaagaacaagaucccaaggcacugaauuagacuuuuaauauucaagauguaaaauaggcacucuuuuaagaaauuacuuuuaguucuccucuaccuuuaaaaaaaaguuucucuccuacucgugaacuaauucagaacuuuacauuucuguuacacagcauaugauuucugcuuuauuacuuggauaucuguuuaguauucacaacauauauguaucuccauuaagcccagaauucuuugacagauggucucacccaaagaacucauaaauacuugauuacuucaacuuaguuugcaaaaauuaaaaaaucaguaaauuauguuacagacuauaguauuuugaguguuaaaaucacuucuaaagaacaccaucacaacagaacccuaaauucagaaucggguugacauggucuaagaaagugaauaaacggguaagugaucuuccuagugcaucauauucuacacuaaaaauucaccauuuauacuucauuucugaaacucaaugucaaagagaagauuaaaaaucugggggcugggcacaguggcucaugccuguaaucacagcacuuagggaggcauggguggguagaucccugagcucaggaguuggagaccagccugggcaacauggcaaaaccccgucucuaaaaaaagauacaaaaauuagcugggcaugguggugcaugccuguagucccagcuacuuaggaggcuguggagggaggaucgcuugagcccagcaggucaaggcugcagucagccaagauugugccacugcacuccagcagaguaaaacccugccccaucucucaaagacaaaacaaaacaaaacaucugacaguuccugaguaaucggcagccuacguaaggaaccuauuaauacugcauaugcaauuuuuauuaacacacuugccaauauccucauuuuaggacuagucuaauguuuguaugaugccagacuaauuuugaaugucugaauuauucacaauuacuaggaagacaaaucauuagacuauggauucagucuacaaucuuauucuauaucuuuuggcuauguuaacugauuaacaacuagaauaggccgggcgcgguggcucaugccuguaaucccagcacuuugggaggccgaggcgggugggaucaugaggucaggaguugaagaccagccuggccaagauggugaaaccucaucucuacuaaaaauacaaaaacuacagcacgcuuguaaucccagcuacucgggaggcugaggcaggagaaucgcuugaaccugaggggcagagguugcagugagccgagaucgcaccacugcacuccagccugggcgacagagcgagacucugucucagaaacaaaacaaaacaaauaacuggaauaaagaaaacaguucccuguccguaucaaaccaaucagaaccaauauaagaaaaugcucuuccaccaaaauacagauuugauaugguugaccagauaauacauuucucuuccuggcccuaaucuagaacuuaacuugguugugacuuugauuucugacauuuacaaaauggcauucaguccuuuauaacccauugacuucgcuuauguugaaauuccuuugcaggaguuuccaaacauguuaaaguacagcauuuggaggagaagcaauguuugccuccuggacucaagcgaucuucccacucagccuccugaguagcuggaaccacaggugcacaccaccacucccagcuauauuuguagagaugaggucucccuauguugcccaggcucaugacaaggaauacugcaugccaauaauggaugccagcugaguguccucuaauucaacuggauucugacacuguacuuggagauuacacaucccacaggcugagggcucaguaccacaaaacucccccaacuucagaugucaaucacaagccccagguuguagccugugcuucugaccaacuggcuaccauuccccagaccccuuacuucguuuugauucauugcuggagcaccuucagagaacuaagagaaauacuugcuuacauucacccauuuauuuuaaaggauauuacaaaggacacacagaugaacagccagauggaagagaugcacggggugaggugcggcugaagagaaaacgagauuccaugcccuuuccugacauccaacccuccaggaaccuccauguguucagcuaucuggaaguucccagaacgcgguccuucaggguuguuaagaaagcuucauuauguagguaucauugaucauuaguuuaucaacucaaacuucagcuccuggagguuggggagggugacugaaaguccuaacccucuaaucacaugguagguuacccagccaccagucaucucauuagcauauaagaccuucuuagcacuggagauuccaaggauuuuaggagcuaaaugucaggaaacauauacaucaggaagaccaaauagaugccacaguaucacaugaccauuuucuuggagucaagauauuuguucuuccuuaaaacuucgauguuucuaaauauccaagguauccacauaagguuaaaaauaaacuucucaccacuccacuugucauuuaaaaucauccaacauuuuaacauuucaucaaaucucuauaucuauacaauagugcccaucucuucauguuuuuaagagcccuguccucacacuauucuuagugaauagacagcaagagauauuauucccuucuuacaauuaugcucugugcauaauaagauagcaagccaaagauaaagccaggauuagaaguacuuucuuaaauugagagcuuaucagaagguaaagcuggcuaacaugauuaucuauguaacagcaccagaccuucucacuucgaaauucaagacaucuccaaccacucagaaaggguauggggguugaaaacagccacauuauaugcacgacuucuauaacuuaaagauagccaaguucauaucaaacuaaguuauugaauuuuauaucacuuucuaacaaguaaucauagaaccaugacaaaacauacaaaauacagaaguuuucuccuugacuuggugcaaauucaauccaauuacuccacagaccucuuuuauuuuagucacucaaacuuugauuuuucauuuccuuagucguacauuaggacaaaugcaaauuauauacagaaggcagcacauuuagccuuauuaucucaaacucauuccuaagcaaguacaucugccuggauggugaggccuccaucagagguuaaaugcaagcccuagcugggaaaguuacuggaagggcauguguccuaccugccuuucucucucaucaucccagaucuuuaucuccccaaugucaccacauuaggaguguuuugcauauaaaucaaaacgaagccccagagagcccuugguaggaauaucuggacuuguguuuuagaaauaguuuugucagccaggcacgguggcucacaccuguaaucccagcacgcuggguggccgaggcaggcggaucacgaggucagaaguucgagaccagccugaacaacacagugaaacccugccucuacuaaaaauacaaaaauuagccaggcaucguggugcacaccuguaauccagcuacucaggaggcugaggcaggagaaucgcuugaacccaggaggcagagguugcaguaagccaagaucacaccauugcacuccagccugggcaacagagugagacucugucucaaaaaagaaaaaagaaaagaaaagaaaagaaaagaaagaaaagaaagaaagaaagaaagaaagaaagaaagaaaagaaaagaaagaaaagaaauaguuuugucacauacacaucugugauccucucacucugcacgccacugccucucugaaagaaccaacauaccacacaggcacgcacacgauggacaauauacagccaccgagcaaucauauacaucuuuuaaaaagaaacaggcaauuucaugauucuacuguacccuggauccaucaggcuuuaucuagggagugcuauuuuuaaaauauguacaggcuuuuuuagguccucaguaagaucauggaaguguuuugcucccuaaggaaaacugaaauuugagguauaagacuggaguuuuacaccucuagaauucaucuuugguaaccaugcccauuugauuuauaaauaaucuaaaaauauggauuuuuaaggagcaguguauuuaccuuaguccaccucaucuuuuucuuuucaggaauguuaucacaaaaaugugugcugauuacuuccuuguaucugagcuuugagcaacuuacaaggcagacacuggaccuaaaacacagguugguuguuuuagaagaagaaaaaaaaaaagcugguuuuaaaucuggauuuaagucuuggcccugacuccaaagcaggccaguuuaugugccugucuucuguugccagaucuguagaaacuagaaugucauucuccgcugagaaaccacaaacuaguuuccuuagaccauucgucuuccuuuuugagacagucucaaugucacccaggcuggagugcaguggcgcgaucucugcucacugcaccuaugccuccuggguucaagagauccaucucugcucacugcaccuaugccuccuggguucaagagauccucccgccuccaccuccgccuccugaguagcugggacuacaggcaugcgccaccacacccagcuaauuuuuccuauuuucaguagagacagcauuuggccauguugcccaggcuaacaucaagugauccgcccaccucggccucccaaagugcugggguuacaggcaugagccacugcgccuggcccuccuuaaaccauuaguuuucaaaccguauuugaaguuccucagaggugcgccaguauuugagagaagguuaagguuucaaugagagcaaaugagauuuuaaaaucuuuucuauaaacggggguucuaucccaucuaaauuuugcuuuuuuaugaaaaggguuacugcccuuuuuuuaaaccuaaguaaaaacccauacccuuuacuuuguuacagguguguuauaauuucaaguugucuuuuaaguaugagauaacuuucauuguuacaaaacaaguggguugggaguggaucaacgagacggagguuugcuccuucauuuaacaaagaaacaagaccagagagcucuuuccucacugggaguuagaaaugaccacagacgcuaagaacagaaagcaagacaccaaaacuaagaaagguuuuaggagcuacaaucucucauuuagaaacuccagauagaauuuuaaagaaaaaaguaaaaacaauauauuucuacaauucaaauaauauaagucagaguaaaaaacaaacaaacaaaccuacuuagcacaacauaaaaauauucugguuacucauccuagagauuuaaaaaaaaaucaggaggugaggcagguccuauuuuuguuccuucauuuaguggaucugagucauggcuguuccaaugauuuuccugaugaaacaaaauacauguuuguuccaucaacaaagggcuacccuaggaaacucaucuucuacugcaguaagaaggguaucauagguauuuuuugugguucuaauggguacucagaaaauccuuaugugauuuaauauacucuuaaaaggaccgucugaaaccaaaacauguacuaauauccaguggccuuucucucuguauacugguuuaauaauaacauucugcaucaaauccuuucagaaaccuaugaacagaaguaaaaugauaugauaccugagaauuauuuuaaaaugcuucagaaaagaaaauggggcagggggaggugcugaaacaagaacagcaaaauguggucaauuuuugaagcuggaugauguauaugucugaaauuuaacauaauaaguuuuaaaaucuucuuagagaguuggcagaucauauacuauacacaaauauuguacauguuauaggaucaaaauaugggauuaaacuaagggacugaaacuacuuauagaaugucauucucaagccaggcacaguggcugaugccuauaaucccagcacuuugggagauuucuugagcccaggaguucaacacuagccuggccaacacagcgaaacucugucucuacaaaaaaaaaaaaaaaaauuagccaggcaugguguuccucuccuguaguccuagcuacuuaggaggcugaggcgggaggaucgcuugagacaaggagguuaaggcuacaguaagccaugaugacuccauggcacuccauccugggugacagagagauagccugucucagaaaacaaaacaaaacaaaacaaaacaaaacaaaacaaaauccuccugcaaauauucuguugguggauaguuuucaauguauacaauacagucaguaccuguuacucaauauuuauccauugcaaacacaacacagaaaccuaaggaacucaaaaagcaaacugacauuugucaggaacugcucccuuguuggucaaagaagaggaaaaggagggcuuucuucgauauuauugucuacuuucuugguaagcaauaaaguguuugcaguuuuauguagacuggcgggguggggcggggaauugugacacgguuacacuuucguauauaucaaguuacucccauacaugauuuuagguagagucuguauuuuaaugugguagaaaggggugauuaguaucuugaacugcagaggcuacaaaaaacaaugaugcaacauuacguaagggaugagaaauaaguaaauaaguaaaaaaaaauaaguaaauugaaaaguuuguuaaugcacaaaaccaaguaacuggagagaaaaggacagaagagucaaagaaucaagguccccagaccuagagugagaauguacauuaucgugugcauaccuuaaucucaaauauaagcucauuaucaaauaauugugcaaaaaaaucaucuguuaccuugugaaggauagaaaggguuauuucuuccaaagcucaaaaugugguccacagauaagguaagguuacauuagugguucuccaauuuuaacuugcaccagacucuacucaagguuuuguuaaauagaucucugggcccacucccagaaaacgguuugagaacuauguguuuauacuauggcuaauucuugcaaaucaucugauuuugaaaccagucacaauuuuuugaaacauucuaugagaaacaucuuauuaauaagaauuuucaacagggcucaguggcucacgccuguaucccagcacuuuaggaggccgaggcaggcagaucacgaggucaagagaucaagaccauccuggccaacaugaugaaaccucgucucuauuaaaaauacagaaauuagcuggacgugguggcacacaccuguagucccagcuacucaggaggcugagggaggagaauugcuugaaggaugcagugagccaauaucgggccacugcacuccagccuggcaacagagcgagacuccgucucaaaacaaacaaacaaacaaacaaacaaacaaacaaacaaacaauuuucuggcaaaguaagaguauuuuacaaagagaacaaucacacugguagagaacugcacugcauggauggccaaauuaaaucauuacaccaaauaauuugcaaacuucaucccuacuuuggucacaauaaguaacauuguacuuuugaaagauauuacugucugagaacagaguuucaucuuacccaaauacagacuaaaaacaaugccaacuucacaguacucacuuacauaguugauaaacagaaccaacaaguccucuaauugguccauuugaaucuggggaagagcuggcuccaaucauugucaauuacaucagcaacuguggaauacucccugagaucaacaaacuguuaacugcagugaccacaacuugacccaggccagagcuuccauccucgggagggugagucaacagcaugucaacacuaacccaacuucuaccacgcacagcaaggcugugcuauuuaggcguggaucacacgcacacugcgccaacuucuaagcuaacaauggacaaccaaagccuccggaacucugucuuggguagaguaaaucaauuuccuuuuguaggauuuucuuggcacaaagccaagugucaggggcuguggagaaggaacugcuggcccaaauuccauccaagguugaccagugguuuaaucccuucucuaaaucaggccucuggcaaaacagcuagaaucaggaagccaauucauauuuaacaaauucaaagucuaucacaacacaggaacuuguuaggcaagaagauaacugaaugaacaccuuuaaaaauucugcuuuuuuaacaaaagcugucuacauuauuuucucaugggaguuuugguacuaguguuaauucauagacucucccuuaaacucaaauaaauuaucuauugaaagaauggcaagaaguacugccaaacuucauagggugguugggcuaaauguucucaaguucuuuuccaacguuaaaacaaccggauuauaagaaacaauucauuuaauggagcauucuggaggaguaaagacagaggauuuggaaugagacugcauagguuuaaauucuaacacuaacuguaauucuggccaaaagguuaugaugugggguccucaucuguaaaauggaguaucuaucucauggagucagugugagaauuaaauaagcacauaaauuucucaacaugacgccuggcaccuagucaacacucaaaauagaggaaggcuaauaaugaugacaugcaaaucugauauugcaaauaccaacgcaaagagucuaaugaaaacuuucuaaauuauaugucauugguucauuauuuaagcuucugagguuuguacaagcacagauuaacucaaauguuacuuaacguuuuacauuuacuauaaacacccugaugauguauuuuacaguuucuugauuuuucccuacaguuugggcacagucuuauuaugacagaaaagaaagcaacaaacccaaaggaaaggcuuuucccuagacugcuuuuaauuuucuauuaacugcccaauuuugaaaaauagaucuacaaaacuggguucuggaugacugaguucuuuuacuuuggggacaagagcugaugcuaaaggagaagacagaggauuaagaaauuuacauucugucauuuacaaacauggguaugaacaugaacagagccucugaaaacaucuggcaaauagaagacacuaugagccaaucaaucaccaaugcuggcuuaguagucauauuaauaaauacuugcugaguauauacuauguucucugggcuguauuauuucuuuuacgccucacaacaacccuaaguuugguacuuuucuaucgguuccaguuuacaaaugaagaaacagggaagaguaaggggaguuuucaaaaagaaauaauaucaacaguuauuacaucaaggguuucacaaaugaagcauucaaaaauucagaaaggcaaugaauugcuuugcuagaccuguggaaggcccucaaccugcacagguagccaacacccgguacauacccaauuacauccaguuaggucaccucuguauggcugcaaggagccagggccauguguggugccuagccacacuauauacauaaccugggaaccaugcagcaagauggaagaauaggaaacaguauccagaauccagauguuagaucucagggguaggguaugcacaaggaguauuugcaccauuuaaggugauaacgcugcugucucauggcaacaugcggggcaguauaagaggcuugguaaauauccacuggaccuucccuaagcuuagcacaaugcguccuggauggagaaaauaucaaagccaccaaucugagcauguuguggaaccagagagacuuaagaggcugcaccaccacacagcccucacucgaucuuucuaggcucugcuaagaauguugcugcuggcucacugcagaaacuaacacuuacucaaagauggugcauccugugcuuauuuucaccaagccucauauccccuucucugccagaccauuuuaauaccauuagauacuucccuauucaaaauuaagacagugucacuggggccaggcacggugguugaugucuauaauuccagcacuuugggagauagaggucggaggcucgccugaggccaggaguucaagaccagucugggcaacacagcaagaccccaucucuacaaaaaaucuuuaaaacugcugggccugguggugcaaaccuguagucccagcuacucaggaggcugagguggcagcaucgcuugagcccaggaagccgaggcugcagugagcuaagaccacaccacugcacucuagccuuggcagcagacugagauccugucucaaaaaaaaaguaaagaaaaagugaaaaaaaacaaaaauagugucacucagcaucacuuaagaaaauuaauaaaaauagguacuaccuguauuucagagauaaguaaaacuuauguugaaauggucaaugcuagauuuuuauaaaaagauguccaauuuuuaaaaacucauucaaguuauaagaaauuuuauaaucuuuauuccaugucaaagauaggcauuagaaaaauucaguauuacuuuacuuuccauaauugucaacuuuuauaaacaaugugguggagugggaauuaaaaucugauaauaguuuugauccauaaaaugagugggaaaaucaauuuuaaggcagaaaaaaaugcuucaaguuaaacacuuacuauuaaauauuuaaacaaaaaaauguaauaaagauaccuucaaaacuggcugggugugauggcucaugccuauaauccuaauaugucgggaggccaaggcaggaggaucacuuagccuaggaguuugagaccagccuaaguaacauagcaagacccagucuuaaaaaauaauaaugaugaugaaguuuugauaaucaaaaguuauuaucccuuuuggcuuuaccauagagcuacagauagguguccugguuaggucacuucuuuuauucuucccuagcuuuacugaaguauaauugacaaaaauuauguauauucaauguauacaacgugauguuuugauauauguauacacugugaaaugauuaucacaaucaagcuaauuaacauauccaucaccucagaguuacuuuuuuuguucugugugguaagaauauuuaacauuuacucucgcagacguuuucaaguguacaauucacuauuauuaacuagucacuaggcuguacauuagguauuaaucucauaacugcaaguuugcacccuuugaccaacaucgccucacuucccccacauccaaacccugguaacaccacccuucuacucuuguuuccaugaguuugaguguuuuagguuccacauauaaaugaaaucaugcaguauuuguuuuucugugucuggcuuauuucacuuagcuuaaggccauaaguaccaggggccuggauuucaaccucaccccuauuguuuauugcuacuugggucaaauuauguagccucccuguauuaaucugaucucacgcugcuaaugaagacauauccaagacucaguaauuuauaaaagaaacagguugaacugacucacaguucagcauggcuggggaggccucaggaaccuuacaauuaggguagacggggaggcaaacacguccuucuucacaugguggcaggaagaagaagugccaagcaaaaggggggaaaagucccuuauaaagugaucaguucucgugagaacuaacucacuauuaccagaacaggaugggggaaaccgccucuaugauucaguuaucuccaccuggucccucccacuacacauggggauuauggggacuacaauucaagaugagauccagguggggauggagccaaaccacaucacucacugaaccucauuuuguuuauacuucauuuugagauaguauuugcucugccuuucugauaaagcuaugcagaauaccaaguuaguaccugguuucauauaugguuuauaauacauuauuccugauacaaucucaauuuacuguuuuuauacagccuauuacugcacaaacauuuuauaucuuaagcaauguggauuuuauuauaaucuccuacacuaaauaguuauaaaaacauuagcuauugguuugggaaaggcuacacucaaucuuaaauuuaaaagucaguuacaauuuuccauuaaaaaaauacaaaauaagcuacagaugucuuaucauggucaauucucuugaacaacuuucuggguuaaaaugcagaaaauauaacagaucucaguauacaauucagugggagaaagaacaguuccacuaaacugcuuucuucugacuuaccaugagaauuccaaagauagcauuaaugucaacuugaaaaaugauauuacaagcaccaaugcuagaaauuuuagaucgagggaguugcuccuugauguucaaugugcugaacaaaguaaagcaaaugggccugaaguaauaauuuaugcuuccaguacuuucaaaagcaaguuuugauauaagaaucaguuacccaugaaaauagaugaaauucacugaaaugaccuaguuuuauaauacaauaaaacguucuuuucaacuuuauaaaaguaauguuccucugaagaacagcugggaggauucuagauaucacaucaaaauacgugccuuccuaacauuagagauguuuuacguggaaugggauggcuugccugugggaugaagucucuggggagaacuaucaaaagcuggcugacuaccuaccaggaauggcagaaccaaggaguccuacauucaagaugugccaagagggagcagccucuaaggcagugaucucuaaccuuuuuggcaccagggacugguuuuguggaagaccauuuauccaugggguguugggggugggauggcaugagacuggaugggaugggaugguuuugggaugaaacucuuccaccucagaucaucagacauuaguuagauucucacaaggacuggaccaggcaaccuggaucccucccauguuuaguucacaauagguuuugugcuccugugagaaucuacugccaggaagcagcacucaggcaguaaugcucacuggcucaccugccugccacucaccuccugcuguguggcccgguuccuagcaggccauggaccaguaccuguccauggcuggguguuggggaccccugcucuaaaguaucugcguacaguuaaaaagacucaaauaguacaaaaggugauaauauacaaaguaaauauguacuaccuucuccuccauuccaauguucucauugcccagagucagauuuugucagauucacuugaaucugcuacugacauaauacacauauaaauuuucuguuuuuuauauaaauuacuguuuaaucugugauuaugccugcauucugaauguuuucacuuauaucgguaugauuuuagauauuucuauacaucaguaugguuaugcccacuuuuaauguaucagcauaauauucuacuguauaagaguuuuuuaaaggcuugcuuaguugauacaaauaaugcucucauaauauccucaucugugcgcauuuauacaauauacuaugaacuaauuaguuucuagaauuccuagaucaagggauauguacauaaaauucuaaaugacugaucuaaaaaauuucuguaccagcugcaugcagcggcucaugccugcagugggcagaucacuugaggucaggaauucgagaccagccuggccaacauggugaaacccugcuucuacuaaaaauacaaaaaaugagccaggcgugguggcucacaccuguaaucccagguacucgggaggcugaggcaggagaaucacuugaaccugggaggcagagguugcagugaguccagacugugccacuguacuccaagcaaagaaauaucuguuaucaauugacaguagaugaaaaugccaaucuggcaagccuuuuuagucuuugcccaucaggguuuuaaaaaacaauguuauaucacuguuuuacuuugcauuucccugacgacuaugagauugagcauaucuucauagguuuauuggcuguguauuuuuuccuguguacuauaaaauucuuugccuuuuuuguccacgucuaauagagauucuguuagacauccacacugaaauauuuauacauaaaauuauagaauugaaauuauuucaaaauaacccagugagggaaaagagaauugagcagguugagaaaggggaauacagauaaaacaagacugggugagagcugaucauugcugagcauucagcgcacuauucucucuuguguauguuuaauucuuuucauaauaaguuuucaaaaauguucauuuuucucugaagauguucauauuuaguauuucuuacugauuuguaagaacacuucauggaauaaaaaaguuugccuuuuguugcugacaaacuguacuggguacauaauacuagguaauccaguauugguacuggguaaauaauuacccaccuuccuucuauguacagucagauaacccaacaccauuaacuaaauaauccaucuuuccccuuucugauguaaaaagacacuuuuaucuugcacuaauuuccaauauaugcacaacuuuauuucuagacuuccaguuugccccauugaccuaucuaugcaugggaugugcaguuuuaauuucuauaucuuuacauuuugcuucugguuuuuuauuggcuauucuuaccuaaugguuuuucccagaugacuuuuauaauaauuguauuaauuuuccuaaguaucuacuacacuuauaaacaccccucccugcagaacuccuucccaaagacagagagccugcuuuucucuuucacacugguauguuuuuauguuuccaccuagggucucaucuguugcaugcaagcucagaauucacuugacaugcugauagcauauaauguuaaagaauucuucucucaguguaaaaaauauuuagcuacuguggaaggucaaacugcuaaaaccgacugguguaacauuugaaugcugcccuuuauauaagcuuuauuuuuauaaauaagcaucugacuagaaagucaguaaaagagcaugauauaaucagucugaagcccaguguuuuaaauauaauacacuaauuuuagacccaaguauuuuaguuuugcuuuauugucuacaguuucuuaagaagauguaacuuaaaagaaaaaaaaaaucuuuuaaauggcucaaucaauuuauuagaaauaagcggcaaagagcaucuguucccacagagcaacuguuaaguuaauccccauuaagucggccucaaagcacuuggaugcagcuacaggaugugggugugauaggaucacacaggcgaacaccugauagggccuuacacacaccgggcuaaucagaacaucaaaaaaaaaaccugaagucucuuggaaggacugaaaaauccaaucccuccccaacccccccaaaaaaaccucccaaaacagacuauuccauucaauucagauuuugugaauuaaugaaauuuaagagccaccugaaaccaccaaagauacacagugauuuucucccgaaucuaagguccaaaugacacagguagaaaaaugcacugauaaaauguuaacaaaaaugcaugucuaauacuuagagcuacgugugagcagguuuuaggagaaggauauugauucucccugaggcaugagcauuacccaccauuucaggaagccucugcaaguggagaagccacaaaccccuucaaaaagaucucucaauuacccacuucccaguccccucugauaugugguaaacaauuauuucaaugagguuggcagagauuuuucaaagcuagcaggcaggcauuuugcagcuaccuccagcugguccaagcagccaaggcugucaccagugccuggucaccgcugaaaacacaaggaggggcaggacuagggcaggagaguagauggagagagcugugucccgaaccaacauucuugagauuccuuugcuaguguuuuuucuucaggguucacugagaagaggaaggucagauggggagggacaaaacccaaggaaaugaggcucauuucaaacucuaacaacuugaucacaaacaaaauguauguagaauuacaaauaaguuauucuguuuucaggcaucaaaaauguuaucaaugaaauguugagaugcuaaagcagugaaaugugaaacgaagcagugucacaggcaacugggccucuccccuggcccaucccaggagggaugaaggguggcugauaugaacucuaaggauuauucugaaggggccaacaaauguuacaaagaggcucaaaaauaaaaaucagaaccauuuuucccucauucauccagggccuacuccuggccauguucugugcuuugcacuuuauucaauuuaauucaauuuuucuccuaagcaaucuauuuagauacuuuguagauguggaaauugguuuagggaagcuuacaucauuuucuugcagucauauuucuaguaaauugaaagaguugugacucagauccaaggucugaaugacuccaacauccacacucagaacuuccuucacuugggauugagaaaaagggaaauaauggaauugggagggggagagaagacaccaaguagagauaucagcauucagaacuuccugcaggagagggugaaagaagcuggcagccaggaacugagggccuuacugauuacuuuaguaucuuaccaaucaauugcauuccaaggcuugcuuacuuaggaggcugacugcuuaguccaagaagaaacacuggcugaacucuuugacuuauuuugcuggaggcagagaagauaagugguuaagaguaaagacaaugaaaacauaguuuaaacccaguccacuggccagcucccucccagcuggggauaacaguagguaccucacaggcugcugaaaagaaaaaauuaagugaaagcacuuuucaacaaggccugguucauagaaugagcuacauacaguaccugguaauuaguauuacuauugccacaaccaaggaggccucucagcaaacuauuuuuacauaugccagaaauacaguuauuuuuuccagacuaauaaaucacaaacaauauggcacgguugaccgccagguuacugaugcaauuucuuuucacuggaaccaaaaaacaaaaccaccaccaaaucugaacuaaguauaauacaauaauucucccugucuuaaauuuuaaaauacagaagaaaagaugaauugcuguauacucuaaacgcucuuuuaaauguuuggaguacagaaugucuuucaugaaaucaucuugauuaaaauguacauucuuuuccaagaagggaguaaacugaguauggaagacccucaccauuaguuuuuauaaaugauugaucaaugggaaucgucacugaaaaauugcauacaauuuuuggaaugaaugcaaauugauggaauguuuguaagcucaugugcuucuuccaacaccccagcaugcucccaccucacagccuuuacacuguauuguucucuccagguuuaauacuuguagaaaaggggaaaaaaaccuuuuuucucuacccuguuagguucagcacaugaggccuugccaauuaaacugacgagacagauucgcaggggaaaaaacacaaauuuuauuuaauguuauuauuuuuacaugagggaggggagaggagggagcuccacagaaaagcaaaaacccaaaagaagcaguuaggccugagagcauacacaccauuuuaacaaagagcaauaaacuguggagaagucacaagacaaaggagaggggauuagggcuuccaggggaagugugguaagguaaauauaugggggaaacuaauagaagauaaggguuauuucaauaagguuuguuucugcaggcgauggugccaccucuaguggucucuccagggauggagaggggaaggaggauaccuucacacagcaaaauuuuuauaaaaaggggguaaagcuuguccugggucugcuauuucucgauugucuucagcucaaauuaguacuuugcugaaauggcauauuuggggguagcauauucugauccccuucauacccuuccagacugugucucuauccagcuccucacuggcuuaauuuuucuucauagcacugaccaccaaguggcacagaguauacugauugacaucuagauagacagauagauagacagauagauagacagacagacagacagauugacugauuugcucucugccccacccaacaaaguacaagcucugugagaucaggaagcuggccucuuucaugguuguaucccaaugcuuggcauaguguugguguucaauuaaugcaccaaauaaaugaacggauuuccauauuauaucaauauuuucuuacaauuagaauuucugugauguugauaguguaagaauuuguuuuuauuaguuuucaacaguaucaacauuuacucauuauguaguuacaguauuguauuuuuuuaaaguaaacaauaaacaacacugucuuugcuccaaauaccuauaaugugaaauauauaaaacuggccgacugaccacagaaacggcaguuaauaaucaaaauuacaugugucuggcugaauggacuccacgaccuuacacuagguucuguaacagcagcauuucaucacaauuuguuaaauuugaagauaaauaccgucucuuuucuggucaaagauucuuauaucuuuggaaacuugacagaauuaauguuuuugacuuguuuuucaccacauaacaucaggagagacuuuaacagcagugaaguggcaaggaggacgcuuuauuuauauccguguaaucauguaacccacuucaugcucccacugaauggcuccaguaaacugaaaucacaauuucacuaauaucuacauuccagcuccagcuacauuugccugucaaaugcaacaacuuacaguuaagcuucugccuacacgagcaaucacagaaccauuaaauaagaggauugcuuguuugaacuacuagaucagccuuuccuuauuuuugcuaaucugugugguguacguucauuaccuuuuuuuuuuauguuaaagaccaccaugcguaacacuacuugacagcagcaauuuauagcagugguccccagccuuucuggcaccagggaaugguuugaugaaagacaauuuugugguuugguuucgggaugaaacugcuccaccucagaucaucaggcauuagauucuaauaaggagugugcaacgcagcucucacuuucuuacaugcgguucacaauaggguuugcgcuccuaugagcaucuaaugcccugcugaugugacaagaggcagggcucaggcagcaacacucacucacccauugcucaccuacugcugugcagcaaagcuccuaacacgccacagaccgguaccaguccauggcccagggguuagggacuccugauucacagcauuacaauaaauaauaaauaauuaaaauauuaccugauauuuggcaaacaaucccucucuaagucacuacuuccagccuauguucaggcuagaaaugccaaauaaaaaagcacaugucugucugggcacgguggcucacgccuguaaucccagcacuuugggaggccgaggcggggggaucacgaggucaggagaucaagaccauccuggccaacauggugaaacccuaucucuacuaaaaauacaaaacaaaaacaaaauuagccgggcgugguggcgggcgcccguagucccagcuacucgggaggcugaggcgggagaauggcgugaacccgggaggcggagcuugcagugagccgagaucgcgccacugcacuccagucugggcgacagagcaagacuccaucucaaaaaaaaaaaaaaaaaaaaaaaugggccaaggaucugaauagacauuucuaaaaagcaaauguacaaacaaacaaaacaaaacaaaacaaaagcacaaguccacaacuacauagcuccaguuucccuaaacagauuuacccauucaguaaacauuacauguacaaagaacuuaaaauaguaugagauuuaauguuaagaaauaaaauguaggaucuaaaacguaaucuauagcauaaucucaaaaaugguuuagaaaugacauaauaauacagacauuugugggugguaggauuaugcauauuuuuauauauuuuuaaauauauuuuucaaaagcuuccuauaaagaauguaauucuuucccaauuccaaaucuagcuuaaacauaauuuuacaaaaauuauucucucagaauguaaacuaguaccaccucuauggaaaacauuauggagauuuccuaaagaguuaaaaguagaucuaccauuugauccagcaaucuuaauacuggguaucuacccggaggaaaagaagucauuguaugaaaaagacacuuguacacauauguuuacaggaccacaauucacaaaugcaaagaugcagaaccaaccuaaguggccacugacuaaugagaggauaaagaagauguggcauauauauaucagggacuacuacucagccauuacaaggaacaaaauaaugucuuuugcaacaacuuggauagagcuggaggccauuauucuaaguaaaguaauucaggaauuggaaaaccaaaaaccguauguucucucuuauaagugggaacuaaguuaggaauaagcaaaggcacacagagggacauauuggacuuuagagacucacgaggaggaggguaauaggggacuagggauuaaaagaaaaacuagacauuagguacaagguacccuacuuaagugcacuaaaaucucagaauucaccacuacguaauucaacuaaguaacaagaaaccacuuguaccccaaaagcuacugaaauaaaaauuauucucucaaaaauuuuaagcccuaaacuucaguuccuauuguuuauauuuacuaagaaaaacaacagaaaacacuguuuuaaaaaugguggauuuuuuuaagguuaaagguauauaagacagcugccuaaggaaacgcagauaccccuguaccuuguuguuguuguuguuuuucacuuuuuuaaaaaacauagagaugggaucuccuuaugcugcccaggcuugucucaaacuccugagcucaagcaauccucugaccucagacucucaaaguuuugggacuacaggcgacagucaccaugccagccaauauccuuguacuuuuaacucauuccuacaagccaugaauccucuaagcauugucccagacacagcacuggcaaacuucaaucguuuucaucagaauauaaagaaacacagggcaugcuuaacuucaagguugauauuuccuuugugaguaaagccuugccacagaugagaaguccugaggaucaaacaggaaaacuuuaaguuuaauuaaaucuaaaaucauaaaaccuaaguuauaugacuaagcaaacucuucaaagcacucagucaacauccaugcugguaaauauuucaggaaugaaaugaaaaauaacuuucaauucuaaaaguucauccaucaugcaugcuucacguuguaaagcaaauauuucacaaaaaugaguuuacaacaaaagaacaccaaucccacuucuccaacccuccaugucaggcaguaagcuuuccacauuugcuuacauucugaaaauaacuauuuuacaugccaggaaugcaauaggcuuaagcugucaaaaaguaucauacuuuaaguguaacuggguaagaacuaugggcacacacacaauaagccuuccaaaacaaggggagguaaaugaaaucuuaauaccuguguuuccagaagcccagaaaugaagugcaauuccuuauaaucuguacauguuuacauacccauacagacaauaaaauguguaagguaaugacagguccaucucuccccuuccuuuuagugggcaucugacauuucaggguucagaaucacauauccugggucccaaaagguccccccauuccuauuccaacagugcucacaauagaaaaagaugaacugaucacuggacccuacaucaucucauauauguauaauacuaguccacagagagguugaagauaugccugguaacucuauucauccuaccccacaaguuuuguccaaaucaggccaugccuucaagugggccagauugucuuaaagcuccuggcuuaauauuuaacugauagcaacaaccuaacguuaguaccuuaguaacuaaaggggaugcagcaacaugaagcagaaaaagugaugaagaaagagauuagaaguuagagaacagggacugggcucuugauccuuaaaaugugggugauuuugaacaacucaacaucuccagauauuacuuucuucaucuguaaaguggagaagcuuaaaaaggaggucuuauagauucuaccuguuccagaaacuaugauucucuuccuagacagcugcagguugaagagacucuccuagagcugcacuguccaauacaguaaccacuagccaucuguggcuacuaaguacuugacaugcagcuggucugaauuaaaauaugugaaauauguaaucaggugcgguggcucacaacuguaaucccggcacuuugggaggccaaagcggcaagucacuugaggucaggaguucaagaccagccuggccaacauggugaaaucucaucccuaccaaaaauaaaaaaauuagcugggugugauggcacacgccuguaaucccagcuacucaggaggcugaggcaggaaaacugcuugaacccaggagguggagguugcaaugagccaagauugcaaugagcaagcuagauugcacucuagccugggcaaccgacugagugagacuccgucucaaaaaaauaguaauaauaaaauaaaaaauaaauaugugaaaugugaacauuuugaagacauaauaugaaaaaauaauguauuucauaaauagcuuuuauauugacccccuguugaaauaacauuuugaauuuagugacagacuaaaauuaauuucgccugcuuauuuuuuuauguggcuacuugaaaacuuuaaauuagaucuaacgguccuauuauaccucuacuggauaauucugcuuuaaagucaguccugggcaugcaugacgcccagaggaauucacagauaaaaugagcccaggaaucuguauggaauacagaccuguagguuaccauuuccauauuaaauguguaaagggcuguuuuaaaaccaugcuuuuguuuucuuauuuugugcaccaacaauaaaucaacagcaaauaucauugggucuaaaaauaauugauaucuggcugggcgcgguggcucaugccuguaaucccagcacuuugggaggccgagacggguggaucaugaggucaggagaucaagaccauccuggcuaacauggugaaacccugucucuaccaaaaauacaaaaaaacguagcugggagugguggcggaagccuguagucccagcuacucgggaggcugagggaggagaauggcgugaacccaggagggaggcagagcuugcagugagccgagaccgugccacugcacuccagccuggacaacagagcgagacuucgucucaaaaaaaaaaaaaaaaaaaaagauaccacuucauuuaugcuaugccugaauccuaauuaucaacuguaggccuuaacaauaauccuaaguggaugugccuuuaugcaggcacuuguggccuuuuuguuuucuuugaauuaaauauacaaaguaauaauuuaucuuacuucauaaaaagauuauaaucucccauuuuuuaaaacacauuugauauuaguaggaauaacuaaaaugaacucguaugaauagaccauuuuuauuucauugauaucuaacuaggaacguugcaacuaauuuuugcaaucuguaucaauuuguuuaauauauuuuaaaugaacaaagaagcagagauaguuucuagagagcuuauuuacuuaaaaauacaacagauauuaaucaauaaaauauuaauaagauucaggugagucgagagugaguacucaaguucucuuuucucacaacguauucuuggagugccaaccuuuucaguucaaugauuuuaugcaaagguauacaucuaacugccugcaaaauaaacuacugacuauuuuaaaucagauaaagcaaacaacagcccccagcucugcaauccaaagccagcaaaggucacccauuucagacuggguuugaagcauagccaguuaugauagcucaaauauuuucagauguaugaaagcagaacagaauucagaaauauacauucuuuggcagacaauuuuuuuagaaccaaguuucucaaauuauauaauacaaacuauaugacuauuagaaaauuaugcaugaauuaaaggagauuuauuuaauuuucaaauucuaauauaauuaaaauuuucaaacuuaacuauaugggcuucacgggugaaaaaaaguauaauuuaaaaauaugagcaauauaauaugacagaaauauacauucaaacacucuuucuaauuuuucauaaauuaacaacuauuugagacaugcacaaauuuucauguguuuuucugaaggugguauccagaagugauaauuuuccugacaguuuaacauuuuuuaaagacaugccaagauuuaaauaauguagcuuuuugauuacucuuuuuuuuugagacagagucuggcucuguugcccaggcuggaaugcagugguaugaucucggcucacugcaaccuccgccuccuggguucaagggauucuccugucucagccucccgaguaacugagacuacaggcaugcaccaccacgcucggcugauuuuuguauuuuuuguagagacgggguuucaccauguuggccaggcuggccuugaacuccugaccucaagugauccacccaccucagucucccgaagugcugggauuacaggugugagccaccgugcccggccuuuuugauuacucuuaaaacugcgggaucaaaaugaaauguuagaaaguaaaaccaacagcagaaaguaaaaccaagagcagcuucugaggaaucauauuuuagacauuucuuucagacagauucuguaaugugucaaacuauuggaacauauuucaacuaaauauuuaagugaagacaaaaucccuacuacaaaaccuccaaauacucuaacaaugaugauucuaucaggccuacucagaacuacagguuuuccccacaucuugauuucaaagcauacuuucugugacguaucuucauuuaaucacuuuuagaauaauugaacaagaaaauagguaaggaauuaaaauaaauuuuaaaauggcagucccauucuuacugacauaaauuuauuaagaucaauguuccuuuuugcauagaucuucccauucuguuucaauaacaccagcaagcauaaacagauuugaaaagcuacgcagccacagaaaacagguucagcaugacagacagaucuagcucaaaagaggugcucagugucaagcucuuuucuaaaaaccucaaagcuuguuuugucugcuguugcuuucaaagaacaagcacaacaaaauuguuuugaggaagucucuagaucaaacgaaagacaguuaaccaacagggagaguaaacugacugccacugcuguccacacagggccacagaaaucauugcuuuguuccaucacucuagcuggaaggccuucccaggaaugcaagucugaaccaucuagaguucucucagccagaaugaaggcucagcucuuggauguuucuaccauaaaaaugagaaagcauuuccuaccuccuccucugucacuccacaaagaugugcuuccuguguggcuggcuagcagauaagagaagguaagcaaaucccaaaagccuacucuaaucgcucacggagaaucuuagcuuugguucagaacguuaagucuacccauuuuccucuaucccuuuaugguacuguauuucuucuacaucccagaaugccaguugccacucaauauccuaccucuccuuuacccuuaagaagagagccggaaauguaauuucugauagcaaugcucccagcuaauagagcacauuuacaugcucccuugcaucgaggugucacuaucuggcccaugagauuaagcagaccuugaaaaggacuucuacaaaagcuccuaaaccuaacugaaccaugaauaucaaugccucguccccauuuuaggaacauuuaaaaguacuccauuucuaagaaaaugaaguucaaacucauuaagggcauccaaaauuuauaauuucacacugucuccuucacuuauuauaccccugggcuucccccuuugaaacucuacacccucgcuguuuuuucugucugggaagcccuccccaccccaguucaccuucacacauccuugaaaccuaguucaaauucugccugccuucucugggaagaguuuguaccuccucuauuauagccuuuggcacacuguaccuaauuauuucuccgucucuuucuuccuccacuggacugcggaauuccucaaggcacagacugaguuaccuuucuauuuacucacagccccacccagauucuagaucuccugucauaacugaaacacagaauccaugcaguauguccauaaaaugaauaauaauuucacaaauucaaaaugagagaaacaauaagauaguaaauuuuuuuuuuuuuugagacggagucucgcucuguugccuaggcuggagugcaguggcacgauggcucacugcaagcucugccucccagguucacaccauucuccugccucagccucccgaguagcugggacuacaggugccugucaccacgcccgguuaauuuguuguauuuuuaguggagacaggguuucaccauguuagccaggauggacuggaucuccugaccucgugauccacccgccuuggccucccaaagugcugggauuacagguguaagccaccgcaccaggccauaaauuaguaauuuuuuaaacaucuaacuccaaauaaaugucaacaucacagaagucaaucacaaaugcccugagaaaacuugcaguagagacauaaaaggggaaugcacaauccaaauauucagcuaaacauucugcauuaaaccuucccccucaucugcacacagaagaaucacgggcuuaggcuuggcuuuguguucaaccucugauagaaaugagcaaacgagcaaugaagucaacaugucagauugcuuuguaaaucuaaauaacuucgcaugugauaauaaauucuaagaaugcauccaaugucuuuuucucugcaacaacaagacacuaauauuuuuuucucaucucaucggcuauuuauuaaaucaauaaauacaauuaaaaacacaugcgcauaagaaauacucucaauaaacugaagggaugcuucccaucugugucccuacaauaugacccagaaaauucacaaugauauaaauuuaaccuuugagucuagcucacaaaagugaagugaaauauccaaauagcaaauacgaagaaaggaacuaccaagaaacaaggaaagucagccuccaauuuuguucauuuaaguauacccucucugccaccacaacauucauuauguuuguccuggacagcucuaauggccaugcugauugauacucaguguuaaggccaccucuguccaacagacagagguggcuucuacucuguuucagccaaauacucacauggcuacucuaucaucaccuggaaaucucccagcuucccucaggaauuccccccucuccuauuucacugaacaagcaggaauaagugauuccaaaauugcaauuuugucucaaauguacucuuaaaagugaaacccuccacaauucaacuagcagcaguucuguaagcugccuuuacauucaaacacccuauggguuagccaagaacgccccuccacaacaaccauagaauuuuuauauucguuuuacuucuguugcauuuaaauuuucuggauucugugguauaagaggauuuaacacuugacacaaaacauucaaaauaagauugagaaaauacuagcaagauacaaggcuaaucauaaugaccucaauuagauuuucaauuccugucaaguuaaugguauauaguaguauuggcuucaagcucuucaaauugaaaaauacaauucuuuuagauaacagagguaauagaauucaauauauuuuuuuaaagggccaauuuugauccuugucacacuaaacacuagcuguaaaauggccaaaaaaggagccaaaaaaaaagacaaugacagagaaauuuucauuuucaugccacuaaauuuaauuccaauacacauuuucuuuccaaacucuacuaacuucuucacacaaaauuaugucuaggcacccucuauugaaagugucccaaucaaucagggcauggaugaaauauuucaaaaaugaggcauuuuuucuuuuugcaggccaacugaauuuuugaaauacaauugcaaaugacugaacgugauguauugacaguauuuaugaaaccuuuucacaauaaaauguuccaaaaagaggcugaaaaaaaagaaucuuauuuaaaaggcuuuaaucuucuuucuaugcuuguucgcaguuucuuaaauguugagaagguugcacagcuguucgaaucuucaaucugaacguaauucuuuaucaccacaacauagaauuucuagagaacucauuuauuuaguacauacaaaauguaaggcauuaucaugagugaucaaacaaauuacuguauagaaaagugugugaucacaaucaacacuaacuucucucucccaccacuuguuuucaacauuuaaucacccaaaguagaucuucugucuacaauuauucuuuuacaauguaguaaauauauaguuccuucccccaguuaucuaaguuuaccuucacauacugaaaugaucagagaacuuugacaauacuacagaaacuauugcauucacaacacacauccuucuacguagcauucucuuauauuccuuacccaacuuaauuuuuuccaagucacuuccuuccuccuuuuuauucugucuacccucuugggggcaaggaccucgaaaauauuugugaaaugaaggaguggcccuuucuugguuguaccccuaagaaucuagguuucuuuguguaugaaaauaagcuaauuuccacagaaauuuggcuuuaauuuuaaauugcuaaucaauuuaauauguaaguaucuaugauuaauuauucuuagaauaauuagucugcauauuuucacauuucuaugggaguuucuuagguacucuucaguuauauccucaaacuaauuuacuguaaugacaaaauuauauuuguguuaaaccauaauaagcaauugagagcaucaggauggagaauauuugcuacuacauaucacuuuucauaugauggguuuuaauguuagucucugaagacuuaagcuaagacuucaaaaacuuugcaucgguuuuaaaggcuuaaucuuugaaguagaugaggauuuuuuuuuugaaagauaaaaaaaucaauaaauacaguuaagaaacagugcuuauccaucuuuauucuaugagccuaucaauucaauuauaaacaaaauaacugaguaaugauauuuauaaaaacaacauuggccaggcacaauagcucacaccuguaaucuagcacuuuggaaggucgaggcaggaggaucgcuugagcccaggaguucaagaucagccugggcaacauaguggggaccccaucucuacaaaacauuuaagaaauuagucagaugugguggcacaugccuguagucccagcuacucuggaggcuggggcaggaagauggcuucagcccaggaggccacggcuacagaucacaccacugcacuucagccugggugacagagugaggacuugucccgaaaacaaacaaaaccaaacacaguaucaauaugcuuuugaaaauucauccaauaguaggaguagauauaacaaguccuuuuuuaagaugaauaaaccuuuaauggauaaagccauuuucuuuacuuucucuuaaaaauaaaauuuauguugccucacuaauuuuacugugaaauaacgagcacacagacaaggaaaaacuaaacaaaugaguuuguaguaacuugggaugaggggcaggucuaaaacacguuaagucuaucucaacaguaggauuaaaccucucauuuuucuuccuguaaaauaucuccagggggucaaaauauauuaguuauucaauguuugaaauuuagcaaagcagcaagaguaauaaugcauuucuucacuuaacacaaaugacuuuucuuuaugcaacagaucucuuauucucauaaguaucuuuuauggcugaaaaguaauuuaucagucuguaucaucuaggaugccuuacauuuuucaaugaagacaguauguggcuuucuggaagcuaaugaaagccaaauuauuaaauaagagacaaauuauuagauucucucaaaaaaagcaucaggcaaaaaaaaaaauuccuaucaaaaucaccaaaaaauuggccaggugcaguggcucacaccuguuaucccagcacuuugggaggccuagguggguggaucacuugaagucaggaguucgagaccacccuggccaauguagugaaacccugucucuacuaaaaaaaaaaaaaacaaaaacaaaaauuagccaggcgugguggcacaugccuguaaacccagcuauucaggaggcugaggcaugagaauugcuugaacccgggaggcagagguugcaguaagccaagacacgccacugcacuccagccugggugacacaguaaaacucagucucaaaaaaaaaaaaaaaaaaaaaaaaaaaaaucaccaaaaaacaaaagaagugacaauuauucuuguugaaucaaauuucucauaagaaaaccuucugacuuugugaagaaaaaaaggaaccaucuggaaauuaagagauucaaacacuguuugggguccaucauuaauaagaccuuaaggaaucacugcacuucauucaucaggauccauuaauuuacaaaacaggcuuauucaucuuuucccuuuuccaaaauguuuguccuauuuauuccucaucccugcucaugaacccuccacuccugcuucuggaaccaucuuaaucacuccucacuguaucuacuguaaucaggauguuuaucacaaauauggcuucugucauuacacauccucguaugugaacccacuucuugucuucuugucuuuaguuggacaggacaauuauaauuacaugagcugguuaacaaaaacccaugugaauucuuugggacucugcuucuugauuuuucccugcguucaucaucauuuaaccacaguaucaccaguuucauacacucaaggcuuucaaauauccuuggccugcuuuugaagcuaaaaaccuuuuauuuuugagcaacauaugcugauuuuuaaaaaaaauauauaauuucaauuaaacagcagaucacuauaaaguuuuaaagauguaacagccauaacauggcugguuacacaaauucacuuuacugcagcugggcgcgguggcucacgccuguaaucgcagcacuuugggaggccgaggcaggcggaucacgaggucaagaguuugagaccagccugaccaacauagugaaaccccgucucuacuaaaaauauaaaaauuagcugggcauaguggcacacgccuguaaucccagcuacucgggaggcugaggcaggagaaucgcuugaaccugagaggcggagauugcagugagcugagaucgcaccacugcauuccagcuugggcgacagggcgagacuccgucucaaaaacaaaacaaaacaaaaaauucauuuuauuuugaaacugauuuccuagagaaaugccgcauucucaagcaaucugcuuuuugguuucccuguccuugggugaacauaacuucaagcuuccauauuaggaccaaaauucuuuugcuggcauuugaaaucuuccauuucuacccagauuggcaaagccuguuuauucguuuugcuagcaaagauucuacugaaaacuaaaccaagucuguucacaguuccuugcacauagcugauagccaacuaauaguuaauaaucaagccaguguauaaacuugcucaauauuagacaucuguggcaagcugccaguguguacaacauuaaaaaauaggucucugggaggccgaggugggcagaucacuugaggucaggaguuugagaccagccuggccaacauggugaaaccccaucucuacuuaaaaaauacaaaaauuagcugggcaugguggcgagugcccauagucccagcuacucaggaggcugaggcaggagaaucgcuugaacccaggaggcggagguugcagugagccgagaucgcgccacugcacuccagccugggugacagagggagauucugucucaaaaaaaaaaaaaaaaggucuacauccauguuauguggaaaaaaagaaaaaaaaaaacuagguauuucccauuuguguaaaaaaugcuuaugcuuuuugcacauuucuguacuguuuuaaauuuuucaaugagcaugaauuauuuucauuuuucaaaaaaccaauugaaauacacaauacauauuuaauaaaugaaauuuuauaacauguauucuaaaaauuguaucugagauaccaugugcuuuuuaaauuuagaucaaacucauagacaacaaucugucaauuuccugcaauagucuuaauuggccaauaaguaauuugucaauaagugaaacaucaucuagauuuuuaacuuucaacuaugcaggaaacuuacauauacccauuguacaucaacaucaucaccauacauagcagcaacuaacacacagugcuuaugcuaugccaucagguuacauauauauuaacucacacacuguuucaagcauuuaacaaagauauuaauucgauccucaauaacuagaaguacucaucccauuuuacaaaggaaaaaacugaggcacagaaacuugcccauggucacuagcucaaaagaaacaaagacagaauuuaugcccaugcauuccugcccuggucuaaacucuccugauuagugugcaaugcugccuucucuacauaccugagaaacacucaaugacucaguguuauuggccuaacaucacgccuggcaucaaauucaacauuauaaauugagaacaacucugguucguucuacagaggugacauuuuuaaaaaccucucaucuuccccauuuuaacuaucuucuuucguaagauacugugagucucgcaagguucaagcuaaaucucuauugcauguuucuucaacauguagccacacaaaauaaaccuaaauaaaaugaucucuuagguuucuauuucagcagauuuaauacaugugaaccugagacuucuguggcccucucugaauacucagcuagcuaaucuacuaagcaucccuguuucauaaagcuauuaauugaugcacauauccaggcuuuuaaauuuaaauaugugaauuuauuccuagagcaaucauuguacuccaguuuuugccagauuucuacuucugaagagguaccacucaagcauaauaauaaucuauaaccaagauuaaucuaaagaggaaaauuugccaaacuuuuuuuuccaagaaaaauacuaguguccucacaguaaugauuauuucuuaagccauccacacuaaacugaaaaaauaguuacauaacauuucccccuuuacuaagcuuuucacuugcaaaaucagcuucaggguuugaguucugucugcuuuucuucuuauacaacaauaaaaaaagaaauacauauuuuauugauuaaacuugcuacucauucuggggugugcucauuccuuccccugccaccuucugucuucuguguacagaugaggguguuaucuguacacuggcugugagacccacagggugacagcguuuccaaggguuugcaaaagacggcauuucccauccauccccacuccauacauuugcaucugagcucucacuaugaaaaggaaaagauuuuuuuauuucuguuuucuucagcccuuuucugucuacaaagccaaucuccucuguucaacucaucggaacauuuauacuauuuuacagaauaguguugccugaauguagaaucacaacaaagccaguugagaucuuuaaauuaaaaaaagaaaaaaaaaagauuucauaaucaagcauagucaagugaaacagagagagguugaaaaccaccagacaaaaacaaaacacaaacagaaaaugugauuuuucccuauccuccucguugccacuguucaucucauacucugcccaucaagaugcuacugaagcucucugguccugcauucagccccuuaccuuugaccucucaacuccuuauuucaaauucccuacuccuguugagaauacccugcaccagcaucugucacucaagugagagagagagagagagagagagagagagagagaaagagagagaaagagacagagggugugugugugugugugugugugugucugucugucugucugguagaggcagagaggaauguaaacaaauauuguauaugcagaaacuuaaccuccaauccccagaccugggauauaaaccuggcuggaaauuuacuaccaggaaaugcuccaggauuaucuaugaucucaucccauuguuccuuacuuuuuaaauacaggaaguuuucucuguaacauauuuacucaguauaccuaaucuguauuuuccuuuugguauuuuaguacauuccacuuuguuuuauuaucaugugcauguuuuauuuacccugcaaacuuccugggaguaaggggagggaggagggaaggggagguaaugagguaugcagucgaacuaaaccuuacauucuggaagcuuuaaauuuaaaaugcaucuguacagguuuaucuuuacauuuguaauugauagagauuuuaaaagaaauguauuaaugaaagaugcuuuguaagauucucaagguaauacaauuugcagaaacaauguacauuucuacugaauuuaaugcacuucucacugauaguuuaguggccacgugaaaugcaaguaauagcuaugcuuauuuccagaaugacugacaacauucauacaaauaucuguagaagacucuaguaugcaaaaaacaguaacauaaaauagagauccucuagcaacaagacuuaacauaaagacaaccucucccauuccuucaaaccaauauuguugaucacguuauuucuuuuuaauuuuuuugaaucagccauuccucauuuaaccucgugaacuugcauguuccuuuucauuuccucagucaggaccaguauuauuccaucuaguaacuucuccgcaguacuaauagccuugcaaaugucguucaggagccucugcugguuccggugacaagagaaaagcuucugcagucugccaguuaucaugguuucucaucgauuagcaagaaccgugacuccuuacagaucaccaucaaaccugagcuuuacuauucugugugucggcuucuaccuuuagcgagguacuagucaguagcagcagguuuccauaaacuauaaauuagcacuaccacaaagguaagaugauugugacuagguuaaacccucaacagagggaaauaaaacuuaagaggaagcuagauuuaaaaauaaauaaauaaauaaauauuaggguagugaaacaucauauagauuaggguuuguuaaacucacaccucuaucaacauaccagccaaaaucaucaacccagauaauaaccauguuucccccgauagccaaggccccauuaucauugcccuuauucauuucuuuucuacagccaccugcagcagaccuauuuucuaagcucuauaaaagacagucaacucguaauuacaucuuuucaguggacacagagagaaccagauaaaccacccucaaaccucaguagacugaauuaccuacccuucuaccaacacuucgcaaaauggcauaaugugaaucucaccuccacccuuuaaaggaguuaacaauagcuacugaaaaggucccaaaagauggcagaaagagcauauuaaugcaauuaaacagaccaaaaacuaaauucgaaucugccuacaugcuuccucuuuuuauacagaaagaaauauugcucaacaaaguuacauauuuaaguuuugacaaaagcuucaaaaauacgguuaucauaugcuuuuaauuccuuaaauguaugguuuuuaaucuguaguaagaccauucgggaaaacuggaauaauucuacaaauaaauguaaguaagucaugagagaaaucagaauucucuuaguuaagugcauuuuuuuaaaacauggaaaacgaaauucuuuaacucuuaaaacaaccugucuuaacuagcccuaaggugauuccugagccacuuguggguaaaaaucagaagagaaaaaaguucaaugaccuugcaaauuagaaacuaaaaaacuaauggugugauagucuguacagccucaguggaauuacaggaaaacaucugcccggaaauugcuuuuuuucuuuuggaaaauuacuaggaggcugggggaaaagaggggaaaaacggguaaggaagguugcaaauguuaagaugccaaacaggaacccaaccgaaguccgaagugaaauacagccuccucuggcccaacugucaugcaaacaacuucuaagcaucuucagauguaaagaaaaacagucauugugcacaggcguuagcugaauguucgagaguuggaugaauggggaagacuuguuauacaccuagugguggguggauuucacuaggcugcagccuccacacagcuuuucuuugcugcacugcagaggcgccaucuucuccgucuuaaucuucacucaauucgauccuuuuaucugcacccuaaaaaaaagacccuucggacccuccccagcauccugugcccccaggggaacuaaaccagaguccccagagcugccagggaagaggccgcgccuuaaucagacaaacgccuccuuggaugcacaggacagagcccgugccuccccaccauccgccacugcccuuuccagacgcacaucccacucuccgccuuauuuccuccccgccaaggacuuuacagcccagcacagaauuaagccucggaggugauccgagggugggaagcagaggggccccgaggcuccgccagaagccccggcagcgucucugcccccucccaggcggacgcgcagccccgggaagggagccgggcgggagccucgguggcgcacugagacuaacgcggcucggcccacggcgagggcggggugucgcggcuuuuguucccgcggaccuucugccucucagacagagcuuagggugcgagcgaacucccgggacguccagacuuggggaaggcgcgggguggcuaugggucuccgaccccucccauuucucgcaaguuacacaaaagggagacgcggacaugcacaaaguuugccuguggaaggcggugcgcgaccccgacgccggcucgggcuagggucgcacccaggcugccgccgccagcagccgcgaaaagagguuggagcaaggaagggggaugggggugagagaggaaggugaaacgaggcggagaacgcagggaaaagcgaggggcuccuagcuuccugggcugucccgacuccuccuccuccuccccagggcccaagagaaaggaaagggcaacgauucaagagcgaaggacuggcuuuagggacgcugcguuuucgguuuuccccacgugcuccuucccccuuccccccugucugaaugucucucgccucccccgacccccgcuuccaaggcagggacuaagucggggucugggcucagggucgcccccuacccuucucgccccgggcuggcgcggaaccagggagaccagcgccucgcccgcucccucucagcgggccggagcgcgacucccuggggcagggcugggccgaaagcggggaugcgcuggacguccgcaagcgggggcggagaggagaggggucccauugacggacccccggcuucucugcauuaaagacuuggguuaaggucuugggggguaucgcguccccaccgugcagccuccccccgccuuccgaggcgcggcacccaccuccagcgcccgagccguccaggcggccagcaggagcagugccaaaccgggcagcaucgcgacccugcgcggggcaccgagugcgcugcugugcgagugggauccgccgcguccuugcucugcccgcgccgccaccgccgccgucucccggggcccccgcgcacgcuccuccgcgugcucucgccuaccgcugccgaggaaacugacggagcccgagcgcggcggcggggcucagagccaggcgagucagcugauccggcccaccccgcucggcacccgagagagaccccuagcggcgccgccggggaacugcgcccgcucgcgccgggaggggcccucgcgccccgcgcccacaggugcacgcgcccuuggcgccgccugcaccccacgcgcccccuccgcuccccggccgacggcccaccugggcuucgugaacagugggagggagagucuggggccaggagagggacggugcaggaucagggaaaggugaguccuaggacgcugaggcucuagaaaagucgagagcgcuccugcucguccccgugagcuugaaucauccgac

SEQ ID NO: 192975 - RNA, 290586 nt, Homo sapiens
gucggaugauucaagcucacggggacgagcaggagcgcucucgacuuuucuagagccucagcguccuaggacucaccuuucccugauccugcaccgucccucuccuggccccagacucucccucccacuguucacgaagcccaggugggccgucggccggggagcggagggggcgcguggggugcaggcggcgccaagggcgcgugcaccugugggcgcggggcgcgagggccccucccggcgcgagcgggcgcaguuccccggcggcgccgcuaggggucucucucgggugccgagcggggugggccggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggugggugccgcgccucggaaggcggggggaggcugcacgguggggacgcgauaccccccaagaccuuaacccaagucuuuaaugcagagaagccggggguccgucaaugggaccccucuccucuccgcccccgcuugcggacguccagcgcauccccgcuuucggcccagcccugccccagggagucgcgcuccggcccgcugagagggagcgggcgaggcgcuggucucccugguuccgcgccagcccggggcgagaaggguagggggcgacccugagcccagaccccgacuuagucccugccuuggaagcgggggucgggggaggcgagagacauucagacaggggggaagggggaaggagcacguggggaaaaccgaaaacgcagcgucccuaaagccaguccuucgcucuugaaucguugcccuuuccuuucucuugggcccuggggaggaggaggaggagucgggacagcccaggaagcuaggagccccucgcuuuucccugcguucuccgccucguuucaccuuccucucucacccccaucccccuuccuugcuccaaccucuuuucgcggcugcuggcggcggcagccugggugcgacccuagcccgagccggcgucggggucgcgcaccgccuuccacaggcaaacuuugugcauguccgcgucucccuuuuguguaacuugcgagaaaugggaggggucggagacccauagccaccccgcgccuuccccaagucuggacgucccgggaguucgcucgcacccuaagcucugucugagaggcagaagguccgcgggaacaaaagccgcgacaccccgcccucgccgugggccgagccgcguuagucucagugcgccaccgaggcucccgcccggcucccuucccggggcugcgcguccgccugggagggggcagagacgcugccggggcuucuggcggagccucggggccccucugcuucccacccucggaucaccuccgaggcuuaauucugugcugggcuguaaaguccuuggcggggaggaaauaaggcggagagugggaugugcgucuggaaagggcaguggcggaugguggggaggcacgggcucuguccugugcauccaaggaggcguuugucugauuaaggcgcggccucuucccuggcagcucuggggacucugguuuaguuccccugggggcacaggaugcuggggaggguccgaagggucuuuuuuuuagggugcagauaaaaggaucgaauugagugaagauuaagacggagaagauggcgccucugcagugcagcaaagaaaagcuguguggaggcugcagccuagugaaauccacccaccacuagguguauaacaagucuuccccauucauccaacucucgaacauucagcuaacgccugugcacaaugacuguuuuucuuuacaucugaagaugcuuagaaguuguuugcaugacaguugggccagaggaggcuguauuucacuucggacuucgguuggguuccuguuuggcaucuuaacauuugcaaccuuccuuacccguuuuuccccucuuuucccccagccuccuaguaauuuuccaaaagaaaaaaagcaauuuccgggcagauguuuuccuguaauuccacugaggcuguacagacuaucacaccauuaguuuuuuaguuucuaauuugcaaggucauugaacuuuuuucucuucugauuuuuacccacaaguggcucaggaaucaccuuagggcuaguuaagacagguuguuuuaagaguuaaagaauuucguuuuccauguuuuaaaaaaaugcacuuaacuaagagaauucugauuucucucaugacuuacuuacauuuauuuguagaauuauuccaguuuucccgaauggucuuacuacagauuaaaaaccauacauuuaaggaauuaaaagcauaugauaaccguauuuuugaagcuuuugucaaaacuuaaauauguaacuuuguugagcaauauuucuuucuguauaaaaagaggaagcauguaggcagauucgaauuuaguuuuuggucuguuuaauugcauuaauaugcucuuucugccaucuuuugggaccuuuucaguagcuauuguuaacuccuuuaaaggguggaggugagauucacauuaugccauuuugcgaaguguugguagaaggguagguaauucagucuacugagguuugagggugguuuaucugguucucucuguguccacugaaaagauguaauuacgaguugacugucuuuuauagagcuuagaaaauaggucugcugcagguggcuguagaaaagaaaugaauaagggcaaugauaauggggccuuggcuaucgggggaaacaugguuauuaucuggguugaugauuuuggcugguauguugauagaggugugaguuuaacaaacccuaaucuauaugauguuucacuacccuaauauuuauuuauuuauuuauuuuuaaaucuagcuuccucuuaaguuuuauuucccucuguugaggguuuaaccuagucacaaucaucuuaccuuugugguagugcuaauuuauaguuuauggaaaccugcugcuacugacuaguaccucgcuaaagguagaagccgacacacagaauaguaaagcucagguuugauggugaucuguaaggagucacgguucuugcuaaucgaugagaaaccaugauaacuggcagacugcagaagcuuuucucuugucaccggaaccagcagaggcuccugaacgacauuugcaaggcuauuaguacugcggagaaguuacuagauggaauaauacugguccugacugaggaaaugaaaaggaacaugcaaguucacgagguuaaaugaggaauggcugauucaaaaaaauuaaaaagaaauaacgugaucaacaauauugguuugaaggaaugggagagguugucuuuauguuaagucuuguugcuagaggaucucuauuuuauguuacuguuuuuugcauacuagagucuucuacagauauuuguaugaauguugucagucauucuggaaauaagcauagcuauuacuugcauuucacguggccacuaaacuaucagugagaagugcauuaaauucaguagaaauguacauuguuucugcaaauuguauuaccuugagaaucuuacaaagcaucuuucauuaauacauuucuuuuaaaaucucuaucaauuacaaauguaaagauaaaccuguacagaugcauuuuaaauuuaaagcuuccagaauguaagguuuaguucgacugcauaccucauuaccuccccuucccuccucccuccccuuacucccaggaaguuugcaggguaaauaaaacaugcacaugauaauaaaacaaaguggaauguacuaaaauaccaaaaggaaaauacagauuagguauacugaguaaauauguuacagagaaaacuuccuguauuuaaaaaguaaggaacaaugggaugagaucauagauaauccuggagcauuuccugguaguaaauuuccagccagguuuauaucccaggucuggggauuggagguuaaguuucugcauauacaauauuuguuuacauuccucucugccucuaccagacagacagacagacacacacacacacacacacacacacccucugucucuuucucucucuuucucucucucucucucucucucucucucucucucacuugagugacagaugcuggugcaggguauucucaacaggaguagggaauuugaaauaaggaguugagaggucaaagguaaggggcugaaugcaggaccagagagcuucaguagcaucuugaugggcagaguaugagaugaacaguggcaacgaggaggauagggaaaaaucacauuuucuguuuguguuuuguuuuugucuggugguuuucaaccucucucuguuucacuugacuaugcuugauuaugaaaucuuuuuuuuuucuuuuuuuaauuuaaagaucucaacuggcuuuguugugauucuacauucaggcaacacuauucuguaaaauaguauaaauguuccgaugaguugaacagaggagauuggcuuuguagacagaaaagggcugaagaaaacagaaauaaaaaaaucuuuuccuuuucauagugagagcucagaugcaaauguauggaguggggauggaugggaaaugccgucuuuugcaaacccuuggaaacgcugucacccugugggucucacagccaguguacagauaacacccucaucuguacacagaagacagaagguggcaggggaaggaaugagcacaccccagaaugaguagcaaguuuaaucaauaaaauauguauuucuuuuuuuauuguuguauaagaagaaaagcagacagaacucaaacccugaagcugauuuugcaagugaaaagcuuaguaaagggggaaauguuauguaacuauuuuuucaguuuaguguggauggcuuaagaaauaaucauuacugugaggacacuaguauuuuucuuggaaaaaaaaguuuggcaaauuuuccucuuuagauuaaucuugguuauagauuauuauuaugcuugagugguaccucuucagaaguagaaaucuggcaaaaacuggaguacaaugauugcucuaggaauaaauucacauauuuaaauuuaaaagccuggauaugugcaucaauuaauagcuuuaugaaacagggaugcuuaguagauuagcuagcugaguauucagagagggccacagaagucucagguucacauguauuaaaucugcugaaauagaaaccuaagagaucauuuuauuuagguuuauuuuguguggcuacauguugaagaaacaugcaauagagauuuagcuugaaccuugcgagacucacaguaucuuacgaaagaagauaguuaaaauggggaagaugagagguuuuuaaaaaugucaccucuguagaacgaaccagaguuguucucaauuuauaauguugaauuugaugccaggcgugauguuaggccaauaacacugagucauugaguguuucucagguauguagagaaggcagcauugcacacuaaucaggagaguuuagaccagggcaggaaugcaugggcauaaauucugucuuuguuucuuuugagcuagugaccaugggcaaguuucugugccucaguuuuuuccuuuguaaaaugggaugaguacuucuaguuauugaggaucgaauuaauaucuuuguuaaaugcuugaaacagugugugaguuaauauauauguaaccugauggcauagcauaagcacuguguguuaguugcugcuauguauggugaugauguugauguacaauggguauauguaaguuuccugcauaguugaaaguuaaaaaucuagaugauguuucacuuauugacaaauuacuuauuggccaauuaagacuauugcaggaaauugacagauuguugucuaugaguuugaucuaaauuuaaaaagcacaugguaucucagauacaauuuuuagaauacauguuauaaaauuucauuuauuaaauauguauuguguauuucaauugguuuuuugaaaaaugaaaauaauucaugcucauugaaaaauuuaaaacaguacagaaaugugcaaaaagcauaagcauuuuuuacacaaaugggaaauaccuaguuuuuuuuuuucuuuuuuuccacauaacauggauguagaccuuuuuuuuuuuuuuuugagacagaaucucccucugucacccaggcuggagugcaguggcgcgaucucggcucacugcaaccuccgccuccuggguucaagcgauucuccugccucagccuccugaguagcugggacuaugggcacucgccaccaugcccagcuaauuuuuguauuuuuuaaguagagaugggguuucaccauguuggccaggcuggucucaaacuccugaccucaagugaucugcccaccucggccucccagagaccuauuuuuuaauguuguacacacuggcagcuugccacagaugucuaauauugagcaaguuuauacacuggcuugauuauuaacuauuaguuggcuaucagcuaugugcaaggaacugugaacagacuugguuuaguuuucaguagaaucuuugcuagcaaaacgaauaaacaggcuuugccaaucuggguagaaauggaagauuucaaaugccagcaaaagaauuuugguccuaauauggaagcuugaaguuauguucacccaaggacagggaaaccaaaaagcagauugcuugagaaugcggcauuucucuaggaaaucaguuucaaaauaaaaugaauuuuuuguuuuguuuuguuuuugagacggagucucgcccugucgcccaagcuggaaugcaguggugcgaucucagcucacugcaaucuccgccucucagguucaagcgauucuccugccucagccucccgaguagcugggauuacaggcgugugccacuaugcccagcuaauuuuuauauuuuuaguagagacgggguuucacuauguuggucaggcuggucucaaacucuugaccucgugauccgccugccucggccucccaaagugcugcgauuacaggcgugagccaccgcgcccagcugcaguaaagugaauuuguguaaccagccauguuauggcuguuacaucuuuaaaacuuuauagugaucugcuguuuaauugaaauuauauauuuuuuuuaaaaaucagcauauguugcucaaaaauaaaagguuuuuagcuucaaaagcaggccaaggauauuugaaagccuugaguguaugaaacuggugauacugugguuaaaugaugaugaacgcagggaaaaaucaagaagcagagucccaaagaauucacauggguuuuuguuaaccagcucauguaauuauaauuguccuguccaacuaaagacaagaagacaagaaguggguucacauacgaggauguguaaugacagaagccauauuugugauaaacauccugauuacaguagauacagugaggagugauuaagaugguuccagaagcaggaguggaggguucaugagcagggaugaggaauaaauaggacaaacauuuuggaaaagggaaaagaugaauaagccuguuuuguaaauuaauggauccugaugaaugaagugcagugauuccuuaaggucuuauuaaugauggaccccaaacaguguuugaaucucuuaauuuccagaugguuccuuuuuuucuucacaaagucagaagguuuucuuaugagaaauuugauucaacaagaauaauugucacuucuuuuguuuuuuggugauuuuuuuuuuuuuuuuuuuuuuuuuuuuugagacugaguuuuacugugucacccaggcuggagugcaguggcgugucuuggcuuacugcaaccucugccucccggguucaagcaauucucaugccucagccuccugaauagcuggguuuacaggcaugugccaccacgccuggcuaauuuuuguuuuuguuuuuuuuuuuuuuaguagagacaggguuucacuacauuggccaggguggucucgaacuccugacuucaagugauccacccaccuaggccucccaaagugcugggauaacaggugugagccacugcaccuggccaauuuuuuggugauuuugauaggaauuuuuuuuuuugccugaugcuuuuuuugagagaaucuaauaauuugucucuuauuuaauaauuuggcuuucauuagcuuccagaaagccacauacugucuucauugaaaaauguaaggcauccuagaugauacagacugauaaauuacuuuucagccauaaaagauacuuaugagaauaagagaucuguugcauaaagaaaagucauuuguguuaagugaagaaaugcauuauuacucuugcugcuuugcuaaauuucaaacauugaauaacuaauauauuuugacccccuggagauauuuuacaggaagaaaaaugagagguuuaauccuacuguugagauagacuuaacguguuuuagaccugccccucaucccaaguuacuacaaacucauuuguuuaguuuuuccuugucugugugcucguuauuucacaguaaaauuagugaggcaacauaaauuuuauuuuuaagagaaaguaaagaaaauggcuuuauccauuaaagguuuauucaucuuaaaaaaggacuuguuauaucuacuccuacuauuggaugaauuuucaaaagcauauugauacuguguuugguuuuguuuguuuucgggacaaguccucacucugucacccaggcugaagugcaguggugugaucuguagccguggccuccugggcugaagccaucuuccugccccagccuccagaguagcugggacuacaggcaugugccaccacaucugacuaauuucuuaaauguuuuguagagaugggguccccacuauguugcccaggcugaucuugaacuccugggcucaagcgauccuccugccucgaccuuccaaagugcuagauuacaggugugagcuauugugccuggccaauguuguuuuuauaaauaucauuacucaguuauuuuguuuauaauugaauugauaggcucauagaauaaagauggauaagcacuguuucuuaacuguauuuauugauuuuuuuaucuuucaaaaaaaaaauccucaucuacuucaaagauuaagccuuuaaaaccgaugcaaaguuuuugaagucuuagcuuaagucuucagagacuaacauuaaaacccaucauaugaaaagugauauguaguagcaaauauucuccauccugaugcucucaauugcuuauuaugguuuaacacaaauauaauuuugucauuacaguaaauuaguuugaggauauaacugaagaguaccuaagaaacucccauagaaaugugaaaauaugcagacuaauuauucuaagaauaauuaaucauagauacuuacauauuaaauugauuagcaauuuaaaauuaaagccaaauuucuguggaaauuagcuuauuuucauacacaaagaaaccuagauucuuagggguacaaccaagaaagggccacuccuucauuucacaaauauuuucgagguccuugcccccaagaggguagacagaauaaaaaggaggaaggaagugacuuggaaaaaauuaaguuggguaaggaauauaagagaaugcuacguagaaggauguguguugugaaugcaauaguuucuguaguauugucaaaguucucugaucauuucaguaugugaagguaaacuuagauaacugggggaaggaacuauauauuuacuacauuguaaaagaauaauuguagacagaagaucuacuuugggugauuaaauguugaaaacaaguggugggagagagaaguuaguguugauugugaucacacacuuuucuauacaguaauuuguuugaucacucaugauaaugccuuacauuuuguauguacuaaauaaaugaguucucuagaaauucuauguuguggugauaaagaauuacguucagauugaagauucgaacagcugugcaaccuucucaacauuuaagaaacugcgaacaagcauagaaagaagauuaaagccuuuuaaauaagauucuuuuuuuucagccucuuuuuggaacauuuuauugugaaaagguuucauaaauacugucaauacaucacguucagucauuugcaauuguauuucaaaaauucaguuggccugcaaaaagaaaaaaugccucauuuuugaaauauuucauccaugcccugauugauugggacacuuucaauagagggugccuagacauaauuuugugugaagaaguuaguagaguuuggaaagaaaauguguauuggaauuaaauuuaguggcaugaaaaugaaaauuucucugucauugucuuuuuuuuuggcuccuuuuuuggccauuuuacagcuaguguuuagugugacaaggaucaaaauuggcccuuuaaaaaaauauauugaauucuauuaccucuguuaucuaaaagaauuguauuuuucaauuugaagagcuugaagccaauacuacuauauaccauuaacuugacaggaauugaaaaucuaauugaggucauuaugauuagccuuguaucuugcuaguauuuucucaaucuuauuuugaauguuuugugucaaguguuaaauccucuuauaccacagaauccagaaaauuuaaaugcaacagaaguaaaacgaauauaaaaauucuaugguuguuguggaggggcguucuuggcuaacccauaggguguuugaauguaaaggcagcuuacagaacugcugcuaguugaauuguggaggguuucacuuuuaagaguacauuugagacaaaauugcaauuuuggaaucacuuauuccugcuuguucagugaaauaggagaggggggaauuccugagggaagcugggagauuuccaggugaugauagaguagccaugugaguauuuggcugaaacagaguagaagccaccucugucuguuggacagagguggccuuaacacugaguaucaaucagcauggccauuagagcuguccaggacaaacauaaugaauguugugguggcagagaggguauacuuaaaugaacaaaauuggaggcugacuuuccuuguuucuugguaguuccuuucuucguauuugcuauuuggauauuucacuucacuuuugugagcuagacucaaagguuaaauuuauaucauugugaauuuucugggucauauuguagggacacagaugggaagcaucccuucaguuuauugagaguauuucuuaugcgcauguguuuuuaauuguauuuauugauuuaauaaauagccgaugagaugagaaaaaaauauuagugucuuguuguugcagagaaaaagacauuggaugcauucuuagaauuuauuaucacaugcgaaguuauuuagauuuacaaagcaaucugacauguugacuucauugcucguuugcucauuucuaucagagguugaacacaaagccaagccuaagcccgugauucuucugugugcagaugagggggaagguuuaaugcagaauguuuagcugaauauuuggauugugcauuccccuuuuaugucucuacugcaaguuuucucagggcauuugugauugacuucugugauguugacauuuauuuggaguuagauguuuaaaaaauuacuaauuuauggccuggugcgguggcuuacaccuguaaucccagcacuuugggaggccaaggcggguggaucacgaggucaggagauccaguccauccuggcuaacauggugaaacccugucuccacuaaaaauacaacaaauuaaccgggcguggugacaggcaccuguagucccagcuacucgggaggcugaggcaggagaauggugugaaccugggaggcagagcuugcagugagccaucgugccacugcacuccagccuaggcaacagagcgagacuccgucucaaaaaaaaaaaaaauuuacuaucuuauuguuucucucauuuugaauuugugaaauuauuauucauuuuauggacauacugcauggauucuguguuucaguuaugacaggagaucuagaaucuggguggggcugugaguaaauagaaagguaacucagucugugccuugaggaauuccgcaguccaguggaggaagaaagagacggagaaauaauuagguacagugugccaaaggcuauaauagaggagguacaaacucuucccagagaaggcaggcagaauuugaacuagguuucaaggaugugugaaggugaacugggguggggagggcuucccagacagaaaaaacagcgaggguguagaguuucaaagggggaagcccagggguauaauaagugaaggagacagugugaaauuauaaauuuuggaugcccuuaaugaguuugaacuucauuuucuuagaaauggaguacuuuuaaauguuccuaaaauggggacgaggcauugauauucaugguucaguuagguuuaggagcuuuuguagaaguccuuuucaaggucugcuuaaucucaugggccagauagugacaccucgaugcaagggagcauguaaaugugcucuauuagcugggagcauugcuaucagaaauuacauuuccggcucucuucuuaaggguaaaggagagguaggauauugaguggcaacuggcauucugggauguagaagaaauacaguaccauaaagggauagaggaaaauggguagacuuaacguucugaaccaaagcuaagauucuccgugagcgauuagaguaggcuuuugggauuugcuuaccuucucuuaucugcuagccagccacacaggaagcacaucuuuguggagugacagaggaggagguaggaaaugcuuucucauuuuuaugguagaaacauccaagagcugagccuucauucuggcugagagaacucuagaugguucagacuugcauuccugggaaggccuuccagcuagagugauggaacaaagcaaugauuucuguggcccuguguggacagcaguggcagucaguuuacucucccuguugguuaacugucuuucguuugaucuagagacuuccucaaaacaauuuuguugugcuuguucuuugaaagcaacagcagacaaaacaagcuuugagguuuuuagaaaagagcuugacacugagcaccucuuuugagcuagaucugucugucaugcugaaccuguuuucuguggcugcguagcuuuucaaaucuguuuaugcuugcugguguuauugaaacagaaugggaagaucuaugcaaaaaggaacauugaucuuaauaaauuuaugucaguaagaaugggacugccauuuuaaaauuuauuuuaauuccuuaccuauuuucuuguucaauuauucuaaaagugauuaaaugaagauacgucacagaaaguaugcuuugaaaucaagauguggggaaaaccuguaguucugaguaggccugauagaaucaucauuguuagaguauuuggagguuuuguaguagggauuuugucuucacuuaaauauuuaguugaaauauguuccaauaguuugacacauuacagaaucugucugaaagaaaugucuaaaauaugauuccucagaagcugcucuugguuuuacuuucugcuguugguuuuacuuucuaacauuucauuuugaucccgcaguuuuaagaguaaucaaaaaggccgggcacgguggcucacaccuguaaucccagcacuucgggagacugagguggguggaucacuugaggucaggaguucaaggccagccuggccaacauggugaaaccccgucucuacaaaaaauacaaaaaucagccgagcgugguggugcaugccuguagucucaguuacucgggaggcugagacaggagaaucccuugaacccaggaggcggagguugcagugagccgagaucauaccacugcauuccagccugggcaacagagccagacucugucucaaaaaaaaagaguaaucaaaaagcuacauuauuuaaaucuuggcaugucuuuaaaaaauguuaaacugucaggaaaauuaucacuucuggauaccaccuucagaaaaacacaugaaaauuugugcaugucucaaauaguuguuaauuuaugaaaaauuagaaagaguguuugaauguauauuucugucauauuauauugcucauauuuuuaaauuauacuuuuuuucacccgugaagcccauauaguuaaguuugaaaauuuuaauuauauuagaauuugaaaauuaaauaaaucuccuuuaauucaugcauaauuuucuaauagucauauaguuuguauuauauaauuugagaaacuugguucuaaaaaaauugucugccaaagaauguauauuucugaauucuguucugcuuucauacaucugaaaauauuugagcuaucauaacuggcuaugcuucaaacccagucugaaaugggugaccuuugcuggcuuuggauugcagagcugggggcuguuguuugcuuuaucugauuuaaaauagucaguaguuuauuuugcaggcaguuagauguauaccuuugcauaaaaucauugaacugaaaagguuggcacuccaagaauacguugugagaaaagagaacuugaguacucacucucgacucaccugaaucuuauuaauauuuuauugauuaauaucuguuguauuuuuaaguaaauaagcucucuagaaacuaucucugcuucuuuguucauuuaaaauauauuaaacaaauugauacagauugcaaaaauuaguugcaacguuccuaguuagauaucaaugaaauaaaaauggucuauucauacgaguucauuuuaguuauuccuacuaauaucaaauguguuuuaaaaaaugggagauuauaaucuuuuuaugaaguaagauaaauuauuacuuuguauauuuaauucaaagaaaacaaaaaggccacaagugccugcauaaaggcacauccacuuaggauuauuguuaaggccuacaguugauaauuaggauucaggcauagcauaaaugaagugguaucuuuuuuuuuuuuuuuuuuuuugagacgaagucucgcucuguuguccaggcuggagugcaguggcacggucucggcucacugcaagcucugccucccuccuggguucacgccauucuccucccucagccucccgaguagcugggacuacaggcuuccgccaccacucccagcuacguuuuuuuguauuuuugguagagacaggguuucaccauguuagccaggauggucuugaucuccugaccucaugauccacccgucucggccucccaaagugcugggauuacaggcaugagccaccgcgcccagccagauaucaauuauuuuuagacccaaugauauuugcuguugauuuauuguuggugcacaaaauaagaaaacaaaagcaugguuuuaaaacagcccuuuacacauuuaauauggaaaugguaaccuacaggucuguauuccauacagauuccugggcucauuuuaucugugaauuccucugggcgucaugcaugcccaggacugacuuuaaagcagaauuauccaguagagguauaauaggaccguuagaucuaauuuaaaguuuucaaguagccacauaaaaaaauaagcaggcgaaauuaauuuuagucugucacuaaauucaaaauguuauuucaacagggggucaauauaaaagcuauuuaugaaauacauuauuuuuucauauuaugucuucaaaauguucacauuucacauauuuauuuuuuauuuuauuauuacuauuuuuuugagacggagucucacucagucgguugcccaggcuagagugcaaucuagcuugcucauugcaaucuuggcucauugcaaccuccaccuccuggguucaagcaguuuuccugccucagccuccugaguagcugggauuacaggcgugugccaucacacccagcuaauuuuuuuauuuuugguagggaugagauuucaccauguuggccaggcuggucuugaacuccugaccucaagugacuugccgcuuuggccucccaaagugccgggauuacaguugugagccaccgcaccugauuacauauuucacauauuuuaauucagaccagcugcaugucaaguacuuaguagccacagauggcuagugguuacuguauuggacagugcagcucuaggagagucucuucaaccugcagcugucuaggaagagaaucauaguuucuggaacagguagaaucuauaagaccuccuuuuuaagcuucuccacuuuacagaugaagaaaguaauaucuggagauguugaguuguucaaaaucacccacauuuuaaggaucaagagcccagucccuguucucuaacuucuaaucucuuucuucaucacuuuuucugcuucauguugcugcauccccuuuaguuacuaagguacuaacguuagguuguugcuaucaguuaaauauuaagccaggagcuuuaagacaaucuggcccacuugaaggcauggccugauuuggacaaaacuugugggguaggaugaauagaguuaccaggcauaucuucaaccucucuguggacuaguauuauacauauaugagaugauguaggguccagugaucaguucaucuuuuucuauugugagcacuguuggaauaggaauggggggaccuuuugggacccaggauaugugauucugaacccugaaaugucagaugcccacuaaaaggaaggggagagauggaccugucauuaccuuacacauuuuauugucuguauggguauguaaacauguacagauuauaaggaauugcacuucauuucugggcuucuggaaacacagguauuaagauuucauuuaccuccccuuguuuuggaaggcuuauugugugugugcccauaguucuuacccaguuacacuuaaaguaugauacuuuuugacagcuuaagccuauugcauuccuggcauguaaaauaguuauuuucagaauguaagcaaauguggaaagcuuacugccugacauggaggguuggagaagugggauugguguucuuuuguuguaaacucauuuuugugaaauauuugcuuuacaacgugaagcaugcaugauggaugaacuuuuagaauugaaaguuauuuuucauuucauuccugaaauauuuaccagcauggauguugacugagugcuuugaagaguuugcuuagucauauaacuuagguuuuaugauuuuagauuuaauuaaacuuaaaguuuuccuguuugauccucaggacuucucaucuguggcaaggcuuuacucacaaaggaaauaucaaccuugaaguuaagcaugcccuguguuucuuuauauucugaugaaaacgauugaaguuugccagugcugugucugggacaaugcuuagaggauucauggcuuguaggaaugaguuaaaaguacaaggauauuggcuggcauggugacugucgccuguagucccaaaacuuugagagucugaggucagaggauugcuugagcucaggaguuugagacaagccugggcagcauaaggagaucccaucucuauguuuuuuaaaaaagugaaaaacaacaacaacaacaagguacagggguaucugcguuuccuuaggcagcugucuuauauaccuuuaaccuuaaaaaaauccaccauuuuuaaaacaguguuuucuguuguuuuucuuaguaaauauaaacaauaggaacugaaguuuagggcuuaaaauuuuugagagaauaauuuuuauuucaguagcuuuugggguacaagugguuucuuguuacuuaguugaauuacguaguggugaauucugagauuuuagugcacuuaaguaggguaccuuguaccuaaugucuaguuuuucuuuuaaucccuaguccccuauuacccuccuccucgugagucucuaaaguccaauaugucccucugugugccuuugcuuauuccuaacuuaguucccacuuauaagagagaacauacgguuuuugguuuuccaauuccugaauuacuuuacuuagaauaauggccuccagcucuauccaaguuguugcaaaagacauuauuuuguuccuuguaauggcugaguaguagucccugauauauauaugccacaucuucuuuauccucucauuagucaguggccacuuagguugguucugcaucuuugcauuugugaauugugguccuguaaacauauguguacaagugucuuuuucauacaaugacuucuuuuccuccggguagauacccaguauuaagauugcuggaucaaaugguagaucuacuuuuaacucuuuaggaaaucuccauaauguuuuccauagaggugguacuaguuuacauucugagagaauaauuuuuguaaaauuauguuuaagcuagauuuggaauugggaaagaauuacauucuuuauaggaagcuuuugaaaaauauauuuaaaaauauauaaaaauaugcauaauccuaccacccacaaaugucuguauuauuaugucauuucuaaaccauuuuugagauuaugcuauagauuacguuuuagauccuacauuuuauuucuuaacauuaaaucucauacuauuuuaaguucuuuguacauguaauguuuacugaauggguaaaucuguuuagggaaacuggagcuauguaguuguggacuugugcuuuuguuuuguuuuguuuuguuuguuuguacauuugcuuuuuagaaaugucuauucagauccuuggcccauuuuuuuuuuuuuuuuuuuuuuugagauggagucuugcucugucgcccagacuggagugcaguggcgcgaucucggcucacugcaagcuccgccucccggguucacgccauucucccgccucagccucccgaguagcugggacuacgggcgcccgccaccacgcccggcuaauuuuguuuuuguuuuguauuuuuaguagagauaggguuucaccauguuggccaggauggucuugaucuccugaccucgugauccccccgccucggccucccaaagugcugggauuacaggcgugagccaccgugcccagacagacaugugcuuuuuuauuuggcauuucuagccugaacauaggcuggaaguagugacuuagagagggauuguuugccaaauaucagguaauauuuuaauuauuuauuauuuauuguaaugcugugaaucaggagucccuaaccccugggccauggacugguaccggucuguggcguguuaggagcuuugcugcacagcaguaggugagcaaugggugagugaguguugcugccugagcccugccucuugucacaucagcagggcauuagaugcucauaggagcgcaaacccuauugugaaccgcauguaagaaagugagagcugcguugcacacuccuuauuagaaucuaaugccugaugaucugagguggagcaguuucaucccgaaaccaaaccacaaaauugucuuucaucaaaccauucccuggugccagaaaggcuggggaccacugcuauaaauugcugcugucaaguaguguuacgcaugguggucuuuaacauaaaaaaaaaagguaaugaacguacaccacacagauuagcaaaaauaaggaaaggcugaucuaguaguucaaacaagcaauccucuuauuuaaugguucugugauugcucguguaggcagaagcuuaacuguaaguuguugcauuugacaggcaaauguagcuggagcuggaauguagauauuagugaaauugugauuucaguuuacuggagccauucagugggagcaugaaguggguuacaugauuacacggauauaaauaaagcguccuccuugccacuucacugcuguuaaagucucuccugauguuauguggugaaaaacaagucaaaaacauuaauucugucaaguuuccaaagauauaagaaucuuugaccagaaaagagacgguauuuaucuucaaauuuaacaaauugugaugaaaugcugcuguuacagaaccuaguguaaggucguggaguccauucagccagacacauguaauuuugauuauuaacugccguuucuguggucagucggccaguuuuauauauuucacauuauagguauuuggagcaaagacaguguuguuuauuguuuacuuuaaaaaaauacaauacuguaacuacauaaugaguaaauguugauacuguugaaaacuaauaaaaacaaauucuuacacuaucaacaucacagaaauucuaauuguaagaaaauauugauauaauauggaaauccguucauuuauuuggugcauuaauugaacaccaacacuaugccaagcauugggauacaaccaugaaagaggccagcuuccugaucucacagagcuuguacuuuguuggguggggcagagagcaaaucagucaaucugucugucugucugucuaucuaucugucuaucuaucugucuaucuagaugucaaucaguauacucugugccacuugguggucagugcuaugaagaaaaauuaagccagugaggagcuggauagagacacagucuggaaggguaugaaggggaucagaauaugcuacccccaaauaugccauuucagcaaaguacuaauuugagcugaagacaaucgagaaauagcagacccaggacaagcuuuacccccuuuuuauaaaaauuuugcugugugaagguauccuccuuccccucuccaucccuggagagaccacuagagguggcaccaucgccugcagaaacaaaccuuauugaaauaacccuuaucuucuauuaguuucccccauauauuuaccuuaccacacuuccccuggaagcccuaauccccucuccuuugucuugugacuucuccacaguuuauugcucuuuguuaaaaugguguguaugcucucaggccuaacugcuucuuuuggguuuuugcuuuucuguggagcucccuccucuccccucccucauguaaaaauaauaacauuaaauaaaauuuguguuuuuuccccugcgaaucugucucgucaguuuaauuggcaaggccucaugugcugaaccuaacaggguagagaaaaaagguuuuuuuccccuuuucuacaaguauuaaaccuggagagaacaauacaguguaaaggcugugaggugggagcaugcugggguguuggaagaagcacaugagcuuacaaacauuccaucaauuugcauucauuccaaaaauuguaugcaauuuuucagugacgauucccauugaucaaucauuuauaaaaacuaauggugagggucuuccauacucaguuuacucccuucuuggaaaagaauguacauuuuaaucaagaugauuucaugaaagacauucuguacuccaaacauuuaaaagagcguuuagaguauacagcaauucaucuuuucuucuguauuuuaaaauuuaagacagggagaauuauuguauuauacuuaguucagauuugguggugguuuuguuuuuugguuccagugaaaagaaauugcaucaguaaccuggcggucaaccgugccauauuguuugugauuuauuagucuggaaaaaauaacuguauuucuggcauauguaaaaauaguuugcugagaggccuccuugguuguggcaauaguaauacuaauuaccagguacuguauguagcucauucuaugaaccaggccuuguugaaaagugcuuucacuuaauuuuuucuuuucagcagccugugagguaccuacuguuauccccagcugggagggagcuggccaguggacuggguuuaaacuauguuuucauugucuuuacucuuaaccacuuaucuucucugccuccagcaaaauaagucaaagaguucagccaguguuucuucuuggacuaagcagucagccuccuaaguaagcaagccuuggaaugcaauugauugguaagauacuaaaguaaucaguaaggcccucaguuccuggcugccagcuucuuucacccucuccugcaggaaguucugaaugcugauaucucuacuuggugucuucucucccccucccaauuccauuauuucccuuuuucucaaucccaagugaaggaaguucugaguguggauguuggagucauucagaccuuggaucugagucacaacucuuucaauuuacuagaaauaugacugcaagaaaaugauguaagcuucccuaaaccaauuuccacaucuacaaaguaucuaaauagauugcuuaggagaaaaauugaauuaaauugaauaaagugcaaagcacagaacauggccaggaguaggcccuggaugaaugagggaaaaaugguucugauuuuuauuuuugagccucuuuguaacauuuguuggccccuucagaauaauccuuagaguucauaucagccacccuucaucccuccugggaugggccaggggagaggcccaguugccugugacacugcuucguuucacauuucacugcuuuagcaucucaacauuucauugauaacauuuuugaugccugaaaacagaauaacuuauuuguaauucuacauacauuuuguuugugaucaaguuguuagaguuugaaaugagccucauuuccuuggguuuugucccuccccaucugaccuuccucuucucagugaacccugaagaaaaaacacuagcaaaggaaucucaagaauguugguucgggacacagcucucuccaucuacucuccugcccuaguccugccccuccuuguguuuucagcggugaccaggcacuggugacagccuuggcugcuuggaccagcuggagguagcugcaaaaugccugccugcuagcuuugaaaaaucucugccaaccucauugaaauaauuguuuaccacauaucagaggggacugggaaguggguaauugagagaucuuuuugaagggguuuguggcuucuccacuugcagaggcuuccugaaaugguggguaaugcucaugccucagggagaaucaauauccuucuccuaaaaccugcucacacguagcucuaaguauuagacaugcauuuuuguuaacauuuuaucagugcauuuuucuaccugugucauuuggaccuuagauucgggagaaaaucacuguguaucuuuggugguuucagguggcucuuaaauuucauuaauucacaaaaucugaauugaauggaauagucuguuuugggagguuuuuuuggggggguuggggagggauuggauuuuucaguccuuccaagagacuucagguuuuuuuuuugauguucugauuagcccgguguguguaaggcccuaucagguguucgccugugugauccuaucacacccacauccuguagcugcauccaagugcuuugaggccgacuuaauggggauuaacuuaacaguugcucugugggaacagaugcucuuugccgcuuauuucuaauaaauugauugagccauuuaaaagauuuuuuuuuucuuuuaaguuacaucuucuuaagaaacuguagacaauaaagcaaaacuaaaauacuugggucuaaaauuaguguauuauauuuaaaacacugggcuucagacugauuauaucaugcucuuuuacugacuuucuagucagaugcuuauuuauaaaaauaaagcuuauauaaagggcagcauucaaauguuacaccagucgguuuuagcaguuugaccuuccacaguagcuaaauauuuuuuacacugagagaagaauucuuuaacauuauaugcuaucagcaugucaagugaauucugagcuugcaugcaacagaugagacccuagguggaaacauaaaaacauaccagugugaaagagaaaagcaggcucucugucuuugggaaggaguucugcagggagggguguuuauaaguguaguagauacuuaggaaaauuaauacaauuauuauaaaagucaucugggaaaaaccauuagguaagaauagccaauaaaaaaccagaagcaaaauguaaagauauagaaauuaaaacugcacaucccaugcauagauaggucaauggggcaaacuggaagucuagaaauaaaguugugcauauauuggaaauuagugcaagauaaaagugucuuuuuacaucagaaaggggaaagauggauuauuuaguuaaugguguuggguuaucugacuguacauagaaggaagguggguaauuauuuacccaguaccaauacuggauuaccuaguauuauguacccaguacaguuugucagcaacaaaaggcaaacuuuuuuauuccaugaaguguucuuacaaaucaguaagaaauacuaaauaugaacaucuucagagaaaaaugaacauuuuugaaaacuuauuaugaaaagaauuaaacauacacaagagagaauagugcgcugaaugcucagcaaugaucagcucucacccagucuuguuuuaucuguauuccccuuucucaaccugcucaauucucuuuucccucacuggguuauuuugaaauaauuucaauucuauaauuuuauguauaaauauuucaguguggaugucuaacagaaucucuauuagacguggacaaaaaaggcaaagaauuuuauaguacacaggaaaaaauacacagccaauaaaccuaugaagauaugcucaaucucauagucgucagggaaaugcaaaguaaaacagugauauaacauuguuuuuuaaaacccugaugggcaaagacuaaaaaggcuugccagauuggcauuuucaucuacugucaauugauaacagauauuucuuugcuuggaguacaguggcacagucuggacucacugcaaccucugccucccagguucaagugauucuccugccucagccucccgaguaccugggauuacaggugugagccaccacgccuggcucauuuuuuguauuuuuaguagaagcaggguuucaccauguuggccaggcuggucucgaauuccugaccucaagugaucugcccacugcaggcaugagccgcugcaugcagcugguacagaaauuuuuuagaucagucauuuagaauuuuauguacauaucccuugaucuaggaauucuagaaacuaauuaguucauaguauauuguauaaaugcgcacagaugaggauauuaugagagcauuauuuguaucaacuaagcaagccuuuaaaaaacucuuauacaguagaauauuaugcugauacauuaaaagugggcauaaccauacugauguauagaaauaucuaaaaucauaccgauauaagugaaaacauucagaaugcaggcauaaucacagauuaaacaguaauuuauauaaaaaacagaaaauuuauauguguauuaugucaguagcagauucaagugaaucugacaaaaucugacucugggcaaugagaacauuggaauggaggagaagguaguacauauuuacuuuguauauuaucaccuuuuguacuauuugagucuuuuuaacuguacgcagauacuuuagagcagggguccccaacacccagccauggacagguacugguccauggccugcuaggaaccgggccacacagcaggaggugaguggcaggcaggugagccagugagcauuacugccugagugcugcuuccuggcaguagauucucacaggagcacaaaaccuauugugaacuaaacaugggagggauccagguugccugguccaguccuugugagaaucuaacuaaugucugaugaucugagguggaagaguuucaucccaaaaccaucccaucccauccagucucaugccaucccacccccaacaccccauggauaaauggucuuccacaaaaccagucccuggugccaaaaagguuagagaucacugccuuagaggcugcucccucuuggcacaucuugaauguaggacuccuugguucugccauuccugguagguagucagccagcuuuugauaguucuccccagagacuucaucccacaggcaagccaucccauuccacguaaaacaucucuaauguuaggaaggcacguauuuugaugugauaucuagaauccucccagcuguucuucagaggaacauuacuuuuauaaaguugaaaagaacguuuuauuguauuauaaaacuaggucauuucagugaauuucaucuauuuucauggguaacugauucuuauaucaaaacuugcuuuugaaaguacuggaagcauaaauuauuacuucaggcccauuugcuuuacuuuguucagcacauugaacaucaaggagcaacucccucgaucuaaaauuucuagcauuggugcuuguaauaucauuuuucaaguugacauuaaugcuaucuuuggaauucucaugguaagucagaagaaagcaguuuaguggaacuguucuuucucccacugaauuguauacugagaucuguuauauuuucugcauuuuaacccagaaaguuguucaagagaauugaccaugauaagacaucuguagcuuauuuuguauuuuuuuaauggaaaauuguaacugacuuuuaaauuuaagauugaguguagccuuucccaaaccaauagcuaauguuuuuauaacuauuuaguguaggagauuauaauaaaauccacauugcuuaagauauaaaauguuugugcaguaauaggcuguauaaaaacaguaaauugagauuguaucaggaauaauguauuauaaaccauauaugaaaccagguacuaacuugguauucugcauagcuuuaucagaaaggcagagcaaauacuaucucaaaaugaaguauaaacaaaaugagguucagugagugaugugguuuggcuccauccccaccuggaucucaucuugaauuguaguccccauaauccccauguguagugggagggaccagguggagauaacugaaucauagaggcgguuucccccauccuguucugguaauagugaguuaguucucacgagaacugaucacuuuauaagggacuuuuccccccuuuugcuuggcacuucuucuuccugccaccaugugaagaaggacguguuugccuccccgucuacccuaauuguaagguuccugaggccuccccagccaugcugaacugugagucaguucaaccuguuucuuuuauaaauuacugagucuuggauaugucuucauuagcagcgugagaucagauuaauacagggaggcuacauaauuugacccaaguagcaauaaacaauaggggugagguugaaauccaggccccugguacuuauggccuuaagcuaagugaaauaagccagacacagaaaaacaaauacugcaugauuucauuuauauguggaaccuaaaacacucaaacucauggaaacaagaguagaagggugguguuaccaggguuuggaugugggggaagugaggcgauguuggucaaagggugcaaacuugcaguuaugagauuaauaccuaauguacagccuagugacuaguuaauaauagugaauuguacacuugaaaacgucugcgagaguaaauguuaaauauucuuaccacacagaacaaaaaaaguaacucugaggugauggauauguuaauuagcuugauugugauaaucauuucacaguguauacauauaucaaaacaucacguuguauacauugaauauacauaauuuuugucaauuauacuucaguaaagcuagggaagaauaaaagaagugaccuaaccaggacaccuaucuguagcucuaugguaaagccaaaagggauaauaacuuuugauuaucaaaacuucaucaucauuauuauuuuuuaagacugggucuugcuauguuacuuaggcuggucucaaacuccuaggcuaagugauccuccugccuuggccucccgacauauuaggauuauaggcaugagccaucacacccagccaguuuugaagguaucuuuauuacauuuuuuuguuuaaauauuuaauaguaaguguuuaacuugaagcauuuuuuucugccuuaaaauugauuuucccacucauuuuauggaucaaaacuauuaucagauuuuaauucccacuccaccacauuguuuauaaaaguugacaauuauggaaaguaaaguaauacugaauuuuucuaaugccuaucuuugacauggaauaaagauuauaaaauuucuuauaacuugaaugaguuuuuaaaaauuggacaucuuuuuauaaaaaucuagcauugaccauuucaacauaaguuuuacuuaucucugaaauacagguaguaccuauuuuuauuaauuuucuuaagugaugcugagugacacuauuuuuguuuuuuuucacuuuuucuuuacuuuuuuuuugagacaggaucucagucugcugccaaggcuagagugcagugguguggucuuagcucacugcagccucggcuuccugggcucaagcgaugcugccaccucagccuccugaguagcugggacuacagguuugcaccaccaggcccagcaguuuuaaagauuuuuuguagagauggggucuugcuguguugcccagacuggucuugaacuccuggccucaggcgagccuccgaccucuaucucccaaagugcuggaauuauagacaucaaccaccgugccuggccccagugacacugucuuaauuuugaauagggaaguaucuaaugguauuaaaauggucuggcagagaaggggauaugaggcuuggugaaaauaagcacaggaugcaccaucuuugaguaaguguuaguuucugcagugagccagcagcaacauucuuagcagagccuagaaagaucgagugagggcugugugguggugcagccucuuaagucucucugguuccacaacaugcucagauugguggcuuugauauuuucuccauccaggacgcauugugcuaagcuuagggaagguccaguggauauuuaccaagccucuuauacugccccgcauguugccaugagacagcagcguuaucaccuuaaauggugcaaauacuccuugugcauacccuaccccugagaucuaacaucuggauucuggauacuguuuccuauucuuccaucuugcugcaugguucccagguuauguauauaguguggcuaggcaccacacauggcccuggcuccuugcagccauacagaggugaccuaacuggauguaauuggguauguaccggguguuggcuaccugugcagguugagggccuuccacaggucuagcaaagcaauucauugccuuucugaauuuuugaaugcuucauuugugaaacccuugauguaauaacuguugauauuauuucuuuuugaaaacuccccuuacucuucccuguuucuucauuuguaaacuggaaccgauagaaaaguaccaaacuuaggguuguugugaggcguaaaagaaauaauacagcccagagaacauaguauauacucagcaaguauuuauuaauaugacuacuaagccagcauuggugauugauuggcucauagugucuucuauuugccagauguuuucagaggcucuguucauguucauacccauguuuguaaaugacagaauguaaauuucuuaauccucugucuucuccuuuagcaucagcucuuguccccaaaguaaaagaacucagucauccagaacccaguuuuguagaucuauuuuucaaaauugggcaguuaauagaaaauuaaaagcagucuagggaaaagccuuuccuuuggguuuguugcuuucuuuucugucauaauaagacugugcccaaacuguagggaaaaaucaagaaacuguaaaauacaucaucaggguguuuauaguaaauguaaaacguuaaguaacauuugaguuaaucugugcuuguacaaaccucagaagcuuaaauaaugaaccaaugacauauaauuuagaaaguuuucauuagacucuuugcguugguauuugcaauaucagauuugcaugucaucauuauuagccuuccucuauuuugaguguugacuaggugccaggcgucauguugagaaauuuaugugcuuauuuaauucucacacugacuccaugagauagauacuccauuuuacagaugaggaccccacaucauaaccuuuuggccagaauuacaguuaguguuagaauuuaaaccuaugcagucucauuccaaauccucugucuuuacuccuccagaaugcuccauuaaaugaauuguuucuuauaauccgguuguuuuaacguuggaaaagaacuugagaacauuuagcccaaccacccuaugaaguuuggcaguacuucuugccauucuuucaauagauaauuuauuugaguuuaagggagagucuaugaauuaacacuaguaccaaaacucccaugagaaaauaauguagacagcuuuuguuaaaaaagcagaauuuuuaaagguguucauucaguuaucuucuugccuaacaaguuccuguguugugauagacuuugaauuuguuaaauaugaauuggcuuccugauucuagcuguuuugccagaggccugauuuagagaagggauuaaaccacuggucaaccuuggauggaauuugggccagcaguuccuucuccacagccccugacacuuggcuuugugccaagaaaauccuacaaaaggaaauugauuuacucuacccaagacagaguuccggaggcuuugguuguccauuguuagcuuagaaguuggcgcagugugcgugugauccacgccuaaauagcacagccuugcugugcgugguagaaguuggguuaguguugacaugcuguugacucacccucccgaggauggaagcucuggccugggucaaguuguggucacugcaguuaacaguuuguugaucucagggaguauuccacaguugcugauguaauugacaaugauuggagccagcucuuccccagauucaaauggaccaauuagaggacuuguugguucuguuuaucaacuauguaagugaguacugugaaguuggcauuguuuuuagucuguauuuggguaagaugaaacucuguucucagacaguaauaucuuucaaaaguacaauguuacuuauugugaccaaaguagggaugaaguuugcaaauuauuugguguaaugauuuaauuuggccauccaugcagugcaguucucuaccagugugauuguucucuuuguaaaauacucuuacuuugccagaaaauuguuuguuuguuuguuuguuuguuuguuuguuuguuuguuuugagacggagucucgcucuguugccaggcuggagugcaguggcccgauauuggcucacugcauccuucaagcaauucuccucccucagccuccugaguagcugggacuacaggugugugccaccacguccagcuaauuucuguauuuuuaauagagacgagguuucaucauguuggccaggauggucuugaucucuugaccucgugaucugccugccucggccuccuaaagugcugggauacaggcgugagccacugagcccuguugaaaauucuuauuaauaagauguuucucauagaauguuucaaaaaauugugacugguuucaaaaucagaugauuugcaagaauuagccauaguauaaacacauaguucucaaaccguuuucugggagugggcccagagaucuauuuaacaaaaccuugaguagagucuggugcaaguuaaaauuggagaaccacuaauguaaccuuaccuuaucuguggaccacauuuugagcuuuggaagaaauaacccuuucuauccuucacaagguaacagaugauuuuuuugcacaauuauuugauaaugagcuuauauuugagauuaagguaugcacacgauaauguacauucucacucuaggucuggggaccuugauucuuugacucuucuguccuuuucucuccaguuacuugguuuugugcauuaacaaacuuuucaauuuacuuauuuuuuuuuacuuauuuacuuauuucucaucccuuacguaauguugcaucauuguuuuuuguagccucugcaguucaagauacuaaucaccccuuucuaccacauuaaaauacagacucuaccuaaaaucauguaugggaguaacuugauauauacgaaaguguaaccgugucacaauuccccgccccaccccgccagucuacauaaaacugcaaacacuuuauugcuuaccaagaaaguagacaauaauaucgaagaaagcccuccuuuuccucuucuuugaccaacaagggagcaguuccugacaaaugucaguuugcuuuuugaguuccuuagguuucuguguuguguuugcaauggauaaauauugaguaacagguacugacuguauuguauacauugaaaacuauccaccaacagaauauuugcaggaggauuuuguuuuguuuuguuuuguuuuguuuuguuuuguuuucugagacaggcuaucucucugucacccaggauggagugccauggagucaucauggcuuacuguagccuuaaccuccuugucucaagcgauccucccgccucagccuccuaaguagcuaggacuacaggagaggaacaccaugccuggcuaauuuuuuuuuuuuuuuuuguagagacagaguuucgcuguguuggccaggcuaguguugaacuccugggcucaagaaaucucccaaagugcugggauuauaggcaucagccacugugccuggcuugagaaugacauucuauaaguaguuucagucccuuaguuuaaucccauauuuugauccuauaacauguacaauauuuguguauaguauaugaucugccaacucucuaagaagauuuuaaaacuuauuauguuaaauuucagacauauacaucauccagcuucaaaaauugaccacauuuugcuguucuuguuucagcaccucccccugccccauuuucuuuucugaagcauuuuaaaauaauucucagguaucauaucauuuuacuucuguucauagguuucugaaaggauuugaugcagaauguuauuauuaaaccaguauacagagagaaaggccacuggauauuaguacauguuuugguuucagacgguccuuuuaagaguauauuaaaucacauaaggauuuucugaguacccauuagaaccacaaaaaauaccuaugauacccuucuuacugcaguagaagaugaguuuccuaggguagcccuuuguugauggaacaaacauguauuuuguuucaucaggaaaaucauuggaacagccaugacucagauccacuaaaugaaggaacaaaaauaggaccugccucaccuccugauuuuuuuuuaaaucucuaggaugaguaaccagaauauuuuuauguugugcuaaguagguuuguuuguuuguuuuuuacucugacuuauauuauuugaauuguagaaauauauuguuuuuacuuuuuucuuuaaaauucuaucuggaguuucuaaaugagagauuguagcuccuaaaaccuuucuuaguuuuggugucuugcuuucuguucuuagcgucuguggucauuucuaacucccagugaggaaagagcucucuggucuuguuucuuuguuaaaugaaggagcaaaccuccgucucguugauccacucccaacccacuuguuuuguaacaaugaaaguuaucucauacuuaaaagacaacuugaaauuauaacacaccuguaacaaaguaaaggguauggguuuuuacuuagguuuaaaaaaagggcaguaacccuuuucauaaaaaagcaaaauuuagaugggauagaacccccguuuauagaaaagauuuuaaaaucucauuugcucucauugaaaccuuaaccuucucucaaauacuggcgcaccucugaggaacuucaaauacgguuugaaaacuaaugguuuaaggagggccaggcgcaguggcucaugccuguaaccccagcacuuugggaggccgaggugggcggaucacuugauguuagccugggcaacauggccaaaugcugucucuacugaaaauaggaaaaauuagcugggugugguggcgcaugccuguagucccagcuacucaggaggcggagguggaggcgggaggaucucuugaacccaggaggcauaggugcagugagcagagauggaucucuugaacccaggaggcauaggugcagugagcagagaucgcgccacugcacuccagccugggugacauugagacugucucaaaaaggaagacgaauggucuaaggaaacuaguuugugguuucucagcggagaaugacauucuaguuucuacagaucuggcaacagaagacaggcacauaaacuggccugcuuuggagucagggccaagacuuaaauccagauuuaaaaccagcuuuuuuuuuuucuucuucuaaaacaaccaaccuguguuuuagguccagugucugccuuguaaguugcucaaagcucagauacaaggaaguaaucagcacacauuuuugugauaacauuccugaaaagaaaaagaugagguggacuaagguaaauacacugcuccuuaaaaauccauauuuuuagauuauuuauaaaucaaaugggcaugguuaccaaagaugaauucuagagguguaaaacuccagucuuauaccucaaauuucaguuuuccuuagggagcaaaacacuuccaugaucuuacugaggaccuaaaaaagccuguacauauuuuaaaaauagcacucccuagauaaagccugauggauccaggguacaguagaaucaugaaauugccuguuucuuuuuaaaagauguauaugauugcucgguggcuguauauuguccaucgugugcgugccugugugguauguugguucuuucagagaggcaguggcgugcagagugagaggaucacagauguguaugugacaaaacuauuucuuuucuuucuuuucuuuucuuucuuucuuucuuucuuucuuucuuucuuuucuuucuuuucuuuucuuuucuuuucuuuuuucuuuuuugagacagagucucacucuguugcccaggcuggagugcaauggugugaucuuggcuuacugcaaccucugccuccuggguucaagcgauucuccugccucagccuccugaguagcuggauuacaggugugcaccacgaugccuggcuaauuuuuguauuuuuaguagaggcaggguuucacuguguuguucaggcuggucucgaacuucugaccucgugauccgccugccucggccacccagcgugcugggauuacaggugugagccaccgugccuggcugacaaaacuauuucuaaaacacaaguccagauauuccuaccaagggcucucuggggcuucguuuugauuuauaugcaaaacacuccuaauguggugacauuggggagauaaagaucugggaugaugagagagaaaggcagguaggacacaugcccuuccaguaacuuucccagcuagggcuugcauuuaaccucugauggaggccucaccauccaggcagauguacuugcuuaggaaugaguuugagauaauaaggcuaaaugugcugccuucuguauauaauuugcauuuguccuaauguacgacuaaggaaaugaaaaaucaaaguuugagugacuaaaauaaaagaggucuguggaguaauuggauugaauuugcaccaagucaaggagaaaacuucuguauuuuguauguuuugucaugguucuaugauuacuuguuagaaagugauauaaaauucaauaacuuaguuugauaugaacuuggcuaucuuuaaguuauagaagucgugcauauaauguggcuguuuucaacccccauacccuuucugagugguuggagaugucuugaauuucgaagugagaaggucuggugcuguuacauagauaaucauguuagccagcuuuaccuucugauaagcucucaauuuaagaaaguacuucuaauccuggcuuuaucuuuggcuugcuaucuuauuaugcacagagcauaauuguaagaagggaauaauaucucuugcugucuauucacuaagaauagugugaggacagggcucuuaaaaacaugaagagaugggcacuauuguauagauauagagauuugaugaaauguuaaaauguuggaugauuuuaaaugacaaguggaguggugagaaguuuauuuuuaaccuuauguggauaccuuggauauuuagaaacaucgaaguuuuaaggaagaacaaauaucuugacuccaagaaaauggucaugugauacuguggcaucuauuuggucuuccugauguauauguuuccugacauuuagcuccuaaaauccuuggaaucuccagugcuaagaaggucuuauaugcuaaugagaugacugguggcuggguaaccuaccaugugauuagaggguuaggacuuucagucacccuccccaaccuccaggagcugaaguuugaguugauaaacuaaugaucaaugauaccuacauaaugaagcuuucuuaacaacccugaaggaccgcguucugggaacuuccagauagcugaacacauggagguuccuggaggguuggaugucaggaaagggcauggaaucucguuuucucuucagccgcaccucaccccgugcaucucuuccaucuggcuguucaucuguguguccuuuguaauauccuuuaaaauaaaugggugaauguaagcaaguauuucucuuaguucucugaaggugcuccagcaaugaaucaaaacgaaguaaggggucuggggaaugguagccaguuggucagaagcacaggcuacaaccuggggcuugugauugacaucugaaguugggggaguuuugugguacugagcccucagccugugggauguguaaucuccaaguacagugucagaauccaguugaauuagaggacacucagcuggcauccauuauuggcaugcaguauuccuugucaugagccugggcaacauagggagaccucaucucuacaaauauagcugggagugguggugugcaccugugguuccagcuacucaggaggcugagugggaagaucgcuugaguccaggaggcaaacauugcuucuccuccaaaugcuguacuuuaacauguuuggaaacuccugcaaaggaauuucaacauaagcgaagucaauggguuauaaaggacugaaugccauuuuguaaaugucagaaaucaaagucacaaccaaguuaaguucuagauuagggccaggaagagaaauguauuaucuggucaaccauaucaaaucuguauuuugguggaagagcauuuucuuauauugguucugauugguuugauacggacagggaacuguuuucuuuauuccaguuauuuguuuuguuuuguuucugagacagagucucgcucugucgcccaggcuggagugcaguggugcgaucucggcucacugcaaccucugccccucagguucaagcgauucuccugccucagccucccgaguagcugggauuacaagcgugcuguaguuuuuguauuuuuaguagagaugagguuucaccaucuuggccaggcuggucuucaacuccugaccucaugaucccacccgccucggccucccaaagugcugggauuacaggcaugagccaccgcgcccggccuauucuaguuguuaaucaguuaacauagccaaaagauauagaauaagauuguagacugaauccauagucuaaugauuugucuuccuaguaauugugaauaauucagacauucaaaauuagucuggcaucauacaaacauuagacuaguccuaaaaugaggauauuggcaaguguguuaauaaaaauugcauaugcaguauuaauagguuccuuacguaggcugccgauuacucaggaacugucagauguuuuguuuuguuuugucuuugagagauggggcaggguuuuacucugcuggagugcaguggcacaaucuuggcugacugcagccuugaccugcugggcucaagcgauccucccuccacagccuccuaaguagcugggacuacaggcaugcaccaccaugcccagcuaauuuuuguaucuuuuuuuagagacgggguuuugccauguugcccaggcuggucuccaacuccugagcucagggaucuacccacccaugccucccuaagugcugugauuacaggcaugagccacugugcccagcccccagauuuuuaaucuucucuuugacauugaguuucagaaaugaaguauaaauggugaauuuuuaguguagaauaugaugcacuaggaagaucacuuacccguuuauucacuuucuuagaccaugucaacccgauucugaauuuaggguucuguugugaugguguucuuuagaagugauuuuaacacucaaaauacuauagucuguaacauaauuuacugauuuuuuaauuuuugcaaacuaaguugaaguaaucaaguauuuaugaguucuuugggugagaccaucugucaaagaauucugggcuuaauggagauacauauauguugugaauacuaaacagauauccaaguaauaaagcagaaaucauaugcuguguaacagaaauguaaaguucugaauuaguucacgaguaggagagaaacuuuuuuuuaaagguagaggagaacuaaaaguaauuucuuaaaagagugccuauuuuacaucuugaauauuaaaagucuaauucagugccuugggaucuuguucuuuuuguagauuuugauuugaaugaacuucaguuugcugaaaugucuaaugggugcaaaguacagauuuaauuauaagguugagcuaaaaucagaauuuaagcauauggcauauauaauaccaauuuaaucuuucccccuuaaauuuaguuauuuuuagugagucccaaacaccauauuugagacaucacuuuuuucuuuuuuaaagagauagggucucccuaugugaggcuggagugcaguagcuauucacaggcucgaucauagcaaacuacagccuugaacuccuggccccagugaguguaaugucucaccaugccaaaguacuuuuaucuuaaauugcuuauuuuuuuguuuauuuuuuuaacugacucuguuuacaaaauuaaccuuuuaucuagugacagcuagauuguaucacauuugucaucuauggacaacugauuuuuaguuguuuaauaugguaaguuuauuauuguuuuuccuuauuuaagaaaacaggaucugagugaaaaaaaaaaaaaucuuaauucaacuaucacgauuccaguaggaaguagacagacauucaucuguauacauuaggugucaaaguagaguuuugugguuuaucauucugaagauuugagauucaagacaugacuaucuuucagucauauugugcaauagauaacauauaauguuucucacugaugagaacaguugguuagaucucucagaugacuugaauuagguauuaguucaagucaguugucaguaaguuuggcuuuaucguucagaggagcuucuuaugacuggacauuucucaaguauugccguauuggucauuuggcuaucaaugcuuaaauuauacucaguauaguauaaauuuucuuauuucccuuauuuaagcaugccuccauuacacuguuguugucucuaauaagaguuuaauaaucuuuguuuuggcuuaguaaaaagagccaacaaauauaugagugacugacugaguguauugcucuaugcgcaauugucuuaaaggaaaaacguuuauagaaucacugugaacaauaaaaugguugcauuucgcuggaaaaccucggugcuccuuugguaaauaaugaaguguuuuguuuuacgggccuuuucacuacuucauugacaacagaccuuuuuuuuuaaauuaauuaauuaauuuauuuauuuauuuauuuauuuuuugagguggcguuucgcucuuguuaccugggccggagugcaguggugcgaucuuggcucaccgcaaccuccgccuccuggguucaagcgauucuccugccucagccuccugaguagcugggauuacgggugagugccaccacgcccagcuaauuuuauauuuuuaguagagaagggguuucuccauguuggucaggcuggucucgaacucccgaccucacgugauccaccugccucggccucccaaagugcugggauuacaggcgggagccacugcaucugaccaacaacauauauuuauauuacccaguaauaggcauagucuaaggaagauaauagaauuuauucuuaguagugaacucuuuggcuuuugaagcagaauuuuuuuuucuuuguucuuuucugugauaguaaggaaggaaggaagggaaggcuacuacuaaaaauauaaauugcuaaauagaagucaagucucuggguguugaagcucacauauuggugcuguccagaccugacgcaucuagaaacaggaauuugcccuuagcguaagcuuagccaaaugguugagucauuucuaaguauuuuaacauuauagaaugccuuaggaaaugucaugaauaucuaaaacaggucuucuugaggauuuuauuaguuucuuaaaacauggaaaggaacuugauucucagugcugguaccuaaaauucaaagacauuaguugugaguugcugugcuccucagcucuaagccacaguugucauggccaagccugucuccuuauggagaguggccuugcuguuuccugcagagcuucucuugugccuggcuugugccuggaagucagcgugucaccacuucagagagacacuauagaagcuuggugaucuucaaacaagaacuuaaaacaaagaaguuuucuuucacagauaucuuaaaacuuguagcuaaauaaaacgugaauaacugugagagccucauuacagcaauuuuuaaaaaagcaguacauguuuuguuguaucuuaaacaucacagaaugguauuguguguccaguuuuguuuguaaaauguaaccuucgugugaaugaccaucuauuccuuucuuuuuggaagguuaguuugucagcuguugugugaugcucaacauuuuauguaaugacauuuagcacaacguuucaauauaacaucucaggaaaacauuuaagaaauagugaaguucucuggguauuacauuaaucauauuaauuaccuguugcuuuuaauuuaucaccguaucacccuaauaucacaaggcauguguaguacuauuuuguaaagauuuucuaaagaccuucccucuauaggaaggaaaauuuaauucagaaauugggcugaacucucuuucacuugugugaaaaugggaaaauuagaaguaauuuguauuuuuuauugugaaaucaguguaggaaccugugcucguaucauggaaacaacagcacuaauguuuuucuccccucgggugugggcuuugcugcagauauccaugucuucuacuuuuucuguucuuaguucuuauucacuuauugucuauacuucgugucacuuuauugaauuucacaaaugcaauuuaggaauccagggaugugauaaaauuugugcaucugcuugucauuagccaucucacguuuauaucgcuaagugaaaauuuaacuuaguuuggaacaaaccaccaugauuuaguucaccuguauaguuuaaaagaccuaagaccugaaauuuuuuuuuuuuuuugaaacggagucucacucugucacccaggcuggaauacauggugugaucucagcucacugcaaccucugccucccggguucaagcaauucucugcuucagccuccugaguagcugggauuacaggcagcugccaccacgcauggcuaauuuuuguauuuuuaguagagacgggguuucaccaucuuggccaggcuggucuugaacuccuaaccucaugauccaccugccucggcuucccaaagugcugggauuacaggcgugagccauggugccuguccaagaccuggaauuuuacacugcauugggaccuuauaaaauucuugacuuguacccuuuuggcauuuucugaaugcucaugauuugcuucugaaauauuuuaggccuuuggaaacacuccuucauucuaauccucucuuuucuugcucucaauucuucaugucauguaauuauuuugccuagagccaaaucugauguguuauuauaaucaucauuucugcaggagcuugguaacacuccugcuuuuguucccuuuaaggcuucuuuugguuuuguuuauuuuguuucacucagaaugaucugguuaaguuuugcuugaucauccauuucaaaucucuuaguacauuuuucaaauucaguuccaagcauguuaaaugugucacaauggaaguggcccacggucaaauacauuuugggaaaccuugguuuuaaaaaaguuaaacugacuucauuauuacgguuuuuuuuuucaaaagccuccaguauccaucuugaaugauccauuucccauauguguuuuaugacagaauucuccccacucccagguaauaacuguugacauuuucugaaaacuguuuuugagaacacugaauuagauaugaaaugaggcauuuauucauacuucgaaacgaaugucuuaaaccucacugggccauuuugaguauacauuacuagugauauauuuaauaacuuagugguauaagcaugcaauaacaaauuucuuacacaagagaaguucuguguagaaacaaauuuaauacuguggcuaaagaaaugaaccaaaaaaauuuaauaucuugaaauuugcuucuuagcucuguuuagaaucauugugauucacggauaguaaauugucagaguggacuucaugaaccuuauaucagacauucugaaaagagcuaaaauugccauuaaacugcaugaguuaaaauaucuuagauaguuuaaaaauacuauguagacuuggugagucagaucugccacacugagcguguagcugggguugacgacacacguguugcagugucguuaccaguuugucucuuuuagagacaacuuggcaggcagacgucuugcagauaaacaaggaaagauugucuauuuuaaauggcauaagacauucuuuaaaccagugugucauaugugguuauauagucagcauuuucuuuagugcaggaaauccucucucaggguuccugaauaaauagcagguaucuuuguagggauagcucgcaggagauuucaaaugcuguguauucaucaguucaggcuccccagaugucuuacgaacgugcucauuuuaguuuucuuuucuuuucccucuuccugcuagauacaaguugagacaauaugauuagcucuuaaagugcuuacucuccauuuuauguauauuacugcauuuuaauccucauaauauccugugaggugggauguuacuauguccauuugagagauaaaggaaaucaagagguaaaguuaacuggcuuucuccaaacagcugguaauuacuaaauacagaauugacuuuugccuuuugauuccaaagaucauauugguacuuucaugugugggucccuucagccaguuccuacagugacccugacccagcuguaaguccccugaggucucuagagauauagacagugauggauuagacccuguucauaguugcagauacaagacauagagagguuucuagcaauaauuuuuuuaguuauauauuuucauagggcuuuugauuuauguaaccuauuaguauauauuuguuauuccaguagaguuaauacauuauucaaagagauuccaguuuuuaagccuuuucuccguuugucuaaguuguucauuaugaaaugauuggcuagaauuugaaagucuuuaccuacagagagauucugacuggcuugcuuggucuuggaacccuaguuaugagugcauugucuugcuuccuggugaacuuugcccagaaauaguuaccaccucauuuuuuuuuuuuaaaugaaagcuggauaauuaacccucaagauuucuuaauuaaaagauuacuauuauaaauugacccacagggaguuaauacaauaaaauuauuuuugaucauuuuauaugaaauaauuauggggcaaucuucuguaaucuugaguugaagggguuaucuugcuuaauguuaauaacuuuugauacaccaacuaccuuuuaaaaauuaacguuuuuuuuuuuugcuucuguggaagggaggcuguauuuuguaggauuuacaguuuacauaguuauuguuuuauaugaugucaguuggauuaauuauguuuugaguggaaacucuguuugguucaaccaauauuugaaugcuaauuuuguucugugaacaaauagaaauacagagaacaguaagacaugacucuuucccccuaaguaaaggcuuagguuggaguuuucaaccugggaauuacugacauuuugagccaaauaauuguuuauguugggugggggagggccuacagcggaggcugccuguacauuguaggauguuuaguaacaucccuagcuucuaccuacuagauagaugccaguagcaccacccaagucgugacaaucaucuuugccaagaacuuugaaccucuaccuagaaacaguucauagggcucaaaaagcaaaguggccuaggacccauguaguuaacaagcuuacccuguuggagaaccacugcauagcugaacaacaugggugagacuagugucaggguaaaggagcucuugacuggagauuggccguacacagaaaacaaagugaguguuauggauauuuggggauuuaccuucauuagggcacaguugguuagcguuagguguacaccaacauuauucccucuuuagaaacagccaugcacguaacauuuuagcacaucugaagaggcacuucuauucuaauuaccuaaaauucuuauuaucuagaauuacaugcuaugaacaacagcaguaaagucagaagccagaaucuaugugauguuaucuguuuugcgaucacaguuguguucuucucuuaguuuauuugaacaaguuugugaaaaaauuuuugugcuuauguaaauacucuuugcuuagauuuuuugguagaauguaaaucuuucccacacagugcaauaccccuccugcccaagggcgagauauagauuguacaguuuguuauuucuguguuuuagggcuuauuccucuguagacaugucaaaaagacauccgucggggguaaggaaugcauuagcaauucaagcugauaaucugcauggugagaguccagauaauuuuuuccccaggucacauaggcagcucugcacaagucuguuaaacauaugcuaguuuugaaaauuaaaauaaguucccaucacucaaggcaaugaaacguagaugaauugcucugccagauugacucuuagaacuccugaugugauguggggcuagacagaaugggauguuugcuaauaaaucagggagguagugauuguuuuccuucuuuuucucccccacccccgucaggacaaacucacauucuguagccuggugcacucuaauaaugccuguugaccuuggccaugaaagcacucuagacucacccccuaaacaccgcaccgaaugugcucauccuugaaauuuacaagccuuagaaucuucccuaccuccacuccuguuuacugccuccuguuacuccuggugcuuccagucagaccguagucuuggcugugcaguaccuuuaggagcccucaaaaauguuuaauuucuuuuaaaaucagaaggaaaaauaaagaacaagauaauaaucaugaauauacaauaaugaauccagccugacuuagaguugucuuuauaccaaucaacagagcccuaaaauauagcuuuuaauguuuuuuuaagagagaaagaggcccacgaaaguuguccuggggcccccgcauccuccucauacacuggugggaugcugcucuugcuugcuuuggaauguggcagcagcucccagugacuucacacguuuauuacaaauucaaggucauuuggacgcuagccuugugcuaccuuucaugcuuccuguccgacccauacucagccugggcauguuuucugcucugaucuuuggucugccuuccuucuccuucuccaagucaaaccagucacucuuuccugagagcucuucgguguacccuugccagaccucugcauuaacacuccagcaccuuugguuagccaauuuggccuuauuugugucuccaccauuggauuaucuguccaucaaggucaggaauguuuucggguuaccccacuguccccaacuuugaauauguucacugccuggaaaauguuuaucugaauauaaggcaucaagccagaacuugcccaaaacuuaaccuaggacucaaacagcuuugaaaucuuaucuguguagagugggaacggcauguguuugauaaccaucagcauuugcuguuuugcuuagccaucaacaauccguuucuaucucuuccucauaguauuuucagcuguauuuuuguacagcagucauucacguuagguguuagguuacacugaaaucucugacaaccaguucugugcuacugaaggcuuuuagcagcaggauuaaaaaaauaguugauugcacauucgaagucucacugcucacacuguuuauguaauucuuggaguccaguuagaucaucugauuuuuaaaauguugccugaauuacaaaggaguucaggaauguguuaucaaagaauuaggaaauuaacauugaaauuuauugagcaacauagcuaauagguugucuugcuuuuuaagccuucuuguuuucuaggaggagccugaaguccguggacaaguugaacuguagcugguauuuaggaauugguaaagacagagguguggaugcuauguuuucuuuucucuguuaggaaauuacucuccuggugccacaauaaaaaauuucacagguaucuaaaguggaauuuauuuuguauuguuccacaccuuugucaauaauuacauuuucuaccuucuaguuuauuacuguuauuauuuuucaugccagguguuucuuaauuguuggcauaaguauuuauugaaugcuuauaugugggagugagagagucaggccagugcuaaagaguagggaauaaccccuagacagugaaguaacuuuugucuuguuugcacauuaaaaaaaaaaaaagauuaggaauccuugcucuauauacuagaaauguuugauguucucuuuucuucucuucaaacagagaaaacuuagaugaauacuuauaggcucuacugucaacuaacugcacccuccuaauauuggcgucugcauauuuuuaccauugucaauaucagauugccucugauguugugucacugaaacugauaguaacauuacauccaagaguaagacugcagugugauuuuuggcucuuggucuucuguucuuucggcaacaauuuuuuauaaauauagucaagaaaauagaaauaagagucuucacugcuaccuccccuucagaauuauuuucuccuaguauugugguuccugauagccuuuauuccuauagaaauggcaauucgaaaaauuccuucugugaaucugagggcucuacaaagggagagcuucuuugauagugcuuugguguaaguuauuuaagaaggacaaucuacccaggcuuaucaagcaaauaaccuggaauuuaaaccuggaguauucuuuaguguuccaagucugcaggaaaagaaguaaucuuggcuuaaacuaaauaaguuaacagaauacaauuugaacaaugaacaagaaugcuguuugaaaauuaucuuggguuuuuaugucaaguuaauauucucacugaauuucuauuauguuuguaaagcagcuuucuccuagaccaaaaauccuaguaauaaaaccacaacaguaugagaguuauaagcacacaguaaaggcugaugaguaaauguuaugacacuuugaaaggaaauaaaccagacgauauaauguaaauauccuuugugcuuaucaaaaauaagugacuucauguucuguuccugcaauauuucuguaaaucugcuaaaaauagaaagguaaaggucuaagaucauaaaucucugaugcccuuuccuuaaaaguaaggaauucuugucuuggauucuuauauaauauacuuauuuauaaucucacuuguucugauugcagguggccucuuacuaucuuuacauccaugugaaugugugugcuuugauguguacauaugagagacaagaacaaaaguaaaugucaaauauccgaauuccuguuucagugagcuuucacggaguaaauucuuuuugucuacuugccugugaucucuucuaauaugacuugcguuaaugaccuuuaagaaaucuuuuaauaaaauaaaaaauuuuauuaaaaucuuuuaauaaaaaaauuuuauuaaaaucuucuaauaaaaaauuuuauuaaaaucuucuucauacguguuacuugaauuuacucauggcaaggaccaguuaguaccauuuuaugaaaucacaagcucaugggcuugugauaaaacauauaagugcuuuaaauuuggcauugguaacggcaggccgacucacuugaaaaaugcucugaacugcucugccucaugcuggugggaagucagauggaaaugacuuucuagagaguuuagcuggccuccaagcuuaguggguacucacucuccuuaucccccgauagcugcucugagauuuuaaugcacauugaagacaauaugauaacuuaaccuggaaaauuagcauuuugguaagggucuuuaacuucauuaguauuuucauaccacuuugguauuagaaauuguaaagauauuaaaggguauggacaauguggaauguauguaccagacucagcaguguauacugacucccucacuauagcccagaacuggaaaucccgcuaacuaccucuccccauccuagccugaauugcccucuccaccuauguugguuuuacaauggccugacgccugaaagcugguagaaacuguauaggaaaauaggguugggauaaauuucugggcugacaaaggauagaggaauaugcuucuuuuuccccuuguccaaguauaucagcaacucuaagaugcagauuuaucaguauggcucuacugggcauguucuaguuaaaugguagacccacuaccucuucuggaaucuuguuuuccauuauauucccaccugcagcuuuucaaagacuuauucucuucucuaauggucucuugguucuuuuuuuugcccaugcucuacguuccgagugggucaacauugcagugggucaaugagaagaaauagaggggaaaaauaaaagaaccagaaagaaaccuguuaaguuugcacuuacuugugcauuaagcauauuagcguaagccuuaaacucuagaaaacucacuguagugcuguaaaguaccacugauaaaguaaaaguucauuuuuaugcugugucguuauuuagugaugaauaugauauugcauaaaagaugaggaucuguaaggccaggcgcgguggcucacgaggucaggaguucgagaucagccugaccaacaugaugaaaccccaucucuacuaaaaauacaaaaauuagccggguguggugacgcgcgccuguaaucccagcuacucaggaggcugaggcaggagaaucgcuugaaccagggaaguggagguugcagugagcugagaucacgcuacugcacuccagccugggcgacagagugagacuccgucuccaaaaaaaaaagaugaggaucuguguauaacugccagguguugugugagguaccaugaauaaccuggcaauauccuaacugugcagguaugaggagugacccccaggaauauaauugcaauuaaacuugcaaauuauguggggauacucuauuucagggcaauaaaauaaauuaugucuagagcucauaacucuuacacauauuuggcuaggucuaugcagcaaaacccaggugauaacugaggcuuuaacuuugggauuuguuuggugcugacucugccacauggugaaauuugguaggaucucagugcgagugucacaugaucagucugcuugacccaacaugccagaauuccauuucucagcccacucucuucucugcauacauaccuaccucccggagagggcugggcgggagccuacguguggcaagagcccucacugcuuuuguuacacagauuucaacacauauggcuugauggagugugauugcaguagcaugaauguuuggugaugaaauuugcauguccuuugcugggagaaguauaauuauaagauuuuuguauucacauagccacaugugagguaugagcaggaacggggucuauuuaauagcauuagauugcuuucagauuugaaauauuuccuuuuagaaauauauuguguaaacaaaauauguuuaauuuuuuuuaaaaacuaugccuuuguacaaauuguuuaucauuugcagaggucuaaaaaauguaggagaaaagaagcucacaaaaucaaucagaucuaaagauugcaaagauugauuaccaucuccuuaaaagcuucaguacauguguuuacaguaucauucuauuugccucugcucagauucuuuccaauucuaggacaacccaaaguguauagaucauaagccauaacugauccuaccuuacauaauacauuaaauauaaaauauuuauggccaggcauggugaccaguucuguaaucccagcacuuuaggagaccaaggcaggaggaacacuugaggccaggaaguugagaccagccucggcaacauacugagaccuugucucuacagaaaaauuagccagguauggugguaugggccuguacucccagcugccuaaaaaaaggcaacuugagaaaguuucuaccuucugaaacaaucuaugccuugauucuaucacuuaguauuuuaguuauuccuaucaaauacaugacuguguuaauuucuuuugccacaaaaaugcugcaaagccacaaacucacuccaaaauuuaguggcuuagaacaauaaccauuuauuauagcccacaagcucaagggucagcugaucccggcuuagcuuggcuacauuugauauaaaacaguagaaauuuagaaauugaauauauguagaauaucucuuguaccaaaaaugaagaggaauaauagauuuugauuuuucuuuguuguauucugugcugggugcuaaucuguccuagcugucagaacaaguagaagccauacuggaaaaucauuuauuuguuacuaucaaauuuauuucagugaaugccauucaaaccacucucucugaggagcccaguuaccaaguccuccaccuuguuagcaacauggacuuaaaugcacuaauucuagaaugagaucuuagcaaaguaccagcauuugagauuugugcaaauugagcucuuaaacuguguguauauguguguguguguguguguguucauucuagcacucccacuacauaccauacaaguagcuguauagcagguauauauacauguguauauguacauagguagguauaugucaacuguugaaaaacuagaaaauacacauuaaauaaaguaaggguugauaaacauuaguaguuggaacauugggagauuuggacuucuacuuugcagauucaguuggcugcauuagauuuaaggaaagaacuaacuuuggagaaauuuguguuugcauuucaggagagauuucuuaaagaggaaacuaccagagguuaguagauauuaacaucuagugauuuaaauuugagaaaugcaaauuagacauuuaagcuguggguuugcuucccguuuuacuugcucuaaaaguaauuuuuuuaaaagccaguaacaaagacaugcaaaauaguacugccaugggggaaaaauuacuugaaaauaauauucaagauugaagaauuaaaaaagcuugacaucuaguaccaggaaugccagcuggcuuguucugucaaaaagcaagcaugugcuuuggaauaacacucuugaguagacucuaggcggguuuugagcccuucugauuaucuaaauagauguggaagugacuuaucuugguuuuucugagucaaaugagauaaugagcaaaggccuuaguaggucuuugauuuuugccucuaacccuuuuucuaucugcauguucacaaggucaaggcugaugagauauggcaauauugagagagucagaauaggauaaagaucucaaauacuauauauauauuuuuuuuucauuuuuuuuucccuuuggugacuguaugagacaugucaguaaaacuuuaaagacaggccaggcguuguggcucaugcguauaaucccagcacuuugggaggccgaggcgggcagaucacuugaggucaggaguggcaacauggcaaaaacccgucucuacuaaaaaauacaaaaauuagccaggcguaguggugcacgccuguagucccagcuacucaggagguuaaagcacaagaaucgcuugaacccaggaggcagagguugcggugagccgagaucaccccgcugcacuccagccugggcgacugagcaagacucugucucagaaaacgaaacaaaacaaaagacacacagaaaaacuguaaagacagaaugaaagagaugaacuuuuuacaucucgcucauuucaucacauacuauauaguauguguaugguuucauauauguuaguguguguguauguauauauaugaaguuaaaagaaaacauucaccuuuuaagacuaaauggacauugacuagauuguaaacuguuuuugaggcuaagaguuuguuugccaugcauaaggcucuauuuuuuguaauuccacuuuuauauucauuuauaucaguccuagcaguagaugccacucuuacuggguccugccuaaaugcaugcuucaaauguugguuauuaauuucacgaguagugaauaacaaagacuccuauugagggaccucuugauuuccuacugggcaccagcagcaagcaugacuuacuggccuucuuaugaguggguaggaguuuugggucaacuugagaacaucuauccuuugaguaguaaaaaagcuugguauuagguuggcacaaaaguaauugcgauuuuugcaccaaucuaauaucaacagaggccgugaaaaacaucaagggaggauagcuuguaauuagaagccagaucaacagugacccaaaaagaauuucagguuuccaggagugaaauauguagauuacuccucugaaaggaauuguuuuucuccuauucgcuuucauggcaaaucauuuuuuaagccgaaacucaagcucugaaauaauuguguagcaaauaguggcugugaauagauguggcaacucuccacaaggguaaauagaaaccacuugcaguuucagucaucacauuuuauuuuucuuuuuuaauagcuucucuauuuuugcucaccacaaauacaugcacacacacacacaggggcaaagccuuggaaaauugcaauuuuccauuuuaauuugagagacagcccggucacauuaacagaacccuugacggaauagguugaauucccuucucugucccuauaaccccauggccuuggacauauccuuaccuggugcccuuuccucccucuuaugguccacuuuugugauucugauuuuaauuucaguucucuguuagugaugaaaugagcaacugcagauguuccgcuuacacuggaaauacuuuuuuggcauuuaaaagaaaacccuacagaugaauuauuccccugaaagggguucacucagauuuucuagauuaugauucuagaaaauaguucuuuacauuugacaauggagaauuuaaauguuuuaauaugaaaauguaaagcacucuugugggguauaguugaauuaugcccagguuaagggaauccaguauuuaugucaggaaaccauggaugugauagaaauaguaucgcuacaaagcugggcacaguggcucaugccuguaaucccaacauuuugggaggccgaggcaggaggaucacuugaggccaggaguucgagaccagccuggccaacauggugaaacccugucucuacuaaaaauacaaaaauuaucugggcgugguggcacaggccuguagucccagcuacuugggaggcugaggcaggagaauagcuugaaccuaggaggcggagagguugcagugagccgagaucaugccacugcacucuagucugggugguggagugugacaguguauccaaaaaaaaauacugagauuaugcaagaaucugacucgaagaaguuugaacugauuaaaaaguaccaaauacuucauuauaugaggccagcuauuuagacuagucagcgggugguucaaaugcagaaaacagauggcuuucauuagccagaaaccuuaaaauuacauaaauccacggaugcaacuaagcuauggaucugugcccucuccuugccaaacaggaccucucagcuagcaaaacagagagcuccuuguucacuuuucccuccuaguugagacccuguuggggaggaaugcugccaagccugcucuauaaggaauuuugaucuccuagaugauaacagagagaaacuuuuuggagaaagggaacacccuguuugaaaggacaacaagagaacuuguucaagaagguggcuuugcauuuaauugaaaauuguagcaacuguaggcguaggguuuccagauucacaucugcagacugguccagauuagguauauauguuuauauucguuuauguuauccccuuaagccucuuuuaaagccauuucuaaaaauugcuuuggaaaguccauuucacuucaguauucuuuauauuguggcucaaaaauauuuuuuuucugguaacaaaaauauuuucuuucuguuuuuaagacuuguagcauuuuuaaguuugauauguacgucucuguaguucagagcacuugguaaacagccucuugcuuuugaggcaauuuaugaaugcuucauuguuuuuagcugguuauuuuguucauugucaggaacacuguuuucccaugggaaagcaucuccaguuuuaugaugucaguggcaagucauucaguuuacaagaauuaccuucauauucagucuuagaaaagcauagaccacaaacggccaguuauaucacaguucucaucuuuuaaauguugucuuagauuuuugcaaaguaaucuuaacucaccuuagaauaguguuaagacauaaauagaacuaaaauguaguaguuaagugguuauauuucccaucuacuaagguauuuauauuucuuuucuuuuagaaaauaaaaauguuuaaaaaauuaggaauaauuaucuuuaggaugacuuuguaagacugugcuuuuuuacuggcagcaaauaccugccagauuucagguauuuggcagguaaauugaaucuuaaaagauuucaauuuuaagaguguccauauuaacagauccugaauaggacccuguguaucauuuauuaagucauuucuuggaggcuucacucaggaaaagggaguuaacccuuggauggcaauguuuaauguggccacauuuccuucuggcugaaugccagggaguggcugcgcuuagcaaccaggcuuuguuucauaaauggguuauuugaugcaggugaggaugccgugaguuguuugucuuguuuuaauucagggagacaggcauauguagugaaagcauggaauuguuugcagaugggcuucaguaagaauaggaagguuucugguucaauuuguaucuccaagcuaauugcucugauuuccauauacacaucugguguugguucggggggaaaaaauuuuacuugagaaacauggcuuuugugaguugauauuuauuugugaagggccucuuguaaugucaaauguaagaagaucuauacacacaaccaauuuuacaauuucuaauucaacagcuuacccuauuauugaggauucgcaguuuaaauuauuaaaugaucuccacuugaagaaaauagagcauguuaaucaucacgauucuccaaacauuuauuuuuaaaguuaauauuaaaucucaucugguggaaaaccugacaggaacugaagcauauauuuucuagucuaaacucucauuguuaaaaugaagacaacaugagacaguuauagcgccguaaucaaguuauuugaaaaaaauguuuuaaaaauuaccacuuuuugguagucaacauacacacauaugccaacagauggcauuaaaaaauggcaagaacaugagacaauuauagggucauaauaaauuuauuugaaaaaaauguuuaaaaaauuaccacuuuuugauagucagcauacacacauaugccaacagaugacauuaaaauagcuguaaagucaagaagcagggaggaugacaaagugaaaaauagaagaaaucaaaggaaguuaagucaaaagaggaaaaaaaaaugaagcauuuacuugguuugucagguagggugauccaguguauuuugccaaaaacuuuccugguuuuagcaccaaaugucucagaacauggcagcugaugaccucccucacagugagugaucccagagagcaaugaagaauugugaugcccuucaugaccuuguuuuggauguuacacaucaucaugcccuucagugaccuuucugguagcaaaggguuuguuuuuaaaagaguugcagcaucuuuaagucuaauauauacaugcucggaaguuacaccaucaucacuucugcuguacuccauuuguugcacagacagacccugauacauuguggaguuucccaggguccaugaauagcaggaggcagggacuauugggggccuucuuggaggcuggcuacccuggggagagaaauugucaauuuccucuccuugcggggaggaaauggaaucaagugcauuuguauugacaagaagguagaacgcuuuccuuagacauuguaaugaacagauuguggauaaacaaaaguacagagagaguuugaggcagaggaggagacuguuucaacagaauauuuaccagcuaugguaaaggcucauuagugucuccguacaguuaacaacaugcugccaagacuggaaaucuuugggacaggaaugaauucggaaggugaacagaauaaaguacugugggaacaauggcgauuccauuaguggauuguacauuccuuacgggcagggcccuccauagcaucugauguagggccuuauccacagguaucugauuauuauuugacuuucuuuaauguuuuugcaguguuauuaucuauacuacuuauuucaguaagauugacaacauuugcauuucgauuucuaagaucaagacaaugaauuuccucuuaaucccucaggaaagcugugaaauuuaaauuuauagagcauucuacuuagccugcugcuuugcaucugucagagaaugagaccccccaguuucauggaagucacaggaaguggcaaggggcucagauggaguugagggguucuagcuauuucugcagaugaucuggauauuuuggcaucggcugcuuugacuuaaccaucuggcaauguaaaggcagaauuucguuaaauauuggaaaaguuacuugaaaacauggcucuagagauuuugccagcagcuuuugcacucaugacuugguucaaucuaagaccuguuuuguuuuuuuguuguaaggaccuaaguccucuguuggguuuugacgaaguauguguaaaaaugacuaaaauggccagagguaucuuauuuuacauuuaugugggaagaaauguuuggaaacuguuucauuucuuuaacugaaaauuucucagugcaauuuuaguugguguuuuuccuccuguggacaguuuuuaggaaugauacaaguuaucguggaaucacccaguucuugagugugugaacgaauggcuucugcuggaaguuaauucuucuuggcaugggugucucacauuuccccagcagcuggauuugacaagggagggccuaucaugauuaauaugccuucuaauugauugguuuaauaacaccuuuacuccuguggauauauuuuucauuucuugcugaauuuuuuuuucuuuuugagauaccagaaccuguuaagugacacgguauagauauuucaggacuuccauuuucucuuuuaaaaauauuuuuguaaagguaaugccuguacacagaagaguuugaaaauacagaaggcacccuuuuucaugaaguuauuuugugaaguggucuauugccugcaaugguaauagcuaggaccccuuacuuacuacccagcaggcacuauguagagcuccaaaugagaaaauguuggcuccuugcagaugguugggagaggagacaccagcacucuuaacagacuuguuaagaguugagacugauaaccagagaauauucugggggaaaccaggagggaucgccaacauacucaguuauauuuguggauggugaauucuacagugaauuuuucuguucaaaaucauaauacagucacuugcuaacuaccaacgccauacuugcucucagugcugagagguggcacaaauauuauuuucagucuuggucaucaggcagggccuggcaggcaucaugcucugugugagucaguggaguuuauuauaagaaugcgguagccuccacagugauuauauuuauuauaggaaaacguguaauuuuguugucagaaccuuucagcagguaccacaaaaucucauaugggaaaacguguaaauuuuucaugaauaaauuccuuucgguauugguaauuuccuucucuguuuuaguauaaaagaaagcauugccuuauagguggcuaagaacaucuguagcauacauaacacuuaaucuaaaggaguguugaagaccgggcugauuccuaauugagaaugagcaagaauagaacucuuuuugauaguuaucccuguucuuccuccaagccucugccuuggagcuauggauacuauaacuaacugaagcuucuucuuucagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaaguaaguccuguccgguggcuagcaauucacguuggaucacaugcauuuguuuucaaaaaauuuaacuucuuguauuuugcaucaguauuuuaacccuacaguaaaaaucuugguuccuaaugauucaccauaccauuaauauauuuauuugcauuacccuaugauauacauauaaauguuuuuaaaauuaugaugucguauuaugaccaucacuaaacaguaguuuaagaugucacagcacuuuuuuuuuuccucacucugucacccagguuggagugcaguggcaagauuauggcuuacuguagccuugaccuacugggcucaagcaauccucccaccucagccucccaaguagcuggacuauaggcacaugccaccaggccugacugauuuuuuuuaauuuuuaguagagauggggucuccuuguguuggccaggcugucugaaacuccugggcucaagcgauccucuggcuggaccucccaaagugcugagauuacggguaugagccaccaugcucagcccuccacacuccuuucaucuucaguauauaucucaccacggcucuacagucaaggucuuuugguuaaaagugcuagcauuaauuuuuuucuguuaccagcuugauacauauuuuaguucauuuguaucuguuuguauucuauuauaguuugguuuuuuccucccuuauuaauuuuacuuuuugacuaucauguuaguucuaugaaauauacucagaaagcucacuuuucacucauucucuauugauaaacauuuucauuguuccugauuuauuuuuuuggcaaaagaaaauacauauuuuuccuucuuguacaaaaaaaguacaaaguucacuguucugcacuuugcuuuuuuuuuuuuuuuuuuuuuuaacuuaacuuuguauccuggaaaucauccuuugucauuucguggagaucuucauuuuuguuuaauucuuuguagucuuuuugcuguuacuauacagggugcuccuuucuuauucaauuuaaaauagcuggaguuccaggcauuuuaucucacacuucuuagauaguuaucucugcauugugacugcaucuuaagaacauuagaaguaauuagucuuaugcuuguuggcaaagcagaauucucgacacucauuauaaacagcagauagccuggcaacauuuucuuuuguuguaauccuuuuuguacuagaaauuuuucuuuagccuacuuggauaaugaauguuuguuguuuaauuaauauuacuauucuauugagauccuuuuauuuuaaauuguaaauacuaaaauuauuauuauuaaaagguuuaauuuguuuugauagcgcucuguuuaagaaaggacaagcucuaauuacuaauugguguuuugagaagcaaaaagcaucuacauuaucacaauauauuacauauuaaguaauuuuuaucuugaaaggaguaugaaccaugaugugaaaugaugaauaguggaaaucacuaauacuuaaguucauuauauguauuuuuuguuuuguuuuguuuuuuuuugagaugacaucuugcucugucgcccaggauggagugcaguggugcaaucucagcuuacugcaaccuccaccucccggguauaaaugauucuccugccucagccuccugaguagaugggacuauaggcacccgccaccacgcccagcuaaauuuuuuuguauuuuuaguagagacaggguuucaccauauuggccaggcuggucuugaacuacugacauugugauccacccaugucagccucccaaagugcugggauuauagccgugagcuaccacguaugguccauuauauguauuuuuacaagaacauucugugugcugauuuacuaaguauggauugauaauaaaucagcuuuugccugggugugacuuuuauaaagugucaauguuagaaauaauauuuacauucugcugaagaguucuuguaguacaauuguguagauaaguuauaaauuuuauaaaucagaacucugugcauacuuauauguuuuugauaccauuuuuuugauauaugcauacagacuauguauucugagugucaaauaaacuuuuuuuaaaggcuagaauuaaaauuuaguuuaugacauugaccaaauuguccuuuucuggugaaucgacuauuuugauacaugugucauaguuugcaucuaaguuuuucuucccuuaguuucacguaugaauaaccagauguuuucacauuuguaugguggccauaccaaaaauuacucuucuugaccccaggaacaccccucuuuucccguuucacuuagagauccuacuaaugccuggguagcuuuacuuucugucuuagccuguuguuugucccaggguguauuagucuguucucacauugcuguaauaaacuaccugagacuggguaauuuauaaagaaaagagguuuaagugguucacgguuccaaaggcuguaugggaagcauggcuggggaggccucaggaaacuuagaaucauggcaggaggugaaggggaagaagacacauguucacauggccagagcaagaaagagaaagagugugaagggagaggugcuacacacuuucaaacacccggaucucaugagaacacugucacgggacagcacucgagggauggugcuuaaacauugaaaccacccccaugauccaaucccuucccaccagaccccacuuccaacacugggaauuacaauucgacaugagauuuggguagggacacagagccaaacuguaucaaaggguugagcacagagugguucuucccaguucuggacuuuaccagauuguugguggccaccaugaguggggagaauuagcccuuugcugucaccuuccucuugcaauucugguauuaucuguccucugccuaccacccacccacggaagucuuguuggaugauacacaccagccagauucuucaacauuaggcgccauaaguaagaaagggccaaaacaucauaccuugugagccauuuuaauggauuugggcuuuauuuuguagcaacaggaagucacuagacuuuauuuuuuaucuauuuauuuuuuucuuuuuuuuucuuuuguuuuugagacagagucuugcucuuguggcccaggcugcagugcaguggcacaaucucagcucacugcaaccucugccuccuggguucaaaugauucuccugccucagccucccgaguagcugggauuauaggcgccugccaccacgccgggauuuuuuuuauuuuuaguagagacaggguuucaccauguuggccaggcuggucucgaacuccugaccuugcgauccacccucuucggccucccagagugcugggauuacaggcgugagccacccgcacccggccuagacuuuauuuuuucagagaagaggagugauuguagauuugcauuuaaacaaaucaccuucuugcuuuaucacuauguccccuaccauauaucuucguucucccagagacugccaugcugcagccucuagccgugugcuguccaguacuguagccacuggcccuaugugguuguuuggcacuugaaauguggcuaguggaaacugaugugugcuauaaguguaagauagauaccguaucucaaagauauaaugugagaaaaccuguaaaaugaucacauucauuuuuauauagguuuaacauugaaauaguuauguuuugaauauguuguuaaauacaucauaaauguuacugaguuguaacuaugugauuaaaauugauuucacuuguuucuuuugacguuucacguggcagugaggaaauugagguuccauaggcaguugcauucuguuuccguggaacagugcuguucucugugcuaucccgagccaccagugacucugagcuguaagggucuuagaucccaugaucuggcaagugggagagggagguagaaaugagucccuccauaccuucaaccagaacuucacugcauguugcaagucagggaacaaggcuuguuugggguccuuuuaaauacaucuuucauuaaauacauuuggauguaagaugauuauaugccuuucuagaacccuguggugcucucuuccuccucagacauaaugucuuuggauacuaagggugcauugaugaacagaacacagggccuguucuucaaagggggagaaaagcuuguaaaaucauaauuuuagcaaucuaaaaacuacauggugacagugacacuaauaccaucagcauugagcauucacaaagggucacaaagggucagcuacuaugcuaaguacuugcacucauuuuacccacucagugacaccuguggagaagaaccgaagaaagcaccuuggggaauugcagcauugaaggcaaacaaagagagacgauuccccaugagggagaugagcaguggccagagagauaggauaggaaguaggaggcguuacaugcuggaaggcaagccauguaaauuucuaaaugaggggaaagauaagagugcaagcaugaugcaaacggaaagcaguugaaguguaguuuuugacaugguaaaaucaugucugucaugcagacugaacacaugucaaauauuuuauucaauucauuaaugagaugaacuguaagaugugaaaaaugguucauuuugacuuggagagauuuaaaauuccuuccccagcacacuugaguugcauggcuaugaacaggaaucaucuggaauuaucuggaauaucgucaaauuauuuccaugguacaggaacacuugcauugcuauggggugucugcaguauccaucuuuacaaagcucuaaggguguggaauagcuuguaaggauguaaguaauaaggguguaagaauuuuaaggguguaagucguaaaauagcuuauuuaguagcaagucaacuggaggaacaugcuguagaaucagauaauccuuuccccgccacccucagggucugcaagacaacaccugcauuucaaugcuaggacacccagcaaucucuuuugcucauaucuuguuuuuggacauuuguaugugugugugacaaaacauuguuaggaucuggcaaauagaaggucauuguugacccuguggaauagcauggggagaaguuacguuguaguccauugcaggaaaaacaacgugggucaauggugagucagcuguggacuccuggaggaaagaccuagaggcaaaaagcuuugaggucauugaagacaaaaggaaaggcuuugugauuuugauuuuuaaauggaaggaauuugggccuaaggaagcuuaaacuaaacugugggaaggacugauacccauccuaagcacuaguugcagguaucucuuaagaacuagguuuuggccgagcuccguggcucagaccuguagucgcagcgcuuugagugagaggaucgcuugggcccaagaguacaagguuacaguaagcuaugacuaugguauucaguucuguaagaacuaggcagaaaggagauccaguggauaugugauugccugggucuuggaaaggggagggaacaucuccuuuucugaggaagaauggggagauaggguggguuaauuaggcaguuucuuuugccaggugauaaaaacccccuaaacaauuuguauuuuauauauggagaauauuuucucccacugaugggaaggaucguagugugggggaugcuuacccaauuucuuaaaaauguacacagaaaugagaucccuaggugcuggaaccgagggucaguacugccuagaauuuccccauuagggucucuuuuguuucugcuuaccuuccugcuguguguuuacuccuuuucuccugcuaagauggguguccucaaggagaccagggauguugguagccacgaccucugguaguguuaguccugguuuggcaucccaacuuuguucugcccaugggcauuaucagggagugcuucugguuggcacugcuuugaguuacacgucugcccuuggagccaccaccguaucugcagggacucaguaucaggacuagcccaucuuggccuuguggguguggccgugugauguggggagaggagcuguugccagaagagggaugaggaauggcaugggcaaaauagaagaaugaccccagugcugcaacacaguggguauggauuagaaaaggcuuguaggcuggacagggcgaggugagggagugcaucaugcauuaggauuuuaaguggcuuuuuggggaguauugagcagguggcaggggagacaaguucacucagaaguuuuagacaguguugacauuuucuuucaaauugugcaucuugaauucucuagaacauucuuuauagauauuucaggaucuuccugccacuuuccacauuguagcuauucugguguuuuucuuuuauaauuagaaauaaugaauaguucucauuuguaggcuuggauuuucaugcguguguuggaaaguguucguuuugccuuuuuuuuuuaacuucauguuuuuauuuuuuaaaccguauugauggauucauugcuaggaacggcaaggaaaagaauacucucacaauguuaccacguuuccuucucacagguuuuauaaguuguauuauuuuuauauuuucaaaguuauaaucuuaccaucuccucuguugccauacuucucauucauagggucugucuuuaacuggacucauuguuuacagcuagucuuuucaucagaucaucucaaacccuguauuacauuaauauuuugauuccguuuuguuggaugacuuucaucuuaaucauucuuauuguugaacaauguuuuucuuauuauugaacaauugcuucauuagguauagaauuccugguugauggguguuugauucagcaccaugaaaauucacgguauucugguaucugucauugggcaaauucuucuucuuuuuuuuuuuuuuuuuuuuugaaaaaaaugcguggaaaccauuaguuaccauugacagagcuacucauuuaaugauuuuuuuuuucucccaauagugguggaugaauuuuuuacuuugcguucucacuuugugucucucaugaccaaaauauuuuagagauaacuagcuggcuaagucugagguggcuguuaacagucugguccuaggauagaacaaaaccaacagaacucaucaccgucacgucguuuugacuuuuugcucacaaguuuaacucauuguuuaauuuguuuuuccaaaggauugcuuugcaguauacauguuggugcauagcuuaacaugaugauaaauacauaacuuugacugugaauuaucuacucugcuccuuucauagucucaugcuucucugaauuuguauuuuguguuacuggguuguuuuguuguuaucauucauaguguuuuuuuugcccuugauucuuugaaccagguuuuggucaagggcaagguucaagagaaaaaguaaaaacacagucuuuuauuuuugcucuugguuauaaacccuuguaaaguuugauugagaagauaacuuggaucuuaugguuuaaauugagucuuuguuuaaucccaagucuuccaaauucuuugugcuuauguauucuuuccucuuucccaaucguaauaguuuugcuucugccuagucauuggucaaauaccugccuuucaaugcauuuaaaaaauauuuuguguuagcaccauuugagauuuuuccccccuuuuuuuucaaguauguauugaggacuguuaugggaugaauguuuguguucccccaaaauuuagauauugaaacccuaaccccaggcuauucggagaugguauucggagaugauaccuuugggaggugauaacuguuagaugaggucaugaguaugugcccccgugauggaacuagugcccuuauaagaaaagauaccaaagagcuugccuuuuucucccugcucaaacgaagaagucacauaaggacacagcaaggagguggcugucugcaagcaaggaagagcggccucaccagaacucggucaugcuggcaccuugguuuuggacuuccagcuuccagagcugugacaaaagacauuuuuguuguuuaagccauucacaguaaggcagcauuuugagcuaagacaaagaccuacuguggcuucuguaggcaaaagcccuacagacccaaaguguugugagaauuaacauuucuagggaucaugccuuacaguggauuuuauccaacacuuagcucugaccuagagcacgcuagucgucguuagguaaaugcuuguggaugguaguuucuggcacagagauuggagcgguaaugggcaggaguucuguauccagcuuaugcugagagagcuucccauaaaauggagccuauacuuuccuuuugcagagaccauuucuauccauugauagaauucuuuuuuuucuuuuucuuuuuuuugacgggaucucacuccaucgcccaggcuggagugcaguggcaugaugucaacccacugcaaccucugccuccuggguucaagugauucucaugccucagccuccugaguagcugggauuacaaggugcacgccaccacauguggcuaauuuuuguauuuugguagagaugggguuucaccauguuggcuaggcuggucuugaacucuagugauuuaccugccucggccucccaaagugcugggauuacaggcaugagccacugcacccagccuuccaucgacagaauucuaaagacauguuuaggcaagaguugguggaauguuggcguguaguccagauuugccuucaguuuguuuuuauccgcuucaaaugcaaaggccaugauaauucaauaguaaagucauaaauccauaguaugacuuaaaauauuugguuguaauauuacaaaguaugcuuccaaacacauuaagcaugcaaaauccuuauauuguucuuuuuguuuaguguuuaggguaguuugugugaaucauagaugaccacaguagacuguugaguuguuauuuucuuuugacauucuuugauagaaaacagugcuuuuccucuguuauuuauacuagaagcaaaaaguaucucucauagcauuauggaaacaacucgaauacaacuacgucaauuauucaucuuuuuuuuuuuuuuuuuuuuuuuuuugagacagagucccacuccaucaaccaggcuggagugcaguggugcagucuuggcucacugcauucuuugcauccugggcucaagugauucucgugccucagccucccaaguagcugagauuacaggugcccacaccauucucagauaauuuuuguauuuuuacuagagaugggguuucaccauguuggccaggcuggucucgaacuccugaccucaagugauccaccugucuuggccucccaaagugcugggauuacaggugcgaaccacugugccuggcaguuauucaucauuuaacagcauaaaguggccacuugcuuuaauaaacuauuauaguaccaaaauuuuggccugaggaauuuauaaauauaaauagaacaaaacaaaaauaauauuccccuugaaacauauucuaaaaccaggggcuaaaaguuagaauuguuagauuuuauuguccuguuucuuugggaugaaaugaaauuuuuuaaaaaccauaguuuuggccgggcgcaguggcucacgccuguaaucccagcacuuugggaggccgaggcgggcagaucacgaggucaggagaucgagaccaucccggcuaacacggugaaacccugucucuacuaaaaauacaaaaauauuugccgggcgugguggugggcaccuguagucccagcuacuugggaggcugaggcaggagaauggcgugaacccgggagguggagcuugcggugagccgagaucgcgccgcugcacuccagccugggcgacaagagcgagacuccggcuccaaaaaaaaaaaaaaaaaaaaaaccacauaguuuuacuuaaaccaaaggcuuugggauuccagaagaauaaaggaaguguacuucaauucuacaucucaagaaucuauuucuucccaaauuuaauacaggcaaauuuagucuauauuuauugggcacuguuagguuuuugugucagguguugcugaguggcgggauaccauucuuggcccauaaggaccuuauaaaucuauuaauacaauuaaauugugaagaaaauuuagaaaauugcaaagguagaaugagguugcaaauuggagggucuuauucuggagauagguggaagcuauggcagauuuuuagcaugaaugcuuucuggucaagacacuuuuagaaaaauuagcuuguuuccaagaguagauuagauuggggagagaaggaauucaaauuacaaaauaauagugugaaaagcauugugggagaucauccuguccauccccucauucaugauauccugaggugcuguauuaagggcaucauugcucuuugucacccgagcaguccaggaaggcugccuguucagucuuagacuguauccucacagucuuaaaccauauccucacuuuaugauagaaacacacaggcaaguguuguaagaguuacauauugucaguuaaacaagaaauuggaugaguccccauacuauucuuccucuuuuaaagagagaacuugggccgggugccauggcucacaccuguaaucccagcacauugggaggccgagucgggcuggugacgagaucaagagaucaagaccauccuagccaacauggugaaaccccgucucuacuaaaaauacaaaaauuagaugggcaugguggcgcacgccuguagucccagcuacucgggagacugaggcaggagaauugcuugaacucggaggccgagguugcagugggccgagaucacgccacugcacuccagccuggcgacagagugagacuccaucccaaaaaaaaaaaaaaaaaaaaaaaggaaaaaaaaagagauaacuugaaacaggcucuuccagccucucuauucuuuuaauaacaugcagugcacuucuuggagcuaggggcuagggucuaggggcuucuugaagguguugaugucucugguaacuuacacugcagggcaggucucuggagggaacuuugaacagguuaagccucaaaugcaggcagagauuuccaauugggaaaguuaggugaacguggcuuuaucaucucuuuuauugguuuauggguauuuucucuuuuuccuguuuucuuucccaccauuuaacauuaucuguucucugccuuuuuaaccuucuggcuuuaaaugaacaguugcuuaaucuauagauuaacaggaucagcaaacaaagcacagcagugccugcacaaagcagaaacugccuguuagaugaguugagcaaaaccauuuccuuugcccaacuuucuccucuaaaauacauaacugaacaugggauucccagacacgaauuguuucucaaccuuucuuuuuccauucuacaguuguaugaaauuaaaauuaaauaaaaagcaaacaacagagguagucuuuuuaaucuuaccgaguuggaagguauacuauauacauuauccuaugguagaaggucugguacauucuugaccauuauuacuuugcuaugggcacccuucacccuuguaggcugaaaauuggcaaaucauaggcacguauacauugugguuuuggaauuugaaagaucucaaauucauauugagugagacaguuuuugaauggagggaucaggcugucuauauguggauauauuuuaugcauuucuggucuguauaaauguaaggauugcuuuacugaccguagauuucuucuaggguuaaaaaguugaaggcaguuuggauauuuuaaaauaagaaaauuagcccuacauugaaagagagaauaggaaaaucuaggcuauguguacacaucugcuuguguuuucacaauuguguccuguccuauuuauuuuuauuucucucccaucucuucccucccacccacaauuuguuuuucauucaacacuuugaaauuagaauagcuuaucuaucaaacaagguucuuugacaggauuuuccaacucugaguaugaaaguguggauauaacaauauauuuauauagaaugucagaagcagaguuuggccagauuauugggaaauauucuaacgcccugcagcauuuuaccgccuuugcuuuuacauaaggccaucauuuggaaacauagcaugcugauaccucccauuauugcaguagcguuucaucagcugcacgcugccucucagcgccucauuaaguugcaagcagagaacguuuucguuuuccaguucucuuucucaauuaaguuagagauuguauuuucaguauuccucauuauuaaaagaauuuuuguugagaauaguuuaagaugugauauuucuuuguauuccaggaaaauuuaaagaaugucauugaaauccagaaacagaaguauauauugucuaggacaugcuuugucuugguuuauaugccuaaguccgaguaguuuaaaauuuaugauuaauauacucuuugaaugcuuagaaauggcaucgauuuuaguuguucuaguuucaucuuaaauaaauuggaguaauuacuaacucaggauuaugaugugcuacacauaaaacauuugcagugaugucugguacuuaggaaacccucaguuaugacauuuuucuuacuuucuucuuggauauguucuuugaaaaagggacugguauggaaaagcuuugagacgaugaaaauauacaagauaggcuaucucugaaacaauuugguauagagcauuugauucucuguuucauguauauauucauauaugcuagcugcagucaugcagacacaauuuggaucuggguuuuuuuuuuuuuccuuuuucacaugcaguuauaaauuuagaaaccuggcuguuuccucuggacuaaauguauuuauuuaaauuuucagugcuuuaaaugcaaaauuacaagcauauguacaaguagaaagaauaguaaaaugaacccucccaucuaucugucacugaauugcaguaaugaucaaaucuagucagucuuguuccugagucagucuggaaugcagguuuuuucccuuaacuauucagguucuccagcaauccuggcaaaacacaugcggguuucagcucaucucuuucagugaccuguaaauuaagaugugcuaaagcaucacauguuacucauugacguuuuguuaauauauuuaaaacauuuuauuaguaccacauaauuuuuagcguuuucaaaaagaaauaagaauuuggcuaaaggugaauuuuaaaaauugaaugacuaaguagaaaaguaggcaaacuguuuucagaauuaguagcaauuuccaauuccauuuacucuguucauuaacuuuguuuucagccuuuuguuagccauguuugauuuuguguuuuugaaauaccuuuggucauuuuaggacuuuuggcauuaaucaccugucuuagguggccuguuuacaaaagggacuuuucgguucuccauuugcccuuaauguugggaauagagacaaaguuucuguaggacucugacaacauauggcuuuacaaaguuuuuuuuuaauauauacauuucucuucuuggcuuucuuaaauaucaucaaugucuuuucuugcuuuacguauuuagcaacuuaaaugucaucuugucugagaucaauauauuuccaacuuggagagauagugagaagagagacuucagauuuuuaaaauguggaacaaaacauucugauggugaccagguuuuaagguauuucuucaguagacaaaacuacuuaggcuaccgaugauaagcuuuuaauauuaauaauaauuauuauauauaaaaauauuaauauaauaugaucuaagauuguuucuauucccccucuuuccugguuguuaggauuuggaauuucuuaugcacucuuuuuuuuuuuuuuuuuuuuuuucugagacagagucuggcucugccucgcaggcuggagugcaguggcgcgaucucggcucacugcaagcuccgccucccagguucacgccauucuccugccucagccucccaaguagcugagacuacaggcgccugccaccaugcccggcuaauuuuuguauuuuuuaguagagacgggguuucaccauguuagccaggauggucucgaucuacugaccuugugauccacccgucuuggccucccaaagugcugggauuacaggccugagccaccgcgcccggccuaugcacucuuaaaauuauuucauguacugauacauucacuuucaaugauaaaacauggcuguaugaccagguagguaggcugcuuuucagacuccuguacuaacugaaugggccccauuagcccaagugagagcuuaacuugucacucuuccuaaaugccuuccucagcugagugcuuauuuacaguaaucuacugcuuauagcagaugcuaugauuuguauaagcuguccauaucuacuuggaagaacaauauugaaaggcauugagauacuuacuuucccucaaaagcccauaauccaacaacuauuuagaauaucuuauuuaagagauagguuuauaauacccaaagggaacuuaauguauacugaaagucccugauugaauggauucugaccuuaaccagaaauauuaauuacaugcuuaucagacacuuacugugcuaucccaggguuugccacuguugagggaacaccagaugaaucauauugucccugccuucaaggauuauauauucuaauaggacagacagcccaucagcagaauaggagguagcaaguggucagggaucagauaaagugaucaaggcaaguggaggaugcagugguaggacagaauggucugcgcacagagauugagggcaucauguggugggaauuagugaacuagcaugcaagccgggccuuuuucuuggcuuuuguucaauuggaaggagcauaaagcuacuaaaggagcuuauguuuagaaauagggcuuauugaaggggacaaggcaucuccuagaauccaaaugcacaucccaagacuuaaaagaguuagagggcacaggcaggcccugucagauccggucucugccagauccagucuugucuguuucucaucuucccuugucucucugaguauucccuguuuuccuuuccuggacuaacugcuucuuccagaugccuaguuugaguccacccaugguuuuuugggggcuuuucuuuguuuuuuuguuacguucuguuuuuguuuuuuguuuuuuugaggcggggucucacucuguugcccagacuggagugcagugacgugaucccaguucacugcagccucgaccuccucgcuuaagcuguccucccaccucagccucccgaguagcugggacuauaggcgcaagccaccaugcacccauggguguugacaugccaccuguggcucagacuuaugcucaccuccagucaaguuucuuccuuaucuaacgacagccuuuguguguucgugaaagcccuugagggaaagaaugcuacguacaguuugguuuucuugggcucuaauaagcuauaggggauggugcugcagaguuugaaauacagucacuaaugaguccuccuucagagagcugagggugggagcaccacauaaaaggaguugggggucagcagccuccugauagucugaaagccaaagaugauggauguggggcuccacggggaggcuauaacaugccacguuauguuuucugcccuugaggaaagcuucuuuucaccaggcaggcaguacagauacaaacuuaauagcgaugugaggcacacugauaaauaccagaaaacauucuguaagagggguuagcauuauuucacugugugcagaggagguuuguccauguggggggacccuaaugggcguaggcauuugaaguguagucuaagggaucuuagguaagaguguguuuggaacacaguguacguauuuauacagcaaaugcucuguguggcuauaauuuaggaaaauuuguaggacuugaggacagcuuauuuuucuacuagcugacagaggcuuggguuugcuucugcuuuaaguauaaguaucucgaguccuuuuuuaaaaaggaaaaucaaggaaauaguuggaauuggguuucacauaaaaaacauuuuagaaaagaaggggaguaugagaguuaggauuugcuaauguuugcuguauuagcaaauuauuugcaaugcuugucauauuagcaauacauguauguuuuggaaaacacaugcaaauuaagcagcuuaaggaacuuuuaucuuuauuuccuauguaagauuugagaugcugcaaagaaaauauuaaaacauugaaccgauacuuacaguaguccuccuauaucugcagaggauaacuuccaagacccccagugaaugcccgaaaccuuagauaguaccaaacccaauauauacuauguuuuuuuccuauagguacauaccugugauaaaguugaauuuacaaauuaggcacaguaaguaauucacaacaacuaauaauagaauagagcaauuaugacacuacgccaccaucacuacucuugcacuuuggggccguuauuaagucaaauaagaguuacuugaacacaagcgcugugaugaagugaucaauggcagguagcauguacagcauggagacgcuggacaaagggaugauucacuuucuggacuguguggguuugagauuucaucacacugcucagaauggugcgcaauuuaaaacuuauuguuggcugggcaugguggcucaugccuguaauccugguacuuugggaggccaggacaggaggaucucuugaggccaggaguuugagaccagccugggcaacauaggaugacccuaucucuuucuuaaaauuaaauauaggccgggcacgguggcucacgccuguaaucccaacacuuugggaggccaaggcggguggaucacaaggucaggagauugagagcauccuggccaacauggugaaacccugucuuuacugaaaauacaaaaauuagccgggugugguagugggugccuguagucccagcuacucaggaggcugaggcaggagaaucgcuugaaccugggagauggagguuacagugagcugagauugcaccacugcacugcaaccugggcgacagagugagaguccaucucaaaaaaaaaauaaauuaauuaaauaaauagaaaaauaaaacucauuuauuuauagagcuuucuauuuaauauuuuuggacugaaacuauggaaagcaaaaccacagauaagggaggacuacuauaguuaugauaaaaaucaggaacuuaaucuagccacgagaacauuuguauuucugaugaaauuuuuauucuugucuaaaauguugaacuauauuuauauuuauaucuuuaaauauaaaugaacuauauuuauaucuuuauaaaugagcuauauauuuauauuuuauauaaauauaaauauuuuuauaucuauguaaacauaaaaaggcuuuuuuuccucucuggauguuuacugggguuauuuaauaaaaaccuagggaugauauugggaauuuuuguuggaauuuuaaauuuuaacguguuuguuucuuuuuuuguuuuguuucguuguuugcuuucugagcugggaguuggcugugcauguggcaguugcuuuaucaaaagggucuugcucugcuucagaagaaguuuuguuaccuugauugcuaauguucucccccuuaaauaaaccuccugauguuggaacagcaaaauugcauuauguuuggaaaaucuaaauuaauaaucccuuaucucugaauaaaaguaacugaaucagguugaauuuacugcuuccauuuuaauaggacaguaggaaaaaacuaugcaugggcuuuaugugguucaaauuuuuuuuuuuuuuuuuuugagaccgagucucgcucugucaccaggcuggagugcaguggugugaucucagcucacugcaacauccgcuuccuggguuccugcgauucuccugccucagccuccggaguagcugggacuuaacaggcgugugccaugacgcccagcuaauuuuuguauuuuuaguagagacaggguuucaccauguuggccaggauggucuugaucucuugaccucgugagccgcccgccucggccucccaaagugcugggauuacaggugugugccacugucuccggccugguucaaauuuuguaaucuccacauccaucugcauauuaacaauugucauuguugguguuauagagagagaagcugaagcacagaaaauaacacgcauguucuagauuuccuggugggaacuggaaguaaauucuguguuuggcugaucacuguauaaaguucuaguacuagucuuuagggaaaagccccgucuucauggauuuuaauuugucaauuugcaauucuaccuacuuggaaauagucaaccuaaucaguuacugcccuguugcaccaacuauuaccauaggaaucugaagaugguaugcaaccaacaugaaaaagagauccuuuucuccugguaaucaguuuguacccuacaaacaauucguugguuuuaaguuguauagagggaaccaugaugugaauaugccugccacuggguuuauagaaaaccgaugacuccugaggaaauucucagcaggguugucuuucagugaaaagaacccuuuagaaagaugcaguaacucacacuuuacugcacauaaagucaugucccucaggguggacucucaggugucauacaguuuaugacucaugagugcugcagcuuugugaucuaauaaacaaguaaagacggugggagaauuauauuccuguacaaaaagccacuucaccuuucauuauauaggaaaaaagccaugggaauauuaaauuuuuaguggcauuuuuagagcauuuucugugaucuaaagugccugcauugagauauuaagauacuuaagaacaaaguaaaauaaagagaaguauuaauagcaggaucccuuuggagcuagguuacuguggcagugguuucaagaauaacucucucagcacccaccccaggauucugauuuagagauuucuuuguguguucucuuagcauauaccucuaccacugaguuuauccccugcugcuacacugauugauaccuuauuuuuaaauuuuuguuuuuaaaauagacgguuuuuuagagcaguuuuagauucacagaaaaguugagaggaagguacagagguuucccauauacuugcuaccugcacacaugcuuagccucuccuauuauaaacaucccccacagaaugguacauuuguuacaaucgaugaaccaacauugauacaucauuagcacccaaaguccauaguuucccugaggguucacucuuggcgguauacauuuuuuggguuuggacaaauguauaaugacauauguccaucauuguaguaccauacagaguaguuucacugcccuaaaaaucuucugugcucuaucuguucauccucccccugcccccaaccacccaaacccguggcaaccacugaucuuuuuagucuccauaguucugccuuuuccagaaugucauauagugggaagaaugucauauaguauggagccuauucagaugggcuucuuucacuuagcaauauuaguuaaguuccuccaugucuuuucauggguucauagcccauuuccuuuuaguguugaaugacauuccauuuucuagguguguaccccacaguguuauuuauucauucacaguaccuuauuuuuuaacugauuuuuuuggggucugggacuaaggugagguaaacaaggcagucaggaauugagauuaagaauuuuuaauguaauauuuuuaaaaaucaaaauuacugcaaaaaaacuccaugaugaacaaaauaucaacuuuuuagacagagauugagucacgcucaauugacaucaagccaugcauaguucuccuacugccuuauuaaaauggaagcaguaaauucagccugauucaguuacuuuuauucaaagauaagggauuauuaauuuagauuugucaagcccucugaaugucauggacaauugugagugaaauuccguguaucgucuaacuccccauggauguuaucuugcucagaaaccuuguucucccuccaaggaaggcacuacuucuccuguagccuucucaggucgaaguucuuuucucaaaauccucacagcguugccccuagaggugggaauguccucuuuuccucuucauuuccucuuuuccucuucauuuuuguuuccaaaccacucuuccuuucucuucccuaaaagccccccuaccucagcuugaagugcaugcuuucagacaaaucacuuugcuccuccaccuguuggucaucuccagaccucuuucuaccucaucgauguucaccauucagacuuugaagauuuuagcuccugccuugcugucaucagguguagcugcuucauuugcugauucuuaagugauccuaauauugaucucaaugauccuuccaguauuccaauuugucaguucaugauucucaucccuccagugaccuuguuuucaucauucuccaucacccauugcuuacaauggucauauuauacuccuugcaaugaccaaucacugcaacuccuccaaaauuuuaauuucaauuauuugacucuccaaguacuacuuauuaccaccucacuuucuccaguccugugcgccauacauucuuuagccccuggagugugaucaguggacucagauuccacuggucccuaccaccuuuuaccugugucuaauuccccucauguucucacuuuugccacuugagauugcauggcccagcauucuaaucauucccuugcuuauaccgucacuucucuauucguuguuauuuaucuggcaaaacaaccacccuguugcaaugcaagguuuaugcaagggaaugcacauuuucgaaauagauuuuuauguuuauguuuuucuuucaaaucucuacucauuaauaaauagaagugguuugauauuucacaaaugugauuuaauugaucaaguuucacauuucauucuaagugcucaguuaaacaccaugauguauucacaacaguaaucaaagcaaggggcuguaguuaguuauaggagcaaagagaauucaugaguuuauuuuuaucuaaaugacacccuugauaacuuuucgauaaguuauuuucauguaaauuacuuggaauaagagcaggauuuuuauauagaaagcuuucuaugugucauauccuguaaaauguuuguccgauuagugagagauagggggagguugaauuuuacuaaacauaauauccccagccauaucuacuguaacguuuguuuaggacauuacagacuauuauccuacaccaauuuauuucacaucaaaaaucaccccaugcuuguaagaauccuccuuucccccucuuguuucuauuuuagcuccccuggaaaaauaauauuuuaagucuaaaugaguacaauaaauuaaaaaguugcauugcuuaauauuuugaauggaauagcuagaugcuuguucauuugcuaucuuuuucuuuguacugaauuucuuuagcuuggucagagguagagcaggcuugacucuuaguggauagugguauagguugaguaucccaaauuuaaaaauccagaguccgaaaugcucaaaaacccaaaacuauuugcaugucaacaugaugcucaaaggaaaugcucauuggaguauuuuggauuuuggacuuuccggauuccagaugcucaaccaguaaguauauaaugcagauguucuaaaaucggaaaaagucagagaccuugaaagcacuucuggucccaagcauuuuggauaagggacacuccaccuguaccuuacaguggaggcuuguuagaugcuuguaaaugccagccccugccucaaguaacaauugauucuuuuugugugcucucccaggucuacccugaacugcagaucaccaaugugguagaagccaaccaaccagugaccauccagaacuggugcaagcggggccgcaagcagugcaagacccauccccacuuugugauucccuaccgcugcuuaggugagccggccggccguggggcugguguugauugggggccuggucuugagggaagaaaaagaggaugcuccuguuaggucacauacacagacuuguucuucagcacauugccacucuguguuguacuguguuuuggacucuugcaguuacauucugugcacugacccuauaggagcaguauuuuugaguucccugccucagaaugaauuuacccaggguguauauugaaauuacaaauuccugggccaguuccaggacuccugaaugaaaaaugccuauaguagcggauccgggaauucuuauuuuaccguaucgcauagaugauucucaugaacaggggccuuguguguuucuucacauagacuuucuagaagaaagaaucuaaugugaagcugcagcauuuuguuaauuucuaaaaaaaaaaaaaaaaaaaaaaaaaaggcuguucuacaauaacuacuccucuuauuuggugauaguagaggaauuggaauugggaaggcuuuuuuucugcuuacaucaaacuggaggaaacagucugauuacuaauguuuaauguuuguuuugucacaaaccucaaauuuaccucaacauuuuauuuaaaaaaauugaguaguuuuaugugguaucgugcucuuuuccucuggaaacugucauacuccauauuuaaucuaacuugguuauuagucuguuccuaguuguuguuuuuaugugaccagucauugcagaagucaaguucuuugcucugguaucuuacaucuagauguuuuccacaaguguauucaucaguaggcagguuguaaauaaggauauagagauugucuguggagauuguggacaaauauugauguauauucugaugacuucuuauaaagguuaaaaggaauauuucaaagaaaauccaacagcaaacuuacaaaguaaggauauuuacugaagauuccggagaucuauguaauauauggucaaaaaugaauguccuaagagcauacugauugcuguucauucaugugcauaauuugagacauaaaaugaaaacacugggcauuagaaagaagauuucaccuggugaauuuacuuacaauguaauugaugaagagaguguagaaaacuagauuucuuaaacaucugauaauucaagaguuuccuuuuuccuccuuauuccuuguuccuauaugcuuuauaaggccucaacucuuuucugguucaucaaaaagugcaguuuaauuagaugaaaauaagcagcacuuaaauucuagauacagaacuccuacucaaaaaaauauagaagucaucuguccccaggaacuguguauuuuauacucacuuaguuauuacaccaagaaauaacacacagagauugaacaauucaguacaaguuaggaaguagaucaugagucuguuaauuugaugggccaggcuuuguuaaugauuuguuucuuuugguucuuacuuaccuguucuaugaaguauuccaaauauauuuucauuagaauguaagcucacugagaacagguagggcuuuggaugggcauuauugcuccugguaugacacucaaaacugcagucauguuucagaagugaacuuaucauuuuacauagauuuuucugcuucauauucuauucagaaugauuuguauuaaaguugauggaaagaugaaauccacauuaagauuguuauuuacuaccuagugccaguuguuguagcaaauauccuuugaaccccaggucuauuuuauccuaucuguugaucacuuccuuugccccugcucuucaagccuccucaucucugaaaagcucuccuuccacugggugugguggcucaagccuauaaucccagcacuguaagaggccgaggugggaagauugcuugagcccagcaguuagagaccagccugggcaacauaaugagaccccgucucuuaaaaaaacaaaaacaaacaaaaaaaccuccaagugaacgaacaguacaacaaguaauaaaggauauaaaagauguucucagaucucaauaucaagucagaagauuuuauaauaauauuauaauuacacggagacuguccaaauauuuguauuuguugugcuacacugcauuaugcaccauuuagggaaacaacagccuaaguaaugugguuuuaaauaauuaaucucaucuaccaaauaccuguuugauaguaaaguuaaugaccuguccucaccuuauguuuuuaaccauuauggaaagagaaccacuugaaaauauaucauuccacugacagauaauuacccagcugugaagcacaggcuggagacuggcaaggagaaauggagagaagccuauaaaauaauucuuucucagggaaggaguuuauuccugccaaggcuuugccaucaaccauuaucagauuucucuuucauccuccgaacagauucugggcuccuuugauguggagguacauaauucaaaaaguugggucacuugugacauguuaagcaaauuucucaguucugguugugucugaugugaaaugagcacguugacacuaacuguucuugacuacuaugggacuagauaaucauuugcuauuuccuguagguacuuggcguguugaaucauuuuaccauauuuucucauuuuaugaaucacugguccuuuuccauuggaccugaaauuagacccuaauaugacaaguagagcauauguugucucuuacuuuguuauuaaccuuagauuagaauuaaggaauauaggugcugcuuuuuucuuagguaguggcaaauuuuccaaaggucucaagcccagaguauaauacagaguugauaaaauaaccugguagaguauguagagcaugccuugucuuucaggaaaaggaacugaaaaacauagguuuuccaauagguguaacauagguaacauagggacauagguguaacugauguacauuuuacuugcacuuaauagacaggcaguguuaguucuucgucucucuucacaggcuauacaacuaccaagauccagagagguugaauuucuugcuauaacucacagcaaauaaaugggagagucagcacuacaguccaagcucucuugauuauugguccaguguuuuuuacaguauacacaaaaauuuguuuuaaaacaaauauucacuaugaauuagagacaauagcacuaaaaaagaaacucacagcuaucguuguguugacagaggagacaaccaugaccuaguauaggauaaaucuccaugugauauguuuucuacuuuauaguaguaguagguaacauucuuacauauuauuccugcuuaacaaagaauuacuguucagcauuaacauaaguaugcucuaaaaucucuugacuguauccaaauauauguuuuagacaagaguuuuuuuuuuuuacugaccuagcaaacaaaauaaaauuaucuuaaacauuaagcguguuaaaauucaaaacaaagcuugaagagagaaaaaugcuuguuauguguggcauacaaccuuccuaaccucuuuaucagaugaaggauccaguguggcacuggauuauuuuucuguaauauuuugccucggacauaugugcuauacauuucuugucugcauggggaaaguaugucagguugcuguugccacuuucuucccauggaguggauaauuucccuugagaauaaguuggcuuucucaucucacccuuugcuuuugguaguaccucuggaaccagaggguaagauucaucuuaaucaugugaacauuuuauuaauuaucucaugugugauucaagcacaucauuacuguuacucaaggagaauauuuucuuugcaaagcuuucaacccuuuccauuugaaugacugcucuucaugguguaauagauccacuguugaaauuggcacuuuucuguacuugucucugaccagcaaaggcaaggaacauugcguaaaauaaauuacuguugaauuauuggggcaaagucagguuaauagcuuaauccaaaaaaggaauuacaagugaaagaauuuuaccuuaaaugucauucuguuucauuuuguaauuaagaccuuccaaauguguaaguaguaaugaccagaaaucuuaucagauauggucaaaugagaaagguauucaauucauauuaauuuugaauuuuauuguuuuaauacaauuuuaggaaaagcaugccuuguuuucuggguuucuuggcugccuuuguaucaauuaucuacagcuaucuucuuuagcauggaaaggauguauuugaauacugugacauuuuauaccaggguaauucuuugaauuuauguaaacaacaacucucuugagacacaucaguacaacacaauagucagaaaugucacaugagaguucaccaaacuuuaaagauggcgaugaggauggaaaaacauuuuuauuguagacuuuaaggaucuuguaaauccccguauguaauccagugugcuagagaauuggugcccauggcgccuccucuccccaccgaccugcacuguggaaauccuacuaauuuugaagucaugggagaugcaugugugggaccuauacaugcacugugaugagaaugaugacuucaucauucucauuauuuaaugagcccagcugcugcauacaagaaggaugcaaauucuugaauguucuugauuguuuacaucauggucucauaaggaaugaccagaauugcugggcauuucuucaucaggaaaggcuaaucagccauccuuggagagacaucagacuccuuuauauguggccuucccaugggaccuuugaauggucaacguuaaucaugcuucagaaccagcauacuaaguaaaagaaaacauguccggaaaagaaaucuuaucaguguuuaucucccaacagugggauuacaggugauuuugauuuuauuuaagcaauuuucuaugacuuuguauaauaaaugaguagcuuuuauaaucagcaaaagauagacuaugaaaucaguacauauaauuuuguauuuguauguaguaccauugaaggauaauagaaaaaagucaaaagacuugaaagucgacacagaaugaucauuaauuuguuuuaucucuugguaguuguacuuuaugagcuuuauacauacaguaugggaaaauacacuuuaguuuugaaaacaccaugaugccaaaauaaaagaaaauaacguucauucauacgaucuucaacaaaauuuaagcagcauuaaucaucacugauucuucaggaagauucuugaucuuccuuaauuuuuuuucccuccaaaauugcauauggcagccacauuuguuucaggccagaaggaagaaugggaagagcuuacauuuaucucacagauuccuucugggugaggaagacuuagaaagugaagcccucuuccauuugauuaagcaagaacaccuauaaaaauggugucuucggccgggcgcggugcucacgccuguaaucccagaacuucgggaggccgagaugggcggaucgcaaggucaggagauugagacugucuuggcuaacaacggugaaaccccgucucuacuaaaaauacaaaaaaauuagccaggcguggugcgggcgccuguaaucccagcuacucgggaggcugaggcaggagaauggcgugaacccgggaggcggagcuugccgugagccgagaucgcgccacugcgcuccagccugggggacagagcgagacucagucucaaaaaaaaaaaaaaaaaaaaaaaaaaaaauggagcccuucuagguaggucauccuccauggcucacugcagcacuuccuuggcccugucccaaguuccauaauugccucaauugcauuggcuccugcuugauuugcuuucuaaaacucaggacagaggaugaguugaggagacugacuuuuuuaacaaucgcauuuugaaaagaaggaagcguagugguguuucuuggcuccguuuccaguuuuguuucuuuucauuuuaauuauuguaccugguauuguguccucuuucugggacuuuuaacaacuaauguuuugauugauaagagcucuaauagcaugggugauuuauacuucauuacaucuucaguuuugucuucuuuacuggaguuguauucaggugucauuaaguaacgaggcauuaaaaagaaacgauaacuuuugaaaaacugcuguuauggcuuaugagugggcuuugcugauauuuucuugaagcacagaauuuaucuaucucuguagguccuagaugauaggugagaaaaagaaacccagcuuauuuggcaugauauugucccaaggcuuguuaguaauugcuuugaaaaaugaauagcaaggcuaauggacaucugauuuguaguacaugcuaagaauugcaaaugugugcucaaaagaaauuucucugauuacaaaaguaacauauauucaacguacaaaguugagaaaauacaaccacuagcuaaaaauaaucaaaaccauuuggcuuccuugcagucuacauuuuuuucauguauguuuugcuuuuguuuuuaguguuauuuaaucguuuccuguuuugugacuugcuuuuuacaccuaacauuuuuagaauacucuaccugugaaauuaaauauucuuggagagcauaauuuuuaauguagcaucacaccagacacuguaauguguuuacucuuuuuuauggucauuuaggugguuuucuuuauuuuguggugguguaauaguuguuauaaaugaugcugugauaaacauccugguagauaaauuuguguuuaguugauuuuuauauaacaguuauuggcggaaugccuugcaaaucuuauaguugguguaauaaaauauaugcgccacauaauuguuuaugaaaauauggaggaaaauuuuaauacugauuuaugauccugaguuuaacauaagcauggauaccccuacauuuagcuaugauuuuuuuauugauagaguaaaagcgccuguaauuucuacuuaaggccauuuaaaauaauuacuauuuaaaucuauuuaaacaauuuuaaauauugcuuuuccaaauuuccaccuuaggaaguaguuaauugaauauucucagagaaauaaguccuacaaaauugaccaauaaaaggucaguuacguauucauuguguacguuuuauugaucacccacagugugugagccccuggaggugggugaaaugugggccucccucuuacagaguugauagugggccugaaggggaugggauuucagcucaggaauuuaaggaagacuugacaggaaguagcauugugagccaagauuucaaggauaagauuucaaggcaagaaaggagauguauuuuagguauucagacagagggucaacaaagucuuuaagguaggaacuaguucacuuuucaaaaagaagagguaauuggucaugauaagaguaguaguuuuuaaaaaucauuacuguuuucauucauuuauaaugaauacuauuauuuuauaauuuuaaaguuuauauccaaauaauuguuuucaagaugguaaugaauguauauugcuuuuauguauacacauaguacuuuuugcuuuuugguaacuaaguuuauaauuuuugagggcaggaaauauuuuuguuuuucacuuacaaagaaacuauauuuuaauaagaguuuuuugacagcagugcuuuaugccaaaggaaaauaaagcaacauuuaacauaucaaagaaagccaaugcaaaacaaggauuauuuauuuauuuauuuauuuuauucauuuuugagauggaguuucacucuuguugccccggcuggagugcaauggcgugaucucggcucacugcaaccuccacuuccugggaucaagcgauucuccugccucggccuccugaguagcugggauuacuggcacccgccaccacgcccagcuaauuuuuugucuuuuuaguagagaugggguuucaucauguuggccagguuggucucaaacuccugaccucaggugauccacccaucuuggccucccaaaguccugggauuacagacaugagccaucaugcccagccaaaacaaggauuuuauauucaaucaaacugacauucagauaugaucacaugaaauaaauaucaacguacaauaacucagggcauauuuucacauuauuuuccuguagaaucugcuagagaacaaguuucagauacccaaaauaccuagagaaaaacugauauaaggauggguaaugagcauuaaggagaaacauaaaaacuaagacucaacgaugguaaaaaguaugauaauauaguauuccacagcuacaugcugugacaauaaagagauucuguaacugucaggccucugagcccaagcuaaaccauccccugugaccugcacguauucgcccagauggcccgaagcaagugaagaaucacaaaagaagugaaaauggccuguuccugccuuaacugaugacauuccaccacaaaagaagugaaaauggccgguccuugccuuaagugaugacauuaucuugugaaauuccuucuucuggcucauccuggcucaaaaacucccccacugagcacccugugacccccaccccugccccccagagaacaacccccuuugacugcaauuuuccuuuaccuacccgaaucuuacaaaauggcccuaccccaucucccuuuccugacucuuuuucggacucagccugccugcacccaggugaaauaaacagccuuguugugacaguaacuuuaauggggaagaaugagaagaagauguggguaaagaaacaacuguuuuucuauuaauggugguaguauuaguguguaauucugagccuggugcauaaguaauaugguguaacauaagugaauaguugugugauauuuuaauucaaucaucccauguauuugagaaucagaauuuugaugugguaaaagaagauucacauguaacauauaaucuauuaaaaagauacccuguagucaugaguuugacuuuuagguaucauuucucaguauaacauauuguuguagauuucagauaacauuuuuuccccauaaauacuguccgcugcaggccuaaaaauaaugaaaaggccuaaaagaccaacucaguagcgguaaacaccaguacugcaccuagauuauggucuuuaggaaccauuuuccaguaaaagauaccaguaaucuuuggaaagcaggauuuuuuuuucuuuuuuuuuuuuuuugagauagagucuagcuucgucgcccaggcuggagugcaguggugcgaucuuggcucacugcaaccucugccuccugaguucaagccauucucugccucagccuaccgaguagcugggauuacaggugccugccaccacuacuggcuaauuuuuuuuuguauuuuuaguagagacggaauuugaccaccuuggccagucuggucuugaacuccugaccucgugauccacccgccucagccucccaaaguacugagauuacaggcaugagccaccacaacccggcggaaagcaggaaauuuuuuaaaagcuauuuuaauucagucauguaaaaaaaaugagcagaaagaaacaaaaaacuuaaaaaaaaacuuaaaaaaugagcagaaucuuaggaaucaccugcgacuuugguuauucaugcuuagccauuucuauaggaaauuccagcacuauuugaguuagaccacuaauuauauguguguuguagcuuucuccaagagauaauggaauucacaaaucaaaacuuugagauuauuaaguguuacaagugaauuauaaccccagucauuugcuuucaaaugaacagcuaaacauauuuuguguuaauuucuuauggaugcugcuuuguuuguuuguuuguuuauugagacggaauuucacuccugucaccuaggcugaagugcaauggugagaucucggcucacugcaaccucugccucccggguucaagugauucuccugccucagccucccgaguagcugggauuacaggcgugcaccaccacaccuagcagauuuuuguauuuuuaauagagacaggguuucaccauguuggccaggcugguuucgaacuucugaccucaggugauccacccaccuuggucucccaaaaugcugggauuacaggcgugagccaccauucccggccuagauaggcuuuuaguugguuuccauauacaguguauauagggagaaacagacuaagacagacacuggcauccacagaaguaaaaauaaaaaguaagguauaauuuaaauuucacacggucauggucacauuuuucagcuuuuugcaccuauguuguauaaaaaagacaaaaaugccuuuagaggcucaaguuuucaggacuuccugaagcugugucauaguuuaaaaaugccauaaaaaugccgucagauuuaauaacguaucagcugaacacuggauuucuguuauguugagucuucaaaaauuucucccuguaugaggaauuaauacuguuaugucugaucugguggucugaaaugugaacuuuucugggccaaccaguaaacagcugcuguugcuuuauagcugcguaauucagucuuggaaauuauuagauaauucccacaccauuucagcuugcuguuuuaccauaaauuuaaugugaacaguauuucuagcuaaccucaagcuguguuuauugucguggaauuuucucuuuuauucugagguaaaugauuacaaaugguuaugaugaggaaucaaagaagaaaguggacuuucuucaaaguucuuuuucuacucuagccgcuucugagcaucuuucucaagcacuguguuuccaucagucccuaccccaagcagagaaaggaaacaguuuuccccuuugucuucagaacccucuucucaucgugucauuuuccaaagcaaauaaaaaucuugagauauugucuugaguuugauuuuuuuuuuuuuuuuuugagauggaguuucacucuuuguugcccaggcuggagugcaauggcacaaucucagcucaccccaaccuccgccuccuggguucaagugauucuccugccuaagccugccaaguagcugggauuacaggcaugugccaccaugcccagcuauuuuucuguuuuuaguagagacgggguuucuccguguuggucaggcuggucucgagcucccgaccucaggugauccgcgccucggccucccaaagugcugggauuacaggcgugagccaccacacccugccgaguuugauguuuuuuuuaaccauucaagccaguaaauaacuuuccagacagcuguaguagaaaacagaauuugugugugacaaaacuuaagauuuugggauugagagcucuaugguuuaugccauguggauaauuguagccagaugaagaauaugaaauuuaaggaaguguuuagagugguacagacagcuauuauuacgauucuugggguagaagaguagcuuacauacaacauaaaauaauggcauuaacugaauuaacuucagccuuugccaugaaacccaagcuuucauuauguuuuaaauaaugaacuacauuaaaaauaguauauaaauauguaaaauauauuagacauagacuucucauaauaaauuaugggaacuuuugauguauuucuucccuaggaaaagaacuaaacaagugcuucuuuguggacuuaaaauuuuucaguuuacuauugugaauuagguacagcauaucuuuauaauuccagauaauacccauaaaagcagaacuguuuauuuacuuauuaugaagggaauacugaaaugaaauuaaggacaauuuuuuucucacguauuauauuuuuaaaaaguuauuugauguuugugauuaaauaaagaaugaauuuuuaaagccaguucucaauuagcacugaggaaaagaauaugcuuuuuuucagguacacaaauaagcaucauggauauaagaaacgacauaaagaugaaucuacagucuggauuaagacguauuuuaauuucagugucaaaggcuguuaggaaauauucagauuuuaguacuugacaaagaagguucucaauauuuguuucaguguucagugaaaggauaaauucugucgucuuucucuuuuaucauauuagucacugagugguuucauuaaacauucccucuuccauauccccugauaaauuucaacuuguuggugaugcaucccaggagugucugucuuuuuuuuuuuuuuuuuuuccuucuccugucagugagucuuaggcuuuggcuuugaaacccuauagugaagggaaaucucaggcaacagcugugcaaccgucuggagagcagcuaguccagauuggaggagacgaacgaggcuggucgcaggagagaggccuccaggaaaaaauggcauugaugcauuaccugcguuaaagauuuuccuguacuuagcaugcuucuuaggguucuacuggagcguuugggaaagauacaguauugauggaugcauagaaaaugaggcaaauuuuuuaaauggggcaaauauuaacuguagacaaagaaaagccaaaaguacaaaauaacagcguuguaagauacgaagauaaaaauacgccuaaguaugagcguucuggcagacucacaauacagaugccauauaugggguaaaaccauaccaguaggauggugggaagggaaaggggugggcucauguuccauagugggaagaccuacagcggaaaaaucaggagaauaguuauuuaagcacagaguuuagggaguaaguugcagaagagacaacuaaaugagauggccgugaaugauuuuuaugaccuccucuuguuauggagaaaucgaucaaggaggccuauauuugauggcaggaagaaguugaguuuaagguuuccagacauuuguuuuaaucuggaaaauuucuuuuuuucuuucuuucuuuuuuuuuuuuuuuugagacagagucucacucugucgcccaggcuggagcgcaguggcgcagucuuggcucaucgcagccuccgccuccuggguucacgccauucuccugucucagccucuugaguagcugggacuacaggcgcccacaaccacgcccggcuaauuuuuuguauuuuuaguggagacuggguuucaucguguuagccaggauggucuccaucuccugaucucgugauccgcccaccucggccucccaaagugccgggauuacaggcgugagccacugcgcccagccuaaaauuucuuuuaagcuuagaaguugcaagucaaguuacuguuaaaggcguccuaacuuugaauuagauaaagcuaaacugugguuuaauugagcugaguuuguuguaugcuauaucucaacuucacaagauguuugcuuuuucuuggcuauaaccuaagauuauacaaauauaaaauuaccuuuaugcccauuugauagacuuuagggcugaauuucccuguguaagauguuguagagguuuguacuugugauuguuuuuacucuagaagcauguuuaucuucacuccuuuagugacacguguuuguucaggaacuucaaacucaaugugaucaaaacuagacucauguucccugaauagucucuccugacuacaaaucuguuggaaacuuccaauccuaauuaauaauuguaaacuuuuuaauguaagucauaugagggguuguugugagcauaggagguagggagaugguagugugagcuggagcauaugguaaaaguuguuugaaagaaaguagacccaugauguggauccugagggauacguaaagaaaaugaagagguguagauuuaaaaauguuuauggggccugggcgugguagcucacaccuguaaucccagcacuuugggaggccgaggugggcagaucaccugagguuaggaguuggagaccagccuggccaacauagugaaaccccgucucuacuaaaaguacaaaaauuagccaggcauggugaugggcgccuguaaucccagcuacucaggaggcugaggcaggagaaucacuugaaaccgggaagcggagauugcagugagccgagaucgcgccacugcacgccagccuggaugacaagagcgaaacuccgucucaaaaaaaauuaaacaauaaauaaauaaauauauucauggggauguuccagggaaaguaguuuguguugguagccuugagaaauaauaauagaaaauuagaauagaacuaaguugguucauuaaaguuggaacacuuguagagauuuuugauuuggacagacauuaauucauuugauuauuucucuuauucgauguccagaaaaauaucuguacauucaaugugguuuuauuuguacugcacaugucauuaauaggcuaaaguuaccucuaagauaccugcuuucuuaguccuuguuacgcuguaaauucugggcaucaggauauagcuuuuuauuauguuagcucuuuuaauagaugauacaauuggauuggggaaaaaacugauuauacucuggaguaauacuuucauagccuguaguauccugcaaauagcuccuggucaucuucgaauuuuacuagcaaacuuguaggguaauagguugggacaaaguauuauaaucaguggcuuugagggccugauaagaggaaacaauaauugugcagcuauauugugaauaaguagugcaugaugcugaugguuaacccuuuccugcggugcucaaacauugggaaauaauugcuuuuuguucaaaauguaagcucuucgauaauugagacuuuugucaauucacugaaauauucccagagcuugaacaugucugguacauaguacauauuuaauaaauauauagauuuaaugaaugaauugaggauguagccaaauauuggaaaaggaaagggaaaagaaagaauagcccaaacauuagaaagacagaagauguggagcagcaauuucacaugccuaaaagaauuucugagauuauggcaaaaucauuuacuuuacuuacuccuuauugaucaacaaaggaagagcagguuuuauguaacaaccaagaaguaacauagggaucucagaagagaagaaaccaagugucuuuggaucuuaauaaaaagaacauucaacuccagaaauaggguuaaaccuauccuacacaugucuaguaaaaagucaguguaucagaggcaucuguguuuagagauaaaacauaccauuagauucauuuauaauaguuucauuguccuuaguuuuuaaggcuaaugauaaagauuuuuuuuuuuuugugagacacagucucucugucacccaggcuggagugcagugacgcaaucucugcucacugcaaccuccgccucccggguucaagcgauucucuugccucagccacccaaguagcuaggacuacaggcacacgccaucaugccuggcuaauuuuuguauuuuuaguagagaggggguuucaccauguugcccacgauggucucgaucuccugaccucaacagaucugcccgccucggccuagugcuggaauuacaggcgugagccaccacgccuggccuuaagaauuaauuuucacagaaaucugcuucuaaauauuauucagugauaauagauuuuagaaauuucagauucuuauguuguaccuuaaagguuaggauacuauuuauaaaugcuaaacaugaacuccugucauccuauuuuaaugucuuuauuaagugauuacaugaauguggcguuucaguagguguuugguguauuaauagauguagguacuccccucuuaaaccuuuaaguauuuucaugccaugaaaaauuuggggggcauucucuuuauuuauugauuagguaccuguauuuucaagaauauuacucagcuucaguucccccaaaucuuuuuuaguguuaacuaccuuccgagaacgugguauaacauuuuaaaauauauuuuuugaagguuuggaugucacugaagaucccccuauuuauuggaugguaucuuuaucagcugggaagauaauuaguuucccaauguugcuauauuuuuaugaauagguccuguagcucuugcuuucuugaaagcuuagaauugauuguaagccauggacuaaugauauucuccaagcauauuuaacaugaauaggcucauguucaguaugucaagaaguuacccuguuguacuauuuaaauaauuugagcuuaguuuucuuuuuccaccuuuguucuaaauucuuaggugagucugaauuccugggcaucugugcacacagcuucuucaguagguccuuuacucucauuguaucugaucuuugacuucauaaagacccuuggccuacugacccuguauuuaauuucacaucucaauaguauuuagccuucucauauuuuuccucuucuuuagagcucccugaucccucacuccagucauucaacucuguguauuccuuuaacuuccacccucgcucugucucuucacagauaugcuucuuuauaugguagucagaaguuccugugugaucuucguaaccuccaguucccuccacagucaccuguuaucaggcaucuguuccuugagcuccagggaaugagcucuuugcuaucauucugguugucggacucacugggcacuguuguguccuccacagucucucaguggcaucgguugaugggugcauucuccccacacugaugucauucugcugcuucugauuuucuuucugcuguccuccauuuuccuuucaggcucccuuccccguccuccccgcgccaccuuuugcaauauuuaggauucagaaauuccaaauauugcaaaauauuuagaaucagaauucagaaauucuaaauaucaguguuuaauaggaguacccugggguuguccauuuucucacacaacacauacuugcuaggagaucucauaagugcagugguuuuucagaggccugcauugaugauuccugagucauuauguccaggccaggccucauacauacuauuuacugguucucuuucugcgggugcuccaccaagaauucagacucaauggaauauuucuucuaagauguacaccaguuccuuaucaaaaaauggcaaauucagacuucuuagguuaaacagagaacucgugaacauggcauaugucuguuauuccauuuuucucuguuggcuuauugcugaguaccauuugggauaaaaaucuguuucaggcaaaggauaggauuguuuucagcuuuuauuaaauucuccuagacccuugauuuuaugcagagaacuaauuaaauuugaaugaauuuaauguagaaacccugcuauugaugcagaaaucaaccugauucuggacuagcaccagaaucaacuauuuuuguuguuuuugcuuucuuuuuuuuugcuuuugcuuucucugccgguaaauaacaacuaguauguaagaaucaaaugaaucaagcauaaaucccuaggaaauauuuaugcauucauuuuuaacaauuuaaagaugugaagauauauaauuaagcauaauccucucaaaguuugacguugaaaaguauuucagauacuucaacuuaaauauauuuuuugcaaaauaucuuuuuuaaaaaaacagauguggucucagcaauguaauuauuacagugugaggagagcuuacaguuguaccaaaauuuauaacuaggaagaagagaaugugaaauaauccggaaaccuacaaaacuguccuauacaggaauaccaauuaaacagcuacuaaaaaugaguguaaaaugacaauauggcuuuaucaagugcuuagggucuggaaaaaugcacauauugccuguuauuuauuguuauacuuaaugaauguucuuuugcacgugagaacuguuauaaaagaugucuuuuguacauacuugguacaccaguuggcuuuuuaacccauuagcuguuuucccccaaagguggccuacucuagaugacguuaaaaauacacauuuuccagggacuuauauaaauagucaacugcccuauuauggaaacuuaaaagcgaaggcccugaaauauccagacaguuugaacauaaaccaaaaaugaagugaaucucuagaauugcuguguaauagcgugaguggggagggggucccucaagagagggaacugaccuuuuucuuccucgugggugaccuugaguacacacuuuauuuagucauuaaaagggucaccugaagcuuagagaaugaagauccuacagccuguuaauuuuaucauuguuagaaacucucugccuuuggccugaaaaugguaaaucaccuuucuuagaagauucucauauccagauauucuuaccaaaucagaaucuuuuccagcauuuucuucaaaaaaccacaguucuggguuaaaacacagcagauccuaacuguaauuuuccuuucauguacauuuuagucaucuuuauaauuuuaaaugaaagacaggaacuacauuauuugaaauaaggguuaacccccucuaauuauaagcauuaaucacacacaguuuucucauuucuaaauguuaaauauaaaaugggagcuaucucuucagacacuuuucuguugccuucugugugcggcaggaccuuacuuuuaagcuuaguuugauuuaaaggcugaguuucugcuugcuuggaaugcuugcucuucaaaauauuugcucccuggagagggaaacugaagauggagcuuucacgugacuuuggauugcugaccuggaagacguuugggguaauaggaugggcuagggcaugguuccacugcuuucuguuugaguggggucaggaaaggaaggcggggcucgcugugugcaaacaggaaaacauagucugaagauguuugaagccugagugcacuuucauuugaugccuugcuuuauugcuuaagagaauuuuaaacugccgaauccgcaaaugugcugcagccuauaaugacacauauuuaaaugauuuuugcaucuaaacaaaugcauucacucuuugccugguguguacaauuugaaugacacucgugcucugccuggaaggaacagacguuuuucauuauaaaauucagucaagcagaaaaguagcaaaggaagcagaaauuuccauuuacaucuaugauugaaguuguagugauaaaagaggaugacuaaguugaagaguagccuuguucucauucugcuaucugacaugggaucuugucacuuugguaauaguuuuuaaacuuacauuauugaggaaggcucugaucagaagucucaaauuauacauguucuucaaccuuagauuuuucuggguguuuuguuucaaaagucucaaauuauauauguucuucaaccuuagauuuuucuggguguuuuguuugguuuuuugguuaucuauagauagauuugaguaucucuuuuuuucuuaaaauccguuacuuacuaguaauaaagacuuaagugguagcuuuacgcuccauuaucacagagauucacaguacuuuuuaguuuuuacuugugagccucagcagguguagacagauaccuuaguugccacugauaacauccaguugccacuagaucaagaaaugguucaaaauucuccaggggcauuuucugcuaaagaagaguuggugaucuuccuuuuggaagccuuaauguacuuaaaccuucuuccuuagaaguccagaaauucaauuauuucagcucucuguggagugauaaguccugccaaauugauuuacaauaaugaaacuaagccuuguuuacaaaucuaaguggugauuucuaaguccacagaggcgugguaacagagagagagauucugauuuaucugggggucuauccguguuugaacagauugugugauuuuugaaacaugauucaaaagggauguugauaaauucuaaaauacauuuuuauugaagagcuugaugaaucauguauacuuacuuuauuuguuauucuauuagauauugucuuccucaucccuaggugguguugcuaguacagugacagaauucaaauccuucuuuuuccucugcucuaacagagcuuugugaacucauagcaauauuguaaugccugguaaaagguggugccaguuucaaguacuauauccuaauuacuucauggcuaacucuuguuauuguuaacaauauuguuaacucuuuuguuaaaugcagugacaucuuuuuucuuucucauucucuguguacuuuuugcccuaaauaguucugcaucuuuuaagauacaaguuugcuuuuucuuggagguuuuuauuuggaaaaugccugaaauauauagaccaacauuuguuccuccaaugguuaaauuacauugucucccaaagugaggcauuuuaagucuggacuauacccaggagaaucuaaaagaggcaguuaauaagcucuugaagagcacaguggggugguuguguauuuauugagucucacacuuaggagagaaauaggcuggaccaaaugagccugggcaucaaaagcauguggguggucguuggugauaugugcagugaugagugugugugcugaggguccuagaccaggcuggcagggaaaugaacugaaggcagugaagccuccccugauaacugcagagagugcugcagcauccaggaccucaggaucaugaugaacaagcuguaguggauggaagggagaggaacuaugggaaggaugaguuucuggccagaaagugguuuacuggagugcugugucugaguauuacaugaucugaggaccaugagguccagcuuugggaguauggagaguuugaguggaguagaguuauagucccauggucuucugauucacagacauucaugagcgauaaguaucuauugagaaaguggaagcaugauuuuuaugaccuccucuuguuguggggaaaucgaucaacggggccuauauugguuggguucuacaaccaaauagaauguguucagcaggagucauguuuugggcuccucacaauguucaguguuaguucuguuccuuucucuugcuuccacauaggaaagacuuugacccaaugaggaauuagucauuguccuuuggguacacuuccggaauuugauaaucaguugggcacuugauucuaguacauuugcuaaaaguaauuaauacccugcaauuggaagcaugcagcaagcgacugggaaugcuaagugaaaggucagaauugaaagaguggaggaggcuguugacccuuaggcauggaugauaugucugagugagaaagcaagaagaguagaagacagagccuuacuuuauaaucagaauuaugaaaagaggagccaaugagagggaaagaaugauuggcuugagauagauugguggaaacuggagaagauugaauuuaaagaagaaaagugggccaaguucaguggcccaugccuagaaucccagcaaauugggaggcugaagcuaggagaguugcuugaggccaggaguuugagaucagcuugggcaacguggcgagaccccugucucuacaaaaaauaauuaaaaaaaaaauuagccaggcauguuggcaugugccgguagucccggcuacuuggaaggcugagacaggaagguugucugagcccaggaggcugcagugagcuaugaucacagcacugcacuccagccugguugacagaggguauccccgucucuuuaaaaaaaaaaaaaaaaagagaauguggcagaguagucagagaacuggagggcugagaagagacugauggcauuuguuguucuugaccuugaaagaagaguugcagauuguuggagcaaggccagaugguaauagguuggaaagaacaagugaggggcgugagagugacagucuacaaccccguuaagaaguuaucugugaaaaugccucuuccugucuugauuauagccucccucgcacauggcuuucugaguaugguaugugaaaacagcaugcuguauauuuuuaccuucccauaugaguuaagguuuugguaaugacuugugguucuuuugccucacggaacaccaaccugguugguauuuugucggcaauuaugugguuuuuaaaaagccccguauauaaccuuaauuaauugcgucucuaaaaucuaucaggcuuugaguuuuuuguuuuuuuuuuuuaaauaaggcagaaagaaaggaaaguguuaggagaaagcaaccagugagaauaccuauauuuugaagaaacaaaguagggaauuuagaauuaucucuacuauaucugcuuuuucagcucaucucucgggauacagaggacugaacuaagcuaaaguagguucaagucuaaaggaaaccuuaaauuaauuucuguauuagaauuaaucacacaccuauaaauacaauuuaugauaugagaacugcaacaagagaaauggggggagaugagcaguuugcugaucaauaggguuaaugaugguaacauagaauccuagugauaugccucccauugacuaaaauguaugcguuaagauagcauagcgcauaaaaugguguacugcagucucaguguauucaagcuuauuaugguuucucugccuagguuugugucuuuggcuuuagauuuucucccauaaccccaaccuguccacauucaagucacuacuccuugaaauauauuauugaucucuaaaaucugaugcuaagucugucuugcccaacgguggccacuagccacccauggccauugaauauuugaaaccuggcuaguccaaacuaugcugugaguauaaaaaacccaccagauauuaaaaaguuagucugggagaaaaaaacaaauguagaaugucuuaaugauaauuauuuacauugauugcauguugaaaugaugaaauuuaggauguacuggguuaaaauauauuaauaaaauuaauuuuaccuguuucuuuuuaccuuuuuauguuaauguggcuacaggaaauuuuaaauuagauauguggccucuauuauauuucugugagacaaagcugcuccaagcuguuuugguccagaacuauaucucgguucuuuuguauccuacauggaccugcauagaaugguauuuaguaauacucagcaguagcagagaugaucucuuaucaaauuauguuaaguuuuaauuuuuauucuugucucucacccuaugugcaccucucuggccaggaggcauuuaucauaucaccuuuuaauauuuggaaaucacuugaucugcuugagucauuguguuguuuucaaaucuagaacucuuucuaccuuauuuuguaacuucuauaauuaaacaaaaggcgaaccaggagcagcuuggcucuuagggaugugugaaaaggcgcucaguccuuaaguuggugccaaaagugacaaaucuauaggaugagaugcagguuuauggaagagaagcaugaaaauuuuuauuuuuuaaaaggacacagcaagcuagucaccaaaagacagauacuugauucuacuuauaugcgguaccuuuuugaauuugaagagucaaauucaaaaagauggaaaacagaauggugguuuccagguucuggaggugggggaauggggaguggaggugggggaauggggaguggaggugggggaauggggaguuguuuaauggugugcaggguuuuaguuuagcaagaugaaaacaguucuggagauggaagguagugaugguuguacaacgauaugaaucuacuuaacacuaaacuguauaauuaaaaguggguaagcaaagagugucuuacaaagcaauaacuuguaacuuaaaauuuuuaaaaaccuuaaugagauuaguuguaauggguuaucuuaaguagacccuuacugccggaaggaacagcugaaucacaucacuugggagcuuguuagaaaagcagacucagucccacccuagacuuguccaaucaaaaccugcauuuuaacaaggcccccaggugauucauaggcacuguaaagcuugagaagcccugcuccaaauaucauuucucaaagugugauccaugagccaccugaagcagagccacccugggaaggucuguuuucaggcgcgucccagaacacguaaaucagaucuaggcuguggagcuagggagaagaugaaucugcagacugaucaggaucccaggugauuuugaagcaugguuugaguuugaaaaccccuaaucuggaaagcuuuaacaacuauuacucuuacaauuccaucuuuuaacgaauguuggaauuauuaaauacuuguaacaagaaguccuguuauugauaaaaucaagauaugacuaauagugcagucaaaaagaggcaacaaaaaagcaccuauaacuuaucuuggguugguuaaugaggaagcugucauucaaaauuaguaagacuacuguaacauuucuugggguccugaacauuggaaugagagucgguuuucagaguugagcccaccucugucauuagcuuugugcaaaccucaucaggcucaagauuccucauuuguaaaggggaaugaauucucugaccaguuaguuuacauuccuaagacaagguuaaauuuggaaagcaaagaauuuucgguauauaugugauaauuuugaaauucuugaauuuuuaaaaaauuuaaaugccacauuacuuauauuuuuuucuaaaaaaaagucaaaccaagcgcugucuaguuauuaauagauaccacagaugagaugccugaguugguaagcucuuuuuaauucuaguucuuuucaacuacaauaauuuuauagacuuuuuuuugaaggcuagaauguugauguggaaucaaauagguaugccucuauguaugguagaugcaccugacagggaucacuugacuugaacaugcccugacaaugauccuguguggcaggugcaccugauucugaguucugaguuaagaaauccgggagugggccgggcgggguggccggugccuguaaucccagcacuuugggaggccgaggcagguggaucauuugaggucggaaguccaagaccagccuggccaauguggcaaaaccccgucucuacuaaaaauacaaaaaccagcugggcgugguggcgcaggccuguagucccagcuacuuuggaggcugaggcaggagaauugcuugaacccgggagguggagguugcagugagccaagaucacgccagugcacuccagccugggcgacagaaugagacucuguuucaaacaacagcaacaacaaaacccaaaacaaaaaaacaacaacaaagaaauccaggaguggcuaacccagagagccauuccuuaucuguaaggaacaucugagcccucaucuccuucuguggaacaugggccucgccggggauugagacccuuuguuaugaguuaaguggaaguugccagguggagauuguuagggggaggguguuaaaugagaaugcuguagagaccacaugccuuuugcaagcggcugcgguuccucuguccaacccaccaccacuggacucucuacccuguaugcaagcccccaguaaaacccuaugagacauacgguucacuagcucugggccucuucuggcucuugaaccuggugccauccacauugcagucaguaggaguuuggcaugacaccuuauuaugugaacuuuuauaucaagccauuaaauuuuuuuaaaauagacuuuauauuuuacaacaguuuuaaauuuacaggaaaauugagaggauaguccagagaguucccauaggcuuugcauccaguuuucccuauuguuaacaucuuauauuaauaugguacauuuguugcagucaguaaaccaauuuugauacaugguuauuaacuaaagucuauacuuuauucagauguccuuaguuuuugucuaauguccuuucuguguuccaggaugccauccaggaaggcgcauuauauuuaauugucaggucuccauagccuccuuuccucuuggcuaugacaguuucuuuauacuucucuaguuuuuuaauaaccuuaaagguuuuguauuggucagauaauuuguaggauuccccucugugggaauuuucucaugcuuugccugggguuauugguuuuaagaaggaagaccacagagguaaaaugcccauuucaucacaucauaucaaggguacguguuuaucaacaugauacagcccuguuggcauugaccuugaucaccuggcucagguggugguuguugaguuucuccacuugaaaauuacucgucuucccacuuuaugugcucuacucuuuggaaggaagucaguuugcacagcccacaauuaaggagcagagaauuaugcuucauuuucuugagggcagaguaucuacauaaauuauuuggaauucuucugcgcaggagauuugucucuuuuuuccuauuuauguauucauucauucagucauuuagacucauggauauuuacauuguacuuugauuucuaauccagcacuacuucauaauuuuuauugcucaaauuauuccggcuuuagcuauuagaagcccuuucacuugguuccuaugcucauuugacauagccucuuuuuuuuuuuucuuacaagaugcugcagucucaucuugcauauuuucagcccuaauccuagaaucagcuguuccuccaaggagcccuuguuccuuuuauuggagaguaauguuauuggagaauaguauuaaaaucuggauguuaaggaugcucguugccacuggaguuucuuugcuuuuaagacuucucaguugauagagcaaggcaauguauuuguccauguucacccuuauguuaugcagaucuauaaauauuucuauagcuaacuaguuguauuuauauuaagcuauaauaucuagucuauauuaagcuaaauacaaguucauccggauguuuccuacucuaacguauuaccacauggacacuauaucucuccuccuugguuauguauaaauucucacuccauccaccaucuauguacuuaauuguucaguuucaguauaugugcguagccguaucagaauuguuaacccaggcuggguacaguggcucaugccuguaaucccaauacuuugggaggcugaggcagguggauugcuugagcccaggaauuugagaccagccugggcaacauggcauaaccccaugucuacuaaaaauacaaaaaaauugcuggucaugguagcaugugccuguagucccagcuacccgagaagcugaggugggaggaucaccugagcccaggaagucaaggcugcagugagcugugaucgugccauugcacuccagccugggagacagaguaagacucuuucuuaaaaaaauaaaaaauaaaaaauauaaaaaaauuuguuaacccacaccuauauggaucuuuuuaaaagcugcaagacugcuaacaaauauuuauuuauuuauuuauuuauuuauuuauuugagacagagucucccucugucacccaggcuggagugcaaugacacaaucucagcccacugcaaccucugcuuccccggcucaggcgauucuccugccccagccucccgaguagcuaagauuacaggcacccgccaccaugcccagcuaauuuuguauuuuuaguagagacgggguuucaccauguuagccaggcuggucucgaacuccugaccucaggugauccacuugccucggccucccaaauugcugggauuauaggugugagccaccaugccuggccauaaauacuuauuuuguucccgugguuuuuuuuuucuuuucucuuuuuuaaaguaaauccuuugcacuauuuuuauuauuuuaagaccaguguuauucagagccuggguuaaacacuauucuguguguguguguguguguguguguguguuuguuuguuuguuuguuuuuugagacagagucucgcucugucacccaugcuggagugcaguggugugaucuuggcucacugcaaccuccgccucccugguucgggagauucuucggccucagccucccgaguagcugggacuauaggugcgcgccaacaugcucagcuaauuuuuguauuuuuaguagagacggagugucaccauauuggccaggcugguuucaaacuccugaccuugugauccaccucggccucccaaagugcugggauuacaggcaugagccaccacucccggccagcacuauucugucuuauacucacucugccaucuguguguguauaugguacguaugugaggcuggaucugugcacuuggaaaaguuggagagaugauuuagguaaaacuuuuaguuuucacuucuuuugccuuuuugcuuaucuugauccauuuaguuccuaccaucuggcaaauaguucucaucugaagaaucccaucugucaguucucacuauuauccgguaauaguuacagugaaaugcuggugacggcaacagccacuuuuuaaaaggauguguaauucacccucauguccucuuugagaacccaguaacugcccacacucugaagcuaaaaccauaacaguuuuaucacauggaaaguuuguugagaaauguuuggcuguuucugugaaguaaucgucccgucucuugaguacagaugccucccaggaaaauuuucccagccuauuuguuaaugugaaaguuacaaaagauagcauauaaugagcacauucaagacaaaaaaauuuguggaguaagagucugaaaugguaaaauaaaaaaucacuuaagaaaacauuuaucuguagcugucauuuucauauacacauaucuaguguauacaaguuaguaaguacauaauucucaaaaguucuaccugucuacacaucuacacagaaaaauuaggaaagucuuguccagacuuuuccaucaucuucaguauaaagcaucuucuagcuguuggaauagaaacaagcuagauucuugacuccuuucuauuugauuauuuagaucugaccuucagacgacauccagaaucugagaacacgcaccaccucuacugcucucauccugguccaagucauugucaucucccaccuggauuaaugccagagcccccuuccuggucuucucacuucuagucuugacccccuagggcaagaauaauuagcuuagaaaaccaccccagagccuuccagcauuacucugaguacuggccagaguuggacaauguuuaaggccccgugcagucagcugucccuguccuguccuggcugucacucacucgcuugcccacugaucucuuccacaucauuccuccacgacagcacugaucuccuuguucuucugugaguucaccaggcaugcaucugccucaagacuuuguguaauacuuguugcuuccucuggcuagaauauucuucccuuugauucugaauacuuuguucccucacuuccucaagucuucacugaaaugucauauuuucaaguaggcauucccugaccacccuauuuaaaauuucaccccucagaaaaaacaaacaaaccaccccuuucucugcuuuaucuauguaacauuuauuaccauccaacagacacuguauuuuuaucuguauuuuuuaucgcuuccccgcuaggaucauauaucguuuuaucuguuuuguucacugcuguauucuuagcacugagacauaauuguaaguaugcagugaagaguuaguggauaaaggacaguggcugcaagaggggauuuaggaaacacccccucccagccaggaccagcacucggugcaagaguugaaagaguugaucacucagauucucugcuucuccagucguagggacuccaccccgcuguguugauugcugucauguauucaccccaucauaagcaguacucacauguaaaacaguaccaugucaucucuguggggcuacaaguagguggugauggugcaaugaacauauaaaaccccagugucuucaguaggugcgaaauaggugauuagugaaugaugaagaguagcuguugcuguuuugauuacuaugauuauuauuaugagaaacuacugugguugaugagauagauacuggggagaaggauacuauuaauauaauuuauugagcaacuuuguucugggcacuaguugaguacuuuagggauauuaauucauuuaauucucccaguucugccauuuacucucuaugugaccuggacuguuacauagucucucagucucacccucucuuuuuuuuuuuuuuuuuuuuuuuuuuuuuuuuugagacggagucucgcucuuucgcucagucuggacugcaguggugcuaucuuggcucacugcaaccuccaccucccagguucaagcgauucuccugccucagccuacugaguagcugggauuacaggcaugcaccaccacgccuggcuaauuuuuuuguauuuuuaguagagacgggguuucaccauauuagccagacuggucucgaacuccugaccuugugauccacccgucucggccucccaaagugcugggauuacagacuugagccacugugcccggcccuugccuucucuuauaaagugaaaucauuguagcugcuuuggugugguucugaggacggugagagaagacgcacgugaaguauugagggugguggcaggcacacaguucagaguuacuaacaauacugguguuuuaucuucacaaggcagaucugggcccauagcacaaggaaaccgaggcuuuggcauuuuacaguaauuacauugccagaacauuucccccacuuucuugaaucaucuuuaccucuugagagaugaggaagagagggcacaccucgggcagaaguccaaagaccucaggcauuuuuggccuuucauucccaugauucuggccaacaucauuuuaguccccagcaguucauagaaauauugucuuuuaaucugauauucaaauaaucugugccuugaagaaccuguguauggcucuagaaucuuuuacauuaaucuacucaaccccacucugaugcucaaaacuucagcagucuguuuuuuuuuuauuuuaaugucuuuauuauuauuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccuugugauccgcccgccucggccucccaaagugcugggauuacaggcgugagccaccgcgcccggccuaaugucuuuauuuuaaacauuuauuuuuagagguagggucucucuaaguuaugcaggcuggccucaaauuccugggcucaagugauccucccaccacagccucccaaguagcugggaugacacccccaggugccgccauccuggcagcagagucaguuuugauacaucuuucccuucucauucuucccaaugucauggauugggaaguuacugugguuuuaguugcaguacuuuuuacucugaauucuguuugcuuccuggaauucugucugucuuuugaaaagacaacauaaagaaaucgaaaaauauacuuuaaauuccauagugugggagccucugcuacucgccuguuugauauucauucccauuuuuuccuuucuaaaagaauuccagauuuuuuuuguucagggugacaaugugcucugcugaaaauacuuucacagauucccuugcaggugcaugugaccagaucacaguaauggcacauauggccucaguggaauuugcugaggaguaugucccucccaaguaacagcaaagcuuuauuagaggaaaaaacaacaacagaaaaccuuucaccuuugucuuguuucuccugccuucugucuggaacuuggacacagagucuugaauuucugugaccauaaaacacgaggauaaaaccaacgugcucaggauggcaguacagaaagauaggaauacgcuggucccugauggcaucauggaauaucugcaguggcccuagcuucagugucacuucuuaggugagauacauaauccuaccguguguuuaagccacgguuugacauguggucuauucucugccgcugacugcauucccagcuguucuauauggcuugcuagcuaauuuaagucuaguuuuauugucaaauugaccacauuguagauuauaauauuaaaguacuucacagucuaaaagugaacuacuuuuguaaaagccaaaggaaaugggccaaaugaaccauuuugaacagaguuuaaaugagugaguugaguuaccacucuuggauggagaacuggagaccuggauuuucagucuaguucuucugccaguuggcucugugggcaagucacuugaccugagcucuuuuccucccaucugcaaaaugagguaauuugagcuagacaguccucccaaagaccaccaaagagcuagcagauugaggccugcagacuccuauugaauuugccauccuuguucaccuugccaagacuucauagccaagaagccagacccagauuuuguucauuagcuuugaaaacacccuuucaguuggguguguguguguguguguguguguguggugugugacaugcguuuugaauauaaauugugaauuguuuuagcaagaaaccagguuguauguuucucaauaaacaugcauacuguauauugaugaauuuauccacuugaaauaaauggugccaaauugccuaaaguuugcuguaaacaggaacaugauuucucauuaugauguuuaauuuguuuuagucuuugaucucuuacaucagaauucuguuaagaacucuuuuuaccugaaagaucaaagcaaauaagcagaagcauuuauaaaaauaagguauacguggcuguggagagaaacuccagguauauacgaucauaggcuuuuuaaaauuaauaaacuuuguuuuuaaaaacaaagcaguggaaguucacagcaaguuugaguagaaaguacaguuuccauguaacugcuguccuagcaaagauuuuuaaguacaauauuuuuuaauuaaaaagagaaaauauaaaccgugcuaagccaguuggugaaaaaggcuucauuauacuuuuagcacucuuaacgcuuauuaaaaguuuuuaaaaacagauuuuugugguugaaucgcuuacaauuucugauguguaaccuucuaacauguuucaucaaauuuuaaaaguaauguaagcagugcuguccacugcuaaauuuuauuuuaauguuagaauacaaugagguuucuauuuugccauuaguccugagagcuuauuaaguaaccaguuuuaauccuuuaaaaaaccauucucauuuugagggacacauauuucuuagcuuugugcaauauaagaagcuaagaccaucuuggcaguaucaaaugaaauguuuugcaaguuagaaaguucaguaaccacuuauaaacauaaugaacaauuguuauagucagucuaaugcagaaauacagguguugggggcagggggguggugggugggcagacuugguccacaaguaguaguuugccaaccucuguccuaaacacaaguucaagaauaugguucucuuggauagauuuucugccagaugaaaguaagaguaacauccuuagcuaaugaacuccuaauauccaaggcaacuuuuaauuaauucaggcuuuuaagaaaagcuuguuuaccaacuccucauuaaaaauguucagacuggcuggucgugguggcucaugucuguaaucccggcacuuugggaggcugaggcaggcagauugcuugagccuaggaguucgagaccagccugggcaacauaucuagacccugucucugcaaaaagugaaauaauuagcugggcaugauggugcacagcuguagucccagcuacucaggaggcugaggugggaggauugcaugacccccggaggucgaagcugcagugagccauugauccaaccacuacauuccagccagggugacagagugagaccuugucugaaaacaaacaaacaaaaagauuaaugcaguacauguccuuuuggugaauaaguaaauauguuuugguaacuuuagcuuugcauuauaaucuagucgucagcagauugacuaagggcagauaaaacaagaugauuugguuuugugguuuggcacuuacugucugauuuaugcccccaagaacucuugcaggccaaggucgaguguaucugauaccugcucuggcucuucucacgaacugauuuaguagcuuugggccagcauuagauuuuuuaaacucuuugaccuauuuguacaugacaggcauuuaaucuuuccaguaguuacuugucaaauagaaaagcaucacuucuuaguuuggacauuugcaaauaugacugagcagagcugacagaugaggugggcaucuucaggccauaggguacuucuggccuccuguaaccuagaaaauugggaugccucagauaucagguauucuuccaagcagcuaggguuagucccugaccucagaaacccugagagcccucagaaacccugagaaauccaccugggaaugguguauuuguuuuggaugagauuaccuuuacuuuccauucuccaggucuucuuguguuuuuuguuuuuguuuuguuuuguuuuguuuuauaucauucuauguaaaagagaaaugugguaucauuugcauuaucauguuauuucuuuccuuauaauuuauaucuuaaugcuuaucucuggggcuagguuauaaucuccugaguuagguagccuuagguuucuuggcggagauuccuccccugggaagugagguuuauaaaagaacccgugauguggcccuguggagcugcauggggugugugcucaguacucacugguuucuucccugcaaagugacaccugcagccuuugggguaccaugucucauaauuuuugcauucccugcaacacacacuauacugcuaugggcaucauugaucauuuuaaagauuuaaggaaugacaagauacagugcuuauucuccccuaugauuugcuuagauuuuuaucuaaauaguacuuauugaaauaaguacuucaguaucaugcuacaucuuacauguuugagcuagaaacagacuaaaguuuaaacccuuuuaugagaaugaaaaguuacuuccuuccccuucuuagggcuuuuaaucccucuuuauguugcauuucagaaaaugcccuauagcguacuaugaaagaaagacauucauuccugucuuugcugcuguguggacgaucuguauuccuugcuccgugggaguuguggguuuaugucuauucuugcauguuuugccugaaggaccacagugaccuacuugguggucucccugcuuucaugguuucacuaugcugaucuauccuucacuuaauuauagagucuaucuuaaaaaaaaaaaaaaaaaaaaaaaaacuuuuggccuauguugcuucuuccaaaauggcauccaaaaccuaagccucuuuaaaauuggaguccagcaugcuuccccagugcuacuuccuucuggacucccuuugccacuugcuuucugcuuccacccauauccagaugggcugcaaauaugccuugcugguucuuuacucugucuuugcacaggaggcucccucauuuugaagggucuuuugcuacccauccauccauccauuuggauucuauaauagaguucuugauguuugacagaacuaggccaggaauuguggggguauaauggcaagcaagacagagucuauccuuacguuauggaaguucaauucauuucccauguggcauacuacuucucaccauucagauucaucucgaauauuguuucuucuuugagguuuuucccacugcacccaagauacuggccugacacuuuccuuaucucuauuacagaauuuaacuuguucauucauuaacagauauuuauugccuacuaugugcaagaaucugugcuaaaagcugggaauauugcaguaaacaaaaauuaaguuuacagcuuacauauaaugugguaauuauccaucuuuuaccuucauuagacugaguucauguaggacuuuauguaauaucuuuauaucuucaauaccagaaaugccuagaaauaauuugcauaauauacauuuucuuuaaagauuuaacaaaagucugagggacaguuuucagaauaaacugaauuaaacucucucucucuuauguguguuauguaaacauauauauaaaauacacuuuuggguuuuuugcuuaggaaguagaaaaaugcuaaaauuucuguuacuuacaagcagauuaaaauguccaagaaagaaaaguagggauuuauauugauucugcucaaaugcuuaccuagacaaugucaauauuuauauuuuacuccccuguuguaguagaaugguaauugguucucuaguuaagcagcuuuuuuaggauuaauuuugaagcaagaaauucagauuaauuaagggacaauuucacuugcagcauuuaggcauuauuuuaaccaucaaacuugaaguggcaagaaacggaguugcuuaaggaggccagacguaacauucuaaagguaguagggucuugauuggguugcuuaggcauuaaaaggcuguuuaacuugucuugaagucuaucuuuccuugaugucuucugcgguaagaacacugugauacagauggaaugacgggaagugguuuuccuuucuuucaguuggugaguuuguaagugaugcccuucucguuccugacaagugcaaauucuuacaccaggagaggauggauguuugcgaaacucaucuucacuggcacaccgucgccaaagagguaccagcccauaaauucuuucuuauugcaaagugaagauuuccuggggacgugcuuaauggcauuuuagggguauuuugaggcaacagcuauguugauaaguuauuuaagaaaaaaacccagugcuacuauccguaacccagauuuuaguuuuuagagugauuuuagguucacagcaaaaucgaacagaaaauagaguucccguguacccccuguccccacacaugcgcagccuccccauccaugaauauuuuuaaaaagucaaaaauagggccaguugaacuagauucauuaugugccugugccguguuucgcaacuuaaaaauauaaguugucugugccaugccuuauaacuuaaaaauauaaucucuaauaguuauaacuuuaaaguuuacccuucagauuauuuuuaugcaccuguuguuuucuuuugucauauacaauuuuuuaauaauuuagccuuuuccccuguuaucuauuagugaauacagugguagaacagugaaguagcuuuuuuauaccagccugaaagcuccaguuagaauucaguuucucaguuauaccauccaguuuuauauucagcaggccaugccuaccaucuugauuuuuccacagggugagucugaccgagcacuugguuaaccucugcuuuuggcuaagccaauaaaagauguaagauacuuagcaugaaaaggucacugugugguaagaccaccuucacagcugcuguguccccuugauagguuuccuaauaaauuuauauagguuuauuuguggcaagaucagucuuaggcuaacuagaauuaggcuccuuuaucuagcucauagugcuucacuugagucaauuuugauccccugucccucaccggaacaugucuggagacauuuuuuguuauuacagcuugagggagugguguuacuggcaucugauagugcccagaggccagagauucugcuaaacauccuacagucaacaggauaaccacccgccacccccaagaauuaggcaguccaaaacaucaauagugcugggguugagaaaucugaucuagcuuagcuuaaccauuguaucauagcuuuauagcuguuagacagaaaauaccacugaagauuuaguauuauuuuaugccucuuauaaaauaguauauuuggauccacuguagaauaaaauguuuuuuauguaaaaauguguuuuggagguuuaagagcuugcugaguuuaagaaaacaaaccaaauaauuugaaguccagcuaccuauuugauaaccucauuuuuuauuccuucuguguuuucaaaagaaaaauccuuugucucuaagaaacggaaaugacucccauaaggucaaaauacagucuguaauauuuucauugucuaccuuuaugucuugaauuauucauccuucauuuaucacuaguggaugcucucagaacuuuaugcuaaucuagauuugugcaaauuuagcaaaucccagaaaagcaaaaagacauucaaggagaaaucucuaaugacuguaaguucugauucuuaguggcugcaggggauaauuucuucucuucccaggauuguuacucugaaagugaaccaagagagucagaauuucuaggauaaggcagguccaugugagauaaacuuccaucuguaagggagguaggagugagcuggggaucuaccuggaaugcgcacaauuucuggauacacgaauuaagccagaaggcauuaauucucugguaucuguucaccaguggagacugcuacaucuuauuucccaauuaguuuccauuccaguuguucguauaaaccucuauuauauaacaucguggucuuauuaaauaaauaauaaacaagaauaaaaagaguaccaaaguguaacccaugcuaaaaaaaauccuguuguaaauucacucaaaaagcaaauaaucuuuuccuuugugaaauugguuccuaauauauugggucugcauguugauuauuuuauguggaguuuucuuacaaugaaacacaucuacucuaccacucacuguuuucuccuuacacuuuguagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagguaagguggccuuuguguucagccucagagaugcugaaacaucuuguauggaguauuuguauccuguaaauuaaucuuucuguuuaucacugaaaaggucucugcccacucccaucagagucugcuguuaugcaaaaaucugaacuaugaauuuuuauggcauccuguugaauuaauaauaucagucacccaucacagaguuaauuuuaacuauuuaauauuaaacuugggaucaaaaucccacugauaacuaucauagguuacugguaguucuaacagggaguugaaauaauaauggcguucuguuuuggucauuaauuuaaaaauauuuuuaaaugcucucugggauugucagucauuaguuuaaggugaauuuucguuaaagguuugguuugagauuuugggcguucucuguguggauguguaaggguuuuuuuuuggccuuuuaucauuucuuuuccuucauaguggaagucaaaggcauuaauaaaugcuuguuaauuuuuuuuaacuaccuuugauuuguugauuguaaagaaaccuauuuucgccucuuuuucuuagggagcuuagucccguuacuucuuaccugauucucauucuuaacugaaggcaaacaucuauauucaaaucauaaaauuauaaaaugagaaucuuuggguuggaaaugccaucugguucaggcauugauuuuaugcugucucaucccccgaagggugaugauuguaucacuuaucuuauuccuucaguauucucuuagauguucccuagagcuacagauuuccaaacagcacauucaauaggaguuguaaguuuauaaucggcaaacuacaggaugcuuguuuuuuuuucuuuuaauuucugguguaaucugcuacuagggcccccauagaguuuauugucuauaucagcuagaacacugggaccacagucauaaacugaaggauccaggcaaacugggucauaugguuacccccaccaauuacagucuucagugaugaugucacuauccagguugauauucaguugaaaugcuagccagcuccuuccuaguuaccuucauuuacaucccauuucaguaccugaacacagucaugcuuuagacucugaaauuccuuagaaauaguaccauaagguuuauagcuuugauauuccucucugaucaugaucuucccucauaaucaccuccccaguucaggcuuuuaguccauuauccucuuuuucccugccugccuuucuaaucaggauggaaucaauggauaaccauucuuaccuauuccauugaacauccuugacuuggcugaaacccuucacauuuucuaaacauauuuuugucaauucuccauagcuaggaaaaauuaauuucuuucuuuaguugcuucugggauuucuaaaguaucaagucauguaaccuuaccacuuaauuccauuucuuauucaugcuguaacaucagcugggaucuuaauguuacuagaugcaccuaauuaucucugucuugaugaccuaucaucuuccccauagcaguugauccagcccaacuucauucuccuugguucccagcguaacucucucucaugcucuacagaugaccccuccaccgucauccauugugaauuucugcaacaugguaccugacauuugguaggugcccaguacguguuuguugaauaaaccauugaauuuucuccuguacuucagcaacucuuguaccuucuucuaucccuuuguuuccugucuucccuuuuaugauuauguucugcuggacucucaaucaucuccucucccuuucuugcauuuucagucucccucucccccacacccccaggcuucauccacccuccucccagauaauucuuucccauguguuacuaucuuucuacuauguguuuuuaauccuguugacaguugguaggaaauauuugaugguuuauucuaccuguagaaaaguccaaauucucuugcagggcauucagaagucucuuacauggcuucagccugcauuuucagccuuauacauguaugugacucuccuggcauccuaaaaccauugaccuuuucuuucucuaggcuuucauucccaccguucugccccaucugaaauauuuuuccuuuuuuugucaaaugggguuaauguaugauaaagauauuugucaacucuaaagugccacuucuuaugacccgucaaaaucuauauauuuauaaauguucaccugaaaagaugcagccuuuacaagucuuuacaggugccuugcucugcuauacuacccuugcuuuaccuuuuucuuauaagaccauaacuuaucuuccaauuaauuguagucauaucucuuuuuaucuguuagaauccaaacuauaguuuaugugucugguaugucuugcacauagguccucaauaaauauuagacaaaguaaauuguauauuuuaaauuuuuuuucauagcuuuugguaaggacuucaugguccacgauuggauauuguagaaagcuuauccagcccacugcccaggacgacuuugaaugcggaccaacacaaauucauaaacuuucuuaaaacauuaugaaauuuuuuugccuuuuuuuuucuauaggcccuguuauagagccucccaucuuuuagcaaagaacugucuaauacaaauguaaugugagccacauacuuuuucguuuucuuuuuuuaagauggagucucgcucugucacccaggcuggagugcaguggcgugaucucggcucacugcaaccuccaccucccggguucaagcgauucuccugccucagccuccuaaguagcugggauuacagacaugugccagcaugcccagcuaauuuuuuuuuuuuuguacuuuuaguagaggugggguuucaccauguuggccgggcugaucucgaacuccugaccucgucauccaccaaccucagccucccaaagugcugggauuacaggcuugagccaccgugccuggccuuacuuuuucauuuucuaauagacaguuuaaaaauaguaaaaagaaacaggugaauuuaauuuuaacaacauuuuauuuaauccaguauaucugaaauaucaugugaccaauaugaaaaauuuaauaagauaguucacauucuuuuuuuauguuucuuucuuucguaagaagucuuaacacuucuuuuaacauuuaacagcacgucucaauucauacuagccacacacuguguuugauaguuacauguggcuggugacuacuauauuuggacaguguaguuccuggaugacuugaaauuucuuaucacucuuuauuuuuccauuaagacagacgguuuguauaaccuaguaauguuuucuaaggcugagccacugaauuuuuauuauuguuuuuaacuauucuuguuuuuaaaauuuaaaaaaauugguuuggauucaguauaauuaguauaucaggucacuugcaccauuuuauuuuuuaacuucuuuuccuguagcccugcaggcgggcagggcuucuuucauguggacaaaaccagaaagguguugcaucacugauccacacacaaggugggcuccugccaacuggcagccuccuuguuccaggaaccagcccuccuuuugacacuugaaauguaaaaucagaauagaaguuuaacguaccugacuuaaaacaucuucaggggaugcuacgugacaauucuugaagaaggagaaacgagcuaccauuuuccuggaaacaauauuugauucacaguauuuuguuguuugguaguuaaugaggcuuguuuugauagaagaugaguguuuuucuaucgcuaauggggcauuuagagaaacauuccuuguaggaugagcucuguuuuaugaccucauugaaaaagagguaugaaaaagagguaaaucuuuaacauaggcaaaacagguaguguuucagaaauuuauguguaaauuaccgaguauauuuuucuccaguguuguaauggucauauucucagaucaccucaaaauaccuauuuaugcagucuguaauguagcauaauccagacuguuacuaacauuauguagcauaauguuaauaauaauaauuacguacauaauguuaauaauacacagacuccagccaucguggguaagauuuuuuuccaugggaaaauucauuuggaaagcuaacuuguaagacuagccagguaggcagccuagcccuggaggcagagcugcuccucaccuggaacugcagaaucugauugaacccagugguccauggggguugcugaauucguaaagcaaaugaaauguuagaagacccucuaauuguuguagagucacacuuuuccucuugcagaggagguacucacauuuuuuuuaagaaacaaucuuuaauuaucgauguauucuuuuagguuuagguuugcagacacuggugagcgugugcugagagguaacuugauguaucuuucuggauaauuagaugauuuuuuuuuucuauuucuuugaacauuuuuuuuuuaaagagcugcuuaagaucuggaggagugauuccuuuugaccgugucuuauuuucauuaagacuguauaacuuggaagaguuuuuuuuuuucuuuuucuuuuucuuuuuuuuuuaagaugaaguuuuugcucuuguugcccaggcuggaguacaguggugugaucuuggcucacugcaaccucugccuccuggguucaaacgauucuccugacucagcuucccgaguaauugggauuacagguguucaccaccacacccagcuaauuuuuguauuuuuaguagagacaggguuucaccauguuggccagguuaguuaauguuacucucugguuuggggggcagugauauguuuuggcuuuuuucccacccagaucucuucuugaauucccauguguuguggaagggacucggugggaggcaauugaaucaugggggcaagucuuucccaugcuguuccugugaagugaauaagucucacgagaucugaugguuuuaaaaagagggguuccccugcacaaguucucucucuuugccugcugccauacauguaagacaugacuugcuccuccuugccuuccaccgugauugugaggcuuccccagccauguggaacuguaaguccaguuaaaccucuuucuucuguaaauuacccagucucagguaugccuuuaucggcaacaugcaaaugaacuaauacagcucgggguggcuugugugggugcguauggccauguaugcaggugugcgugcauuggaauauacaauuccguauugaacccaguuuaaacuucaucaguucuggugauugcuggagugucacauauggcaagacgucaccuugcccucuaacuacaccagaaaaccaggccagcaccauugacuaucuagauacagugggccguuuauauuauuauuguuucauauuuuuagauuauuugguaaacaauuuacagaacuaagaauaaaggaauagugagaaauaacuauuagcaauuuuaauaagaguuaacauaguaaauauuuuaauuuuacgaagaauuuaaauaugguaaacccacauguuuauucuguauuuucccaguuuugaagguauggauuucugaaaugagcauuauccuuuggaaugcagcuagcugcuaaucaccugccaugcacgaaccugaaauauauccgucuuacaaauacugguucuacauuucaaauacaucucuauuagguucaucauauuucuuggucuuuuuuuuuuauacuugcaauuucauuuaauuauuguaaaaauuuaagauauuuaaaacauugacagcucauaauuuuauugaagagagaauauagccaucuucccucaggaauaaaauguuuucaaguuuggauuuguaaacagcuauuaaaaugaucaagccagucuuuuuuucccccuuuuuuucugcauuaucucuucuaaucaccuuagagagauuccugccuugggcauuuguccacuuccuaaugguaucaaauaaauguguugcacagacauaaaauguguugcauaagcaucauaaaauggcaaggaauacugucacaucauuuuagcaaugaugguuaauguuuuugucacauaauauugagugaugauauccuuccuguugaaugacuaaguggaugagaauaccauauuuccuuuuuauucuuagaaauacauugcucagccgggcgcaguagcucacgccuguaaucccagcacuuugggaggccgaggugggccgaucgccugagguugggaguucgagaccagccugaccaacauggagaaagcccaucccuacuaaaaauacaaaauuagcuaggcgugguggcgcaugccuguaaucccagcuacucgggaggcugaggcaggagaaucaauugaaccagggaggcagagguugcagugagccaagauugcaccaucacacuccagccugggcaauaagagcgaaacuccaccucaaaaaagaaagaaagaaagaaagaaauacauugcucacuugucaauucuugagcuugagaaaauucaucuaggauaucaugugaaggcucauagccuaagguuuuacuuacgugaucaauuucauucuucuucugguuuaucuaauugguaaaaugccuccuucugucaguuguuccuauuugccaauauguggaagaugauuuuugacuauauucagugagucuccagacuucuuuuuaucaugcuuuuuaaagagaugggaccucacucuguugcccagacuugagcgcaguggcuauucacuggugugaguauggugcauuacagcugcaaacuccugggcucaagugauccucaugccucaacaucccaaguagcugggacuaugcagacuuuuuuuaaaccaucuugaaagaugaugcaguacuuugggaacacagcaauaaaaaugugauaauuucccuauugcaucaccuuucuaggcaauuauaucauucuuucaugcucauauuauuuugucuucuuuagcacaguuuuuaaauaguugauggcuaaugaugaaauaauucuucggaugauaaauauuuuguaacauaggaacacaauauaggaaaaagaucgagguucauaccauaucucagacucaugguuaaguacaagcuagaaugaguuuuagucgauuaaauuucuuuuucucuaugaauggauaaagugagaauaucagcccacaaguaguuagaagugcucagaacucaaagguaaaauuguguccaagaccugaugguauucuaaagguuaacagccuauccuacuuaccaagaauuuacauuuauuaugaggccuguacaaccugaugcaggaaaauacuuggcauaauuuucuauaaguuagguaguuaggugcucaacaaguauuugaguugaaucacauuggcauucacaucaaacacauacaccuacgucaucauguuaacuuaagguuaauagugucaccaaaacuaacuggucuuuaaaaaagaaaaacuaggccaggcaugguggcucaugccuguaaucccagcacuuugggaggccgaggcuggcagaucucuugaugucaggaguucaagaccagccuggccaacauggaaaaacccccucucuacuaaaaauacaaaauagccaggcaugguggcaugugccuguaaucccagcuacuggggagacugccagagaaucgcuugaacccaggagguggagguugcagugagcugagaucgcaccacugcacuucagccugggcaacagagcaagacucugucucaaaaaaaaaagaaaagaaaagaaaagaaaaacuaaggaauaucauucuagacaugcaguaauuaaguaaaauugcaucaggagucuaauaacauagcaugaugggucccauguuucauuauuuccaugggcagaagagggauggcuacauuauaaauaaaggaaaauuguaagaauaagaaaagaugaaguaugaaauauuuccaacucaaaaacaaacuguaucugagcaugcagagguacaaaaugucaccuuuuuccuccaguguaaugaagggcacuaaaccucuugagcauuugauauguuccagauacuauauuaaagugauuuuuuuuuuuaggagacagguucuugcugucacacaugcuggagugcaguauugcaaccauagaucaguguaaccuugaacuccugggcucaagugauccuccugccucagccucccaaauggcuaagacuacaaacacauugccaccaugccugccuaauuuauuuugauuuauuuauuuuuuuuguagagacaggggucucacuauguugcccagacuguuuucaaacuccuggccucaagugauccuccugccugggccucccaaaguguugagauuacaggcaugagccaccacgccagaccaaggggugaaaucuugauaacaauaaucaaugcagucaucauaaaacgcuugcacaggcucaauuuguagguggcacagugcuacaucuagucaaaagcaaauuuaauuauggucauugugcucugagaacuuuucucagaaaauaauaaccagaugguauuauagauggugcauuucacaaauacaugauuuguaguuagugaaaacuugucauucaaucauguaauaaauuaugcacaugccggucuuccacuuagcuagugauguugaaacauucauagccuuaccugaugagcucaggcugucaugagaauuuaugucuauucaguacuuugucuuuaaaauuaggugagagagaaagagaggcuguauuugacuauauaucuuuuuauuuguaucucuggaguuacaaguuuuugaauauauaaucuuucagcugccuuucugcauugcauuuugagaaaugauauuaaaugcucaaggaaaaaaaaccuaacaacuuuagagggccgcaaagugaaucauacaaaagauaaauuaaagcuuuaaaucuuugccaguggaugagucaaguaagaguggauuuaaugaaauggcucauggcuuugagaagcagcugucauaaugcuggguuggcagcuuccaggacugugugaggcuuucugacugucuauacugaaauaggagaacucauuugaaaaugacgaauaggagaauagcagaaacuugcauuuucuuuugagggaacuggcugccaguuuugagguccuuauuuagaaaugcucgauuccuguauugaauaaacuuggacuacauguaugucaaaaagaaaagcaaaacacuuuuauagccuuaagcagauuacagauguguggccaaaccaguggggucuguuuuuguuuccaagcaggugauggcuggaagaggagaugccucuguagugcagggcuugaguugcugcugucugagcuacaucuggcaaugagacugugcugcuuacugagaccuaauggcacagguugccccaguaacaggauauugcugaaugagaaauacuguaggauucauuuguaagaguuauuuggaggguuggauuauucagugcuaaggauccuaagcuacugaugcauggacucuuuucuucccuccaguaucuuuuaauuaaacuguacaaauucccuggcuuaaaaauaguaggaaaagaggaagaaaauacagauucuuaugauuuuaacuggucucuggcaauaguacaccgaaacauuaauuucuuguugaaaccaucuggauauuuguaucuucaguguaaaaccccuaauuuagauaggacucuccauugugacauggaaaaauaacccuuuaauuaguuaauuaauuuuacuguggccucaaaaucuacauauuagcauaucaagccaaaaacuguuggcuuuacuugggagccauguggcuuaaacuaguaccaguaacuuaccacaaggaacucagcaaaauuauaaguccauguuuguuuuggaaggaaggcaauuauuacgaaaauaauuuagagauguucaaacuauuuccuuugaguagagguagagagugaacaaaaucugucccaagugggagcuaacuagcuuccuuuuuugcccucccuguuuacaaaguaacacuuuuaguuuacuagguaacauuugcaguauccccaguguuucaauguaaaauuguaggugguagacuaaugccacuuagccaaagccaugaucaccugaauuuuuaauauauauuuuuguauggagugagauacugggagaacagucuucauuagcuuaaacucuagaauguacuguuuguuuguuuguuuguuuguuuguuuugagauagagucucgcucugucacccaggcugcagugcaauggugcaaucucagcucacugcaaccuccccucccaaguucaagugguacuccugccucagucucccgaggauuacaggugccugcuuccacacucagcuuuuuuuuuuuuuuuuuaauggagacggagucucacucuguugcccaggcuggagugcaguggugugauuugggcucacugcaaccucugccucccagguucaagcgauucuccugccuuagccucccgagucgcugggauuacaggugccaaccaccaugccuggcuaauuuuuguauuuuuaguagagacgagguuucaccauguuggucaggcuggucucgaauuccugaccucaagugauccacuggccucggccucccaaagugcugggauuacaggcauaagcuaccaugcccagccaagaauguacaauauuuuuaaagaaaugcgguuuauuaccauaaaauacagguugagcaucccuaauccaaaaucugaaaugcccuaaaauccaaaauguuuugagcacugacaugacagcaaacguagaaaauuaugugacuuuauguguucaauguauacaaacuuccuuucugaaacaaaaauuauuuaaaauguuguauaaaauugccuucaggcuguguguauaagguauuuuugaaacauaaaugaauuuuauguuuauacuugggucccaucuccaacauaucuuauauguauggaaauaucccaaaauuugaaaaaaaucugaaaucugaaacacuucuggucccaggcaguuuggauaaggauuacucaaucuguaaauacaguagcucaaauugauuuuguaaggcagucaaguuauuauuuauaguauuuuaauuuguauuauucuuuuaauauagcaauucauuuuauauauuuauauaaauaaauuuuuugcaauugagcaaauuaaaaaaauuaagugcuuccuucagaucuacauuuuauuuucuauuuguuaucaauuuaauaaguaaaggacacacagaucaucugauuguguugucagacauuugaaggugcaacugaugaauguucacuguuguacuuuguuuugucauguaaauuguuuuaaagagaagugaauguugagcauauaguaggccacacgugccuguggauuggcucauuguuuuaggaauguguaauucuggaaaagauuugccaaggguauucaaaaguauaguuugauauuagaaauuauuugaaaauaaucuuuauagcauagcaccauuuuauuuagaucaauaguaauucaagcaguauacauaauuugcuauuguaagcguagcauauaaccuaaguuuucuuuuacauuugagaccacuguuugcuguuggucgaauuuggucuuccaagauuuuuugcuuagugaccuaauugccagccuuugugaagagcuguuacuuauugucaaaccaggcaguaaggguuugcuuuuaucuuuuuaucaguucuuucaaugcuaguagucaugagauuaauguaguuggauacuaaaauguuaauacguguuagauaacaaacugggaaagagaugaaugacaucaugaaggaaagggcaguauugcacuuacagugauuucaugaugauagaacuaaccugccuaaaaagacauuggguggaaacagaaaccagguguaauagacgcauccaaguagucaaggaaagaaaagacuuguaaguaaauaagauaaucuuugcuucaaaaauaucuucaaagguuuaaaaugugcuuuacccucauauauaaucuuuuugagccuauuucuuuaccucaaacauggggaaaauugcaauaaucuguaucacgguauuugcuuccaaaacgacuaauugguguaaaugcauaucaagccgguaaaguuuacaguggacuuguuuaaaaugcguagauuggaauuguugggggagcaggccagcagcaugggauguuuuuuuuguuuguuuguuuguuuaagacucugucgcccagacuggagugcaguggcacaaucucggcucacugcaaccuccgucuccugaguucaagcaauucuccuaccucagccucccaaguagcugggauuacgggugccugccaccacgcccagcuaguuuuuacauuuuuaguagagacaggguaucaccacguuggccagacuggucucgaacuccugaccucaggugauccgccugccucgggcucccaaagugcugggauuacaggcgugagacaccgcgccagcuggggugauuuuuuucuuagucaaaucacuucucuacccaucaucucacacugucgaauacaaagacucuccuuggggcucaaugacucaucucccaccucugguuugauaaucauggcuauuauaacauguucccuuuuuaauuaguuauuuuaaaauuauuguaggucuuguaaucauaaucaauaauaauacguaauggcuccuuaagcacuucuauccuagauaagguugagaacauuauuaaaauuaguuuugguaguaaucaaguaaugauaauucuuauuuaugaauuuaaauauguaggaguuuuuuuauuuuagggaagcaaaaaggacuagaaaguaugaugucucaugauuagaaaacugcuauaaaaaugaagguagaauugauuugggcuguuuuggacauuuuaaauagaaauuuaaauagguauucaaauagcaaagucauucuacuuuaaaacuucuauacuuuuuuaggaucuucaauuuuauauuuaaauuauauuuuugaaaugguuuuagaagaaauauuguaucuuaaacucuaacuacuaauaaguaagagaagauauaucaaagguuugaucuuuuaucuccuagaauauacuauucauucguuucccauuguacgucauuugaauguuaaugguuagccucaaaugguuuucaacauaauuguauagcuacuauuauuggaaaauuggagccaaggacucauacacauaucagaagugguaaugaagcacuuugguuuuaugaaaauauguuuacaagguagucacaggauagcaauauugcauuuacuguaauacaaugaugguggaacuaagugcaguggaacaggaugcugagaccacaguuaccgcaucucuaagugccucgucuaguuaugguccaaccucagauauaacucauugguguugaaacacaccuagcaacauuuuaagcauagaccguucauuaaaagguaccuuuuuaaaaauuuuuauuuuuaaaaauugacauguaauaauuguacacauuuacaggguacacagugaucagaucagacugaucagcauauucaucucaggcauguaucauuucuuuguguugggaaaauucaauauccugcuucuagcuguuugagauuaugucauauauuacuguuaacuguagucauccuacagugcuguagagcacuagaacuuauuccucuuaucuagcuguaauuugguauccuuuaacaaaucuuucucuauccucaguuucuaccuacccuucccagccuccaucauccucuguucuacucuuuacgucuaugaaaucaacauuuucuagcuucugcauaugagagcaugugguguuuaacuuucuguuuuuggcuuauuucacuuaacauauguccuccaguuccauccauguugcuucaaaugacaggauuuuauucuuuuguauggcuuaauaguauuucauuauacgugcaugcacgcacggacacacacacauacacacacacacacacaucacauuuucuucauccauuagucucuuuggacaucuagguuauuccauaucuuggcuauugugaguagugcugcaguaaauaugggagugcagauaccucuuuuaauauacugauuucucuuccuuuagauaaaugcccaguagugggauugcuggaucguaugguagcucuauuuuuaguuuuuugaggaaucuccauacuauccucaaaugguuguacuagaacagagcuuuuuuaccuuccuuccauuugggaaucuucuuacccaacauguauauuaguaacuuggcuauguauguuccauucucugucucaaauacugugucuaggacaucugcaaucuuuggcuaugaccacgacuguaaagugcaugacgcuuuugcucugucaucaguauuaguugacaggcaaguaagauaguacuucucuucauaaccccuuuaccugcccagcagaauaccaguacagacagacccagaauaucucugggcucaagaauccagacauuuauaggaugggacuuuuaucuauaaaucaccuuaagauuaguaaguucuuagaauugguuaccuuugccauuucucagaagcccuuugucuaguaaccugugugucacugucauuuccagccugucuuuccuacacauuguuuaugcaggcuuuaggagugcccaccccccaguucuaccccccacccccacccuagccuuugugguuuuaauuauccugucuuggcugauuuuguuuuguuuugacauuucauccauuaaauuccugacacuggcuaucucuuuacaauuauuauacuauuuuucuuucuggcucgcucuuccugauugcuguaauccaugcccuugacuuuaaauaccauuuguaaguagacuaggccaagguuuauuucucuaggccagacucuaccuaguuauuucauaggcauaugaauccuaacauguccaaaugagaguucuuaauuccccugcuacccaguccucaaugugguucucucaaagcuauucuaucucaguaaugguccuaugcccucuccuagggauuauugcugagaaccuagaacucaucaucgucucuucugcacauccuaugaauucuggauuuauccacuuaucuccaucuuuuccagcacuaaucuaaacucccauuguuucuugcuggaguuauuuccguauccugcuaaucucugcucucguucucucucccugacacaugcgcugcuuucuucucccacaccaagccauucucuguacagcagccaggauguagaguguuuauuuacauaaagcagauccuggaacccccaaauuuaaguuguguucguggcuuaccaauacgcuuaaaaaccaagugcacagagagaaaacaaugaagccuuauuuggauaugcugaggauaauugauaacggguaacaacuaacaaacacguaguuggugucagguuugaccuccuacauuccuuacagguauuaguguauuugacccagcuccucccuaccuccgcaguaucaccccaugccucucuuucccccgacucuccccugcucagugucacacaagucaauauccccagcuugcuaacccccgggcugacagaucucauugucuauaauggauguuccaaggucccaccuucagccucaguuuuguugccaucuuuccagaaugaauucccuugaucauucuguuuuuuggagacaagguccugcucugucaccuaggcuggagugcaguggcaugaucauggcucacuguagccuugaccucccuggcucuggagauccuccugaguagcugggacuacaggcugcaccuggcuaauuuuuuuuuaauuuuuaguggagacaagaucucacuuuguugcccaggcuugucucaaacuccugaacucaagcaguccucccaccuccgucucccagagugcuagaauuacaggcaugagccaccaugccuggcccugaucauucuuuucugaagaaaacaccccuucuucauuauucucaauccuagcagccuauuuacuuccauucugaaaugaaucacauuuuaguauuuuauugguucguugucguucucuccccccauagaauguaaucucucugaguacagggagcuuaucuuuuucccuuuuggagccucggauccagcagaaugccagacacuuagcagccacuagcauuugaugagugaauggcuuuucauacacaauuuuagacauuguuccugauuggucucucuagucaauaauagauuuaucaaaucuaaucgauaauagauuucuuuuucuuuucuuuuuuucuuuuucuuuuucuuuuuuuuuuugagaagucuugcucugucgcccaggcuggagugcaguggcaugaucuuggcucacugcaggcucugccucccagguucacgccauucuccugccucagccucccaaguaacugggacuauaggcgcccgccaccaugcccagcuauuuuuuguguuuuaguagagaugggguuucacuguguuagccaggauggucucgaucuccuguccucaagauccgcccgccucagccucccagagugcugggauuacaggccugagccaccgugccuggccgauaguagauuucuuuuauugauuagagagacuaaucagcaacaauguuuuaaaauucucacauagaucucugaaugggaaagcagucuugaauuaugcuugcagggagagagaggggaaggaaggaggaggaaugguauaauuagacuucauaaggcuagauuuuguuucuacuuaaauaaugguaucacagugggacauauuauccaugcagaaagugagugggcaucuggucuauuaucuguggucuuucaggaauggcagcucuuuaguuuaaaaaacaacaaagugcagcacuguuuauuuaauggaaauagaaaagcagugccuguguauuaguggcucagauuuuuuuguucuuuguuuucagcugucugcuguaugccucuccagcggggucuuacagaaucucaagucuaccaugaucaaagcugaacccauuagcuccauuucuuaauuccuccuguauccucuguuaccauuaguaacuauucuccaacucaaagcaucagauuccuccucuuacucacucccuucauccccagucaccaguucugugcuguuauuuuauccaaguucucaguaggcuucacgagcaccgccuucacaucccaacugucgcuccuccaccuaucuguccuccaugcuucugcuagcucauguuuguugcaauacaacuaaccuugccacucuucugcuucaggcuuuucuacuaggcucugcaucuagaugaugguccagacuccucagccugugaaacaaagcccuucauaaaagagcagagcuacagcuagucagcucccuuccugcaguccacccccuccuccaccauacugagaauuggcaauuccuguagcacucuuuguaugaguccauuuucacacugcuauaaagauauaaccaagacuggguaguuuauaaaggaaagagguuuaauugacucacaguucugcauggcugaggaggccucaggaaacuuacaaucauggcagaaggggaagcaaacacauccuucuucauaaggcggcaggaaagagaagagcgaggagcagagugggaacagccccuuauaaaacugucagaucuccugagaacucccucacugucacgagaacagcauggggaaaccacucccaugauccaauuccgucccaccaggucuuucucuagacacauggggauuaugaggauuacaauucaagaugagauuugagugaggacacagccaaaccauaucacucuucaucugcuacgggugccauucccuguuucuacaguguccuguuugcuaccuucuuuguagauuucuauucauucaucaugucccaguuuaccuguuaccucuucaacagauuauucuucagucugucccucccaaacuccaccaaugaacauucuuuguucagcccauuauuguuaauaugcacuucacugaaaacacuguuuuaugcuuguuuacaucccaucucugcagggcucugagccuauagucagcaguugggaacuuacuaggcauagcgcccaguaaaggauagcucuuuauauauauauauauauuuuuuuuuuuucuaaaauaauaagccccaagaaaaacauuaccugugaaaaacaaaugauauuuuuauaccauuuucaaaaccuaauagcaauaaaaagaaaagaaaugucauaaguauacauuuaagcuguaguuaaaaacaguaaauaggcacaguauuuaacucuuaucaugugcuguuccaaguguguuauuuacaucauuggcuguucacaccauccccugaggugguuaauauuuccaucccauguuaaagaugaggaaaccaagucacagcagccuaagugacauguucauagucacauuggagcuggcagguggcagcacugagaaugaaacccacguggcugagcucuggaaagucaccauuaaucaccacacuagaccuucucucuaggaucuacauaacuagaacauacaauuaacuggaguauauguaaguguagucguuccuugagaaaggaaaagaauucacaaauuucauagccucaucccuugugcauuuguggcauugugcuaggggugucuauuugauauuugacccuacagauuucucagaugccaaccaaccacagauacuuuaaaaaaagauacuuaauacuuaccaaugcaagaaagugggcuuguuggaagaggaaaaauguuagcucacuaauggaaaaucaacuaaaagucuuaccucuccagaacaugcuuuuccuaaauguuguggcuaacccaagaagcuacaucaucuuuaccuuuaugauacaauuuaaaguacuuuucuacuuacuucaagcccucagagcacagaggcaagggaggccuugggcuauaaacccuguagccugagccacauggcuucuucuccuggacagauaccuggcauauucugccacugaggaucaguggugcagauguaucuguuuucuccuaggaauggggcuccacuuacgaaucuggggcaggacaagguauugcugcauuuuggggagcgugcuggaaggaggagcagaguuuguuguuuuugcuuccugauauggacuggcugugucuccauucaaauaucaacuucaauuauaucucccagaauucccacauguuguggagggacccaggggagguaauugauucaugggggcugaucuucucuguacuauucuugcgauaaugaauaagucucacaagaucucauggguuuaucagggguuucugcuuuugcuucuuccucauuuuucucuugccuuuuccucauuuuucucuugccgccaccauguaagaaaugccuuucaccucccgccaugauucugaggccuccccagccauguggaacuguaagucccauuaaaccucuuuuucuccccaaucuuggguaugucuuuaucagcagcaugaaaacagacugauacacuuccuuaacagaaccaauuauuuuuucccaaaaaagagggggagaagcccagaagcaugcagcuucucucuucuuucuaaggaauaggucuucacaaagugcccccaaaagaaaaggaccaggcuuuucucuuacuuugugacuuuccuagguugcuuuguagccauuuuggacacagaccaccuauagcuguguaguaguucucauguguauggacacaguggaaggagaugccaggcacauaguucuugcugcauugacaccuuuucagggcaucuucuuuuaccaucuucuguagaaacugcaacagcccggccaacuaccagccccagcccaccccuagcuuugcugcuuucauuuucucuguaacacuugucaccuuguaaugugcuaguguaacaucguuguuuuaguuuucuuauaucuuuccuucccuguagaauguaaauaccaggaaggcagggaauuuugucugcuuuauucucugcagcaucccuagacuccagagcagacccuggaacucaaauauuuguuagacagccaaaggucauauacuuccaacucuccacccaaaauauauauggaucacccauccuuaguagcagcuaaaccuuuggacaugaggaauuugcucguucacaguuuucuggccuagcaucugauuaaccaaacuuuuucacauaucaagaauuuaaaaugacuccaaaacuuuuuaugaccuuaggugcuucuccuuaauucuaguugguucauaaagcugucagaacaauaaucugcuuuugauaauauaugacuuuucuugccuccaagauagccuuuaaaaaagcaauuuagccuuuuacuguaauuauauuccaaauuuaagucuugccagaauaucauuuucccccuuuaaacauacuuuuuaugaugccaagauauuuuaaagaaaaguucagauaggaagcauauuuaagaugucaguauaugucucuaaaaucuaagaacauuuuucuacagaguccagaugauaccaucucacccacaaaauuaacauaaauuuuuaguaccauuggauaccauguccauauucagauucucccugaguuccagaaagguccuucacagguuaugcauuucacauccuauccggcaccagggccagcaucuuacauccuuaauucuuaggauucagaauagcacuuuuuauauccugacacugacuugcugaagaagcuguaccaguuuuccuauaaacuguccacuccuuggauuugucuuauaucaugucccagggguauuguuuagauuguugcucuauugcuaggauauucauguuacccuaaguguguacugagauagcagaguaaagagagauugucuuuuaaagguucugcccaggaacugcugguuuacacaaaagcugggcuuuagugcuucucggaucucuuugcuuguuucaguaauuuuuuuuuagaaauucacuaauucacuaacguaaguggggcaggguuuacaggagcauguguugagagaaguugguuugacuuuaaauggucauuuuuacaauccguauuuaggccuuacaggucgcauacaaucucugucacauauugcugucauuuuuacccccuuucuuuucuuuuuauaauccuuuaaaaaaugcaaagcccacccuuagcucacaggauguacaagaacaaguugcggguugcaguuugccaagaccugcucugugccacugcugacuugccauucuuggagcccacuuucuguucuugucagccaauucccuuucaggugcucagguuucccucccuccugucaccgggccuuugcacaugcucuacccacccugccuaguggagagcuaucuuuggccccuggacuucauucacuucggaccuucuuugggucacauuucagucaugccucacuagacaccuggaaucucugccucacuagacacacuagcacucacucuuuugggucuucuggcuguauguaauuguuaucagggcaguaauuuugcauuuauacaggugcugaggucagugucuggccuuuggcuacuugccuugugagccaccuuugcuuuccaguguaccccuagcuccuggcccaguguccagcuucccagcauccauucauguuuucccuggagaccauucugugcccagcagccagagacaucauugcaacuuaaaucucauugagucguuccaguugcuguaagaaauguaaccguacuggguaacacuaugccugucugucuccaccaccagaucuuauacuuccucccucaucugcuacucccuaagcucacuggcccuuuguuguuuuugcugaacgugcuaaucucuuccucacaccugggccuuugcacuugcucuuaccccugccucagccauccaugcacucucuugguuuugccgugcccgacuucagcauuuuuaguucacauggcucuuccguggggcccuucccugaccacccuguuugaaaugcuacccaucccuggcacacaucuaucauagucauucauuagcaauuagccccaucuccuuucccuauaguacuuuuccauaauuuuuuuucuugcucauauuacaccuccccaacuaauagauagauuccaagaaauugagugcuuuaucuucacuaccuggaauaguacuggcacuugguaaagcacagcgaauauuguugauugaauuacuagggguuggcuuagagagguacuuaauggaaugauucaauggaugaaugaaugaaugcauugccacuuuuuugcucauuaucaucaauuuguacauaugccuuucaacucaaauauuuauccauuggcuaaagaaaaaaaauaccugaauccccgugucucugcaguuuacccuuccucacuguuaaaacucagugccuguguaaaauuucauuauauuuuauuuacuucuuauuccacuugugcauuauguggauauuccugccucauccccacagccaccuaucacuuccggccaacucagaugccucuggucgcaacaaucacuucucuguugaauuucugaagcguuuaaucugcaguaugucuguuacucauacagcaguuagugugaauugucucacucagaauaaguauucauuaaauguguaagaaugaugauauagccuaauuucagaucaagauugugauuuauagcucauucuuaaucagcugugucaugacuuuauuuauuuauuccuuuuuuuuuuuuuuuugagacagagucucacucugucacccaggcuggagugcaaugcagcuucugccuccugaguucaagugauucucaugccucagccucccaaguagcugggauuacaggcgugcacccccacguccagcuaauuuuuuguauuuuuaguagagacggaauuucacuauguuggccaggcuggucucgaacuccuggccccaagugaucugccugccucggccccgcaacgugcugggauuacaggcaugagccaccuccucaggccugagucaugaauuuuugguaguccagucaugugguuaucuuccuaaagcuggaggccuuaaaccuagggccccaggugggcuuaugccuuuagcugcaaguaacaagaaacccuuuucaaccuuuuuacugauuuauuuagagagaaguacacauaagagguaaugcaaguaagcaaaguuuuuuaagaccacacaacuagauagccagcauccggaccagaacacagagacuugcuggccccuagaauccucucuccuggccccugccaguuacuggccuuuccccugaguucuauuugccugcaguuugcuuguuuucauauuuaauucaaauagaauuaggugauguguccccuuguguuucgcuucuaacagugccuuuaugcgggagaaguacuggcuauuucuuacuuugcccucccuccccggaaacauuuuccuaauuuaguagcaguaauuucaaaaacugcuuuccuuucggacaaacugacuuauccagccauuguaccuuccaguuuagacucuggcaguuuggagaguugagacagagagaaggagaaccgucuguuuaucuucuugaaaaaaacuacuguauuuucucucucuucugacucugggagccucuagacucuuuuuucccauuuucauauccacagaggaagagucugaaccucuuccugcugagcuuuccccugguugguugcauuucaggaacugacauugguugucuucccucuucccucaucagugcaaguagguuggaucucaugauaguccauauucacauaaccaugagaaucagagcuuucucucugucauuuccucccuguuuaucuguagcaagaagaaaaaaguccgucuuaacagagacugugaaagaauaaauauagacuuuauuguuuuagagcaguuuuagguucacagcaaaauuaggcagaagguacugagauucucccauauacucccuguucauacacuugcacagccucucccauuaucagcgucccccuuagagcgauuuguuacaaucagugaaccuacacugacaccauuauuaucacccaaaguccauaguuuacauuagcauucucucagcauuguuuauucugugaguuuggaaaacugucuaaugacauguacccaccauuguagugucauacugaguacuuuuacuaucccccaaauccucuguguuccuccuguucgacccucucuugccuuuaaccuuuccaagccacugaucuguuacugucuauaauuuugccauuucuagaaugucauauggcuuucuuagaaaauacaaauggugacuuuuuuggcaugacuuuaauaaacagaaaugaaaauuggugugugaaucaaaaucuuucacucuguaaagggacuuaucaggcggcaccugcauguggaauuauaucaaggucagcuuuaguuagaaacagaaggagagucaccuuugugaugucauuucuccuucauccaaguaaaaucucgcaugcugacacauaaaauuuuaucaucagugauuuauuuccucguaggaaugucccuuugaccuuauuaaauucagauacucuggggauggucagcauuuucagaugguucccuuguucuguaaaaauguuuguuauugguguuuaaaagcuguaaaagccacccacuauaaauugauagccacuaaagucugcgaaugugguaugaauguuccacuauguugccaagcguuuauuuuauugugaguuguuauuugauuguuuguaaggaaauuguuuuaugaugcucagcuuuauauuuccauaaacuguuccucccuugcaacuccuuaaacugugaugagcuuuucaaaacaaguccacaggacaacagucuguccagcauuugaagaagugguggaaaagucauuuuuuuccuuucaguguuucuagcuguucaugaaaacugcaguuaaaaguuguaauguuguuguguuuggcauucuuugggaagaugcagcauuauucaaacaaaaccgugugcucuuguuuuaaauaguguccaaaugaauaauugaauucauggacaucuaaauuuaauuccagaaaucaaagcuaugguaauaagaacuuggaccugaguucucuuaggccaaguaauuuaauuccuuagccgguugaacuauuuauuacgugucuccguuccugguuauuaugccaguaaauugcucaggcagaugcagggauggaugaugggcauauaauucacucuuuuucacggcuagacacauaccagaaugcagaucacacuaaacagcuguuuuuacaaacaugguuucuauucagagcuuuaagggccacauccaaguaauaacaaagaagccuggagaaggaaccuggggauacccagggucauguuuucaccaucccaccuggaaacacggugcuguccaaacccuggaugguacacuuggacaucgucauuccagucaugguucaagaucacguguauacaucaugauuuaaagagaauacugguuugauuuuucuuccugacuuucccugaauuuuccacuuaaauuggaaaacagcgcuaguuagugcccaugauuugauugaauaaguaagagaucucaaacacgguaaauuaacugaugacaugcaucaggucaucuuucuuugauucaccaguaauacaacagugagauccuacagaaaaaugcaaaggcagaagcucagggcagcugagcaacuguuaaggauucuuuugaaauguagccccacguaguaaacuuucgugcaauaauuugggcagucaaaaaaaaaagucaguuauuucaccucauuuauuucuacgaggagauaaaggcuuccaacaucugauuuucagugccaguguuuucuguuucucuuuucaccuauuucguccuagucuuguggaaauguuacaauaacugauuaggauuuucucuguauuaacacuucauuuauuaacauaugaguaaguugcuauuaauaaauuauucugcuuaaucaguuucuuuuuauucuuuagccacaugcuaaacuucuucggaugucuucacuuaauauccuuacaucauauuuaaucagaguuagaaaggcguuccacuugggggucauacacauuuuuuugaaacuuuuauaaacgcccuuuauacuauucuuguauccuacguaaucagagucagguguuccauggggaucauacacaucuuuauacaacuuguguaacacaugcuuuaaauccugagguaaucagagaauuccugccauugauggauuaaucucuuuacauaucuuucccuuucacucucagcaaaacuacuuauggcgguccuguuagacuuugaaagccuuucagguuuauggaggagucuuccuuucuauugucguagaucauggaaucauaguguucgcuugucucacguguuuggaaucugauuuccuacauaaugcugugcucucacuacgaguccaaggcuuccuguggcuacaaaucccggguuccuaucacuuuucccaaugaugagcuucuccuuguuggccagaaucagcucugugguaauaauucccuucugcuuucucccucucgcuuuuuuuuuuccuucuggguacauuauaaugucagcauagcagcuuuuaauucuauuacuaugguacuucucgaauagaccugugguaguugccccagaaagguugaaacccccugccacaucuaggucuuucuccuguauugguuuugugaucugaucaaggacaucuauuccucuaguccugcuaggugguauacgauaggcuuuuacuauuagauauucaaaugcugucaaccaugccugccuugacagguacaugauuuccacaaggauuuccuaauaggccuuuuuaauuuuguucuagacaugcccuucuuuugccauccaaauuugcuuauuuuuuacaaacuaugaugcaucagcauguaaauguuuaauaccauaaauauuucugauccucuucccaauuucacugaguuacugguuaucucuugccauuauucucagcauauugcaguggaucucagaauauuuuccccugaccaccagcaucaguauuaccugggaauuugaaaugcacauucucaggccccaccaaggccucaugauucagaaacucuggagcugcauuagaaacugccacaggcaccuggugaucuguguugguuuuuguuuguuuuuaaggagacagugucuuugucucccuggcuggaaugcagugaugcagucauagcucacagcagccucgaacuccugggcucaagcaauccucccgccccagccuucugaguagcuggaacuacaggugcacaccaccaugccuggcugguuuuuguuuguuuuuaaggaggcagugucuuugucucccuagcuggaaugcagugaugcagucauagcucacagcagccucgaacuccugggcucaagcaauccucccgccccagccuucugaguagcuggaacuacaggugcacaccaccaugccuggcuuuuuuuuuuuuuuuuuuuuaauuuuuuuggagacagggucucaccguguggcccaggcuggucucaaacuccuggccucuagguuuuuucccaccucagccuuccacagugcugggauuacaggcaugagccaccacauuuagcagguaggugaucuguguuucaauaagccuuccaggugauucugaugcucacugaaauuugagaaccacugaaauauuugguuuucuacaaaacauaagcaguuaguaaccauaggguacgcaacuaaauaguuccagcaggcaucccugaccacagggcauugcagauuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucagcuucaucuuccaccuguguguccaguuuaagcucucaguugcaguuuuuaaaccaauuuccaccagcauauacugaguauccgcuaccgugcaaugcguugcggcucuuguaugugcacuaugagaaguaauucccauaauacggcaaacucaguuuugauauccaccaccccacuuuuuauaauggacuacauuuuucagagcaguuuuagguuuacaaagaauucaagcagaaacuacaaaaaguucccucuaccucucacuuccccacuccccaacaguuuccccuggauuaacauuuugccuuaguaugguacguuugaaccaauaucgauacacuauuauuaaccaguauuccuguuuuaacaugagaggcgacuuuuuguguaguauagucucuugguuuugacaaaugcuuaaugcuguguaucuauuauuacuuaugacaguaucgugcagaguaguuucuaaaaauccucucuacuccaccuauucaucccuuccccacucccccugaaccacuggcaaccgcugaucuuuuuauugucuccguaauuuucccuuuuccagaauguccugugguuagacucauggcauccccuuuuagcaacugcagaaacuaagaacuguccccaaggauaaaaauuuuugcagacccacugagcugggauuuauacuuagaccugcugaauugaaguuuuggguguguuucuucucaaauugccaaaauuccauauggacgacuuuucuuuuccuucccugaaauguguuuaauugacuuuuucuguuauuuguguuugccuucacagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagguaauccaccauuugcuuggauuccccccacccccaaggaaaagaaagcguaauaccagaguuggaaauauccacccuagcaccacugccuuccccaaucaaaaacauguuuuuuuuuccaaaaggcuucuuaugcuugugaaauuuuuuugguuuaacaagcaaacaauuucaaauaaugugaaaucuuuauuauacaguuuguuuuguaccuuguauaugcugcuuggcaaaucccaaguuaauucuacaagacuccgcccaaccagguagucaucuaauuugacaaacacugaguuaggugacuccuugguauuccuuuggcagugaguguuuguuauauaauauugucuguuaccaccuagacgaugagcuccuugaggguaaggacuugauuuuauucaguauugcacagagugccuggcuuguaguuucgauaaaucuuaguugagugaguaguugugauuagauuucauuaaagaaggagauuugggccaggcacagugccucacaccuguaaucccagcacuuugggaggccgaggcaggcggaucaccugaggccaggaguucaagaccagucuggccaacauggugaaaacccaucucuacuaaaaauacaaaaaugagccaggcgugguggcacgcaccuguaaucccagcuauuugggaggcugagacaggagaauugcuugaacccaggaggcggagguugcagugagcugagaucacaccauugcacuccagccugggugacagagcaagauugucucaaaaaaaaaaaaaaaaaaaaagauuuggugaguaucgcauuauuuuaugcuaugaauuuuaacagaggugauuuauguugaguuuacauuguuuuauugggaaguacggcagugcuuucuucaagaaguaaauauaguauuaaugucuuagacuuucucuauugaauuaauguuuguguugcaaauauugugaacuaaaagaacuaaaggucauacuugucuccaugaaauaaaaacaaacauucaguugauauuaaaugaccaaauguuacagaaacgaguaaacuguuggauugaguuccuuaaagaguaugcauuuguuccuuaaagaguucugcauuucauaucugccaucugcuuggcagauaguaaaagaugcuucuagagcuagauugaaugaauauguacuugacugaauuuuaauguacugcaaauacuuauaaaggucaaccacaaauguuacagcauuuacaaaaaguggcuuucucucacuuuuugcuaaaguuuaaugauuucagauuuauuguucuauuagagcuuaacaugggcuauuuugucucccucaacuauauucauaguugucacuauaguauuuucuucccuuuguugcauuuuuuaccuuauuaagguguaauuuacauauaaguuucauuugcuuuuaaguauauaauucagcggcuuuaagaaauuugccaagcugugcaacuaucaccauaaucuaaucuuagaacauuuucgucacuccaguaagaucacacauacucacucccaguuaagcccucuacucaccucuagccccaagcaacaacuaaucuacuuucugucucuauagauuugcccuuuuuuggacuguuauuauaagugggaucauauaauacauggucuuuuguguccgacuucuuucacuuaacacaguauuuuugagguucuacauuucuuuaacuugagcuuuuaaaauugagauuauucugaauuaaacacucagcguuagcuuaaaauuuauugaaaguuuuacauguucuuugaaaaaaaagaacagagugcaagauggauuaaguuuaucauucccuacuuaaugacaguuucuuacucacuuuagcacauaaguaaaugugcuaguaaaugcgcauuuuguuuaaaccaccauuuuucaaauacugagacaugcuuucucaggguguuuuucauacaacuguuaggaccaacuauggcagaucuggucaaaugaacuuguuagccugaugccuguagcagggaaggacagcuuuucagggcuucucuucucgaaaccuaaaugaagugugaauacaaauuacagcagcuagcagccugcagugggacugaaaguccuuggugaaucuccaucaagcugggcuguuuaauagaaccaguuuagugucccauuuuacuugaaacauuagauuuugagcaccugcuugguacaagccauuuugcuaggccauguggaauggaugaugagcacacacagaccagcuaacccuaguggauguuaaaaucucuuaggaaauagaagucaaagaaguacaaagccaucuguguuguaagaaaugugaacacagaaccugccuccgagaguaagagggaacuucuggauugaucagagaagguuccauggagagcaugacauuugaacuagagccaaaaguguggguggguggugugucuaccaguggauuuugcuguagagucaucaggacuagcaaaacaaauguggugccauggaaaggcauauuuaggagacaggauugguccaauuuaagcuagagcagaugucuuuuagguugggaccaaaauauagagaccuucaaugccaggcuggcaaagaugggcauuaacugcaggugauuaauuaacaaauauuaauucagaagcuacugugcgcugcagauuuuuccaggagacaauaaagagauuuuguuuugaugcuaguacuguugagguaacaggugaacaaggagugacaucaguuaugcaguacaaugagaggaugccacauaaacuuaggcccauauucuagaacaagacaauuugcuugagauaaauuggucucauuaucgucugcauuaguccaguucuuuuugcuugaguuuugcagguaguauuauuugauauuaagacggaacacagagauguuguauuguuuuauuuccuguagaaagacgaaggcaguuaaaagaauuucauaaacaaaacacuccaggcuaaaggcaaaaaagaaaugaaccuuaaaaaauaacaaguuaauaauuuuguuggcaagaagagcaacaaaagcaaccuucugaaagcaagauaccuggucauugagagauagcaacuguuaaugccccagaaauagaggaaucuuuaaugcagguccauucauuccaccucaaacuccugaacaaaagcucuaauugaggcaagucuuccugggaaagggggccuaacagaaacauguuauggucaguugugcccaugcgagauaauuuuuuugugcuuguagcuaauuccaguaaagaaguagauguuuuagaggguaacguuaaaggggucagcugcaaagaguccuuuuccuccuccucacuguuacaaaaggugacuugugguucuucccuaauugagagcaauggcaacgccauaggugauuacucauuuuguaaaacucuaauuacaaguagguugcuucuguguucaacauaaaaauuagaagugacuugcaaagaugagauacugcagggaggcuuacaaucuuguuuucaguguuaguguuucaguaccuggaacaaaaugugauuuacagccauccuuucuaagaaaauugucaucauuaccaacauauugcuacugauaccaguccuuaaugugcuucauaaaaaacucaauaauuucauaacccguuaaaaccggaaagaaauggagggaagaaaaauaagacacuuuuagcguagucauaaucuucucugccauauuguguuagaaucgaugauacccaaaugagaagaugucuguucucugucacugauuccaguagaauaaaauuauuguuuaaaaguaagcacauucgcugcacuccagccugggcaacagagugggacccugucucaaaaaaauaaaaauaaaagugagcacacgauugcaagaucuaucugguuuugggggcuuauugucaucuuugguuguuaaaaaaauacuuggauauuauugguuauuggucuaguggaauaagccauuaccgauuugaguacaacagugguguauuuagauacuugcuccuaauuuucuguucuucaagaagggauuguacuucagaaaccagagauaucaggguaguuuugauugagccauaaauucuaaauucugauugaaauggguauuguaauaaauggcauaaucuuuuauuuaaucuagccaauugugcccuguccagaggaacuggacauuucuuccuuauguuccauuuauucagcaacuauucguuguaccccugcugauggcuaggcucuuugcuacuguggaaggcaucguuggggcagagcagacagcauuuuaccuccugggagacuggcagauuuuugaagccuuuguugcagauauagauuuucacggucaccacucuugcccuuuaauguaauuuaaauuuuuuuuuuuuuuuuuuugacacgggauuuugcuauguuuccuaggcuggauucaaacuccugaguucaaaccucagccucccaaguagccgggaaaacaggccucuugugcuuuaaagcagugauucucugucuuuaaaccuuguaacuaugcugugugguggaaauuuuacuuccccguuuaaagccaagaucucuaaggccaagaauuuuuuuuuuuuuuuuuuuugagauacagucucgcucugucacccaggcuggaguguaguggugcgaucuuggcucacugcaagcucggccucccggguucacaccauucucccgcuucagccucccgaguagcugggacuacaggugccugccacgaugcccggcuaauuuuuuuguauuuuuaguagagucaggguuucaccauguuagccaggauggucucgauuuccugaccucaugaucugcccaccuuggcggcaccccccgccccccgccccccgccccccacaaagugcugggaauacaggccaccaugcguggccgaaaaaaauuuuuuuaauuggccugggcugggcgcaauggcucaugccuauaaucccagcaccuugggaggccgaggcaggcggauaacgaggucaggagauuaaggccauccuggcuaacacggugaaaccccaucuguacuaaagauacaaaaauuagccaggugugguggcaugcgccuguaauccuagcuacacaggaggcugaggcaggagaaucgcuugaaccuaggaggcggagguugcagugagcugagauugugccacugcacuccagccugggcaacagagcgaaacuucgucucaaaaaaagaauaaaauaaauuguccugggucacauaacugguuaagugaugaaaucagaauuuggaccuagauaggccaggauauuucugcuacacucaugucaaaauuacacuuuuuauuuucuuuauaaauacacacaaauucauuucaaccuguguucccuuguaaaugcauauaccuuugauauaggcauauauucaucuauuauuuuacacugugcauuucugaauuuuuagaauuuuuacuugaagugaucaggcuggcgcuguggcucacgccuguaaucccagcacuuugggaggcugaggugagcagaucaccugaggucaggaguuagagaccagccuggccaacauggugaaaccccgucuucacuaaaaauacaaaaaaauuagcuaggcaugguggcgcgugcccauaaucccagcuacucagguggccaaggcaggggaauugcuuggaccugggaugcggagguugcagugagcugagauugcgccacugcacuccagccuggcgacaagagcgagacuccgucucaaaaaaaaaaaauagaaaaaugaucggggguccacaaauaagaguaaugaucaagggucagcaaauuggggccaaaaauagccuguuuuccuguuuucuacacaaaaguuuuauuaggcacagcccaucccauuuguuuaaaaauugucuauggauguuuucauguuuuggaaguagaguugaggaucgcaaaagagauuguuuugccugcaaaacugaaaacauuuacuaucuggccuuuucaguaaaccauuugcuaaccccugauucucacuauaagacggugacugugaaguucuuucuauuucacauacugccauaucaaguugauuucuuuugagguaggguuuguuuuuuuuugguuagagauagacuaguauaguguuugagagaauuuuuaugaccuugggccaguuaaguaaccuguuuuuuauguguguaguguagaugguaauguuaucuugcauguuucuuguaagaaugacuuuagguaacuuauguuaaacgcuuaccaucaugcccaguaaguguucaauuuacaaacucaagcuguccagauucaaaucuuugccuuacaagcuacuaacuguguaaauuuguauaaaucaaauaaccuugaauccucauugcuucuuuuuguaaaauagggauuaauaagaccuauccaauauuuaacuauuuugugaggauuaaauuaauuaauuuauaggaaacacuuugcauaauuccugguauacaguaacugcucaauuaaccuuaguugcucucuuaguuaugguuauaucaucauuccgauccuccauugcauuugaaacauuagcaaacuaauguuuacuacuaaugaggaauguuaaagguaaaccaauaaguugacuuuuaauuauaaaaggcauaaauguaaccuauccauaucuauugguauaauaaagcugauauuuagagagaacauuauguuaugauuaaaagaaacauuucuugcuuaaauuuuuuuugugugaauauacacuguauauugaaauaucugcacuuaaauuuuaaauccagcugaaaauuggauaagauaguauuagaugccacugcauuucaagauagaguuuuauuucuugcagguauuuuaagccuugugggaguucuucuguuaagugaacagauagagacacugauacagauggcucuuucaccgucucaugugaugauaaaagcuaaaagguuugauccgaauauugcuuauauugggcuaagugauugaccuuggcagaauuaaauuauuuuucuucuucuggugacaauuaaucugggagaaguaccauuugauuuauugcuauacauuucaccaauauccacaaggcacuuguagguaccagacauggcauugguugcugggggcacagagauaggaacaaaguggcuugcucagguugcuucuagccauaucugcauuguccuugagagggaugagucucucaggccugccuaggaaggaauuuuggcagcauggagaagagaaagugcucagcccggaacaaaaguuuucaccuacuauguugcagagaaguuggcguaucaguaauuauaaaggaagaauagggauuuacugggugauagagcaccaaauagaaugaaugcaauacauacuugaaguaaaucagaguagcuuguauugaucucaaggggagaagaaacaaagcuuagcuuaauucucaugccucuguuguuacuuguuuguaauggacaugacacuuacaagguauccuauaauucacuaacgggauuuuuacuuaugauuaauauuuaacucuccacaaagcuugggguaaacugugaacuuaacuugcugugaacccgaacaugaacucacauacuucaguuggaggccucaguaguagcaugcuguacaaaaaugaaacuaaagcuccagggaguauuugggaacagggcaaaaggguaauggcuccuccuuauagagcaagccucaggccuuuaccuuuguguuuugaagauggagaggaugcacuucuacucucgcccggguuguagcaugcuugcuaaugaugucaagagaacuagugucagcacugaccauagaugugacagguaacagccuguuauuuugugccccaugucauggcagccauugauuccgagguguuugauacacacuuugauagaggcagagugaagcaggacauggacaagcaucuuuccguguaguuuaauggucucaaucuagaaagcccacucagauaauuagguugcuuaaaaugugaugagacuagggaauagagccauauagaagugugugugagagagaauucagugguuuaguauauucacaaagauacacauuugacaccagccugggcaacauagugagaaccuggcuuuaccaauuaaaaaaaaauagaauagcagaaguaaucagugaaaggcauuuuaauacaauuauaucuagauuuauuaaaaauaaaauuuuaguccaauuuaauuaaaggccagaaacuagauuuuuaaagaauauuagucuuucucauauuuuccccaaaucaguugcuuuaaaaaaaaaaaagugugcagaugccucaggcacaauaacuguacucaacucaagaauuugcaauuaagaaaaaaaaaaaucaaaccucaaagaagaaauccagcaacucagagguucagguucauuuaaacaugcauacauuuacaugggcacacuuuuuuuguuuuguuuuguuuuuaagauggaguuuuuguuugucgcccaggcuggagugcaauggcgcgaucucggcucacugcaaccucugccucccggguucaagugagucuccucucucagccuccugaguagcugggauuacaggcgcacacaaccgcgccuggcuaacuguuguauuuuuaguagagacagguuuucaccauguuggccaggcuggucuugaacuccugaccucaggugauccaccugccuuggccuccuaaagugcuagcauuacaggugugagccacugcaccagcugggugcaccuuuuuguuuguuuguuuuguuuuguuuuguuuuguuuuguuuuguuuuguugacauggagucucagucacccaggcugggauucaguggcacgaucuuggcucacugcaaccuccgucucccagguucaagcaauucucaauucuccugccucagcuucccaaguagcugggacuacaggugugugcaaccacaccuggcuaauuuuuguauuuuugguagagauggguuucaccacguuggccagacuggucucgaacuucugaccucaggugauucacccaccuuggccucccaaagugcuggguuacugguuugagccaccacacccaaccgggcacacguuuuuagccaagccauaggucugauuaaguacagucagauuccuugagcagguuacaaagcuguggauuugaauggagaucuuuaguucccuugcagaacaaugaguuuccaaaagcagaguggcuuacagccuaaccagcugcuucucucagccuuuaaccauuuugcccuccugaaaauucaucuuugguuuccaaccaccucuuccaauaugccugacuuuuugugauucuguuaguagaagaguaaaaagucaaggggaggcaagaaugaaugaaucucauauaaaaaugaugcucaagagaaucccuuaauuuucaagacagcagcccaaauuguaaacauugagacuuuuacaguguuaaaaaaaaaaaaguguuuacaggccaggcaugguaucucacaccuguuaucccagcacuuugggaagcugaggcaggaugaucgccugaccccaggaguuugcaagcagccugggccccauagggagaccaaaaaaaaaaauuguuguuuuggcuguagugucacaggcuuauagucccagcuacucaggaggcugaggugggagggucgcuggagcccaggugaggucaagccugcagugagccgugaucacaccaccacacuccagccuuggugacagugagacccuguccaaaaaaaaaaaagauuaaggcagaggaaauguuaaagguuacgcuauauuuaguugauaauaaugguaagacuguucagguguuuuaacuaugagaguaggguugccucuuucuuaaauuuauauauguucuuauuggguauaauuucuagacagaauaugcaaguaucacagaauauggauggcaauuuuauguugcuugcacgugacuuuagguucuuauguuucaugauaggagcaaagaaaagucuugcuugccaauucuuaugauugcaucuguucuggaaauuuacuagcauuuguuacccaggauuucugaagugcuggugacugcugcccaguagucuuggugggcaaaguuacuaaaaugcaucacgaauccuucugguguuugcuugggcuauggcaggguuucuggaccuuaguacuauugauguuuugggccagauaauuguugcggaugauuguccugugcauuguaggauguuuagcugcaucacuagccucuacucgaugccagcagcacccccaagugaugacaaucaaaaauguccccugggaggaguaggggauagacucucucugguugcaaaacacugggcuaugguguugagaucugcagugaugagcagcuuuagauaugugaacagaagcccaggcgugguggcucacacuuguaaccccagcacuuugggaggcugaggugggcggauuacuugagaucaggaguuugaggccaaccuggccaacauggugaaaccccgucucuacuaaaaauauaaaaauuagccgggcaugaugaugggugccuauaaucccagcuacuugggaggcugaggcaaagaaaucacuugaaccugggagguugagguugcagugagcugagaucgugccauugcacuccagucucggcagacagacugagaugccgucucaaaaauaaauaaauaaaaauaaaaaagugaacagagaaauacccgugcaauacugugucucaucccccaaagacggagucuugcugucgcccaggcuggagugcagugacacgaucucaguucacugcaaucucugccuccaugguucaagcgauucaccugccucugucuccgaguaccugggauuacaggugugccucaccaagaccagcuaaguuuuguguguuuuuuuuguuuuguuguuuuuugcuuuuuuuuuuuuuuuuuuuuuugagacgaagucucacucugucacccaggcuggaaggcaguggcacagucuuggcucacugcaaccucugcugcccagguucaagcgauucucuugccucagccucccaaguagcugggauuacaggcaccugccacugcgcccggcuaauauauuuuuuuuuuuuguaguuuuaguagagacaggguuucaccauguuagccaggcugaucuugaacugcugaccucaagugauccauccaucucggccucccaaagugcuggguuuacaggcaugagccaccaagcccggcuggucucauuuuaauguaagcucuaacuucuguaucacugcuuugcacauuguagauaaccagugaacauuuuuuauuguauaagaaaaaguaaaauaaacaaaaauaugccaaagcaaauaugauaaauacacauuuaguaagguaaaagcaaguauuugauaaaauguguaauguagucuaguagcuuuauuuagaaacagaaaacaacauaaaauguugacuugaaacauugcguaugcauauuugccauguagacagugagauauggagguaaacugcuuuccuaguuuuguuuuguuuuuuuuuuuuuuuguucaaaaggaauucacucuccccuuguccacuguuauaaaauagcaaauggugauuagcaucugugcuguaaccagagacacugcuguucccagcuggaaucuguagguuguuugccugcuagagauugugacaagaagccaguuaacauggagagguguacaugucagucuuccccagaaaaggacaugaaacaguaggaccauccuuccaacccaugaccuacaucuagaggcauucuuuuuuucuuuuuuuuuuuuuaaaccggaacagaaauaucaucuaauucuuucuuuacagagaagugguauaaggaaguacauucuggccaggcacgauggcucaugcuguaaucccagcacuuugggaggccgaggugggugcaucaccugaggucaggaguuugagaccagccuggccaacauggugaaaccccucgcuacuaaaaauacaaaaauuagccgggcgugguggcacacaccuguggucccagcuacucgggaggcugaagcaggagaaucgcuugaacccgggagacggagguugcaguaagccgaguucacuccauuguacucuagccugggugacagagcgagauucgucucaaaaaaaaaaaaagaaaagaaaagaaaaaggaaguauauucuaagcccuugaauugaucuuggcuuucuucauuauuuuuacaaguaaaaauaaaaacuuugauauuucugauguucugggauauuauaggaaugauaccacuugaauucagcuuucuaagaagucugguauuucaauagucuuaauaugaguaagaaaauuaugaucuugguacuggaucuaaggcagagguaucgaagcuguuuuaauguugcuugagauaggacagaacuucagaguaaaauaaauguguauagacaaucuguucaaucuguucaaauuaaguuguugagcuguauauuugaaucuuaagacuacuaauuuuguuguaucugucuuuucccaaauauauguguacuucuuuuaauaagccaaaaccuaugcaacuuuuacuaauucuucccuaacuacuucuuuuggaaaaugauuaaaucuuaugucucacguuuugacauaucuauugcauuuaaaagauaagguugaucaugcugcuucucaaacugagauauccauucgaguuauccaaggcccuuggaaaacaaucguuguugagucuguauggggggccugagucccaggugguguugacucugcugguccaugauccuauuuugaguaguagacucuaguagcgucuccugccuuccauauggugcagauuugcagcauugagacaggaaguaagaaacugaaaaggaaaaccauucuuaccuuugguguuauuguucuugguauauuacagauaccaacaaguaugaggcaauccugagacaucuaccuacugagcuuuucuuuccuuaaauucacaccucaagaccaaggaaaccgaaaaacucuuacagucucccuacauguguucacuugugccccuauuuccugucauuaacaugguaguguagccaacuccugcuagccuguaaaagcuaauuauuacaguauagaggaauuuuguaagccauagccauuaguagcuugaaauaccaauggugggaguauuuauaccauggcaguuggcauacacuguaacucaagaguguucuauuuguuuguuuuucuagacagugccaguuucccagcauacuccugucucucauucaguaagacaaagcacuuccccuuauuuuccaauacaggacaugauaucccgaguuuugagcuucuuguuaauagccuguugcacgcuaaccacgcagcucagugaagagcaaguuuauucccauaacaaacaggaaacaaagguugaggaaaaaccacagugguacccuuuugugaguguucccuaacaccgucacgggaguccugauuagucuaaauacuuuacaaguaaaucuccuucagguggcauuuuauaaacaaucuuucaucauggagagaugagaauugggucagguauaauuagaaugacagauguauuggcuagccugagagaauuaacgcaauucaguaaaaaggcuagccaacugcggauaucuucuaguuacuuccgugacaaauuagcaccauccucuuguacugaagcagugcuuucauuagcaugcacagcuguuugcaucaucuuuguuuguauuucaauccauauuuggagcuuaagugagauuugucauaagacuucaguucaagcuugcuugccuaauuuuacaugcuucuauuuaguaaaauaugauuacuaggucauaaauauuugauaauuuauugccuuauuagaguaauuuucuaaacauguuuuuugacgacugcuugccacuacguacaagcacuugaaaaauguucuuuucuauuaaaaguacaugguuccagaauugggaaaaucacguucuuaaaaaauaaccaguuuucuauuguguuggcuuuuaaaauuuuuucaucaguagaaucaaaugcaaauauugucugcuuauuuuucaacagaauacaaguuugauuuuaauaacuuaggcucaugaaaugucaccacguaguaauacuuagaauuacagcaauaacuuaggcuaaaaaaauaaaguuguuaugaacuacauugagcucagacagauauauguauuauguaaacauuuauauaaaauguauauaaauuguauauuguauuauauaauuauauauuguaauauauaguauauaauauauaauuuauaaauauaauacauaaauuauauuuauaaauuauaaaguuuuuauauaauauauuauaaucuaauauauuauaauuauauuuauaaauuauaacguuuauuugaaauauugaaguuuuguauacuuaguggauuuuaauauuuaugucguuuucauuuuauuccacuguuacauuaaggaaguaacuuauuacaaaaauaaauuauauuugucuuacauuugcccuuuuuacucuacuuaaaauuggagaaaaagaguucaagauagggaauuucugucagaaaggagaaauaguuguauuaugugaaguuuaaguagauauucuuguagaguauggagaaaauaaugcuauaaaauguugccuuuuaaaaaaaaguucagaaaauauaguuccuagcucucucuaaaugacuaguuugauugugacugcuuucccaaaauuuguaaauuuaaaauuuauacaucacauggaauauaguuuuauuucacauacauuccaguaggcugagaauacuugaaauucaaugauuaaaaaugaaauaauaauaaccagcuuugcuuuauucuaaaaccagcuuuauucuuuauuuaccacuuuauuuacagcgaauuauuugcuaaucuguuaacuuugcuucauaagaaggcauuauaauuaucguacauuugaaaguggagauuuucuccccauucugguugccaguuucacaacuguguucauucuaaauuuauuaaaauauguaaaaucagcuuucuaaccuugguuguccacaaagaauuucacuccaauuugaaauaucuauucagaacuaauuuuuugugguugagcauuauuuuuugaacaaugaauugcauaaucauuuuguauaauccagggagcucuggcuuagauucuguauuauuuuguguuauacugauuuuuagaaaauggaauguagcguugacacgagcacaaaucucagcaagggccuaccuuacaaagauaaaaugcguggaguuuuauuagaagcacaugauuuugcuuuguguuucguauacaccagcauuucaguguaguaaauggcauuuugucuugaagagugagcagaguuguuacaaaagaaggcauaaugcuuccuugccagcagaauucagauaagugaauaucagaaaagcuauuugugaucuugaaaguguaagaaauucaacaucaauaaaggauugugguuccuuagauagccauguaagucuuugccuauguuucuaacauuucucuuuaggaaauauucuugcuuuuauuuuucugaacaaauuuucuccauuauuaucucugauauuuacuuugaacagaaagguggauuggaaaucaaaaaauaaguuugauuucaaaaaugauuucaaaauguuaguuuucucaguauuuuacauuuugagaagagaacaaagaaggcagaugaagaguuuuuuguuuuuucuuaaauuuguuuucuuuucaacuuuauuuuuaauugacauaauaauuacauauaguauacauuuugaagauacgguuuuaauuuucacaggaaucuuauuuggguuuaguuauauaaggucuaauuuugcauccucuacauuuaguggcugauuuauaaauuuccacugagugauaauaguaauuaaugugaaacagguuuuuugcugauguuuuuagaaguuucaguagauuaggaaggaagaaauuaugcuauugagaaaaauagaaaauguaaacauaagcauuugaacucucucuugagauauuuuuaucuuccaugaaacuagaugcggcuuauugaagauguguuucaggucucagugcucuaaaacucuucuacuuggugagcaucuugauugguuagaucucuuacuaauaucccauugcuagagagggauguaaaggaaauuuucucaaacugagauuuccaaaucuuccaaucucugagucaaguaaagagacaagguuagaacucuuaggcaaacugaaaaaucaauauuccuauauuaucauuauuuuuuucuuuuuuugacaccaagucucacucugucgcccaggcuggagugcaguggcacuauuuuggcucacugcaauguacgcuucccagguucaagugauuccagugcuucggccucgcgaguaggugagauuauaugugcacgccaccaugcccagcuaauuuuuguauuuuuaguagagacaggguuucgccauguugacuacguuggucuugaacuccugaccucaggugaucugcccaccucggccucccaaagugcugggauuacaggcuugagccaccaugccuggcuuccuauauucauuuuuuuaugugggcuuuuuaaaaucuuuucaauagcaaagacuugacaccaacccaaauguccaucaaugauagacuggauuaagaaaauguggcacauauacaccaugaaauacuaugcagccauaaaaaaggaugaguucacguccuuuguagggacauggaugaagcuggaaaccaucauucucagcagacuaucacaaggacagaaaaccaaacucugcauguucucacucauagguggaaauugaacaaugagaacacuuggacacagggcggggaacaucacacaccagggccuguugggggggugggggguugggggagggaaagcaucaggagaaauaccuaauguaaaugacgaguuuaugggugcagcaaacaacauggcacauguauaccuauguaacaaaccugcacguugugcacauguacccuagaacuuaaaguauaauaaaaaagaaaaaaaauuaaaaaucuuuucuuugagacaauuguagauuuacaugcaguugaaagauuuaauagaggccgggcgcggugccucacgccuguaaucccagcacuuugggaggccaaggcaggcggaucaugaggucaggagaucgagaccauccuggcuaacacagagaaaccccgugucuacuaaaaaaucgaaaaaaauuagccgguguguggcgggugcuuguaaucccagcuacucaggaggcugaggcaggagaauggcgugaaccugggaggcggagcuuggcgaagccugcagugaguggagauagugccacugcauuccagccugggcaacagagcgagacucugucucaaaaaaaaaaaaaaaaaaaaaaaaagaauuaauacaaagagacccugcauagucuucacucaguacaguaucacaacuauuaaauugacauuaaucccuuaacacugcuuuaacccaagucuaugcugcugcuucuccguguucacuucugagaggcacuggccauuucuugugugcuuauucauacuuuguguaaaagcauuagcaucauacaucgcuggugcugacccuacccucagucccagcuucucccagaguaggcuaagauucucuuuucuacuacauggaaaauuguucuggaauaauaaaggguuagcaaaaaagucagagaaaacaaacaguugcauucccuuucccuguaguagaguaggaauauaauuaugagugauagaggauacguuccauuccuuucccaguccucuccgaagucagcuucacugcuguaggaaguugcuguucucauuauuucccugagggaaaguguugggaagugagaguugaggugauggggaaucaggguugcugacaauugggggaauuauaacgagaagcucuuuuucaccaggagagggguugcauguuaagagaaggccuaucugcucauccuccaugucagcagaugagaaccaguuggacaagguagcugucucuuagagauugagaaguaacaaaagcacacugucaguccuguucuuccagccucacguacaucuucuccauacauuauguauuugacauuaaauuaacauacacuguuacacccauuccugaccgcauuaucucagguagccuuuuguauuugaguauugugggaucuguugcuauugcccaugaugcccacuuggacuccaccaaggcagugaaacucuugggggccguucaaagucaagagugccaacugccccuaacaggauugggagaaccaaccaacacuccccgaauagggacuaacucacucuuuucuuggccuuuaugaaaggaaggaguuaaggcucuuacagcuggagacuccagcaagaguuguaggcucaacguguagcuuauacuauuuacuuaauuaacauguaaauggauuuugaguucugaaugcuuguucuaguugauuagggcucauuuagccuggcuucuacgaauuagcuauaacaaaugguuucauagcuguuauagaaugaggcagaagaaaauaaaaugaauguagcauuauguuuaauuagugguauaggaaaauguuaauauaaugccauuuagauucuggacuggggagauugugccuuuaucauaaguaagaaauuguugcuagguuucacauaagggcacauaguuaucaugaaucaucuccuucgaucaucauucuuuuaucccauuacuugacuugcacccauccaaaauucuaccacuuuuauuuaauauauagacucauaaagacaagguuugugcaucugcagagcugugauguucacugcgaggcccguggcacacaucuauaagaagacacauauuugguacucuaagaugauacuuuuuuuuaaugccaaaaugugagggucagcauaaauugccaaggcaugguaaauuuuguugccaaugcucccgugacuauggggugaagggauucugugccucccuugguagcaaugaccacggugcuugcaaucccagugccaauucccggcacagugcaggcucuggaggcacugcugccuugcagucuuauuggaauuaacacugccugaguaagagauuaauaauggguauuguugugucuuagaaacguuaaagagcaugugacaugaauauguacacauuggugaaggagauacagagaaggaaagcaaagugaagcuguagauguuuguuacaacugaagguaagcucugggagcagagaccacugcuggcuauaguugaugggauccacaaugucaauacaaauggggacuaacuauuguuuuacuucccuauacacguugcucuuucaguagaugcaauaaaguacugguaaaaccagagguggcuaccaucacgaugaugucaacaggagggacagucagcacuaagcccagaaggugucaaacacuccgcaggagaaaugcgccaugcaacggacaugaagaugaucugacacucuucacgugguuuucagauggaaacguggcuacgaaagcaucaaccucauuaucauccaucauuaaggccaucucacucaguacugcugcuuucaaaguccacgcucccaaagcaaauuggauuucuguacacaauacucuuacaggaugaaacccaaccaacuuguugacguaaguaucccaucuacuucgcaauuuuauuuaucuuccaaaauuaaaggacuggcacccugauuuauuaaaagugaauugggucuagggaccauauccccucugaguuacugacagagcagcuucuggccugugaagcucaaagccaugccuagaugugauggauccuugucuuugauuggcuaauuagaaucaaucuguugaaggaccaguggcaguggcucacgccuguaaucccagcacuuagagaggcugaggcagguguaucacuugaggccaggaguucaagaccagccuggccuaccuggugaaaccccaucucuacuaaaaauaccaaaaaauuagccaggcgugcugguacaaggguaaucccagcuacuugggaggcugaggcgcaagaaucacuugaacucaggagguagagguugcagugagccaagauugugccacugggcggcagugcaagacccugucucauaaaaagaaaaaaagaaucuguugaauauuccuaacuuggaaguaaugggugaugcguggcuuucaucuuuuagaaagguguuuuuuccucugucaguaaaacuaagaagacaucugugugugcuaaggcgucagucuagcaagggcagggcacaaacccagagagagaauugggcuguuguuucacuuccaauaaaaaugggauauacaugggagguagaguuauaauucuacucaggauugacuuuauacaugcaauuggaugggucacugauugacuuugaggcaaucagggaugagugaaacugaucuuggggaggguggcaagacauguugacagguaagauguguuuuaauguauaacagugcgugguguguauuaaucaguuggaguugauugacugcguuuuauuguuuggaacauuccugcccaagggucagguaaauauacaaaauauacaaauaauacagauuuuuaauacauaaauaucaauuaaguagcauaauuaaauaauacauuguuauaguuguacuuaauguguauguaaauauauacaaauaauacagauuuuuaauauauaaauaucaauuaaauagcagaauuaauaauacguuguuauagauguacuucaugcauauguaauuaaauuauuaauguauaauauauaaauacauauuuuaauauacaaauaaaauggucuuaaaucagaguuaauuuaagaccguuuauauuaguacauaucuuaauauacaaaugaauggucuuaaguuaaugucauugaguauaagucacauuuacagauaugacauguguuuccagauaaagucaauggacagacagcuuccaacacuggaaaacauucaaaauauaugcaauuaauuuuauauuugaguuaaggcaaucauuuauuaaggaaagcaaucagauguuugugagggcuuaaacuuucgcuucauaaccaaagcaguuuccuuacaugaaaguugacuucuuaaaaagagaaguuuauuuuuuaugauggaggauuguugugaugugcagauaccuuccgucauuucauacucaucuaaaagcagccaaaugaucuuuucaccuuuggccggaauccuuuuauugcuaccgaguccugcacucauuaaaccagaugacagugcaugcucugagagguguaaaucucuaguccugguggccaguuaaauuccucaguaaauguuugguagaugcugccuaauaaaccaguccagguugccacugggaggauuaaaagaaguaaacguguauacaugaacagagagacagugccuuuucaugcuaaaugugguuccccacaucuccucugauuagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccaguaaguggacccuucuucgagccuggccaccuuucgucucucucgccacugacucugcuuuuuguaacagauugauuuuccugguucuugggaaugggccuguugcuaccacuaaccacauuucuguccacuucucuaauugcucagagucuccgcaguauguucaaucaugagcacaccucuccgucuuucccugauaaagcauggccauggauguguucucuuccuagcuguagcacauaugucuugcaauccagagggacuuuugagugcuucucuuuuaaacaaagcuggaguggcuguuuugucuucugcagccagccguuucugcaaaugcauacuuauguguuuguccguguacauauguguucauguuuaugcaugugcacuaccugugcagauacugucuaccacuggaagccuggcugaugcagcuugaguugcauugauaagguguauggcugugaugaauaccuuuaaguugguucauaacaugucuuuuauugugcugaugagggaaugugauugaauugagcucaugcaucucaaaugccggaggguagaagugcccgucuugcccccuccgagcucagcacacagacauuugccaggucaaacuucugcuucuucucuugaaaguagaagaaaacuuuugacuuaacgugagaaacuuucaaugacauaaggcucgaggaacauaauuuuauuuuuuuuguuuuuuuaaagacagggucucauucugucucacaggcuggagugcaauggcgugaucuuggcucacugcaaccuccgccucccggguucaagugauucuccugccucagccuccccagcagcuaggaucacaggcacaugccacugcgcccggcuaauuuuuuguauuuuugguagagacaaggcuucaccauguugaccaggcuggucucgaacuccugaccucaagugauccaccugccuuggccauccaaagugcugggauuacaggcgugagccacugcaccccgccagaacauaauuuucaaagucuuucucuugaacauuaagcuuuucauaauuccgggggauaaaaauaugaagucaugaugacuuaagugcaugaugaaauuuuccccaaagagguaauucucaggagguccaguaccagaugugagacuuccaugucguuaacagacuuccaagugaaauucccaauugugcuuauuuauuuauuuauuuauuuauuuguuguuguuguucaugaguaggaaguaugaacuacucaagaaguaauuauucagcucagcuugauaacuaaaaaugaaacucaauaacuguguauuacuuuuuugagagacuccugccuaauucuccgcuguguugcaaggguggcagccacauuuccugccugagauuccuagggauuauauaaauuguuuugcagcaagaucuuaggauuaagcaaaacaacagaagggccugcaccauuaauacccccacuguaaaggagcccaggaucuaagaggaauguaauggaaaagcuccuguuggucuccugccaucgccagugaaugagaugacugcuucagucccaugugugaacagguguaggaacugauaaccucaagggcuuuuuuuuuuuuuuuuucuggcucugauuggaugauugcagcuucuggaucaaaggacucccuucuucaguuucaaacaaagcagucaauuaggucagguauugcgaacacaauggagaauucuguugccugcagccuuuggaacaaaggccuuuuguuacagugauucucacugguuuagccggugggagagguuuccuggcagauuugcaacuuuuuucucccuuucccuggguggauucauuuucugaaauaucauguauaguuuuugguaauaagagauuuauuugguuuuaauuauuagcagugaugaauuugcuucaagagauuaaaauucucuccaccucaccccaguacugccaucccuucaccuaacacucucucccuuugaucaguuugggcugggagugaccagugggcaccuguccagguguccuggguggcacacaguuugcugaggguuuugcaaaaggucgaugcucccaacagagauguauuagaugaggcuagcuaugccugauuuuagaggggaaaggugacagaauaauguaugaagaaggcaaaggcugaagaucaguuagauggguggacaagaauaaguagagaguauaagccucagcaaacagccagagccgagagccacaugcuguccuaugaaugagugaaauaaauggaguuuuugugaaaaaaugcaucgaagggaauuggggauauuuggcacaaaaggagcaagaaauccucuucuguuaagaaaccuguuguuacucggauauacuaucagagacaaaauauccagcauucucaaauguuaacuucuuacgaaaauagaucuuauguuuauauguucauuuugguuuuguuggagggaccaaaccuaagugagugauuuuguuuguuagguuguuuuuuugucaguggacucgugcauuucagccaucauucccauguuucucuuuuuguuuuuaguuauguucucuuauuuuuuccauagugucccaaaguuuacucaagacuacccaggaaccucuugcccgagauccuguuaaacguacguugucauucaccugagggaagggaagaggggaggaggaugcugcuugguucacauaacuccagcaucaucaccuucuuugcaugguuuuguguuucuugaacaccugucuuaguaaaauguuucuucccauuaccuugcuuguaauuacaucugauuuugccagacagcuugagauguugggcuaagagcaucauugacuaaguuucuucuauuucugaccaauuuccuuuuuauuuagucugguuuuauugaauauuauauggacaacaucauuguauuguauuugccauuacuauuuuauuuccuaaaagcuaucaguguaacugagagcaggcuuagccucucacugcuuuugcagaacugaagaacaagggcuaggugcaguggaaggaaagugacuuuacuuagcaaagcuagcaauggggaaaugguccaggcuccugccucaaagcaaccaucucaaauuuuggauuaaaaaacaaaggcuuaaaaaggggagcuuggaaugcagggcaugaaggaggggugaggaggugcugcuauacaggacuuguuccaaagacuugaguuauuauccaguucgguaagugggcuggcgcaucccgcacaaucggguuguaaauuaacugcagccuugaggugaucuccugaugagggagaauucugaaggugccuaagucagucaguggaacuucuaagcaagcauuaauaauuuuaauaauaauuauaagcguaauuagauaauggaagcgcugugcagggagugccuggugggaagaaagagagcaaagguuaccauuucauuacuaaaacuggaaggaaaagaaaggaagaaagaucuuuaaaauagaguacucgguuacaucaagaugccaugauuuaacaagagacuauaauacauaaguaacuuguuuccucagaaaaaguacuuaauauucaugguauuguaguacauggacuaauucguacacgcagauuucaauuuauguguguuauaagacccgguuucaacuuuagacaugaagggucacuuuuagacauuaggaaccccucuuucuccucucccagaaggcauaaugguagguuagaggugcucaccuuuugacuaggaaguagagaaagagccuccuauaaagaaaugcauuguccagccacugcaggccuuacuuacagugucuuauguuuuguuuuuauuucaguuguaauaucagacgaguuuaguuuuaaaaugugguuuuaguacucauauuugaauuuggauuccauccagaaauagauuuauccaguguuagguuagggaugauauaugccauuuaugcuuaugauugcuggaagaagaggcacaauuucaguuguaacuuagauauuuuauaauuagcauuuguguacauuauccugaaaaaaaaaaacccucaucucaaaacugaugaagccaguuaucuuuuuuaaagaugauaaauuauagaugaaggauuagguauuuuaaaaaagacugcauccuaaacuauaaaguuuuuuaauggccuccauaaaauauucagaauaauucacauuauguauaacuuuugaaggaugugguuuguacugcugcaacauaaacguuucuuuugcuguugugaaaaaagcauuuuucucuaaaaacacuguaaguacagcaaguggguugacagacuaggaaaaagcucuagcuauuccacuauaguguugacauagguacgcauguugaguugcauuguaccgagcauuuucacagaucauuuaauuuuucuucagaacacuuugugggcauuuuccucauuccuuuuguacauacgagaaaaaaugaggcuucaagagcuuagugacuugucccaagccaucgaacauggcaggaccaggcuuugaaacccaaaaugacguuuuggccgcacuccacaccaaauggcuaagcauugguucugacauuguuuugccgguuagugaaaucacauuugcgauucagaagcacauuuuaagaauacagaaaacagugaaaagaggaugaagaauguuaacauuuuuuccuaaaugccaugaauagagcacgcaucaguaaauuaaaugucuuucccauucuuuuauaaaacagugauuauuuuucucuuguuucauuuuagcauuuauaagaauucuauuuuuccauuuuuaauaacugauggaaacaagcaucauugucugauaaauuuauuuucaugcuguacacguaacuaccacuuucaucauccacuguuccaaacagauacugaaagucucuuuuguaauuuucuccuucccaguaauuuucuccaucuacuugcaguguauuugggauccugacaccuuuccauucuaggaggaugaagugcuuugggcagcuauauuuucuugucugccuacagagacuauucaaucacagcaagugaaggguuuugcagugcuaguacaaacagacaaggaaaaaaacauauaauuucuaguuauuuauagccugugcagcuauguggucuuauuuauagcaaacugcacauuugauuugaaaaagucauggucaucuggaggucaaauucagauggcagacucaauucagagaaaaggagcugaacuagaagguaagcaagccuguuagacugggcaacuuggacuugacuuugcuccuucaacaaucuagagccaguuggaugauauuucugcacaaaggugguugguuuuacagguugcucagucuaagcugcuucuagucaaauaacaaaugugaaaggagauagaaaaagcucuucaguugaacugauaaaagauuacacuuagggagaaaauguaugaugguuugcauuauaaaaacaauaauuugccauaaaucaggcauuucuagguuucaaacuuuugucauaaaaaccaauuuugagcauugcaauuuuagggacauauuuuauuguuguuauuuuaaauaaaaaucuaaaccacaaauauaaggcugagagcuuucauuuuauucgugaacauaggaauucaaaucauuaaaaaaaaacccuuucucauuugggauaaagaaucuuacgagagcugaguuaauuucugacauuaguuuugcaccugcccauuuggguuuaggacagugcaaaagguuucacauuuaaucuucaaaauauaguauuuguagacaauaaaauuauauaaauauuuguggauucauuuauauuuuaaauaugagagugugaccauuuuuuccuggugcugucuccaucagacugcaucccaaaaggcaaacagaccaacuccuuaauggcauuuaaucucucaaagagcaucaugccaauuuuuagucagcagauugcaccaugugaucuggccaaagugugucccaucucaggcuccuucauuugcgcugacaugugguacaaacaacuaaaccaagguuucucaaccucagcacuauuaacauuuugauucaaauaauuaauuuuuaggagucuguccuaggcauauggguguuuagcaguaccccugaccccuacccacuaaaugccauuaacacaacuccagcugugauaacuaaaaaugucucuagacauugcuaaaugugcccagggggucacauucugguugagaauccuguucuagaguaguaguuuccccacaucugacucagagauagaacucuccugguguaaacacguguacuuuccacaaauuugggggcauguugaaauguuagaaugucagcaucauccaauucucgacagauguuugaaauugaauuuguuagacuauuguccaagcucucaauauuugcaagguaaaguggaaguugcuguugcuguccugacuauaguauugaaggucucguaguuuuccugcucuaauguaagcuacuguggcagcagaagagaaaccagcaaaucccuuaguuugaagucauugguucaccuaugcaccaccccuuucuccucucuguuucaucuuaguuuccuagaaucccaggauaugcuggaggacaaccaucuguagagauguccuauagucuugcuacacagguuauuuguacuuuaggauuauguuugauggccuuauaguuugugcagagguguaggccugaccccaugcaggauugagggagggaaaaagauugauuucuaggcacaucagaaugguccagaugacaugaaacagacugguacacuuacagagaauaugaaaagaauuggaacuuaacaagucaggccccaaguuccauccccagguuccaaguuuguugccgcagaagcucauaauuuucaaaucguagaaaacucacaccacgcagccuuucaauggaauaugccaccuuaaccccagggucguuguaaagacaggagccauaagacagaagucugaaugccuaggccauuuaaucuuuggccaaauuugaacuauuguucuuaaucacacuauucuuguucuuuucacugugcaguagcaaauguuaguucccauuagcacauucugcaauaccauuggaacuaaaacugccaaauuagauuaggcaaccugggauuacacuuugcuccccaaccaaccuagggagggagaacaauuuuaaagcauuaaaagaugugauggugaauuaaacuaccugucacgucagugccaguauauucuaucagauuaacaagugugaaaagcuaaaucuuugguaucuggaaaugcuuagauaggaagaauggcuuuuucuucaaagccauaauaauuagagaugacccuaaaauugaaaggaacuggauugcuuagcaacucagcauuuuuuaaaaagaagggccaucuacuuugaauacagguuaaauaucucuucucuaaaaugggaccagaagugcuucagauuuuggauuucggaauauugauguauucaugaugaaauaacaugaaauucauuuauguuucauguacaccuuauacaaaagucugaagauaauuuuauacaauuuuuuuuuuuuuuugagauggagucucgcucuguugcccaggcuggagugcaguggcgugaucucggcucacugcaaccucugccuccuggguucaagagaucccccugucucagccucccaaguagcuggaaugaaugacaggcgccugccaccacacacagcuaauuuuuguguuuuuuaguagagauaggguuucaccauguuggccaggcuggucuugaacuccugaccugaagugauccaccagcuucggccucccgaaguacuucgauuacacgugugagccaccacgcuuggccuauacaguauuuuugauaauuuuguucaugaaacaaaguuucuguacguugcacugugagagaacaaagguguugcuaucccagccaccaugaugucaugucagugcucaaaaauuaucagauuuuggagcauuucagauucucagauuagagauguucuaccugugguaaaagaauguucauuaugucucugcucuguuguuuagcuauuugccaaaagaggguaaguggaucguuuaauaaaguggucagcaaauauuuuucauacaaggccagauuauagauauuuuaggcuuuguagaucaugcaguuugucauaacuacuuaacuaugcagugguagcaugaaagcaacaauagacaauaaguaaacaaauagacaaggcuguguuccgauaauacuacuuuuauaaaaguagccagcagcugggugcaguggcucacgccuguaaucccagcacuuugggaggccgaggcgggcagaucaccugaggucaggaauucgagaccagccuggccaacauggcgaaaccccaucucugcuaaaaacacaaaaacuagcugggcguggugaugggcgccuguaaucccaccuacucaggaggcugaggcaggagaaucacuugaacccgggaggcagagguugcagugagcugagaucacaccaucgcacuccagccugggggacaagagcgagacuucaucucaagggggaaaaaaaagguagccagcaagcugauccuugguuuaauacagcagguuuuuuuauuuuuauuuuuauuuuuuuuccaauagcuuuggggauacaagugguuuuaguuacggggaugaaguguauaguggugaugucugagaguuuaguguccccauuucacugaguaguguacauuguacccaauacguaguuuuuuaucccucuccuccuucccacucuuccucauucugagucuccaauguccauuaugccacucuaugccuuugcauaaucauagcuuagcucccaauuuauaagggaauacauacuguauuuccauuccugauuacuucacuuagaauaauggccuccaccuccauccaaguugcugcaaaagacuuuuauuuugugguuuuucuggccuacuaguauuccgugguauauauacaccacauuuucuuuaucccucauugguugaugggcacuuagguugguuccguaucuuugcaguugugaacugugcagcaguuauuuuugaccccaggaugugcgaggccagguauuuugagagacaccagcaaaggaaucugaguacuggcuaucaauaccugauaauuuuauuaaugaguugagacccagauaugccguagagguaaauaaccauauaaaggaaauauagaaguguaggagaagauugcucuggaaggcugggguaaaaugaaaucagcuuuauccuuaagaccuccauagagguuaacuguaccaucuccuuuuacugcuacaguuuauaugaaacuggacaauauugaagauuuugacuuuucgaacucaucuauugaguguugagcagcuaugacagguuauuucuuuaugugccuccauuaacgaagucaagaauagcuucugacaaauugacaaaaaacaauaaccuaagguuaacccauucuggacgccaguuauugcuauugcuucacauauauuuuuuagauucaaacuugagguugcuuuuaaguuuuagugugaugugcugaauagagaauagauguuaauaaaaaaauaaugccagcauucguuccuucacauucaguucauauauuugaaaaaauucccaugucaguauguguccauggacauaaaaaagaaauguagcuugacuagaguaaacacaucauagauuauauuuuuauuaccuuauguccaugugaugcauugauaguguucuccaccaacuaugauugcacugacuauaaaauuguaauacaagggcauauuagggggagaaugccuuuguuuuuucuuuuguuguuauuuuguuuuuaagagagucugguauuacacuggaggaucacaaacuguauuuucuuguuauaaauggcuccucuaucuuggacuuaaugguuaggauaaauauuugaauguagaaugcguuaggaguuuuaacuauuuuugaaauuaggaaaauggagagacacuuuuuuuuuuuuuagagacacuuuuuuuuuaaguuauaauaagcauggcacucggaaagcucugccauguuucaagauuaaaguuucacaugaacgcuaacaaguuuauauuucacucauauauaaaugauccuccuugucuccuuuccuaaauuauagccaucucaaaugacaacauugcugggucgguaucaaauagcauuuucaaugauaaggcaaugauuuauauaggucuuaauuuguuuuaaucuucuguuaccaaggcuguagagauaaauugcuuuucugcugaugaaaggagacuaacccaauuuucuuguuagaaucuaauauuaauauaucgacugaaugccauucauaagccuugguuuagggaaacauucagccuucuggccuguuggagauggccacggucauugcuguuugaaggugggucauuucuucuuuuguguccugaguccauugugacuguaaaauuaugggucaccccagaagccugaggaaacaaaugcauaucaaaaugauaggggcaaucuuucacagugccuuuaauuuugaccccacauucuuauaugaaugugaaguaccacauuaguaugaauaugaaauggagugcuccgcaaugauuacaaaaucagaacuaaaaugagggaaaucagugcauguacaguucaacuuaauggauuauccucuaaggagucuucagacaggcuaggagagugacgucugccucauccugaagauauuagcagguuuuccccuguuuuaaaguaacuucccuucaaaugcuaacaguuuucucagaggaaacacagguauggaaaauguuucguuggugucuuggccccagugauggaggagcauuuugugauaggaacguugggugcagcaucgccauuuaugaauaaacugaaagcuaaccuguguuacuucaccccagaaaacagagcucuggcagguauugagaauagaucacagugugaaguggcaguauugugacaagcaugcguguaucaguauuaaaauugaaaugagcccucacgcacaugugaaagcaguuucucccguuuucauauucaguucccugagguaauacagcauuuuggugugagagaaagaagggaaucugacccuucucgugugggaagggggcugagggcaacaaccuccugugacagccacccugguccaagccaccuucaucuuugucuccuuuuuuuuuuuuuuuuuuuuugagacagaguuucgcuguuaucacccaggcuggggugcaauggcacaaucuuggcucaccacaacuuccgccucccggguucaagcaauucuccugccucagccucccgaguagcugggauuacaggcgccugccaccacgcccagcuaauuuuaguauuuuuaguagagacagaguuucuccauguuggucaggcuggucucaaacuccugaccucaggugaucugcccgccucagacucccaaagugcugggauuacaggcgugagccacugcacccagccugucuuuuccucuuaaaagaucuuccuucuacuuuugucccauagcagccagagugauccuucaacaaaacgccccaucacauauacucccccucaaacagcccacgcuggucccucagaauccuuacuguggcuuuaaggcuguacaugaugucccccauuucuucccugccucucccacuacuuccucucuugcuucuuuagcucuggccaugcgggucucguggaauuugccagccagcuucaacucuuagggcuuccgugcuaguuuugucaucugccugccauguccuuccagcagccagcugggaagaucugaaugucaccuccucacuuaagacucugccuggucgcucacuuacugcggucuaccuuuccccucuccccucagcucucccgauccuucugaacucugcucuguuuuucuuuuuccucuuuuucuccauaauacaaaucacauauuaacaauaugacuuacuggcuuuuaaaaaauucuugugguaauuguuucuuucccuagaauauaauuccaccaggaucagggccuucauguuuuucucauugguuucucccaugugccucacauauaauaagggcugcaauguuggugggcuggaggaauaaaagaaugaacaggcgcacuaaaggcaggauaguuuguccaugucagagcugcugucucagcugcuuugauaccucugacuucccaggguggcaaagaauaaggauguggcuuauguagaaggcguuagucauccaaaaugccacuguauauuuggaagcaaauauucaccuugaagcagugauguacuaggaauuagaacugcuuuucuguuacauuuuuucauuuguuaugaguguuuagauacacaugaucacuauuaaaaggaagggagguaauagccuauauauccuaccaugccccucaaggcucuguuaggagacuaaaauacaaaggucauuuaaaaaguuaaaagcuuaugcaugugauguugguauugcugcuaaugacuaggcaucuagaggucaaaaccuagagcuaaggauauugaacccuguguuuugucucguuuuaagucuagguuuuuguggaggggggaacauaccuagccagcuugcuugcagaaggcaugagugagcaggcugaaggagggacccaaggccagaacguccuccauauucuagcuccaugggcucuuucacuugaucccugcuuuaugacccaacuucuguugaaggauuugccagauaguguuuggggcaggaacagcuguuucauagaaaacaagccaacggacaucauaacaaagcauaugguuguuuugccaaguugugcugcucauuaacaaaacaaaacaacaaaaacccuuuacagugccccagcauguggauggauuggcccuuuacuacucuaaaaauuagcuuuacagccuuuuuauggcuuacccaaucuuaacagacuuuauuuguguguguuuagggaugcaaauggguauguuaaaugauaguguuuugccucuacgcaauaaaauaggguaauuuuuucuucccauguauuaaacgagaacacagaacaugccuagcauggugggcucugaugaaaagaggcuguuaucauuuggccaacauggaaauccuagccuuuauuuauuuauuuauuugagacggagugccaacauggaaauccuagccuuuauuuauuuguuuguuuguuuguuugagacggaguuucgcucuuguagcccagacuggggugcacuggcaugaucucggcucaccgcaaccuccgccucccagguucaagcgauucuccugccucagccucccaaguagcugggauuacaggcaugcgccaccacacccugcuaauuuuuuuauuuuauuuuauuuuaguagagacgggguuucuccauguugaucaggcuggucucaaacuuccguccaccucggccucccaaagugcugggauuacaggugugagccaccccauccggccgaaauccuagccuuuaucagagguuccguggaaucucagaggucugugagcaggauaaacugcuuuaugguaguuuaaaaugcaaaaccagaaauaaacccuccuaaagccaguuuguuuccacuuucuaagugguuacagugaccuguguuuuaaguaccuuaaauauaucagugaccugcugauauacagcuuccuguuuccucuguguccugugacauauccugacauuccuugagccccacucccuucccaaaaggaaguaccuugaugggugaggacauagggcacacgugucucuggccuucuguggacauaaucacaaaaugguagucaguccuaugaauuuaaucucuuuaggauauaaggauauucacgaaauagaaguugagcucucuggacauacuccaccuuaaaauugcucucuccuuccgggauccucaccagcugcagagcaguaguaaugaacuauuaaauucauuuaacaauaucagcauaugcuauccuucucugcuugacuagacaguaaucuggcuugcugguugguaugaauauaggauaauuucacucacacuaauugagauggggaguuuguaugaauggcugaaaaauuugaguuaaagauaaaaagagacacagcuuccucaacuaugggaaauaacugggacuguuaacaaagauuuacuugaagagaaauuguauugcucaggguucuccagagaaacaggaccaauaggauauauauguauaggaagagauugauucugcagaauugacucacacaacaauuauggaggcuaagucccacaaucuguugucugcaaguuggagacccaggagagcuggugguaugauuuaguccaaaucuaaaggccugagaaccagggaagacaaugguguaaauuucaguccagggagaagagaagaccaauauccugacucaggcagccaggaaauaaaaagggugaacugcuccauccucugcccuuuuguuuucagacccucagcagaucgggugauuccugcccauguugaggagggugauuuacuuuacugagugcaccaauuccgaugcuaaucucauccagaagcacccucacaaagacacucagaaacaauguuuaaucugggcaccuugcggcccaaucaaguuggcacagaaaauuaauuaccacagaaauauuucuggauucaauggauuaaguugguaauauaguauucauauucauuuccacgugccuaaaaagaagguuuuuauccuuuuuaauauccucaguccuauuaaacauaccucacauucauguuccaugguuauucucuuauuauguugcuaagugcauuucuacuuaggccaaucugauuauagugauucagauuauaguguuuaucuucuuuccuuuauacaguagacaguguucgcaaaccauaggagcugaaaaaauuuccuucuuauauaguaaguuuuaugauuccaguuuuccaaaggggugcuuauguuaugguuauaacaguuacagccagaugacuaucuucaucagcagguauaaccccaaauauuuauacauuuucauuuguuucaaacauaaaauaugguuugccuaaacaugucauucugccagauuggacuaugcaaaagaauguuacuguuuuauuuucugcuuuuacuuuaacuuguucucauuugagcucuaccaguuaagaugagaagaugacuaaagcuagggaagcacauuuuaaaugcuaaauaccauguucauuucaaguugggaacuugaaaugcaaguauuuuuaacuuaaucauuaaguuaaagucaguaagaacgugguauuuagcauuuauucauuuuaacuuaaugauuaaguuaaaaauacuugcauauugguuugcuugaagcuauggagaaaaacauuuaccuuuuuuccaaaaaggucuuaauauucaaaauuauuguuucaaucuuacaaauuaacaauuuacuuauuuuugauacuuucggccuuuuuuaugugggcuacaccuaacauuuuuugaaaaauacauacugcuuuuccuguagguugcacuuugugauccuguguguaauucauuuucagugguucuauuuuauuuauuuuuuguuaguuuguauuuucuuuuguuucuuuuucucaauuuuuaaaauuuuaaaacuuguccuuuucuuuuuuuucuuuauuauugcacucuucuaccaaaacauuuucaguggcuuugaauaaaaguaucagaacuuucccgugguuagcauuagcucugagauuugaacaggauguauuaagcagaggaggagggaaggccacuaacauguaugagcuccacugugugucacccucucugccggaugacuuacaugugguaugguaucucauuuucccagcucuccuaucauguccugcggcauguuaucaccacuugauaaaaaaauugaaacauggagugcuuaaguuuccugccccaggucacagcugaucugaaaaagaaaugggauucaaauccaaaugugcuuaauugcaaauccccacaugacucuuuccuuccuuccuuccuucccccguugcugccaauguaagaaggaacaccacucccucauuugcuacagagaagacaggggcagcuguguaaaggcaccaggaauaugcccugccuccuuccuuccacuugaaagcaacaucuggauagacacucaacugcuuuuauuuuuugaaaaaugauuauuaaucaggauugaaguggagggaaaaaaucaaaacgaauguuucuuuuuaaaaugaaagauacuguuuaauuauuuaacagccuuccgguuuuaguuaauaucuuugaagacuuuggauuaagauuccagacauuuucuugaaggauguagaaaacguauuuaacuucaaguuuaguuucaaaaugacuuagcuaucaauucuucucauugaaguccucuuugagauauuauaucccaaauguaauacacagguaauaauucaauaggaauacuuggaacauuggugauauuugaauaaccuuuugaaugaaacaauugauuugaucucaaaagauagugaaaacgucucauuuuguuuuuuauguuaaauaugcuuccucuuaagucaaaauucuuuuuucuuuuugcuuuuaagcucauaaauacucugaauucucacuaaucuuuuggaaaauugcuuguauagguauuauaauucacuuggcucaugaguuacauaauauagcaguauauguugcaauucaaauauugcuuagcaguauuaguugaauucaaaauagaaaucacuuucuuuuugacaacuagcauaaugaauucauugacuauugucaaauuuaugaagacagaaaaguccuuuugugauucaaaaauguguuuauugauguuuauauaucuuuugucguguuuccauacugucucaugaagguugucuucguaauucaguuaucuaaauacaucauacauuuaccuuuucccuggggugccguuauucuacaacaggcuaauuacagauaucugugguuucugcaggagucuuaguguaugauauugaugauaucaucauuuacuuucaaaauugcaaaauaguaauuuaggaaagcauggggauuuggaaaaacaugucuucagcaccaacuguuuuugcucuuugcaugcuuguuucguaaagaacucuaaugcuauaauugcaaaauggaccauuuuaaagauuuuuccuucauucuguacuugggaguggugaaagacauccuuacugugcugcacagugucucaugguguucucuuaaacagcauuaacgucuuguaugcgcugcuuuacuaaauucucuguucugagaaauaacugaaaauacggcuuucuauuaaacgaguggauuauucuguuguuguuggcuuuuuuuucucaaaccuccuucucuucuacuuuauaguuccuacaacagcagccaguaccccugaugccguugacaaguaucucgagacaccuggggaugagaaugaacaugcccauuuccagaaagccaaagagaggcuugaggccaagcaccgagagagaaugucccagguaagucuggcucuuccaucauucagcccuacgauauugggaaaccugagcuugccucugccucagucuccccacaggccugcuggcuuuaucaagaucuuuaaagauguaaaguucuaauuuuaaauguuuacugugugggcacaguuuguggguuuuuugcauccuccgugaacaugcugccuaggaaggauccagguauaguuggauuuuguaagcacaaauuaaaugaugucuguaacauucucucuggcgaagaaagguacuuggcauuauuauucuguguauauguaguaccuguaaucaacauguuguaaauuaaaauccaucaaaaugcucuuuaguaaagaugagguuuuguauuaaaucccagacuguuauaauugugaaccuacgauuguuuacagucuguaaaaucauagagacuuaaaacugagcugaaccauagugauuauuucaucuagucuccuaagugauacauaguggaauagagguucgagagaguggcuucccauuuuagcacaaagcaaaaucagugagccagagacaacauuuagaauccaggccuuucuugcuccuaguacaguacuccuuucauuauacuuugcugaaaaaaaaaaaaaaaaaaaaaaccuguuuugguuugguuuguuuuuuuuuagcagguccuuaauuaagcaaauuaaaaaauaacuuaugucuaaaacauggcuaauccauauauacuaucaacuacaauugaagcuaugucugcuaccaggcacuggauguuguauuggaguuugauaauauggaggauuuuagcccuugcucagauuccucauucauucauucauucaaucaacaaauauggacuuauuauuuuccagucacuuuucugauuuguagucuacaaaccuaggagugaauguggggggaaaagaaguaggacauaaaagugaaugaauaaagaucucagguuaaaguaagccauucauuuuuaguguuaauauucuguggcaaauaucagaagauaggagaaauuuuugucuuagcacagaugcuuaaucucuugagagacauuaaaugcaauuuaugaauuagacugcugcguauuuucuaagaucacagucagucuuuaguagacaauuaaucuuuccuguaauuucugaucugggucccugcugaccccaggaagauuccucccucccagggccaaaugaauggccccugagcaugucuuucccaugcaaaccagucaaucaaaagcuccuuacucccaaccaccuucuuauacucugggccacuauucaccugcucuaaucaccccaggaccagguaccagaccacuagggacaaccucaugccccaucaccauuauuugaacuaaucaguccuaaacccgccuacccugcuucgcucauucuuuccaugaaaaccacaauaaaaggcucuugcucauguuuuccccuccugaccaacccuggugcuucccauaugacccugcauguaguggcauguaccggcuucuugggagcugaguaacaaacugucuuuuccaugauaaucaucuccugaccucuuggccucaccugaauaauaagaaaaucuacccuugaaaacauaaaacuaauaguuuaucuagaaagguacaacacagguacuguuuuuuguuuguuuguuuuguuuuuuguuuguuuguuuugccuuaagaugaauaacaauacuuggaucuacuuugguauaauaacauaaagaggaaaaaagccuuauaaucacaguacuuuuggcucuggaauauaaugugcaguucuaguggcugcccacgaugaaaaccuaacagcuaauugaacuagaaagcuagccacagggaauuauuaaguuuucaccugaugccaagaaaaucagaucuuuccuuaggaaagacacaggcacuguucggaaagcauuggaggacuaugaaucauacuuauugccacugaaauguccucauuugaauuuacauccuaucucccuucuuuaugaagcuuucagaggcuuccugugcccucacaaauccacuucugggcacaugaagucguaaaaaaagaacaaugacaaaaauaaacaccgaaugcucagcuugucauuuucagcgccuaccacuguacccugacucuggucuuccuaccaccucuuccuucucaacugcuacccuugcuuucuguacagcguuaagcugcuguucugaucaggccacucugcucaucgucuguucaucucaucuugggcuucccuuugcccuuggcauugaguucuucuggaaaugcccucccacucuucuucacgcugacacaucucacccauuccuuacaccccacuucauacucagaaugagacaggcagucauugcucuuaccuuucauuuaauucuaaauauuugcuccccgguuuuguuagugauuucuggacacaccugcauuaucuuuccaagcuggauagaaaccuugagaccucaagucaugaagccugcuaccugcauucaucguggacccacuguagcauuuuuuuuaauguguguuuuuuuaauccuggauuuuuucuccuaguauaucuuguucauuuuugaccuuauuaagaaaacuuauuucaaauucucuguuaguuuuagaugugacaggucuucuuuaaaauaauaauuuaacuuuuagcacaucuguguaacuugugacuuaguucaugauuuuguagauuuuguucaucuuuuagucaucagauauaucugauauaaccuaagagauguugucccagagcagagaauguugucuacuagauuccaguggucauaggaaugugagacaccugaaaucaauauguaucuucauagucuguggugcugaaaucuagggacuuuucaacuuuaaacuugccugccucuuaaaucucuacuuaguaguagucauuuucucugcaugaaacagccaagucuuugaagauugauaaauccaaaugaaauugauaccuuugugccugcaguggaaaauugcuuuauaagaauccauagagccacugcaagggccagguccugagaauuuuaaauuuuaaaaauugugcgguuuuuuaaauuaaguuuuauuguaguuuuuguuauauguuuucuuacaaauacagaggauuuuggaauuuuuucauauuuugguuuguuguugccauuguggaguauaacucuaaaccuguagauuuuuguugcuaaaccuguagauuuuuguugcuauaugucgugacuagcaucuagucaaauagaaaucuacagcugaaccaugugugagcacuuuuauuacuuauaaacuuacuacuuuuaguauaugcuuaaaaugaaguccuucaaauugaaagcugacccaacucauagguuuuuauuucuuaucuuuuuuggagauggagucuugcucugucacccagcuggagugcaguggcacaaucuagacucacugcaaccuccaacucccugguucaagcgauucuccugccucagccuccccaguaacugggauuacaggcacgugccaccacgccgagcuaauuuuuguauuuuuaguagagacaggguuucaccauguuggccaggauggucucgaucuccugaccuugugauccacccgccugggccucccaaagugcugggauuauaggcaugagccacugugccuggccuagguuuuuauuuuuaagauaagcagcaacauuuuaagagcgccccuuucuccugucacuaaauauaaauaaacuuagcucaccuaaugaauuuuuuauuuuauaauaaaaaauuggguaccacaggguacaaaaacaugaucuuuagagccacagagaucuugguuuauauucuucccucucccuuuuuuaccugcauagccucgagcugguaccuuaaccugguucguaaaaugggauggcccuggcuaaucucacaagcuguugugaggaaucaauuaaauuagauagauuuuguaaagcucuuaauacagggucagcaguaaugcuacuuguuaucagucccacagugaaauucacuguucacagggagauggucagccuacauauaguguguauucauuugcaguagagucuuagugggauggugcaggugauuuguuuauuuguggggguauaggauauuguuaaauuguucugaaaaucaaaaugugaguuaauuucuauaguaaugcuuauuugcaacucauuagcuaaauaaaucucuuuaauuauuucauggauucccccagcuuaaagcuuaaaguccaguuucuuaaaguguaugagguaaaauggaaaaaauguaaauguaauaugggaaaucaguucucacauugcaguagaacauugaacuucuaucucaaacuaauuuugagauuccuugcuugaagaauuguugguagaguaccaccacugugaacauucccaaagcaggaaauugaaauauuuauauugcaaggcuuaucucaucuauaaagcaaagauggucuuccauuucccccuugcccacagguucccuuuauuaacgugguagaagcaccaaagcagaugggacaauauguuucuuuucuuccauguucuauucuuguucauugcagcagggcauuugucccaauuuugcugugaaccuugagauuauuuuugauaugcuuuucaaguguaaugaaauauuuauuccaucuuguuuccuccaugguuuuacaaaaacaacaagaagaagcuaauugccuaucauauacaaagaaugaaugccaauggacaauaaaaucuguaauuaggaacccacauggugauuugauauaguauugucucauagaagucuucuaucuauaguuauuuauuccaagccucuuuuucuuucccaucuugaaguauguuagaagagucuauuccuuaaggcuaaguaccuacaaaaaacaggcucuuauaauacaguaaucaaguuuucucaugcuuugggaguacacagaguaugcaaguacacaucuggcaccaaaccaauauuuuguuuccuugaucuuucuucauuuuaccuaguucagaguugcacuucaaacaaauucuacuugucauacacuugaaaaggcagcuguaggugguaggaaguuaauauuuucuuugaacaacauacagaggugcagacuuuuacuuuuuguaucagguuaaugagugaacuucucucagggaaauccaggugaacaucaaaguugagagcaggaagcauugauuuccuacaaaacacauucaccugauaucuuagucaguuuguguugcuauaauagaauaccccagccuggauaaucuguaaagaaaaagaaguuuaaaauucggcucucaguuuugcagguggggaaguccaagaacauggugcuggcaucuguugaggacuuccuugcuguaucauauaugguggaaggaagaagggcaagaggagggcaaaacugaguuuuauaacaacccacuucucacaauaacaaacccacuccccccauaaugauacuaauuuacucaugaggacagagacugaaucaccucuuacaggacuuaccccucaacauuguugcacuggggauuaaguuuccaacacaugcuuuuuagggguuacauucaaaccauagcaguugguuacuaaauuagugcuacuuguaaaaaaauacauguuugcugcauucagaauauuacauguuuucuuggaguuuuuggaaggacuuagcguaauccuugcuguucaugacuuagguuggcaagcucaaagggccuuaauuccccaucaguucuuuaaagggggauaggucuuaggauauuagacagcagaagucuucuuuuucuucccccauuauguacugcuuuuuggcauuguauucaugacacacacacacauaaaaugucauauuuucuuuaaagucaaaauauacaguuuaaaaugguuucaguugcuuucauaagagaguaaaacuuagguguucaguuuaauauuggaagaccuuguucaguuaaugugugccuuccaugaauaguugguauuuguucacaucaaaucaaaugacugucaguucucgggguaaaaaaagaccaaccuugacucaaaaagcuauauuccugcaauaaauaugaacauuuauguuuaauauacugcugugauuaauuauuuauauccuagugggaggucaaauauucuucagauaggaagggguauguaauaaauuuuuuaaauaucuaaaaugacaaaaauagaggaaaaacauaaucauccauccuauuaagucuguauucaaaggaugaacugaugauuuuaaauucaaauguuuccuuaauuuauaggucaugagagaaugggaagaggcagaacgucaagcaaagaacuugccuaaagcugauaagaaggcaguuauccagguaaaaccugaacccauuuccuaccaaacaucacaugccagcagucuuuuuaaugagugucugcagguuuaccuuuaucugccagcaccucacgugugauuguucauagucccaugaacuucagcuguucuuaaucauugucuaguaauugaguuguuuaaauccugccuuauauuugcucccaauuauuucaaguuauaauucauugccauaaaacucacauuguaacuugcaaucuacuuuuuauuaauaauacaucuuuucagucaccacaaucuucugcugcuucucccuccagcaaaaauuaugagaauuugaauuuuugauggaaaccagucucaaaauuaccuuaaguaaaccaacaguuuauuauggucaauuacuugagguacuguuaguaagagagggauuuuuuuuuaauauguaauauaagaguuucaagagugcauauauuuauccaaaguuauuagucaaaucagccuucagagagccuaugaaauacugauuuucaaugagaaaguagguuugaugaggguuggagagugcaagaaagugaaguaagcuauaaaacguagaauuagucaauguuggaaugacuaugcagucuuuaggauacuuuuuagcacuagaagaaaauggaauaggaugucuuuuuuagaagacuugaaauugcugcuucauccuacuuauucaguccccauggacauauguguuuaugauggcagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggguaggucucgcugcagccgaguucacacuucaggucacagcacagacaguaaggguggggcacugggaacuggaagccauacaaaaagaaugaggagaaaugccuugagcacuguuauucagagguucaaccccuguccauuccaucuugaaggucaaagggucacagggcagcuaccuccacaaggucaucucuacacagcagguacucacacuuccccacagagcagccagacaggacucccagggacucacauugcaagcccugacuugauuuaauauuccugagguggugacaauugauggcauaguucaaguucgaacacaaaagcuggaaggaugucuuccagucccuucaggcugcuguaacagaauaccauagacuggguaccuuaucagcaacagaaguuuauuucucacaguugcagaggcugagaaguccaagaucaagacaucagcauacuugguugucuggugaaaguuugcuuccugguucauagaacuuaaauuuuguuuaucuuuuauuuauuuuauuuuuguuuuuguuuguauuuugcuguauccucauaugguggaaugggcaagagagcucucugggcccucuuuuauaaggguacuaaugucaaucuugaaggcucugcccucaugccuaauugucucccaaagcuuucacccucaaauagcaucacacuguggcuuagguuucaacauaugaauugggggugggagagacacaaacauucagaccauggcaaaggauuuuagaaguaaccuugcccagcccccucaucauguaaguauaauaauauaacuaaggucaaggaaaguugagauuuggcugaguuguaagaauuuuuaguggaccagaaagaauuagaacucaaauuuccaucucagagcaguggccauauucucuguggggaagcauuugucagucaugacauuagcaaugaugagacuuauucaugguuuucagugaucauugccccaaaaaggcauguugagugguacaggcauagauguguucaccggcauucugugggagagcuuacuuggaauggaaggaacuuucugagcaugaguguguaacuuauguccacuuguucuuuuuuuuuuuuuuuuuuuuuaaaugagauggagucucacucugucacccaggcuggagugcaguggugcaaucucagcucacugcaacuucugucuccuggguuuaagcaauucucaugccucagccucccaaguaccuaggauuacaggugagccacgacacccagcuaauuuuuguauuuuaguagagacaggguuucaacauguuggccaggcugaucucgaacuccugaccucaggugauccacccaccucggccucccacagugcugggauuacaggcgugaaccaccaugcccagccauuuguucuuucuguuugucauugagcaagggauauugaaagcucugccugugauuguggaccgggccauuuuucuaaacagugcuaucaguuuuuauuuuguauaguuugaggcuguguuuuuaggcguguaaauguuccaggcuguuaggcccuccuugagccucuucuuaugaaaugaucuuuuuauccuuuguaauguuuugcuccaaaaucuacuuuaauauuaauaaagcuauuccagcuuucuuuugauuaauauuaauguggugcauuuuuccauccuuauacucuuauugaccuuguuugucuuuauauuugaaguguauuuuuuguaggcagcauguaauugggucuugcguuuuccuuuggauugggaagaccauguacacugaaugagguuauggauaugguugucacugaaucugucaucuugauauuuguuugcuauuuguccagucuguuccuuguucuucuuuuuuccucuuuuuuuuuuggauuaauuagaaauuuuuuaugauucuauuuuaucucuuuuguugguuuguaaguuacaacuaguuuguuauuuuacugguuuaucuccuuuguggguuuauaaguuauaacuaguuuguuauuuuacugguugcuuuaggcuuauagaaaacauucuaaacuugucacgaugauguuaugucaguucaaaugauauuauaccacuccacagacaguacuuuacaaaaguacuuccauuuuucaucucucucucucucuguaagcgguuguugucauacuuuuuccuuacuacauuguugauguuuuucuuuaaacaguuauuuuuuaaugaguuguaaauuuaaaaaaaaaacaacauguuuacccaugaagucaucauuuugggugcuguaaacucuuugcgcagauccagcugguaucauuuuccuucugccugagagauuuccuuuaaaaugucuuagagacugggcuugguggcuuguaccugcaaucccagcaacucaggagguugagauaggagaucacuugaacccaggaguucgagacugcagugagcugugauugcaugacuguacucccaucugggugacaaagggcauccugucucuuuaaaaaaaaaaguuugagugcacauaaguuggugaugaaaucuuuguuuggcuuugaccaaaaaugucccuuuuauaccuuugguuuugaaaaauauuuuugcuggguaaaaaauacuggauugagguuucucuuucacugccugaaagaugauacucugcugucuuauuuguguugauaucuuuaucuuuauuucucuaaaaauaacaugucuuuuuuuucuguuuuuacaguuuucucuauaucacugguuuuuaacaauuuaauuuugauaugccaugguaucauucagucugcccuuaauuccaucuggccguuuuucaucuuaucaccucacauacuguaguuguuguauauagaaauuuaaccugggcuacccccaacacccauaauaucgucuguaucuuaacuuuugaaccuauggaauacaguuauuauaugaaaacuguuuaaauauccauguuugcuaauucuaacaucucugucaacuuugaaucaauuuugauugcuuauuauuacauguggcauuucccuguaucauuuuaugccucauaauuuuuuauuaaaugucggacgcugaauuuaaaccuguugaaugcuagguguuuuuguaauauucuugagcuuuuuucugucacauaguugaguuacuuggaaacaguuugauccuuuugagcuuugcauuuuuagauuuguuaggugggauagaagcaguuaucagccuaggacuaguuauuccuuacuagugaggcaagacccuucucagucaucuaccaugaauguuaaguuuucucaccugacucgugggaagaggcauuauuccugucccugugugaacaccaagcacuguuaaugcuaauucuuuuuggugauuuucccccuggcuucaguuucuuucacaugcauguacccaucauuacucagcuauauucucagggaucacucugcacaucucuggauucucuuuuggagcaacucucuccucaccaauacccuguccugugaauuacaacuaccuugaucucuccacacacuucauguccuccacuccacgaguccucuaggcucuguguggguuuccccaccugaaaccaugaccuggaaauucagggccaugaguuuggcagcuguaaguccucauuuguuuccccuuuucaggaaucaguguccuucaccugaugucuaaugucuugcagaaauguuguuuaugccaggugugguggcucacgccuguaaucccagcacuuugggaggccaaggcgggcggaucacgaggucaagagaucaagaccauccuggccaacauggugaaccccgucucuacuaaaaauacaaaaaauuagccaggugugguggcgcacaccuguagucccagcuacucaggaggcugaggcaggagaaucaccugaaccugggaggcagagguugcagugagccgagauugugccacugcacuccaguguggugacagagcaagacuccaucucaaaaaaaaaaaagaaacgcuguuuguauaugaauauauuguccaguuauuggugguucaggcaggaggguaaauccaguucuucucacucaaucuuggcuggaauuguuugugcauuuuaugcaacuuaaccagaaagucacccauuugcaccgauuuuccucaccauuuugauuuuucuuucuauggauaaaguuacagugcacagaaagccaugaggagccguuaaagagcucguggcauucuuccaagacguaagauacuauuuacccuguucuaccgaugauaucacugcaaccucgggagauggagcggcugguucagggugacacugcugggaagggagaggguagagccgcgagucacuguggugccuucucacuagaacgagcuuccucucuaaacaaagagcuuuugaaaaagaauauucauauuagcguuuucauuuucuauuugccaaaauucucuaucuuagcaaggcacuugucaggaaauuuuuuuuuauaucucugcagaacaaaaguuccuugguuccucucuuuuuuggagaacacgcuuucaggagaggagccgugugaucauuugccagagaaggauaggcuggugggugcugagaccagaaucuuuauagcagaaacuugugaagcguuccagcugaaaguccaaucucuaaaguaagaucuuugcuaaauggacauugaugggacuaaaaauaagcugagggcugaauggaggcuuuaacaaauguacauuuaaacucucaguuuagucucaucagccaucacaggaaaggcaguggcaagaauguuugccgaagugucaucuuuuaucaaaggggauaauuuuagagugguuguaaucgugcuuauugugggccuccgcauugcuucauauggaauuaggcaacauguucauuugaaaaaaaaauuaaaaacuggauuaggaagaaauauuuuacugucaaaaaucagaucacuguuguugauugaucuaaggauuccuguuaaauucuuaacucggauuuauuuauuuauuuauuuauuuucucucucucucucucuuucucuguuucucuuucucuccugccuuccuuccuucccucccucccuccuuccuucuucccuuccuuuccuuuccuuuccuuuucucuuccccuccccucuucucuucucuaaucuucucuuuucuuuucucuuuucuuuucuuuucuuuuguuuucuuuucuuuucuuuucagggucuugcucuuucacccaggcuggcaugcagugguccagucguagcucacugcagccccaaccuccugggcucaagcaauccuuuugccucagccucaugagaguugggucuacagaagcuccaccauguguggcuaauuuuuaaaaaauuuuuguaaagacagggucucgcuguguuacccaggcuagucuugaacuucuggccucaagcgauccuuucaccucggcuuuuuaaagugcugauauuacaggcaugagccaccaugacucaccuuuaaaucuuuccuuuguaauaaaauguggcuggguggucacaggccuggagucuagggggcauuacuugccauuuuuguuaaguuaccaucuuuagguguucauuuaaguuuuaauguuguauggcuugaccuggcacuuaggucugcacuuuggcaggcacaagaaaauuguaaauaccuucuuuuuuuuuuuuuuuuuuuuuuuuuugagacagagucuugcuuugucgcccaggcuggagugcaguggcgugaucuuggcucacugcaagcuccgccuucuggguucacaccauucuccagccucagccucucaaguagcugggacuacaggcacccgccaccaugccuggcuaauguuuuuuuuuuuuuguauuuuuaguagagacgggcuuucaccguguuagccagguuggucuggaucuccugaccucgugauccgccagccuccgccucccaaagugcugagauugcaggcguaauuaaaugccuucuugaggacuuuuauaccuuccucuugaagacauaaauccagagcuuacuggugguugucugaaaaagaucacaucuuguaauaggagucauacauaaauauuucugagaucucccucauacuuaaccaccgugccuggaaaaugcagacaacuguauucaguaaaugguauuugaauauaaguaaaucaaaagugucguuuccauagauucuguagauguuaccacuuagaauaauuaccugucuaacccuuaacaaauucuaccguauauucucagacuuugcaaacacgggauuccaaaacaauguggauuguuuucaguuucuuugaagcucagauuuaaaucauacuuuuacucaguuuuuaaaccuaaacguggaaguguuaugagauguuguuuuugugcagcuagaauuccuuguucuacuaaugaauuucauuuccugagucccugugucugaguauacuguauguuucaaauuucugauuuaguuauguaccuauaggcaaauacacugaauggucaaccuaaaaaugcauuguuugacucauauuuagagucauacauauauaggcacauguauuuaaaauaaauacuuuaggcuagaugugguggcucacagcuguaaucccagcauuuugggaggcugaggugggaggaucccuugagcccaggaauuugagaccacccuaggcaacauagaaaggcccuaucucuacaaaaaaaaaaaaaaaaaaagauuuuuuuaauuagccaggcaugauggugcgcgccuguagucgcagcuacucuggaggcugaggugugagugugaaccaggaagucaaggcugcagugagcugugauggugccacugcacuccagccuggaugacaaagcaagacgcuguuccaaaauuaaaaguuaaaaaaugagauaaauacuugaaauauuacaauuauuaaaauaguuguuuuccccaugggaaaaaaaaguugagcagagcugugucuuugcacucagaaaaaacucuuacucuguugaaggcuagugacucuucuaaacaccaaccccuucaccuuuuuacuuuccuuagacuuucuuuggaaaaucaaggaguuagcacuuuuucccccuggaagaauuaaaugccucuccagaacugcagcacaggagguuaacuucuaccaccuuuggaggccugcaagcuaccagauuaaauacuuaaagcuaagcauucaucauuucuuaaccugcccucuacagucaugcacuuccugcuuuuuacuuugucagggcucguacucaaacuauucauagcuucaugaaacaggaacuaaaugcugucugagccuuuccccuuguaacucucagcguucugcuuauccuucauagacagaagaugaugauauguccugacuguugaagagaaauuagacuuaaugugauccuguacaguuaaaccaaaggccagauagggauuuuuuauuucaaucaacuuucuauuguaggccuagguuuggaaaaccuuagcacccccuaauuuguaagacuugaacuguuuuaaagauaagggauacacagccaaagcuuucuuuguaauucugagauuuuugguguuuuuacagauacuuagucuaaaucuuucaucagacaguuaucaugauuauuauucugacuucaacaacugcauuuucuaaagggaagugagaauuaggaaacauuuuccuguacaucuguuuaucuaucccaguuguguuguuuggauuuuuucagugucuuaacgauugaaaccaucuuauccauacugaaauucauuucaugcuucuaucugcugcuucacauucaggcuaucaguuuaauugagcaaaaaaaaaauguuggcaguuucuauagcaucggcauccuucuuugguuucucauuuuugaaugguucagccacauguuaaauuuugcugagaucucuggaaacuucuucacauaauucuuugauagaacaugaauucugugagacucuucauuaaagagcacgguuucaucacuaaguugagauuuugcucaaggcuauuugguaaauuccagcagaagagcaauaaauguucaacaagaaacagccgucauuggagauaacaaggguagacauuaaugggagguuugucacagguaaacaggugauggcaugagaagguuuaaaccaccucauaaauaaauuuuucgccacuauaugauguggauuacaacuaaaccaaacuuuaaccaauguggguguugguguaccuuucuuuucuaaagcaaaaaagaaauugugguacuaaacuugagcuuuuauaugauaccgcuaauugcccuucacccaacaaaccaauuauuucuacccaucacuuuucguugcaaaagaaauuaucuuauaaaauauauguauauagcauauaucuccaaagcaaauaugggacaucuguaccucaauguaacugauaguaaguuaaaaauuauuugcugaguucuugguauguggacagaugaauauuauaauguuuaaggcauuccaccagcagguuuugaauuuaaccaaaauuuuaugaagcuaaucagaauggaauuaaaaguugaaagacugccaggccaaaaagaucaucuuucagaaaaguaaauaauugcucuauacuuacauauuuauuauuuauuuguucaccauccguuuauuuuuaguugaguucuguauacauuggugagcaaagggggacucauuagcuugggcacuccuaagggcaaacccaauaacagauagugaaugggaaggaaaaugagagaauuagcauuuagugaacaaaaucuuauaaacuaugcugaaugguauacaugcucuuucaguaaagccacucaguacuauuacuucccuaccuucugaauguuuaccaaguucgauaaaaucuugcuacauacaaaugggaaguauguaacaagagauacuagugguuucuggguuuaauuaaguuacauagaacauuaagaaguauguugggaaggcauuagcuuaaaagcugucuuuugccacugaggccauauucaucacccagauucccuccacaguggagcacugcucagucacugccuucagaaugcaaauaggucuucacaggaugcuauuaaaacccauagcaccguaugguuuuacgcucugcuuucuuccagcaaaccuacguauuuuaauguuaauauauauguucauuuuaucuuugagaaugaaaauguauuaugaaaauauaaauauuuaguuuuuguagacaaauagcacauuuaaagauccaguaguuauucaccugccugguaugacugauagagaacagauggguagcaaagaauccucacccuggaaacauguacgcauacacacgcaaacacaaucucgcauaagcuuuaagggguucauucauuuugugaagguugaccauggauaccaguuuaaagaugccaggugauguuuggcuuuuaaguaucaucaccuugaguuuccuuauauaaauguuuuaauaucaacaaaaaacucagaauuucuaauaggucauaacacugccuagguaugggaagaggagaggguaaaauuaaaagaaaugcaaauguacuuuucuuugaauaggcuaaccaguuagaggauguaugaagcaggaccaccauaguccaaguaugaauaugcaaaauuaaagcagauugcuguaaaucucucuuaaaaagucaagaauaugucacaguuggcauuuuucggaugaucagaccguuugacaaaucucugcaaggguccgaguuagucgaacauaucuuuugcuuaugauuucagcaacacugugcgcuuugccuucuggguuguauuacuaauucuguucaucauuaaguguacacauguuucacuguuugacuaaacaaagcuugaagacauacaaguccaaacauuuucuguccuuucuguauucccaggucagaagaucuuagcucuuuauccauucugugcuagaguuugucugaaagcaugaaucaugggguuguguugggugcuaaauuucaguucuauaugcugccuucacuaauuuaugacuguggucugaacaaccaaaauaaauuauuucugagaacuagcaaaauacccuggaaaaaauuuaugaaaccuaccagauuuguaaaaaggucagccaggcgugguggcucaugccuguaaucccagcacuuugggaggccaaggcggguggaucaccugaggucgggaguucaagaccagccggaccaacauggagaaacccugucucuacuaaaaauacaaaauuagcugggcaugguggcgcaugccuguaaucccagcuacucgggaggcugaggcaggagaaucgcuugaacccggguugcagugaggggagaucaccccauuguacuccagccuguauaacaagagugaaacuccgucucagaaaaaaaaaaaaaaaaaagaaaagaaaaaaggucacuaagugaugagagaauuaaaaccacuccuauuuucuaccuuuuauaacauaaacucuugucuuuacuucccagguuugccaucuuuauaaccuguaacuaggagcaagugauuuaauaaagggauuccuccuauuccgucugcaaauuggaguuaauuuuucuccucuuucugcaauuucuguuguuuuagcuuuuguuagccauaauuagaaaaucaaaaggauucauugaaaguugagacaaaauugugaaguaggaagaugucuuccuccguaagaggagaaagauuguuagaggaaguacauggaggcuuuggugacacaucccuaugaggaagugaucugcuuccacgggaaggagagaacagaugauagaugacuccuagaugcuccugcgucauguucaguacaaaaucagagccgcaucagcaaaccggauacccugggaaggaacauugggauaacuccuuggccauaaacaaaaguuuugcucuggccuuaugacuaaguggauuaauagagauuaguuguucaauauccuuccaucuaauggauccauauuguuaaaacuuaagaaacaccaaagggggagagugugagaaucuacugccauuuucuccauugcuucauucaagacuucuguguccaccuuggcaugggauuaucauuugcccuuuuauacucaccuuaaacuacaaagaucauuuguuugccuuucugaagaaaggaagguggauaaauuuugcaggagacuuuaaaaauucagcucaacuccuggcauuaaagacaauaaagguggugauucagagguccccauggcaguuuccccaaauauuacguuuaacuaagaucaucucaagcacagagagacuuaacucucuaaagugugauuuuuaaaccugcacacggaaauuuucuacauuuuauaugcucaagauuucuugaaauccaggguguaaaacugugaaaauaauaguucugaaccuauuuaugaaagcaggagagaauugcuuuguucaguuuuggaaaccaccagggugcaauuuaaugcuccaggagaggguuuucugugaccuggaaagguuggggugauucccguacagugagucauuuacuuccuucuuggcaggauuaugcccagggcuuuuaaacgcucuugacacuucacugccuuccauaagaaacggguuuagggcacaagugucuauuaugauaagaugccagauuucuagaucaagcauaaagcuguggagugggacaauaggacuuaauaauuuuaauacacuucccacgugaacugucaaguaauaagcuacauauucagacgugacuggcauugagucauccugccauuagucaaauguaugagacuuuucccaagucccagcaacaccaaauuugagaaaucguauaaaagaaaaaugaaaaaguaaauacgucuaagaaauggggaaaucaauaaaaaauguacuagcaccaggggcgguggcucacgccuguaaucccagcacuuugggaggccgaggcagguggaucaccugaggucaggaguuugagaccagccuauccaacauagugaaacccuucucuacuaaaaauacaaaaauuaggucggugugagggugcacgccuguaaucccagcugaacucaagaggcuggggcaagagaauugcuugaacccaggagguggagguugcagugaguugagguggaggugcaccacugcacuccagccugggcgacagagugagacuccaucuccaaaaccguguuagcuuuuaucaggaaaggccauuaaauuuucuucaauauuaccuacaucaauuugacaucaaacuauaagaacacaauaugugagauguuuugaaauuaaugaaaugaaucuucucuuugagacgaguuugugcacgcuaugaaguccauuaaauauuuucugggaagaguucccaguuaaaacuacuuucuaaaguacccaagcacacuauauagauacaucaaguagguuuauuaaugucaguauuucggugaaaauugggaaggccacuauucugaguagagagguguuuguuuucuacuugaagacuaugaaggauauucugcacuacugggccuauuucugaaauuguaucuagcugcaaguuacucauuaauuuaauuaacaaauauuuauuagcaaccaaauuguggcaggaacugugccuagagguagaaauacauuacgcucuuguuuccagagaggaaaaugaguaauguucuaaaauguaaaucuuauguuucucuuuccucuugcuguaaaugaugucuaagccauuucgguggugccuguucuuaauccuuuaauaaauuauuuugaaugauuuuuuaaaaggcagugugauugugaggugaguuuaguacaaauuaaaaaaugucacaucaguugcaaacagacagcacauaauuaugagcuaaacacuguuucagaaacaguagugacaauaaauaggauucgguauaauuaguccuccugggacagaucucuuccucuguucuuugccauauauuuuaauaaugagauuagccaucuaaugccaauauaaccagacuguaguauuaauacacagaaaaauuauugcuaguaacagaagauuuaaagacaugagggugauccggauuauaugccugcagguuaaaaaaaaaaaauguuucuuaaacucucuuuaucaauauccuuuucgugagccacugaauucuuuuguuuuucugaucauaugaauaacccgucuuaaguaugaauauugugacaauaguaauagcaauuacuuuaagagaauauguuucuauagagauaacagagggguuuuucccuaccauuccuguaugaagguuucuguguuuuuaauuaaaauuuuaagaaauucaucuuugucuuagcauaauaaaauaaaccucacuagacaaucaggacaccuuguuauucuuagauacauuauuauagcucaagaaauaacaaauguuaagccuggaggauuuguauuuuggccaaaaguugugagggcaauuauuuauuuauuugagugaaauaugcaggaaucauauaucaaaaggagggaggucuuuuuuuuaaccucaacaaaaauauaaaaguauagggaacuguuaucuaugugaacccagcaaaucugagacaggucucaguuaauuuagaaaguuuauuuugcccugguugaggaugcaccugugacacggccucaggaaguccugaugacaugugcccaaagugguuggggcacagcuuaguguuaugcauuuuuagggagacaugaggcaucagucaauacauauaagaaguacauugguuuggucuggaaaggcgagacagcuugaaacaaaaagcaggaagacucgaaguggggaggggccuucuaggucagagauaggugagaugaacaguugcauucuuuugaguuucugauuagccucuccaggguagacaaucagggugauuggcucuaagcaguucccagcuagacuuuucccuuuagcuuagugauuugggggccccaagaauuauuuucuuuuuacaccuguguuuuuucuuucuuaacuaaaaauaguauuuguuucugagggauagagauaacuaccauuuuauuugguaugauuuauuugccuaccguccaacaaagaagguaaucugauuuuguuuucauuuccaagcaugauuccuagagauguguuuagguggccaaaucaaugaagcagaacccugcaaauucauuuauugggagauauccuaaggucuuccugaauuaucugauguucccaggcuuugcuuauccaauaggcauuaggaagaaaaggcuuguguuuauguagaugcacacaaaaugcgcaucucagcuuacauaaacagugaagggguuucccaggucucauuaucccuggaggagcugaggccuggggaguccucagagccuccuuugcuacucuguuauuguggcaggccaaaucucacuaaugcaggccuccguaacagcuguuuccguacugacugagugguucaguuaaauacuaaaagcuaaaaaaaagccagcgcccuuauacagaggcuggaauguaacaaaagcccaccaagaguuuugccuaggccuuuccuggcaaaaccaaggaauucuuaacaggacccauuuaggauuaacaaguuuuacugggagucugaagaaacucuacaggccuccaagaacaaguuuacuggaggucugcaggaacuccucaaaccucccugauuuagcaggagacaagauaagaguaaucaccccagcaccuagacccauuuagauuaaguaaauuuacugagacuccagaggaaggucuucaggacucagaccuuaguuauggauuaaagaaguuaaucacuucugucaugagaugaaugcacacuuacacguagacauacagcuuagaaggcauauaaguucuggaaacuuuguaauuuugaguuggucuggcacuaauuuccaggccaucucccuguaaaagguuacaaaaauaaaaacucucuuccucccaguucaucugcaucucguuauugggcugugagguauaguagcccaacccucaguucaguccgggaacauuauuaucaaacucuggggauuuucaggauaaguuaggaauauauuuugaaggagaauggcaguauuaaaugagaucagcaauugaaaacaugugaauacauucaccauuuaauuacccaucucaauagaagauaaggaugaauuuagcacuagaaaccaugaaugucacaaaagccuaacuuuaauaccuugaaucacuuuccaguaauccuaauccuuuauccacauggauagaggacauuccuaucuugcucuuucuucuccccacacauuagcuuaauaauuagcuaaauaauuucaugcauuagcuaaggaauaauggaacuccagaaaccuaggacaguaauugagagacugaacaagcuaaaucugaaccuucugcacaauuaaaggagcugauguuagcauggcccacagaauauuaccugcacuuguaaaaacuagaaagucaggcaaguacuccuggaacagacugucuuuucuaaccaugcacuuauuucuuuguuuuuaacuuuguuuuuguuuguuuguuuuugagacggagucucguccugucgcccaggcuguagugcagugguggaaucucaggucacugcaagcuccgccucccagguucaaacaauucuccugccucagccucccgaguagcugggacuacaggcgcccaccaccaugccuugcuaauuuuuguauuuuuaguagagaugggguuucaccauguuggccaggcuggucuggaacuccugaccucgugaccugcccgccucggccucccaaagugcugggauuacaggcgugagccacggcgccuggccuguuuuuaacuucguaaguugcuuuguagaacuaucuuaaacuuggucuauuuuagauucuccuugaagggccagaucacaaagugauuaggagaaggaggcucuggagccaagacagugagacuaacccauucuucaaaucuaacacuaacuagcuguguaaccauugggccagggauguagccuauguaaccacaaucuccuuugugcuucaugccucaccaauaagguggggagagcugcuaugacucugucauagggcugagacgaagauuugaugaguuaccagcaaaaagcauuuaauauacugucucauucagaagcagucaauacacauugaacucuuauuacuuagaggaaagaaaggggucgaugauuuauagauaaggccugagugaaagaaauaaauguguauugaguaucagcaauggacuacgcaucauucuggguaacuaucacugaacacauuuaaucugcaaauacuaucugaaagauacugccaucugaauugcauaggugggaaaagucaaggcuuuugugcuuauuuuuaaauguauguuaacaugaauaauuaauuggccgugcacuggucgcacgccuguaauccuagcacuuugggaggccaaggcgggcagaucacgaggucaggagauggagaccauccuggcuaacauggcgaaaccccgucucuacuaaaaauacaaaaaaauuagcugagcaugguggcacgugccuguagucccagcuacucaggagacugaggcaggagaaucacuugaacccaggaggcggagguugcagugagccaagaucacgccacugcacuccagccugggagacagggcgagauuccaucucaaagaauaauaauaauaauaauuagugggaauauaugcuguuuguugugauaggagaagaaaaggggagauccagauguuggucaucagaaaugaccugcaucuucucuaaauugaaauuuagcuugaaguaguaaugccaaggccagccuggggccauggcauccugguguaccugcuuguuggugacaguccuuuuaggacaaaauaucuuacaaaaacauucauagaugacuaacuggaaaaaaagaaguuaugaugaaaagcaauucuuacuguuuuuguuuuuuguuuuuuguuuuuuuuaauuaaaagacaggcaguuauucucuuucccaggcuugaguacagucgugcaaucagggcucacuacagccucaaccuccuggguucaaauaauccuccugaccaagcuucccaaguagcuggaacugcaggcaugugucacugcaccuagcuaauuuuuaaaauuuucuuguagagacagguucuuguaauguuguccaggcuggucucaaacucuuggcugcaagugauccuccugccucagacucccaaagcaauccuuacuuuuuuaauugaagugcuuuuuuuuuuucuuauuuaaacucuuaaaaauucaucccauuuucuucaaaacaauaaauccuuuacaagggagaaaaaugaaauagagcaacuaagaaagcauccaugaaggccaggaaggaacaucaugguuaaaugcgauuagucacagccccuucugucuccagucuuggaugaauaaugguaacagaacuagagagauuucuaagaccuuggugcuuaauaacaagcaagcaucgagggugguugugcaagauccugaucacacaacucugcauaucaaauauccuucacaaucaacaagagucagccuuuaaucucugauguuuucaaauguucuuuuuuuuuaauucacauguauaaccuauccucuuuucaauauauagagauauagcuuaucagucauuaccucuuuuacuacuuuucuucugagauuuaaaaggucauccucugauuuguaaauucaaccagauuucacaguucagaugagaguuguaauaaguugccaagaacuguugcaagcugugauggcugucuuucuggggauuauagagaagcacauuucuuuuaggaaaaaagaaggcagaugagcccaaguuguuuuauuuuuauuguguauauguauuuguuuucucaaguacaguagcauggccucuguggcaggcauucaccaagcaaauacagagcacccucugggucaagcacuguguuauugggguuccaaauaaagaaaaaagaccaaauccagcccuguggaucucacauuaaagaggggaguaagaaucauagauaauuuaaugaguuagguacauuaauggggauuugcacaguauuucauaggagcacagaaaaaggguaccucguuccaccugagauggcagggagauggcuccuaaguuaacuaagcaaaaggggaaggagaggcacaucccauaggauauggauaacacaacaaaagcuccauuaccacccgccccaccaccacacacaccaucucuggaauaaauuuuguaccuuccaacugguuuucaggguacucaugacacauggguuaauaauagcuagguuugcccaaaugaccaaaauucuauucccaacaugaauuuucacaacugguuuuuuuguuuguuuguuuuaaugaagaagaaauguuguguuuuuggaaaucaucuuacaaaaucauguaguggaaugcauauagugaugaaauuguugaagaccagggaaucuuuguccuuaguuuuuauuaggauggauguuuucagguaaaacuaaaauaaaaaugaaauggaaccaauuagaaagaaaauaggagcacuuaagacgaaauguaauuguugcugaaagaauuagaaucugauagcuuagaaagaacuuaauuaaauuucagaguaaaauaaauacaguuuagcaauggccuuucuccuagaaaaauauaaugucucuuacaguucaguuacuccuuggcuuacaaaauagugguuaaauuuccuguuuuucucauuuugauuucguauguuacauguuacuggugaugggauuaucugugugacauuaccucuggucuucaaaauguacacguagcaauguagucucacauaugccccuugggugcgaaaagagaaggaccuaacuuaaccugacagaccucaaaucuguucucuuucuauagcagaguacuccuauuuaaaaagaaaauguugaguaaggaggacagucaucauauaugucgagaauguuaaaugcucuuguggaagugaaaagcagccgaucuaaguaauuacccauuaagaaaggaguaggagaaauguuuagaaggcagaccugcaaaaaggugacucacaguacguucacaugaccggaugcauuaguggaaccucuaacccaucgccaauggaagaagcaguguuuugcacaaacuugaaaaagaguuuuucauuuuccucccacagccucgucacguguucaauaugcuaaagaaguauguccgcgcagaacagaaggacagacagcacacccuaaagcauuucgagcaugugcgcaugguggaucccaagaaagccgcucagauccggucccagguaagcgugggguauaaucaucuucugcagcuuugacaauccaggauucuugcuucuuggguuggugacaggaucccacgcauucuccgagcaccuauagguguuuucccuauggcaagagcucuuuaacuucugguaaauucuaaaagcuugucuuagagcaauaugugguuuggcauuuucugaguuaugaaaauaacaaauguaaaaaucuuagucuacugcuaacugauugcuaaggaacugauuaaaaccaaugacuaaaaugagaaaaacaaaaguuguauaaacuaaaaucuugaaaacugguucaacugaaguauggcaggcaaucauaaaccuacuggaauguugagauuucaugugagccuaaaugaagcccaguaauaauguauuuuauacuccccgguucccaaaggcugaaaacugggaucuaccuuaggaaaugugaaauuuuacauuuucuugaaugaaagaguuaaauauauauagcaugaaauagccaaucaaauugaaauacguuguuuucuagggggaaauuugcaaagaaauguauuuaggcaugaggguccuguuaagagagccucaguauuaggaaucagagguggcagagguagccuuuuuaauuggcuguuauaagcauacaagauaaugguaaguuucaagaucaagucuuaaaccugagcucaaaaaguuagagaacagaaauaggagaacaagaaaaauaaaguugcccuuucaguucaaccuuuuuaacaguagcaguguuuugucaguuuucuuuuggaaguuuguaucuaccugcagugcuugguaagaaaaauaaccugggcgacagagcgagacuccgucucaaaaaaaaaagaaaaaaagaaagaaaaagaaccauuccuacccccagacauuguugaccuggaguugucauccuuugaugcagguuaugacacaccuccgugugauuuaugagcgcaugaaucagucucucucccugcucuacaacgugccugcaguggccgaggagauucaggaugaaguugguaaguaagcuguucuuuugaugcugcacauggacauguauuuucccccagaggaaaauugaggaagugaguuaucuguuugaggaauauggaaguuaauagaacagcuugccuuuuacgaugaaacugucaggcuggaacuagcuuacuagccuuagcaauugaaucaguucuuaccucuccauacuuguaagacuggaggaaugucgccugacuuaggguauaguuuuguaauaauuggacacuuguuauugaauuauacguggcagcauuuuuucuaauuugcccaaucuuguuauggcucucaaauuaugaugcuuugguacuuuacaauuaauggggaaaaaaacucauucuucaucuuuugagugucacgauuguuccaucuuacaaaugaaaaagcucaaacuuaaaauuugaguaacuuacuggccugugucacaugcauuauaaguagcacagccaaaacacauaacugugacuugugacuuugagguuauuguuauauucaguaagucacaauucucuuugauggcugagcagggaagccaugaguguucucugaaccacaucauuguuuaaacuuaaaagauagugggcuauuaaacuuauauucugaaauaauuguacucucacaagaacuuggaaaaauaguacagagaggucucaugcauccaucacccacaugccucaccagugacaucuuacguaacuauaguccauuaucaaaaccaggaaacugaccuugugugcccacugucuuuuaugucccuaguuuuccuaaugacuaaugauuucauuuaagaucucucauuucuguuucucuuggaaagagaaucaaauaccacaugagucucugucagcugccaaaaugcccauaacuguuuaacuuacuucacaaagguacauagaugacgauuauguuggugcaucuuucaauauaagcauauguaccuauacuggagauuuaguguguagucuaccaacauauaagcaauauguaucuggcauauccuuccccauaaagaauccuacccuuuguuaauuggguuggaaauagauacagguuaucaucuggaaucagagcacccaggauguuguagauggauguacccauuacaguaaguccgacuuugaagugccugaaacaccgcucaagggaacagcuggcccucacuuuuucccauuuuaugccaguguuauucugcucauucuuuccugauuuauguggccuuguaaauauuguuuguauugcugugaaauauuuggcaugugucaagugaugauguucuguucaguacugcacauuaauggacggaaucugaaauuauacuuugagcuacauaacuugcagaagaaacuucauaugucagggaggugcagugucccagaacuuugggaggccaaggugagcagaucaccugaggccaggaguucgaaaccagccuggccaacauggugaaacccccucucuaauuuaaaaaagaagagaaaaaaagcaacuucauagugugccaagcuuuuguucagaaggagcaacucaguguugagcaagaauuuaugaagauaguggagguggaguuuuuagucuacaccaugaauugagaacagagaucuccaauuaauuuuucacuguaucaaguuucuuuagcaaacaaauauacuuuucagguauacuuggagaauagacaucaguaaggaaccuuuaaaauacuauguauuaaauaaguguaaagaaguucuccaaaaaguuguagaagguacaaaaugaaauaauuuaucagucuuaaugaacugaagcuaaaaucuucuagaaaacaugguuuguuuguuuguuuguuuguuuuuuacagcuaucuuaagccuguuuucacaugugacuucaguugaaguggcauagguaauaacuauagggaaauaagccauuacaaaggacuaaaaaguugaugaccaauauuccacccucacccagcaauuauuguugacucuuuauaauuaaauuauuagaacuuuuuauuuggcacuauacuacugaaaacauuagccacuaauuagucacacuuccacagaacagauggugguucagauaucuugaauauuacgaaaugcccaagaauagggcagcacaauaaacuucaaaucucaguaccagggaggauauuuagauaacuaguaucauggaaucuuuuucuguaaaaagaaaaaaaaaaacagccauuagguuggauuaagaacauauuagggggugcagcacaccaacauggcacauguauacauauguaacagaccugcacguugugcacauguacccucaaacuuaaaguauaauaaaaauaaagaacauauuacguaugugcucuuaauguguguguguguguguguguguguguguguguguauguauguaauaugcucucaauccacccauuaguuggguuuuuuuaaguaaugacauauauaucauucuaaauauaccagaugccacauucugaaagauaaucuuuuuuaaaaaccuuucauuuggaauccugggugcuuccauuuuuaaaugacuguucucuauagaaagagaaguuugcaauaacgaacccuguacacuaucugagcugcuagugucaaagcuacagaagugguuugcuggggagaauagcuuuucuggguugaaccuaguugucaucuauaguccuuuuucauuugaaggaacauuuaaaacaauacgucccuuuuuaguaggaauauaguugaaacuucaagauuggccaggggugcuaauugcuuaagccaaauguuauuagagguuccucauguuauucuuuuuacuuuuguauguguuuaaaauuucucauaauaaaaaguguugcuuuuagcuuacuuucuaaauagguucuucauagauuuuuuuuccagguuaugucuuguagucguucuaauauucucugauuaaaugcuuugucauuagucugaguugcauuuauuugcuauuucuguauauaaucaaauuuuagauuuggagucaguucaguacaaauagcauacuaaaauucagagacacuggcaaaaggagaaaauuuuaaagucccuaaaaaugcaugccuuuuguauagaaguuugugcuuauaaauacaagcaauuaggaugugcuuaaugcagucaaacaucuguagagagauacaaugguuuaauuaaauaaugguaacaguugcuuuauggauaagagguuuucaccagucuggggaacugccaguaucuuuagugggagagguauaucugcuucaguaaauuaugcuuccaauuagaauucucuuuuaugggugaaaaugaggaagaauggagucaugcugagaagaaggaaugcuaucggugaaggggaaaauugacauuaaauuugugagcaguaaacugugaccagagcauaggguucaucaugcuugugaguucuggcccuggccuuguaucuuccauugugcuucccugaggcauccugucuguucaugcuacuuucccacuaacuucagugaaucccaaauucaugggucuagccacagccagcguacugaaucccagugccauauuccagaccccaaauaucccaugugccucugaaccugcaaucaauguguauaacacucauguccuucuggaaauuuacuuguuuuacacacucuauucugaguucucuugguuggccuaaacuauccaugaugccuuccucucccucacccauuauuucuuauuaguugcaaguucuguauauuuggccuucuguguucaugugaaaucucugcacauccccuacuuaccugagauccuguccucucaucagugucauuagacucccagccagucacccuaccucuuaucucacauuggcccccucccacuucaauuccuccuuuucggaacuaugcaaguucccuuaaaaacaaaagacaaaacaaaaaaaacagcugcaggccggcggcaguggaucaccugaggucaggaguucaagaccagcguggccaacauggugaaaccccaucucuacuaaaaauagaaagauuagccaggcaugguggcaggcaccuguaauucccaguuacucaggaggcugaggcaggagaaucacuugaacucgggaggcagagguugcagugagccaagauugcacuauugcacuccagccugggcgucaagagcaaaacuccgucuccaaaaaaaaaaaaaaagaaaaaaaaaaagcugcuugugguuuuuccuugcuugaaaaguugcaccuuucaagauucaaguaaaaugcccaaguccuauaaacccuuucuaauuugcauagagaacggagaaaagagcuggcauuugagugacaaccauguaaccaacuaaugagugccucuuugugauaaugcugauggucacauucuuucuuuaugaauguuccccguugagguacaggaccgccauauagagauguggcaguggcaggugguuuaggguaagaguggagacugauaauuuuauucuacaucccacucaaggagccaagcccucuggcauugugcacacccacuggaagugggcuguucuugcauuucacacaaaggcagcauaugggcuagugaagauacucggaaauucagugauagcauccccaguuuacaguugaagaaauugaacuuugaaccuaagagaguuugccaacuugcccagcccagauaguaaagugaugaaagugggguggaagccaagaccugccagaaguccaaaaucuguguucuuucugcugccuauuuuccucucugaaguggaauuuuccccuacuuaaccucaaugugaaagcacuggguauccaccuccaauaccauacucuaacuuggaguaaauuauuuguuuauaucucuacuaacccuccauccugugaacucuuccagauauauguuggucauccuugccuccucaagauccagcaaggacccugguacuuuuuagauauuaguaauuauaaauauaagguugaagccaguccccaggauaaaaaggcagaugcuccuuaacuuggacugaugaagugggcuccuccguaacccuaaagaccugaccaaaacuccuuccuugacaucuagcguaagcaccacacaaaacaaauuucuuuccuaggccacagcauccucuaaagcugugauugaucaagcuaacuaaauggaugugguuggccaagauaacaaagcauaaaucaggguucugaggaccuuuauuaauaaaauuuuacaacaugguccuucuuuguaccaugacccucugcuauuuggucaucuacuugauuuaauugugcuguccuguuugaccgccaaccacagucugaagcuauucccaugacaaauaagugugaauuuucaaguguccuguuguguuauaaaaggcccguguuuuauuuuauaauuucauauuuuuuucauucaauuuuaauuauuaugugcaaguucccaggcucagucauuuauuaauguuuuuauuuuuuaaaaaguuauuuucaggcagauuaugaagauuucuugcaaagaauggccucaggcauuguuuguauagagauaaaaucuccucuuuuaaaucacuauguaggucuucauuaauauuuuuucauucaacaaacgauggaaucauuauuucagugaaacuauggcuccucuucaguguucauauucugcuuuaauuauuuauuaauccuucaaaagggcagaaucccuucauccuuucaaccuuugcuuugucaaauuguuacuuaaaaaugaugguguuuucuuuguccuuuguaaucuuccuuaaaucucugcuaaaaggauucuauucuacucuuuguauuggcacugagguuauuuaucaaagugugcuucucuuugcagcuaccucaaggcuaaaaauguagcucuuuucagagauggcuguuuuacagaaugcuauaauaaccaauuuaugagaaaggcaguaggaaauaaagagggaacaaaggcauaauuguuucauacccauuuuuuuucuucuagcauucaaaauuaauaaaaacaugaauuauuauaaaccagaugcgggaaagaucucuggcugaauaaauccauagugaauggggcaggauugaaagauauggcggggaaucaagaaauucgcaauaaugaaaggaugcuuauuuuuuauuacaauuuuacuguggccucuugauaaaauguuccacucuucaggaaaaaugcagcaugguuauuucaaagacaguguuuccauauucuguuucuaauaagccuguugauuuggggguuuaguggguccaaaguagacuagguuuaaaauagaauauuuauagcacuucccagcccaacaaaauagaaauuuaauguuauugagaauuucaaguauccuuauguguaauuguuagucaaggaugaacaucaaaaaaaaaaaaucauaacagcaaauagagagcugucacuuuguucuuauaagaacauaggugugacuuuguuuuucauaagaaaugacuuuuaaauguauauagauuuaaugguuuacagcugacuuaaguauuuggacauaagaacuuuuuuuuuuuuuuuuuuuuugagauggagucuugcucagucacccaggcuggagugcaguggcgugaucucggcucacugcaaccuccgccucccggguucaagugauucuccugccucagccucccaaguagcugagacuacagacgugugccaccacaccuggcuaauuuuuuuguauuuuuaguagagacaggguuucaccauguuggccaagcuggucucgaacuccugaucucagguggucugcccaucuuggccccccaaaaugcugggaauacaggcgugagcccccacaucuggccaagaacauuuauacauauuaucaacaaccaaagccuuguucccccauugguuucauaauagucucagagcuccuuauucauauuuucccuaguguuauuaaguaacagacaugaggccuguaaguuuagcugccugugucuaaauguauaucuuugacccaagacaauuucucuuucaaaauagaaccacucauuuauaaaugaaaaugcuuugucaaaugaauggcaaaguacgguauacuauuaagacagccuccuaguuuucugacauuuggacugccauguugaaaugucuccacacagcaagauacaaaugugugaaugccaguacacuucauaccuuagguccccaacuggucugucugcagacuugagguuacagaccugcaggugucgaacucaccccauaguggugguuaguagagugcuuuguauacguuuagcucucuaugccuuuuuugguugugauauuagguaagcucucuuuuucuugcuuuggagcuuaauuauggaaucuguaaauauagugcauaugucauccagaugaucuguggaagucauugauaaugaccuuuaaaaauucacauguaauacagcauccguuuuccugaaugauuuuuauaguuuuaccauuggcaaacagauacuuucuuuuauguauuucuacuccauaauuuuaggaaaaaguaaauccuuuuagcuacauuaaaaagaauacacuuucuaggaauaaugaauguaaaaaaaguuuccuuuuuuaaaaaaauauugcgcucucuaccauucuggcagacaaauuguugaccuuaauauguauaauucagugcaguauauugaucuuguuuauugugcuccaaauggacgcuggcagaaauuugaggaauuaaauaucaaccacaguguuuucuucaugcgauugcaaugguuuguuauggauuauuuuguucaguucaaauaaaugauguacguucagauucuuugcccaauuuuuuaauuggguuguuuaccuuacuuucuuaauuuuauuuuuauuuuuauuuuuauuuuuauuuuuggagacagagucccgcucugucacccgggcugaagugaagcggcaugaucucaguucacugcaaccuccgccuuacggauucaagcgauucucgugccucagccuccccaguaguugggauuacaggcacaugccaccacauccagcuaauuuuuguauuuuuaguagagacaggguuuuaccauguuucccaggcuggucucaaacuccugagcucaggcaaccugcccaccucggccuuccaaagugcuaggauuacaggcgugagccacugcacucggccugcuguuauuauugaguuguaagaauuuuuauauauucuggauacuauuaaauucuuaucaaauacauuauuuggaaauauuuuacccauucuguagguuguauuuucacuuccuuaauaggauccuuuugacacacaaaaauuuucaauuuagaagucuauuuuaucaguuuuuucuuuuguggcaguuacuaugguaugguaucuaggaaaccauuguccgaaacaagguuacaacgauuuauaccuguuaccuucuaagaguuuuguaguuuuagcucuuacaguuaaaucuuugauucauuuuaauuuucauauauggugugagguagagguuugacuuuauucuuuugcauauaaauauccagugucccagcaccauuuguugaaaaagacuauucuugccaggugcaguggcucaugccuguaauuccagcauuuugggaggccaaggugggcagaugacuugagcccagaaguucaagaccagaaugggaaacauggcaagaccacauuucuacaaaaaaauuauccaggcaugauaacaucuauuuguagucccagcuacucaggaggcuguggugggaggaucuccugagccugggguggcugaggcugcagugagccuugaucacgccaccugggcaauagagcaagacccugucucaaaaaaaggaagaaaaagacuauuauuucccccauugaauggucuuggcacuauuacacaaaaucaauuguccauagauaauauggguuuauuucuuaauucuuaguucuuuucuuugaucugugugccugugcuuacuguaguaccacacuguuuugauuauuguagcuuuguaguaaauuuugaaaucagcaagugugaguccguuaucuuuguucuucuuuuucaauauuacuuugaguauccggagucucuugcauuacaacaugaauuuuaagaucuuccucacccccugcccccacuaccauuucugcaaaaaaaaaaaaaaaaaaaaaagugcggauugcauuggaucuguagaucauuuuggggaauauuuauauauaauguuaaugagguuuuaaacaacacuuuuaucuacuagaacugauauuugccucgaaaugauuccaccuugagccccauucaggaacguuaguauuuuagaaguagcaagagaacugauuuagcaugcuaucaucuuuuacuccaaauuuuggugagauuccagagaaauuauuugugagcuuuuccuuaagccaugaugacugacaugucaguaguuuuugucuguuuuuaugccauucuuuuauuuuugugcaugugugggcaccucaaccaaauggauggagccugaggcauggucucccacgccaaagucugccguuucuuuugaugauccaaugcaguuccaaagcuauuuucucaacucaccagcucguuuguauggcccuguaauuugaaacaaaaucuaaaaagaaauccaaauuaaaaugauugggaagugaagucagaccacagugguggcuguggaacuacuuccuggcauggaacacuagagcagauguguccugcuuuuuuuguagagucuugggaacaaccaaugauuuuagacuggaacaagggcugguuauucuguuuuucacaagcaucugccuucaagguucauuuuuuaaaagaggaggggaaaaaaaucagugauguuugccacccugaguauggagaugaauccaaauugagauuaauuuugaaauauguuucccgaauuuugagauuaauuuugaaauauguuuccacaaacacuaacugggaaugacaugaguuuguuucaugugagacggaguuuggaagacauguuaauuugcuuguugguguucaacucagaaacaaauuuugcauguauuuucugaguaagugccauuauuaguuaacaguuuuccugccguaugcacuaugggcugcuuuagaaaguaaaucauagaagguuaguuauaauaucucaucaaaaauaguggauccaucuauuaaccgguuccaaguuaugagacguguccaaaggaauguugacuuggugugcaccuaaacacuauuugugaagaggcuuuggacuucgagcaugaaacggggucagagggucaaggccagggcguuacuuaauuucagcuccuguugauggauucauugacuucagauagugcguuuaaaaaagccuguuuaauguguuugucuuuugauaauuauuauguauuuacauaugcuccuaaaagcaugaguuaaaucuuauuucuuugaaacagugcuuggcaacaacuuguauugucuuguacaugccuuuugugucuuugcuuuugguugggggggggcauugaaauuugucugcccauccccugagggcagauacugagguguggaccuaugucuucagcuuccuguauagcauugaaguugcuauagcugcauguucucuaaaauuuuuauacaugcgauuuaauuguuaaagcuuaugauuuuuaaguauaguauucugauagcaaauagauuuugucaaauaaaaacuaacuuuaucaucaccacugagauaucacuagguauauggcuuaguucucagucaccacuuuuauuuguaaggaagucuuagaaguuuucacaaguguauaugugauagacugggcacaguggcucacgccuguaaucccagcacuuugggaggccgagucaggcaggaguucgagaccagccuggccaacauggcaaaacccugucucuacuaaaaauaaaaaaauuagccgggcaugguggcacaugccuguaaucccagcuacucgggaggcugagguuggagaauugaaccuaggaggcagaggcuguagugagcugagauccugccacuucacccuagccagggcaacagaacgagacuccaucucaaaagagaaaaaaaaaaaaaagcugggugcggugcucacgccuguaaucccagcacuuugggaggccgaggugggcagaucaccugaggucaggaguucgagaucagccucaacauggagaaaccccgucucuacuaaaaauacaaaauuauccaggcgugguggugcaugccuguaaucccagcuacuuaggaggcugaggcaggagaauugcuugaaccugggaggcagagguuguggugagcugagaucgcgccauugcaguccagccugggcaacaagagcgaaacuccaucucaaaaaaaaagaaguauauauaugaugcuugcuuuagcagcacauauacuaaaauuagaaugauuaaagagauuaaccuggccccugcacaaggaugacaugcaaauuuuguaaaguguuuuauauggaacuuuacuuacaugagguaccuaggguaguaaauucauagauacagaaaguagaaugcugauugccaggggcugagaggaugagggacuguggaguuaguguuuaaagggcacagagguucaauuuggcaauauugaaaauaguucaguggggaagauggauggccgugaugcaucguccaucacauugcacagcaucgugaaauauacuuaauacccugagcguuacacuuaaaaugguuaaaacaguaagauuuauguuauauauauuuaccaugauaggauauauauauguauauucauaucauucgccauugugaauagcaaggagauugaagaaauaaggacacaggaucuucaauaaauauguauuaaaugcuucccauguuccacauucuuugucauugccagacacgucacagguauaagggcccaaucuuuguuacucaaauaauuuagaauaauuuagaauuugcuuggggagacuuuggauaaacaguuaagaagcuguauccauuagguaaagggacauugcuugcugcgucucguagcauuugguagucucguuagacagccguucuuacuccuaucguuugcugaaauuuauuagcaaaggaaagaaucuuaguuuucagcucguucagccgcaugauuucauaggcucaggaaaaccauguaauaugcccaaggucagacgugaugaauaagacuaaagacugaaucuauuccagugucucuguguccagugauacuuacuuacugcuguugccaaguuaaacaaaacuggguuugcagagcuguuuauucaccuucagcaucuuuucauugaaaaugcgguagauagaagaaaugucccucuuuuagcauuuguaccucaguaauaagaugcuucccaagcucaaagacuccacacccuuaaauauguaagucaguguuaagauauuuaaagagaacaugaauaucagcuacauugugcauguugcaggaauuuuauauuauuuuguaucuucugcuuagaagucauaagccagcccaugaaccaugccaacaaacauaccuucuuccaugugauuauugcagccagauuuuucagugcaggacaagcaaaguuuucucugaaagcaugagauaauaauucucagccaggucuucgccauuugcaagggaucagacauaagaguuuuuagcucuguugauguuaauagcuagagccccuguuagcagauggcauguuaguggccuguugcugcuggcuauuaaaucauacacauuggccaggcacggucggucacaccaguaaucccagcacuuugggaggcugaggcgcacagaucacaaggucaggaguuugagagcagccugaccaacauggugaaaccccaucucuacuaaaaauaaaaaacuaggcaggcauggcggcacaugccuauaaucccagcuacucaggaggcugaagcaggagaaucacuugagcccgggaggcgaagguugcagugagccgagaucacgccacugcacuccagccugggcgacagagcgagacuccgucucaaaaauaaauaaauaaaaauauuaaaaguaaaugauacacaucaugagaucaucucccaaggcagcagagaauuuugcguauuuuuuucuuaguuuauauuguugcaacagaguaauucuucuugaucacagacuuugcuuuuuuuguuguuauuguuucuaaguuucacuugauccucaaaauaaccugagacagacaaaacagauagguuuucccauuaaucuccuucaugagucugacuuugccagccaggcugaucuuauauccauagcccuggaugcauuuauuuauguuauuccaucugccuauaaugcccauccccaaucuuggccuauuacaugugucuaacauuacuuugauguguacaugucagugaauuaccacuuaacugauuguuagcuuuuugagaguauguaucaaaucucaugugcauuuguguguccugaaacaaauuauuagguauaaaguauguauugcaaauaccaugcccagggaauauuucagagcugugguucuccaagugugguccuuagucuagcaacaucagcaucgccuggcaucaccugggaacuuguuggaaaagcacauuccaugaucccaccccugaccuccugaaucagcaaagcuagggauggggcugagcaaucuguauuuuaucaagcuguccaggugacauugauaaaugcuaaacuuugcgaauuacugauuuagagacuaaucaacucauuaaaaaguuaauaaauaggugagaauccauuguagcaccccagucaccuaugcuauuaucuucuaaauucacauuauacaaauuguaugccacaaaaauguuuaaggugaaaacccaaaggaauugaugcauuggauuaauucacaaaaauuuaacagcugcaauucauagaaaaaaaaugcaugcauaucugauaauuaguuguagauuaaaaggugaacaacuucuuauuauuaauacccaaugaaaauguaauuuuuuaaaaauuauggccaauugguaguuuuuuaaaaaucuguuaugccuugucaugauaaggauaggugaaaaggaacuuucauaaacuauugcuaaguauaugggugaaaccuuuuagacuauuugggucuaccuaauaaauuaaaauguucagucuuuucuaauuuuagcaccguauuucuacagauacacuggcauaucuguggagaggggcacuucugcuugucaccugauaucccuuacuacuacuaauauuuuuauaagcauuauuaccuuuaaaaucauguuaaaggguaaaugaugugcaacagacucaguuuccccuucucugacuccuguuuaguuuacaucucuuuucucucucucauuugggggcucaauacccuuaagauuauagagaaauugcaguagguaauguuggcuggaaaugcuaacuuguaagaaacuuggguggaaaugguuuaagccaucagccuaaacgaucagugaaaaugucagacauucuccgcuuucuucuuccaagauacuauacucuacuguggccuuagaguucuuaauuccuauauaauucugauuaaaaaggaaggagaugcuccuaauauaccuugcuguuguccccuccuguucauuaggguagcugaugucagucaaaauaaagucuagaaauucuugaguacuuuuuuuuuuuguaauauacugagaaugcuugaagcaaacuaaccaaauuuaaguguuuuaaggauauuaacaguaacaggagagccccucgauuuucugcuaagaaucaaccugaacaguuuccagacugcugguuggcaaugucaguaucaugagaaaaacugaaaaaauaagaaacuuuagagaaaaagaggaaucagugcaggcuaggggaaugaacuugguaauccaguagucuuucccugccagcauuuugauugauaagcuaagugucugcuuuuucucaucccuuauuuuuuggcaggaaaccaguauuuugauacuugaaugccuucuuucuaucuuaagggagaagccuucuuaaacuucaagugugaaguagauccuuuagguauaggaugaaaaauuaagugggacuauuugugaauuacuaaaucgcaaccauuaaagaaacuaaugcccuaauuagccugucuuuugacagacauggcauccauauguaagucuaauauuguaugcaaaugugagacagguuuugcuuucuagaucucuuugaugugaaaggaaaagcuggcuuccuggcuuccuucccauguucuguauggaccugccuucauccugcugccaacagcuccucaagggaacaugaaaguggaauuaaacccuccugguuuucagauucagaauccugggugauuaaguggcuugaucaaaaucagaaacugugaaagugcuaaaaauggucaaggcccaaggaguuccucauguguggucaaaagccuuucagaaaucaaagugugucuuuaaauaccuggggugcaaaaaucagauguuuuuuauuuaaagaaaaauagguauauuagagcagaacugggggcccucuguaggagccugagucuggguguuuacugucgucuaaggccuuguuaaugugggcuugaggcuucggaauccacgaacaggggaagcuagcgucucucgcugacuccaguccuagcucgagcuuuccauacugcccuacgugacuucugcacuuuugugccaucagccaguagacugagaaaaguaucugguauuugucggugucuucgguuuagcugcuuuaaguccuuggauggaaaaggcugauugucauccugaaaucauugucuccuaauguguaauuggggccaagugaagcacaguaauuuagaggaauucuaguuaaaaauacagauucuugggcucuaccucagaccuacagagaucugcauuuuucuuauucccccaggugauccuuuaaacauucagagguuuuuaaaacucaugcuuauaugcaauaacaaaaauauaaggauucuuagaaacuuguuauauuugucuugaacaugggaugacagacauugucauuuucauugaaaaaaaaaaugaagcagagacucagaauguauuuagagacaacucuaaauacauucuggcagagccuaacuacuggauugcagagauccucccugcuucccccaguccccaucuauaaacuggccaugugaauuucuagugguguucacuuccaaaguggugauuuuauaaaauauuacaaugaagcauuauuaaccucaagaaguucagaugcauagagaguuuauuuggguguggcagcauuaguggcuagguuuuauuuauccaagauaagacuucuuauuagcuaugaaaagggauuggcauaaacugcuuauuaauguccauuaacuguaucuaaagggaauaaacaguauaaaaggccaggcaugguggcucacaccuguaauccuagcccuaugggaggcugaggcaggaggaucauuugagcccaggaguuuaagaccagccugggcaacauggggagacccuguuucuacaaaaagucaaaaaaauaauaagcuggguuuagggguacacaccuguaaucccagcuagucaggaggcugugguuggaggaucacuugagcccaggaguuggagguugcagugaggccuggcggcaccacuacacuccaggcugggugacagagggacgaccuuaucucaaaacaaacaaaaacaaaaaacuguauaagcauaagaugggcuugagucacaaaauucugccuuucauaacuuucccccauuugcuguuugauuugcuguuucagaaauugugaaccuacuucucuacuuauagaacauuuaccucccucuuagauucuucccuuucuaucauugauacugacauucugcuuaaagaauuauccauuuaggcucucuucaaauccaaagugauauuauuuuauuuuaauaagagaugaaagggaaaauugacaaaaugugccuggaguugucagcauuguaaaugauggacuguaaaagcuucgucuuggaagauugucagagagccuagugccagcucaaaaaguguggucuuuuuagagaauugacagaaauguuacaaagaaaacaugugcugaauaccaacuccaggugcgaauccugagaagcaacucacucuauucugcaguaggagaugaauuuugcagguuauacagcagagcaauuuaaacucccuuguuucuuaaaguauauccuauagugacuugggauggaagucauauacuauccccuuuuuuguuccuucaaaguaaauacaccacagagcuggagaugucccagacacagggggaagcuguuuggauuuuucccacugccuguaaugaagcaagauagggaggaagaacuugggaacuugcguggcaaauggucaaguaaagaaaaagaaaagcuuuuucuuuacuugaccauuugucacaugugcuuucaaauccugaacugagucacaucugaaauaaaucacuuccuugucauuuccaugaaaggggcaguacaagaaauuccuugcacaucccuggugagccccuuguuacucucagauucagcuauugccuucaggaaaaaaagaaaaagaagccgaagaaagaaagaaaacagaauccucuagaaaaagcuauucugaccugugcucuuucuuuugucugagugugacuagauaaaugcauuagucugcuagggcugccauaacaaaauaccaaaauaccacagacugaauccuucaacaacagaaauuauuuuucucaugcuucuggaggcuggaaguccaagaucaagguaccagcaggucgguuucugaggaggccucucuuccuugauuuacaaauggccaccuacgcaucauguccucacauggucuuucucagagagaaagagaggugucucuuccucuucuucuuuuguuuuguugagacagaguuucgcucuuguugcccaggcuggagugcaauggcacgaucuuggcucacugcaaccuccaccuccuggguucaagcgauucucgugccucagccucccgaguagcugagauuacaggcaugccuggcuaauuuuguauuuuuaguagagacaggguuucuccauguuggucaggcuggucucgaacucucgaccucaggugauccaccugccuugcccucccaaaguucugggauuacaggcgugagccccgcacccggccuccuccuuuucuuauaaggacaccuguccuauuggaucagagucacacccccaugaccucauuuaaccuuaauuaucucuuuaaaggucugaucuccaaaggucccuugaggguuagggcuuugauacaugaauuuucaggggcacacaguucgauccauagcaguuggcuuauucauacuuuggguagauccucuucaucguuccucagcuacugucuauuuagugcacagcuucuuuauccuaaagcuagucaggggaggcauggaagguauuauuucuccuguuucugcaccuaaggcauuaaaacgagguuguggucuggcagccuaaacucggccuugaugaacuucaaauccuagaccuccuugguaugugaagugcauacacuuguauggagggauuugacagguuuuuuuuuuuuuuuuuuuuuugagacagagucucacucuguugcccaggcuggaaugcaguggcacgaucucggcucacuacagccuccgccucccgguuucaaaugauucuccugccucagccuccugaguagcugggauuauaggcgcgcaccaccacacccagcuaauuuuuguauuuuuaguagagacgggguuucaguauguugaucgggcuggucucgaauuccugaccuuguaauccacucgccucggccucgcaaaguguugggauuacaggugugagccaccgcgcccagcccagauuuuuuuaaauuaguuuuuaguguauccacacuguuaaagcagguggauacugcuggauaguauaacaaaguauagugugacaaacccauaaccaagcauuguuagcuauauuuucucaugucuugagccaaaaggucacaguuaaccuaauguugcuacuaaacacucauaccauaaaacauucuauuccagucuuccagauuuuacacaagaauaaaaugaaaacuuuuagacuacuggagauuuuuuuuuaaauacacaauuuguugaaugugaacgcuaaauugaaauugacaugcuaaguuuuauagauuacuucagcugcccugacuucaguaaauuuaguugugacacagguacaacagcugacuucuuucuggcauuagagguggugauguuucgucacucuggaguuaguaaaaccugaaacccgccaggcauuugacacacaguuugcugccagggacagcucagcuucuggcuuauuggagaggaaaugaccuaaccucuguguuuacaaaguguuugaaacugaggcccuuccacuuccuugcugaguguaaggguugaccuggcauccaaaauccccaugaucuucucaggauaagucaugcagccauugguggucaagaaaggauuuguucccuguggaagggcauuggaagaggaacagagcugaaacacacggguguucagagggaaaacaucucugcacuuaagagggcuagauuagacuauuagacuauuaucauagagcucgugauucaucuccuuuguuuaauuccagccuugaguaaaggacucacuaagaaaccacauucggccggguguuguggcucacgccuguaaucccaacacuuugggagaccgaggcagauggaucacaaggucaggaguucaagaccagccuggccaauauggugaaaccccgucucaacuaaaaauacaaaaauuagucggggaugguugcgggcgccuguagucucagcuacucgggaggcugaggcaggagaauugcuugaaccugggaggaagagguuacagugagccgagaucacgcuacugcauuccagccuggugacuggagcgagacuccaucucaaaaaaaaagaaaccacauucuauuccaguauauuuauuauaaccagaaauucuugucuuaucagcaaauagcuaauauucacuuacaugggcaguguauuagauuccuagggcugcuggaaccaguuaccacaaaccgcauggccgaaaccaacagaaauauacucucauuaucucauuauucuagagguuagaaguccuaaagcaagguguugccagggccacacugccucuuacagcucuaggggagaaucuguuucaugccuuucgcuugcucuagugcugcugccagcccuugauauuccuuugguugguacaugcaccccuccaaucuccaccucugucuucacaugguguuacuccccaugucucuguuucugugucuucucuaauaugauuaagggcccacccuucuccauugugaccucaaucuuauaucugcaaagacccuguuuccaaguaaggcuguauucuuagguguaggcauuaggacuucaacauauauuuugggggaaaauucaacccauaaugcgguuauguuuuuauuuuccuugacuuuuaagaaugugaacuauugucaaauuuuuucaaccacuaucaaauuuaaaucuaagaacuacaugucuuaaauuuaugaccucuucauuaaaaaaaaaauaauaacauuuaauugguaccaaaacgugaaagaguuuaaugcuuugcauuugcuugaggcugauuaaugaguaaaugugucaacuguggcuguuuuaauuagccaggguuaauuaauguuuaccacacuuggaagaugaaaaggcauguauaaaugcucuauaaugugaaucauuuuuuaauuuguuguugaagcuuauaguguagccaaguaaggauugcuuacaucauacuuacaaagggagguucauuaauggauacaaauacacaguuugauagaagaagcaagaccuaguauuuaauuaucagcaaggugacuaauuuacaguaaucuacuguauauuuaaaaauagcuaggagaaccuaauuugaaaguuucuagcguaaagaagacaggcugggcacgauggcuuacaccuauagucccagcacuugggaaggccgaggugggaaaaucacuugaccccagcaauucaagacuagccagggcaucauagugagaccccaucucuacaaaacaaauauuuaaaaauuagccaggugugauggugcaugccuguagacccagcugcucuggaggcugaggugagaagaucacuugagcccagcaguucaagguucaagugagcuaugaucacaucacugcacuccagccugagugacagagagagacccuuccucaaagcaaaaagaaaagaaaaacauuuaagugauggauaucccauuauacugauuugaucuuuccaaauuauaugaauauauuaaguuuucucauauaaucugaaaauaugcacaucuauuauguaucaauaaaaaauaaaauuuuaaaaauguaaaaaacgauguuggagcacuaugguacuuaacguagaggcucugacuuuugagguacauucauuaccuguuacugaaguugaguaugcuuuaauauuguauguuuagaaaagguaguuacauuuuuaaaucugauuguguaagaagaaaagaguagaaauguuuggggccaagucaauaauuauuuaguauaucauaauuugagaugaaauguguuuuuuuuuuucuuuuuuaguuucaaguugaaacauuuuaagaacagauaaggaaaggcuaacugugcugagaugaaaauaacauuuuuaaaguaacuaucuuaaagaaaauacauuucuagaauuuuguguaaauuuucaacaaagacucagaagccuggaugaggucuugugccaagacuggaaaguguggggauuagaaaaaguuugaagagauuguugugagauccucucguaugaggccugaagcuguacauccauggaaagcaguuaccccaggcgggaaaacagguuauccauucucgagugaguggccgggugggaaauaguccaucaugucgaauggaucguacuuuccagcaccaagauuugugguucucuaggugaauaagaugacaccccuucacuucacuucacuucaccauugucugcauggaguacguaucuaaaaacaaauuagcaaaaagguugggucuacuuuacuuuucaucuccuacacuauuuucuucuuuguucucggcaggaaaagaugaaguugcauuuuauuauuaucucauaggauucuuauucuaaaaugauuugauuuaaaacccauugcacuuuauuuggauaaaaaaugcuucacucucuaguucuuaacaauaacaccagccugauuuuauuacguuaagcacugcaauuagacaauacaaagaauuugcagcaacaacauguuauuuuaucauggguggaacuguucauugucuagcagaauuuauuaccagauaaaucccuuuuggggaaucuaauguggauguuuuuuucaaagcgccuguggaguucugcuaguauugggaacguuuccauuuucauucugaugcuucccugugggcuguuucagcauagaagugagcucucuggguccauguuuccauuggcuccacccaauauucugaaagauugcaacucaacauguguaaacagaaccuuucucccccauauuuucucuuuucguagauuaaacucaggucaagaauuagaaguuuauccuccaccccgauagcaucucgcccuaucccaaauaccgccaccaaaaugcccacuguuuuuccuugggccaguuccugaaauaucuuucuggcuguaucacucuugugugcauccuuaucggcuaugcuuuuggccauuuuuuacugcugacuuugucugguuagucuuuuauaaucuccaggcuucuccuccauccuuuuuuuacaguuuaccuguucaugaagcgcaggucacuugacccguagaauucccauaggcugggauuuugcuaauugcauacucaugguauaggucaguguauuccucugcccucuguaucccacaaacugaaagccucuuggcuaagcugcuucccuuuucacuucccuuguaccacagcagccagaagagucacagauccugggcagcuuguccucugugccucgguacaugcacuuguaucugcuaggacaaugaucucuuucccuggggccccacuguaauaucacuagucacaucccuaaagcccaggcuuguuucuuugucauucugucgguaucccuaccauaacacuuguaauaguaauuauuuuuaugcccaucuuuucuucugaaccaugagcccuucaagugaaaagaaauugaugaaguuauuucuagcacuccccuggaaaaaggaaggcaggcagggagggaggggcucacuaguuuaugauaaagugguuugauuuucuugguugcagauuauuucuuuuaaagugacucuuuucagcuucucucacuccugugcaucgugaaugcucuccugaagacagacgcuuuccauucauuuccaagccccccaugugaagugcuuucuguugccaggcuugguuuccccacacguuguuaaagaaguuaaagaagcuugugaauaagcuaaagcagaggagaaagaaccauugcuauaucuagaauuguucaccagaaagcaaguuuuguguuaaagaaaacacgaguaggccacugugcagaagugcuuacaggguuugugugcuuuuuaaaaucugcauaaauaaacauuucaaaugagcuaucauauauacaaggaugaugugcugucugugggaaaaggacccaauccuguguugugauuuuacauauauauauauauauaauuugugcuauuacacacuugccugauccccuuauaauuaucugcauaagucuuuuuaggcucuuugaaugaaauucacuauguauggauguugaaaaucauccuuucuaccaugagcucaucagacuugcuaaccaauucuuugcauccuuugaaguauaaaauuccaucaauucagcauguaucaacaugaaucaauuagaaugcacuuucuucacagcauggcggaguuuuugcuggcugccgggagcggcacuguuucccaauucauucauuugcuugggcccgccccaggauccuucuuaucccggucagauagacuucucucaugagcuugagagacggggcuggucacacaggacacggcuuuagggacacgacucacugaaacuacaaaaugagugcugcucuuagaguuguacccacagccugcacagcuguuauggcaaugcugugggcaagucuugcuacggcccauucuccucccucccuuguccuguuggaagguucagguuggagcugaaauucaguccagcacgcagcuggacaagccaugucuccuguaugugacucacuccccagagaaagcaucauguggacuaguaagggcuuggcuuuaucagaagcaaaggagagguuuacaucucuucuugcucucucuuaguggguucagagcuccagcagaaaaaaugggacacuguggauugaucuccagaaaaccccaaaaccagcacugaaggcuccaggagauuaugccuuuagauuguauacaggcaccagaaugacuuuugccuuuauaaaaaugcgugcaagagcaugaaaacuaauauuugaggaauuuuuuuuucucacuguacuuucugguccucacugaaagcauuggcaguuuuaaaaaaugaaaugugauacuguuauagacguagcaaaccucacguuucauuuuuuccaauucauucuauaucuaggaacuuacuuagaaggagaaacaaacuguacccagaaaaaggaaugaaacuggagaauucuuccucaugauuccucuguguccucaggccuaauuauccucauuccaaagacucuccauugccucaauaacuucgaaaaauuuacucuccuuaagcauagucauaaaaauugcauaguaaagugauaaagagacgaaaauaaugcuguaagaauaaaaccauuaaaaaaaaaccacuacucuugauuauuucugcuguuagaauuguaaaugaauucucauuccuuuuuucuacauuuuuggcaugaaauuuauguuacucuuauaauuaguaaaaacauuauauuuuauuaauaaaagaagacucacagugaagucauaacauaugcugcagagguuagacucuucaagucagauuugaagagagaauuucacguaacaaucaccuugaaaugucuucaggucagccaucaaaguacacaucucucaaccagccaggcagccaguuuuuccuccagcaugugaagagugaagagauagcuguuucuuggcuuaaagaccauaugaaauaauugacuuauguuuaaaagauaugagggaucaggccgggugcaguggcucaugccuguaaucccagcacuuugggaggccgaggcggguggaucacaagguuagaagaucgagaccaucccggccaacauggugaaacccugucucuacuaaaaauacaaaaacuagccgggcguagugaugcgcgccuguaaucccagcuacucaggaggccgagguugccaugagccgagauuacgccucugcaguccaaccuggugacagagcaagacucugucuccaguuaaaaaaaaaaaaaaggcaucaaaauuacauucacuucuauuuuuauuuuuguuuguagaagacaugcaguuuguaucacauuaaugggcauaugauguaauuucacuauaaaucgaaccagaggaagacauccaaauauguauaaauuaaagcugacaaugccuacaguacuaaacuuuuuguuuuaguauaauuggagacuuagaaaaguucuaaaaauauauuuaaaaauuuuuaaaggaaguugcagacauaauggcccuuuacaccuaaauacuucacuguacguuuccucaaaacaagaagauauguguguguguguuuguguguguguguuguaaucuuaauacagcaucuuucagagauuauuucuguaguauauaaacuugguuuuuuuguuuguuuguuuguuuguuuguuuguuuugagauggagucucgcucugucgcccaggcuggagugcaguggcacaaucuuggcucgcugcaagcuccgccucccagguucacaccauucuccugccucagccuccugaguagcugggacuacaggcgccugcaccaugcccggcuaauuuuuguauuuuuaguagagacgcgauuucaccucguuagccaggauggugucgaucuccugaccucgugaaccgcccaccucagccucccaaaaugcugggauuacaggcgugagccaccgcgccuggccauaaaguuguuuuuuagucucuacuuuaaguuccugacaacccaggcaggaccaagacucccuaauguaguuggaaaucagaucagcacauuggcacaaguucuacagguaaacgggaaaaaggagcccuacaaucugcuuuuagaugccagggagccuggcuggucuuuaucuugauuacugacugaugccacugguaggucuaaguucuuugaucuaugauguuugaaagccaaaaggaaauguguuuuaaaggaaaagggacuucuucuguacccucagucuaagccagacaagugauauuucaggaaaaugucccuagcaauaaggaauauuuucacaaaugaugugaagcuuuguuugugucccuuccagggcaguuuguuaccauaaggggacaaagcaugcuucauuuaaacauguguggccaggaaacuguuauuuuuaaacaaaaauaaaccccgauuuagacauguagucugaguuuuaacucugggagauuuucaagauugauaguguagcuaaaaauaacugaccuaauuuucuggaggucaagauaaaaacuggauuuaugguacagcauuuacuuugugauaauauguguauaaauucuuccccaaguuggaaaauguggccgcgucauacagggcuguaucucucuugaccauugaagugccuaggucgcuacacuacaauuugacuuagaguuggugaaacuucuggccauucacguagccaucguauucauccugagaaagggaaaccuaaagacuugggagaguguucugggaggaaagugcuauugagaaugggcuguccaagcaaagugacaggcaggccucacuuagcuagaagagggagcuuuucagcccugcuccaccaucaggaaucuccgugaccuuggacuacugcuuuaaucucuuuuauccuggcuucuaaaagauaccgucgaauucauucuuuuucaaaccuaucaaaaauuugaaauguaugaaaaagagggugcuugugaugauagauggguuuaugcuuccuuuuuuuuuuuuuuuuuuuuuuuuuugagacggagucucacucuguugcccagacuggagugcaguggcgcgaucucggcucacugcaagcuccgccuccgggguucacaccauucuccugccucagccucccgaguagcugggacuacagugccaccaccacaucuggcuaauuuuuuuuguauuuucaguaaagaugggguuucaccauguuagccaggaugcucucgaucuccugaccucaugauuccaaagugcugggauuacaggcgugauaugcuucuuuaauauuaguuucuaauccaaguaauauagccauguccucuauaaaauggaacuuuucauggaacagugagaagguugcauuaggaauugggauacuuggguucagauuucaguucugccacuugcuaguuuuaaguauacuucucaggauggaugucaguuuguucaacugucagugggaguagugaucccacuaaggaagauuauugugguuaucaaaucagcagauggguaugaaaaggccaugagugcaguucucaugguuaugaaggugucauaacuggcauagucccaucacaguauggcuuuggcaucgcagauggcuguagcauauaugcuaaucagaacaucccuaccguccuuaaagaucucauggguucucucccaaaucagcugcuccaccgaccuacaaguaaguccaugcuucuuuaguauauuuacucacuagugaaggcccgucugcuaaaagugucuucaguaggggagagcugcucuuuucugggaaacccagcaaugaaguuuguccugugaugcccucuacacuuacugaccuguuuccugagaacuucccguaacaaaugguccagggaagaaggaagucugugaccagucuuuccuuuccuguggcuuucugguucagaaaugugacccugaugauaagaaacuucaaggcaugacucugguguuuuggcaauauuccccuggcaguauuguuucuuggcucacacucaucucaugccuugcuuuguuugcuuuguuuuugagaauuguuuuuuuguuuguuguuuguuuuugguuuuggcuugugagacagagccuugcucuguugcccaggauggcgugcaguuggcacaaucucggcucacugcagccuccaccucccggguucaagcaauucuccugccucagccuccugaauaauggggauuacaggcacacaccaccgugccuggcuaauuuuuguauuuuuuuaguagagacggguuucaccauguuggccaggcuggucuugaacuccugaccucaagugaaccacccaccucggccucccaaagugcugggguuacaggcgugagccaccacgcccagccauuauguuuguuuuucuuucaugaagggauaaccgaggcuguugugugguggugucuugguacagcucguggcuguggucagugugguggaggguaggucuucucagaugguaacaugcaugagagucaccuggggaucacauuaacaugcagauucugauucccuggaucugggugggaccugagguucugcaugucuaacaaacucccagagaacacccauguagcaagaguacagacaaaaggauucaaagcgaagggacugcaagaaccauggaaccagccucccacgauuuugcggaugacgaacccgagccuuggggaguuucagaggccauggagagaugaaguauaauaaacagcauagcaguuguauguugagccaagaaucagacaugcacagaacugcugauuggaaaauuaaaucuguuucucauagcccugguguggcaaaaugccuagcuggaagugggugaccgcuugauuuacagugggccuccuggguagggaaaauuaguccaucccauuuacagcuacuuccaaugcagcugugucaggggagagagaagaaaggacauggaagagagcguagagguaugaucuucaguccuuucaggcaggcacauaaguaaauuuuuauuuaaaagauaagaauuggucauaugcgaaucuccuguuagauaagauuaaaaacaaauuuccauuuuguggagaaguugcagauaaauauuuuuccaugggauccaaaagaaucaaaaaggaaagaaaauaguaauagcaguggagguucgauccuagacagaagaaaauccagcaagccgagggacuucauauucucacugguguccaaaucagagcuuuuuuuuuuuuucuuuguuuacuuuaaguucugggauacaugugcugagcaugcagguuuguuacauagguauacaugugccuuggugguuugcugcacccaucaacccgucaucuagguuuuaacuccgcaugcauuagguauuuguccuaaugcucucccuccccuuucaccccaccccuggacaggcccugguguaugaugucccccucccuguguccauguguucucauuguucagcucccacuuaugagugagaacaugaguguuuggguuucugguccuauguuaguuugcugaggaugauggccuccagcuucauccauggcccugcaaaggacaugaacucaaccuuuuuuuuuuuccuuuuuuuuuuuuuuuuguauuugcaaauucaaaucuuuuuuuuuuuuuauuauacuuuaaguuuuaggguacaugugacauugugcagcuuaguuacauauguauacaugugccaugcuggcgcugcacccacuaacucgucaucuagcauuagguauaucucccaaugcuaucccuccccccuccccccaccccaccacaguccccagagugugauauuccccuuccuguguccaugugaucuccauuguucaauucccaccuaugagugagaauaugcgguguuugguuuuuuguucuugcgauaguuuacugagaaugaugguuuccaguuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaauugcgacacugacuuccacaaugguugaacuaguuuacagucccaccaacaguguaaaaguguuccuauuucuccacauccucuccagcaccuguuguuuccugacuuuuuaaugaucgccauucuaacuggugugagaugauaucucauagugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuuguccauuuuggcuuuuguugccauugcuuuugguguuuuggacgugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuucgguuacuguagccuuguaguauaguuugaagucagguagugugaugccuccagcuucguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcaguugguuuguaguucuccuuuaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcguaucagcuuaaggagauuuugggcugagacaaugggguuuucuagauaaacaaucaugucgucugcaaacagggacaauuugacuuccucuuuuccuaauugaauaccuuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuaccuuuauugauuugcguauauugaaccaagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaaccaucugguccuggacucuuuuugguugguaaacuauugauuauugccacaauuucagcuccuguuauuggucuauucagagauucaacuucuuccugguuuagucuugggagaguguaugugucgaggaauguauccauuucuucuagauuuucuaguuuauuuguguagagguuuuuguaguauucucugaugguaguuuguauuucugugggaucgguggugauauccccuuuaucauuuuuuaucgugucuauuugauucuccucuuuuucuuuauuagucuugcuagcggucuaucaauuuuguugauccuuucaaaaaaccagcuccuggauucauugauuuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcggcuuugagugagauuauuaauccugaguucuaguuugauugcacuguggucggagagauaguuuguuauaauuucuguucuuuuacauuugcugaggagaguuuuacuuccaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauguuuaggauaguuagcuccucuuguugaauugaucccuuuaccauuauguaauggccuucuuugucucuuuugaucuuuguugguuuaacgucuguuuuaucagagacuaggauugcaaccccugccuuuuuuuguuuuccauuugcuugguagaucuuccuccauccuuuuauuuugagccugugugugucucugcacaugagauggguuuccugaauacagcacacugaugggucuugacucuuuauccaacuugccagucugugucuuuuaauugcagaauuuaguccauuuacauuuaaaguuaauacuguuaugugugaauuugauccugucauuaugauguuagcuggugauuuugcucauuaguugaugcaguuucuuccuagucuugauggucuuuacauuuuggcaugauuuugcagcggcugguaccgguuguuccuuugcauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuacgugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccgcaucacuuucagguacaccaaucagacguagauuuggucuuuucacauagucccauauuucuuggaggcuuugcucauuucuuuuuauucguuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguuccguugcuggugaggaacugcguucuuuggaggaggagaggcacucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugcagugugaggugucagugugccccugcugggggugccucccaguuaggcugcucgggggucaggggucagggaccacuugaggaggcagucugccguucucagaucuccagcugcgugcugggagaaccacugcucucuucaaagcugucagacagggacauuuaagucugcagagguuacugcugucuuuuuguuugucugugcccugcccccagagguggagccuacagaggcaagcaggccuccuugagcuguggugggcuccacccaguucgagcuucccggcugcuuuguuuaccuaagcaagccugggcaauggcgggcuccccucccccagccucgcugccgccuugcaguuugaucucagacugcugugcuagcaaucagcgcgauuccgugggcguaggacccuccgagccaggugugggauauagucucguggugcgccguuucuuaagccggucugaaaagcgcaauauucgggugggagugacccgauuuuccaggugcgucugucaccccuuucuuugacucagaaagggaacucccugaccccuugcgcuucccaggugaggcaaugccucgcccugcuucggcucgcgcacggugcacgcacccacuggccugcgcccacugucuggcacucccuagugagaugaacccgguaucucagauggaaaugcggaaaucacccgucuucugcgucgcucacgcugggagcuguagaccggagcuguuccuauucggccaucuuggcucccaccucccgaacucauccuuuuuuauggcugcauaguauuccaugguguauaugugccacauuuucuuuauccagucuaucguugauggacauuuugguugguuccaagucuuugcuauuguaaauagugcuacaguaaacauaugugugcaugugucuuuacaguagaaugauuuauaauccuuuggguauauucccaguaaugggauugcugggucaaaugguauuucuaguucuauauccuugcagaaucuccucacugucuuccacaacgguugaacuaacacucucaccaacaguguaaaagcgugccuauuucuccgcauccucgccagcaucuguuguugccagacuuuuuaaugaucaccaucccaacuggugugagaugguaucucauugugguuuugauuugcauuucucuaaugaccagugaugaugagcuuuuuuuuuuuuuuucauauguuuguuggccacauacaugucuuguuuugagaagugucuguucauauccuuugcccacuuuuugaugggguuguuuuucuuuuuuuucugguaaauuuguuuaaguuccuuguagauucuggauauuagaccuuugucagauggauagauucagaucagagcuuuaacagccagacuuuacagggaaaaggcugaguggcaccuccuuuauaugaagaaaauguucuucuccaacccacuuguguucaguggauggaagaagcuguucaguaauuauaacugacacuuguaacacauaacugauugauuuaaugcccauaaauuuuauuuucuuuaaucguaagaugugaccguuaaauucuuagaagacauuuggcuaguggauuaauaauuaaaagaauauuggaugaauucaucugcuuccuauucagcaguucuuuuauuuauaaggcuauuuuucucaaaaugaaugaucaugaauaucuaagaaaaaacaaaauauuuagcuguuugaagaugaaauuauuaucuuuugauguuguuuucuuuaaaguguuuacaaugauaacuaagugguagggcuucuucccucuguuacucuaaguaugccucguauacauccucaaagcauuuuuuuuuuuuuuuuuuuuggagacagagucuuacucgguugccuaggcuggagugcaguggcaugaucucagcucacugcaaccucugucucccagguuuaagcaauucucccgccuuagccucccaaguaggugggauuacaggcguccgccaccaugcacggcuaauuuuuguauuuuuaguagagacgggguuucaccaaguuagccaggcugcucuugaacuccugaccucgugauccacccaccucggccucccaaagugcuagauuacagacgugagccaccacgccuggccaccucgaagcauuuguaaaagagcaaggugaugggguucauuagguguuugguauuugaaauuaaauaccucuguuauugaugaagccauauuuuaaauauuaucaccacuaaacucaguuaaauauuuccacuguuaacuacaagguucaaaugcuuggauauuauagaagauauuugacuucaaagauaaacgcuacaauuuugggucauaacaaauagcuuuuagaaggggaaaaaauaagucuugggaggaaaauaagcagucucuuaguuuaauauagcgguuggcaaauauagaugcuuaaaaguucugaaaauccccauugcaggccaucagaguguuguaauuaaguauuaaauuaauucagauaaaaggauaauccaucagggccacuaauguaguggaagugugguuucggugugauuagucucaccauggaagucaaagaaagucccacucagaaugaacaaugaaagaaucauauuugucucuggguauuuugucauaggcucaauugcccagugccaguguguaagccacugguaaaauccugagcccuuagucaugucuacagguagcuggcugccuuagacauuuuaugaugacgaaauugaauuccacuucugauaaugguaauccaucaugucuaccucuuuuuuucucuuaaaacuacacugacggccaggcgcaguggcucccgccucaucccagcacuuugggaggccaaggcaggcagaucgccugaggucaggaguuugagaccagccuggccaacauggagaaacucugucucuacuaaaaacauaaaaacuauccggucaugguagugugugccuguaaucacaguacucgggacugaggcaggagaaucgcuugaacccaggaggcagagguucguuguucugaaugacauagccaggggugguuauuucuaaauuuucuguguugaauuaagauaggaauguggauuucuuccuauuuugaacaacgaccaaaaaaaaaaaacgaaggcuaaguguguuucacucugcuaaaaauguaccuuuucuugaaucugucacuuuuucacuuacauuuucugaaaaugaauauaauuaaccaccauggggcucagcaugcugguggccauuuggaggaacuuuucuaccaacaguguaacagagaaaagagaaaaggguacuacagcguaccucaaccuccccugacuguucugugaaguacaaguguaagauuucucacugugaucuuuugcuccucugccuuuuuacugccaagggcuaagaugggcacagggcccuuuccagcugccccugccugagaaaugcuuauuugaugaccaaaagcaauaaccauuccauaggacuaacggugauuaagucagcuuacaaauccacaaggguggaagagacugcuaaagauauuggaacagacaugcuuaauaaugccuaauuucuacagcuacuuuugugauaauacgagaggcugaaauagauaggggcugaacaugggaaggcugguguuaugaagcccaggacuuggauuucagcacuggugcuuacuggccauugggucuugaagagauugguuccuuucucccagccucagucuccuugucccaucagauuaauaaugccugccuugggagaggagagucauacaggagagggcauuugagcugggcucuaaagaguucaaauaacguagaugagcagagaugggcuuccaagauagcaggaauagaaaacaaaagugucagaauggguaugcauggucuuuugugggaauaccccaagcuauuuagccugagagagaggugugguguagacagcuggagcugugaguuccauggcuagaaauacggggugggcccagaccacagagggccuucagcaucuggcaaaggaguuggaauuaauucgguagaaaaugaagacccacugaaacaaagagggagccauucuugugugucaggaacuaagauuucaggaaccaaacguaaaauaaaaaccagcagggagaccauugucucagucgguuugugcuguuaucaugauaccagagacuggguaauuuauaaacaaacaauagaaauacuacaauucuggaggcugagaagcccaggaucaagccgggugcaguggcucacgccuguaaucccagcacuuugggaagccgaggcgggcggaucacgaagucaggagauggagaccauccuggcuaacacggugaaaccccgucucuacuaaaacuacaaaaaauuagccgggcgugguggcgggcgccuguagucccagcuacucgggaggcugaggcaggagaauggcgucaacccgggaggcggagcuugcagugagccgagauugcgccacugcacuccagccugggcgacagagcaagacuccgucucaaaaaaaaaaaaaaaaaaaaaaggcgccuuguggcugcauccuccagaggcagcaaaaacuguucucacauggcagaugcacauaaaggggccugugcugguuuccucuagcccuuuuagaaggcaguaguccauucgggggcacgggguggaacugucaugacuugauuuccagaagaccccaucucucacuacuaccacaguggagauuuaaguuucaacacaugacuuugggggacauucagaccauagcaagcagugaggagacuaucguaauuauccaggcgaaaaguaaucauauuccuaggggcggugagggugguguggaaaagcaagcaggaaauggcugagagaauucagaaauagaaugcaaaaggauuugucgguagugugaguacuggacacgaagaaauacagggaguccuggauggcucugaaggauucaagccugugacugggagggagaaugguucugccaugauuagaaaacaggaaagguggaagggaaagccagggaccuugaguacaguuguguaccuaccaagugcauggaucaggagggagcccuaaguugguaucuccagcaaacuguuggaaauauacaaauuugagugggagggagaagucaaagcuggggaaguacauuucagauucacccaaagguaggagaucuuuagaguuucaagagucgaugggauuuccaaaggggagaauuguagaaagagauggaaagagauacaagaagaaaaugacagggaugaagagaggagaaaaaaagaguaaaaagaguuauucagagaugucacagggaagaagauaaguacuguguaugcgaaacagugagaacauuuccaaauaaaggacaugguaagugauaguagauaccacagacccaagaacagcguagccccuggggaguucaagagcuuucucgcuggcaaagguuauuuccugucaagaugaauguguaugcaccaauaauuauuaguauuccagaauauccucucuuuagcauaguaagugcuuaacagucacaagcaaaagauuuauauaaaagaaaugcucauuuaauuuauuuaaucagacauuggcuaaguuauuagccgcuaccuauggcuuuguaaaacaugaaaaaguuggaggaaaucuaaugagggucuuuuaucuguaagggaaaggucaucaugggcaucaaguauugaauuuuagaaacggugccacagugaauagggauauauuauaacucagauuagacuucaaaaggacuaauuugcuugggacuuccaucauuuaaaaucacuugcaauaaaacugacuacaugaaaagauauuaaucacaagcuuuaaugcuauuccaucaaauuauuuuaauggguauauuugaacagaauuuuaauuuuucagauacauuuuuugucaauagaaaagagaauuugaaagaugauuguaaaauguuacaaaucaaauuuaaauccugaucuuauuuucauuuucucuagcaauaaaacuaaccagugaugugucugaaauauauacuacagcaaacucuugacacagcuaugauuggaaaaugagacauuuugguuaaucaaauauuauuguuaauagugcagugcugucugucggucucuaauuuguaaaaaucagagaaaaacauggugaaucuuuggugacauaagagaagacucacaaaucuucauauccuggggucaguuuuuaaagcaguaauuacacaugauacaagauuauauucuaagcucucuuuuuccaguaagaaaagauaagucaaugauguuccauaaagcugauucuuguuuaaucaauuuuuaaaguggggggguaggcggcacugacagcauucuuuggaaagggaagcaacagaggagaaaggcaggauauuuggugucugcucacauugggaaauacggggagccaggggugguuaaguccagagaaggcuggaugucugucugcagggcuacaucuggaagggcaagggaacaguuuccuuguugccucagagcauaggucaugcagcacaagaggagcauuuaggaaaugcagauuuuuuuucaaggcaagacagugaaaacuauucaagaagguagcaaacuacuggcccuuuaaugcuuuucuuauccuugcaagugugcaaggcaagacaggagauugucuguugucuuucagcuugaaugagauugugccucacuuacugccgccacaccaaagccuggcguuuauuccugugcgaucauuguauacuagggacgucuaacugugucaggaggaaauggcagcugagccccuguggccuuucaccucuagcagugccacgcugcagcacauuggccggcugccaugcuccugccugcaguccugccagcagcucuugugagcugcgacuuugcauaaguagcuugaaugccaugugccucaguuuucacaucuguaaaagggagaugauaaugguaccuaugucauggcucuaaacgcgaucaugcacgugaaagcaguugaagucuugccuggcagaaguaaaugguggcugcugcugcugcugcuguugugauuguuguuacucaccaaagagaugguuuuguuugguuuagaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaagguaagaguccccugagccagcaagggcguucugggagguauauauacacauacauaacgugugugcaagagagagaguuaucuuuuguauguucuugaguggugaauuuuuuuugauguagucauaaauauuuucauuauaauuuuacuuuaaaaaguaaauacuaggaguuacuaugucauuaaaauaauauaucuguguaaauuauucuuuauauuuuuuaugcugcaaagcauguaaacugccaauuguuggaaaagacaacaacuccauuguauagguggcaaaacaaaaugguaaugauuuacauaacauuugcagguaaagggccucuuguuucgcacauguccagguuugcauucuagggaauauuauccuucgagugaacacucccggacgaaggggagccacaguguauuauugaagaggcaguucuucacaaggaaaauguguggcaauaacauucuucuaauuuuuauuuuccaguuccucuucuuaauauaaaaugguacauuauauaacaaaaguggauacauaaagagcauguacuguauaucauauuauuauguuuaugacuuuuucaaaugaggaaauggaggcaccaggagacuaaguucuuaagugaugacuuuugguaggaauuuuuuagaaauguuuuuuaacugugagguauauuguucccucuggaauggaagcacaaaauucaacuuguguuuaugacguaaugaccuagaaugccaccuuccaaaaaagcagauagauagugaaauaaggaaaaauuacaguuuaccaacagagaggaguuuugagggccugcagagaugcagauuugacaggcaccaaaguagucuucacuggcuacuuauucuuacaugaaauuucagauugaauuaaauguuaaaggcaaagauagagaacuacauauaaauaaaauuuaauuuugcuuaagacuuaauuuguguuuagaaaauuaaauuuaaggcagcugccaaaauuaaggagcacauugcucuaaauguuuuuuccuuugguaccucagagaaguaagauucuucucuaucaacaaauuugagcaguagauggcauccuuuuucacagggauuucuuagcagaaacaccuguucaggcaagaauaucuuucagcuucuuuuaucuuuuucuacauguucagaaguauacaauuacacacaaacaccuugauuucuagauacaaauaacauguuuuuuaagaacacaacagcacuuuaccugauuuucuuuaucaaagcagcaaauguugauggagauuucauauuuauaauauaccuuauaggccaggcaucgugggucacgccuguaaucgcaggacuuagggaggcugaggugggcagaucgcaaggucaggagaucgagaccauccuggcuaacauggugaaaccccgucuguacuaaaaauacaaaaaaaaguuagccgggcgugguggcgggcaccuguagucccagcuacucgggaggcugaggcaggagaauggcaugaacccgggaggcggacguggccagugagcugagaucacaccacugcacuccagccugggugacagagcgagacuuuaaauuuaaaaaaaauaaauaaauaaaguaaaaaauauauauaccuuauaacaugcaauuaguacuaaaucuaaauauaauauuagaccuuaaguguacuggacaaguuuuuucuaaagaaccauugcagaaaauauauagacuauuuucacaaugugaaucaucaccccaaauuuguuuccuuaauuugaaaaagggcaccuuacaguaauagcaaacagcauguuacugacaauguaaaaauaauuaaaacuuuaccauuuaugaaaauaauucuuaaucacauagaagaaaacaauuuuagggacaguucauuaucaaagaccuggaaaacuguccuguuaaauguauugagugcagauuguuuuguuucuuuacagguagauagauuuuggucauugaagguccucuucauucagucucuaaugagaauuuuuagugaaaaauguccgaucucauuuuguaaauugaaugcacgcuaaauuugcucuuuuacuaacagcauaccuuguugcaucagccuuaggagaaaaucugcgugcacacgugugaauguacacacacacacauacacugugaacccuugguaauugccaggauguccauuugagcaaagcccuugauuaaguacuucuggauacuugacaaacacgcagcuauuacauugccuaggucucaugaaaagagcugauauucuuguuggaugauucuguuugaacaguagaaucugguauaacaauuuugggaggcaauagaacuugcagugucagagucuugaguugcaguacucuucauuaucagucccaacauugacauauauauauugauuauagcaaacaauuuaaaaagccacuuaagcaauuuuuuuuuuuuuuuuuuuuuuugagacggagucucgcucugucgcccaggcuggcuggagugcaguggcgcgaucucagcucacugcaaacucugccucccagguucaugccauuuucuugcuucagccucccgaguagcugggacuauagguacccgccaccacgcccggcuaauuuuuuguauuuuuacuagagauaggguuucaccguguuagccaggauggucucgaucuccugaccucgugauccgcccgccucagccucccaaagugcugggauuacaggcaugagccacggcgcccggccccaauugguuuuuaaauaaaauagacggccaucaucucauaggauauuaaauacuaccccauaccccugaacuccugaaugauacagacccgaguuuaaauuccagcccugcuaugugcuucugagcaaguuacuuagccucucuggcugcuuccucgucuguaaaauaagguugacaauaauuccuaacucagagguauaguaugagcauuaaauaagaaggcauaaaaaagcucuuagcaaaauuccuggaacguaguaaaugucagugguagcuuuuuuuuuuuuuaauggagccaggaucuuauuagagagacuuuaucagccugucucaagaugaaucaccuuauggccucaacaauguauccuuaaaauaaugaauauaauaagccauauaaugagauacaguccuaaagccgucucucuucuaacaccgucucccaccucuccccagaaacuuguuagucuuucuuuguacagacaugugcacacacacacacauacacccaacuacugaaaauaucuaaaauucucaaaggauuuccuuuuguucuucaugcaguccucauuaucauaguuucaaaugcuuaccaaaaauuuguuguuuuucuuaagaacaaucagugaaauccagaggagguucugaugcccauuuuuuaaauuuacauugaagaaaauaagcauaucagaguuuuccaaugugcugugauuugccuuaacaauuuuuuauucuuugguuuucacauccacaaaaccuaaaugaauggcuaggcugaaaugaagcuguuguuacagaauugugcucacagaucgugaaaugaucuggcuggaagcauuagcguugaugacauuuguguuuguucuacuuuuuccugacugccugagaagggcagccacaaagagcagcauagcaugcagugacugccagcaagucuuuguggccaacagucugccucuuuguagauaauaccuagauauaauauguagauaaaauaauauuuuuaaagagacaaagcaggucuuauaagacuuguauggauguauuugcaaaaugugaagcugccuucuaguauauuuuuaacuagcuuuauagaggcaaugaggaagccaauuuaaauguugaaauuuagauuaaauaaauauuucauuaaacuuacaaaccaguucuugucagccucuuaucuauauguaaaacugguguacugcugauuccucauuaccuuuggccugguagagaguuuguacaaggcagcacgguuaauaguugagguuuauuacaaagaauaccagaaguaacagacucaaaaaucccagaggucugaccauucuguuucucuccucuuacagcaaaggauuugauucaaagcuacugagagcaagagaauaacucauuucugcuuacauuuuauuuuaacucuauuaaaaguuaaagcuaagauaauguauuucuuguuuuuaaauuacuaaacagccaauguaagauguuuuuuagcacuucauugaugaaguuacugucugguuaaguaaaggucaauuggaaaaauuggaaaguauuugcaguggauugggaaauaacacacuacuuuguuuuguugguguguauucuuuuuuuucggcaaugauaucauaauugccuuuuaaaaaacuuuuaaugucugcucccugagcuacuuauuuuuugagcauuaauuuauacuaaaucagcuucaaucuuuuaaagcagauuaggguuuaugucacugaaacuaguuuuguuuaaucuuccuaaaaaauaggguuaggguuuuauuauuguuuuuaaauaauacaugccuauuuaaaaaaauagaagaagaagaagaagagcggggagaggcagagaaacuuauaggacaauaucauuuguaaguuucuuucacauaaguauacgcauuugaacccuggaaaaaccauuuacuuugugacacaacugaaguucagaaagaaugugauuagccccagaucacagagaaaguaaguggugacauuagcaguggcccgugggacuaccagcuccucagccugcauuuaaaccacagguacacuuaacuuacugccccgaguugcauauacauuuucuaauaacguaacuauugauguaugugcucaccaccacuucaagguacgcguuugcccucgugcauguggucuguuguguucuuaacugcaguugaagcacuauugggucccucaucaucaggaaauucucacaaaguacaaugaccuuucaacuaacugcauuuuacaaggaguaauacaguuacucauuacagguugcugcaaauaggaaaaaaaaugaaguauagaaaaaccaaaccucauugucgaaauguauuugggaguugcagaaggaagugaacuaugucuuccucuaaugcacuagugaaauacuagagaauagucacucucgcaucaguaguuacuauggaauauuuaaucauaggauauuuaaucagugcaguucuguaguaucugguagggucucaaacaggcuuuaaagguuacuuauuuguuccucaccauaauuagaagaugcagauguuaacauuucuguuuccauauggagaaacagccacagaaguggcgcaucccaaggccacagacauuguaaauguugggcccaggccugggauuagaugccucacccuccuuuugacuccaccaugcugccagucucuacaugagaaaggaccaaauuuuuauuucauccaaauauccuagugcucccggaaauauuuucuuauauuuuggagacuuggcuuacugccacuuuuuuucucccucacuguuucuauuaacauguggcauccaaaaucgauuuggacugagaaucccaccuuugaaugccuggccugugugcaucaguaagcuggaugguuuugcugaaauuguuagaagccauuucaucgagcacaccgugucuccuucagcaccugugcucacuuugucuuaccuuuuucccuuuacacuugccaccuuaccaaagcagcuucccccugcaccuaccuccguggcuucauuuacccuaugaccauuauuaauccuaaaaacuucacuuuuguccccauuccuuguuucuucaaacgccagcguaaaacaaggaaguauuuucugagcaucagaagugcuuuggaaaggucagaugauggugaggaauaucaugcuguccacacugcuuucuuugggucggacccagaacacauaaaaagggaaaauugugaacaauggcaaauauaaaaugaaauauccucauuucacacguuucagcuguaugucaucugucaaauggaagccagccuuuuugaaaaagugagaaaaagacugcgguuucccucuucugcccucauacuaaggacaaauuugauucacucacuaaauggcagauuauauaguaaaacuuugcucuccugauaaauucauauuugcacuuccccuggaaauuuaacagaguccuuuuguaguuaauuaacuguaaaauaagauaagauugggcaguuguaaaaggaaguaucuuuaagguuuucugcuaggcugggaauauuuuauuucuaaucaaaagccaagaaacuaucucuaaacuagcucagagggaaauccacccuccccaccccucuucuuugauguugcugcguauccuggugagggcuuuuauuagaaaacuaaggagcaggacuggcacaucaauagcgauaagccauuuaaaguggugccccuccugguccucgaugcucgggauuaacucacugugguucuuuucuggcugcuccuuuuuuguaacuuguuuauugcauaugcuuuuuucccugcucgacuauguuugggagccacgacuuaccaucuugauuugucuuguuugcuuucugugucccuugcuuccugugcccaguugagccuguugaugcccgcccugcugccgaccgaggacugaccacucgaccagguaucagaaccgcuugacuugugccucuccgcaucuugggccuaagcucgagcagacguugucuccuuucugcauuuuaagccucucucaauuguacuuacugcagaguagaauuugaagugaccuuagaaaccaaacuuuuaaaaauuccccuugacuauuccuuacucuucauuucccaaguuccgagugaaaugauuuuuuuuguuucugagcuuucccuuugaaaccuaaaagagagcccuuccaaauuuggguuuuuuuuuuucuuuuuucuuuaaaacaaacaaaacaaaacaaaaacagagacgauuauauacagccuguccuuaaaaacagaagcccagauagauguagacucucaggugaugacuuggauaccagugugaacaucucuccuuucuuguuugguguccagauggguaauuuucuaacugaacugggcucaaacuucaaucaguuacugaaguagacaugauuuccugaaaauaccagaauugguuucuuuccagagcccaaaauacaucuucuguuuuguggguuguauguacuuauucucaaugaguggcuaaaguaacacaacagauguggaugcauaauuuugcacauaagcccuuuuuuuauguauuacuuaaaaaucccauuaacacugaaauagacacuucuuuuuuuacaguuucacaaacauuaagaagaaacacauuuuuauuuuaugaauaaugucauagcacagcagaagcauauaugugccuggugucuacucuaugaacaaccucacccaacugauaguagccagugcuuucagugaaucaaaaagaggaagaaaguuauugaauugacaaauuuguguauuccagggagauuuuaaucccaaauaacacauacuuuuccauauuuauuuucuucuuuauccucauaauguccccaggcgauagucaaagaacagggaauuaacuuucuuugaagauauuaauacacagaggucaaccuuugcugccugguucagauacagucagcagcagaccaggagacccacccugucccucacacuuccaccacaggcucgagccaugacugccuccaagcacggucacugaugaagacugagagucugccuguggcaucuucaugccuuuaugcugugauuaacaguggcagcagagacaguagugugacacgucuugacagcuggucucguugauuuaugaauuucugucuguaggcuuuuaaggggaacuuaaauuauagugagucagagacaguuucaguucuucuaauguccuccuuauugucaaugucauguaagggaaucucaaggagccaggaguugacauuccuguucugcucagccaacuuguaaggccucgggcugagggucaguucaguucuaauugcaaccacagccagcucagguuggucauuugccuugggacuuuuuucauggugcuucucuuuaaaagacaugcucuucaucuacaagcauaaaauguaacuuagaaagcgcucauucgacucauucaauuuuaucaaauuucuacauugggccaggagagccuauauguuacuauugaaacauccaggaccaggugacacuaccagucaauguuuuuuucuuuuuuaaaaaaauuguuuuuugauuuuuuuuuuuuuuuuuugagauggagucucgcugugucccccaggcuggaguggaguggcacgaucucaacucacugcaaccucugccucggggguucaagcaauucuugugccccagccucucaaguagcugggacuacagaugcgccccaccaugcccagcuaauuuuuuuguauuuucaguagagacgggauuucaccauguuggccaggcuggucucgaacuacugaccucaggugauccacccaccucggcaucccaaagugcugggauuacaggcauaagcaccaugcccggccuauucuuuuaaaaaaaauuuuuuuuaaucuaaaucuaacaaaaaggacaccuccaaacgcugucaaacaaaaacaguguguuuuaaaggaagagcuagagaauaguuaaugguauuacacuggugggagaaaaccauccaaaaccuuucucauaacaguaagaauaugaugucacuuggggauuucacaaagaucaauccacuaaauucuuucuagguuugaaagaaauuaaacgguagggucccugcucucaggagcuugagguauaauagaaggaauuuugcauauuuggaaacaugagauggaauuuggaagacaaggaaauacaaagcaacauuaagugcuaacaagaauguucugugaugggaggagauggaguacuaacccaggggcauguuaaguagagaacuuacuggagaugggcuuccagagagguuaugaaagauuugaggcaccuggauuggcaaagaagaagggaacaauucuauucagaagagaggguggccuaagccaagcuuccuuucauacacagcguaggcuuggguugcccaguaagauggcuaaaguugagaaagaaugcucagauaugaagugaggaagauucuaguuaagguuugucuaugaauagcaguauuuacugcacauguauuaagccaugcguguguucuguuuuugugcuuguaguaaguuuaucaaacauuugggcuaauuuccccguguuuuguagcauagcuuugguucuucuucacauuuuagagaccacccacuugagucuaaugugccgaauuauaucuuuagccuuuccaaacuuagaaagccuucccaagauugucaugccguucaagugauggcauuguuuuugaauaaucacuguuguccucagaaacaaguuaaaaaaagguuuuuguuuuucccccacccagugcuuuauaaucaugacugaggaaaauggcuucuccuuaacucucauaucuaaaaaaacagaauaugguagcuuccagcaugcagugucaaguagggaccauuguaauaacaguggugauuugggggcauaguggccauuauagcuccuccuccuggcuuacuuccaaagaaaaaauagacucugaaggacuaauuauacaguuugaccagaauaaaaaagaaaaacacauuagcgagcucuucacauaggguagaaagcuacccuuucuguuacaauucaucaccacccuucugcaguccaaauaaagggaaaccagguccuugacccgagccaugcaagaggugucaugaaggacauaccucccuuagcccccacaugaacaaaaggcucuguccacucaucaugacuuacaggaagagagagcuggagucaccagggcuuagggugaaaucagcacaacucaagaaagaccucuaaguaagccugcaaaccaaggucccugccauuuauuugaaacuacucaucacauuuuauuacaugcauuaucaccuuauuaugaauauuucccuaugugccagcuuacugauuuugucuuuuaguaagauuugcuuaauguaaaaagucuucccuagaugacuauucaugcuaaacaaacaugaacuauuauagcaagagcucuucugccaagagcuucucaaacuauugagcuguaaacaugaauuuaucugucaugcugacuugauaauaugaauuuuuuuuuuuggaccaccaaaaguauucacaguaucauuucaaaaguagugugggcuuguaaaguuuuuaguggagagcucuugguuuuguuuuuuuuuuuuuuuuuuuuuuaaaacaggauuugucucuguuuccaggcuggagaacaguggcaugauaccagcucacugcaacccccauuuccugggcuaaagcuauccucccaccuaaguuucccaugcagcugggauuacagggaugugccaccacaccuggcucauuuuuguauuuuuaguagagacagaguuuugccauauuggcuaggcuggucucgaacuccugaguucaaacuguuugcccgccucagccucccaaaggcugggauuacaggcaugagucacugcaccuggccgagagcucauucuuuuuuuuuuuuuuuuugagauggagucucacucugucgcccaggcuggagugcaguggcacgaaucucggcucacugcaagcucugccuccuggguucacaccauucuccugccuaagccucuaguagcugggacuacaggugccugccaccacguccggcuaauuuuuuguauuuuuaguagagacgggguuucaccauggucuugaucucuugaccucgugauccucccgccucggccucccaaagugcugggauuacaggugugagccacugugcccggccagagcucauucuuuacuuuuauuuuucaguauaaauauuuggcuccaaaaucuaaaagggaagacucuucaaacuguucaagaaaguuuucuuaaaaaucucagaaauauaguucuaaccuauuguguugcuagaucuuuuauuuauuuauuuauuuuuggagacagagucucauucugucacccaggcuggagugcaguggcacaaucucagcucacugcaaccuccaccugccggguucaagcgauucuuaugccucagccuucuggaguagcugggauuacaggcacccgccaccacaccuggcuaauuuuuuuuuuuuuuuuuuuuuuuuuuuuuuuguauuuuuaguagagacaggguuucaccauguugaccaggcuggucucaaacuccugaccucaagugauccacccagcuuggccucccaaagugcugggauuacaggcgugagccaccgugcuuggcacguugccagaucuuaauaacagaaaaggagugagcucuaaagaaaucacugguuauauaaggaucucagauuuaaaagggcuauagaaagauuaaaauauacagccagugagaauuaagagaguuuuagcaucacuacccuauaaaaauaagugucagaaagguucguuucagcagaaugaguugaaacuuaaccaaaaaauacuuaacaauauuaaaguaagaaaauaaauaagaauagagaacucugugggucucguagcaagaaguuggggguugaggguuaggucauugagaggaccagaguuaaagaaugagaaagggaaacugucccacuuccauugugccuuuuaugucuauauuaaagagaaugaacuucugaugaaaggaaauuaaagcccgagauagaucaacaugagaaaagaaagcccuagcccauuaguuaccuauugcuacguagcaaauaacgcgagaauuuagcagcuuaaaacaacaagcauuaguuucuuacaguuuuuauaggucaggauuugggaugugguuuagcuggaugguucuggcacaguguccgucaugugguugcaguuaagacacugccugagcuaaagucaucugaagguuugauuggaccuggugggucuguuuccaacguggcucacucacgucacuguuacuaagagaccucaguaucuuaccaugugaacucuguaaugcugcuugagcgucccuacaacauggcaucucgcaccccugcaccaagagguccaggaaagagauuaaggaaguuuuagugccuuuuuuggcccagucucagaagucauacaccaucacuucuaucaugcucuguucacuagagcaagucacuacaucccgaccacauucgaaggaagggaaucaaguucucccucuugaaggaaggaguaucagcaaauuuguggauauauuuuaaacuaugacaucuugcuacccaaguccaaguucuuaugacccagaccaacugcaggcuaagagaacuugaaggggaaguagcaccauugccuguggucuuuguggaaagcugggaagguagggauaggaaaaugaaguucugaauagcaaaaaggagagaagauagcuucacaaucuguaagccagguauagagugacauugauugugggucucuuuucaaauagguuaucaaguggaagcuuuuugaacaauuggaugaggaaauggugcuaggucacaaccagcguggauuuccuagguuuugucagauuauccuuaccuucuccuuguauaggcugugcucuuagacuggcacaucauaugcuguggacauugugcuuuucagugucagcaagaugugucacaaguuucccagaaucucguagacaagauugaaagagugauuaggccaagagcaggaagugaauuccccugggagccaaaggaauugggaauguguagcccaaguaagacaagaaccagcaggaacaugccucuccuuagggucgugauaccuguucaagguuuuaauguggaagggaggauuaggcuugcucuguguugaaucaggcucaaaggauggaaguuacagggaagcugauucuggcuucauguaaaaaaaggacaguuugggcaggcaaaucuaucaaaaaauggagggaaauugauacauuccucuauguucaaacaggaacugacaaucugccccugggugggaacacgguagagaagaugacuucaaaagcccuuuucauccuaaaauucugauguuugauaauuaaauguuauagcauggacacugacauuuacauuuuuuacuuauguuuuugguuuuuaaaugacucugcauuuuguuuuaagcuucaaauuauuauuugaauaaugaaauucaucagaacaauuaguguuaagaaucauauagcaauuuauagaaaaggaagaguucguagguuauaaauucuguuaguugcuaagaagcauuuuuaaaauuauguacuauagcucuuuauucagcagacgaaccaauuacaaucuguguaacuagaacacuugacuaaaauuauauaauuuuuacaacgcuucacugcauagauacaugaacauaauuuauuuguaauuggaacaaagccccaaaguagcaguuuuguucuaccagguaauuaaugcucauuuuuaaagccuuuuauuauuauuucugaaguaaugagugcacauggaaaaagacacauaauaggcuaaacaauaagcccguaagccaagccaacauauuccaggaacaaauccuugccaaccucucaaccaggauuuaacuucugcuuuucccccauuuucaaaaauuauagcauguauuuaaaggcagcagaagccuuacuuucagguuucccuuacccuuucauuucuuuuuguucaaaauagguaguaauugaaguuuuaaauauaggguaucauuuuucuuuaagagucauuuaucaauuuucuucuaacuucaggccuagaaagaaguuuuggguaggcuuugucuuacaguguuauuauuuaugaguaaaacuaauugguuguccugcauacuuuaauuaugauguaauacagguucuggguugacaaauaucaagacggaggagaucucugaagugaagauggaugcagaauuccgacaugacucaggauaugaaguucaucaucaaaaauugguacguaaaauaauuuaccucuuuccacuacuguuugucuugccaaaugaccuauuaacucugguucauccugugcuagaaaucaaauuaaggaaaagauaaaaauacaaugcuugccuauaggauuaccaugaaaacaugaagaaaauaaauaggcuaggcugagcgcaguggcucaagccuguaaucccagcacuuugggaggccaaggcggguggaucacgaggucagaaauucgagaccagccuggccaauauggugaaaccccaucucuacuaaaaauacaaaaaagauuagcugggugugguggcaaacaccuguagucccagcugcuggggaggcugacgcaggagacuugcuugaacccaggagguggagguugcagugagcugagaucgugccuaggcgacagagcgagacuccaucccaaaaaaaaaaaagaaaagaaagaggcuguauguauaguucuuucagacuacaaggcagcaaaguucgugcaugacucgggacuuaaaguggaauuaauuucaauauagcagccacuuugacuuccacuguguuuucugggaaaauagguuuacaauagguuuauuugaaggaucaaacacaugcauacacugcuugguuuuacagaacacuuuauguggcuuaaauucacauccggaacugucuuccuuuacccauucauuucucccccagcucuuucuuuucauucccuccccuaccucccaugauuuaacuucucuugcaagaguaagaucauggagugagcaggaccccaugauguucccgauaguguuauucaucaaaagguuugugcaaagaagacagcagcuuccuuuucagaugaaaucacuuuuccccccuaauguuagaauuggaguaaaucaaaaagccacaucuccuuuguggucagcucuaguaguuauauaaaauccuuuaccaaaagcuuagaaauggagauaaaucaaaucguggauuauguuaggguuccaucuuaucaguaggugcaguaagaggguuaaauuaaugaagacgacaauuuuaucacauucagugguggacagaaaaaugguaagaaaauuuccauagcaauaauacuuaaaguuaucucaggcacuucuuuuguuuuguuuugugugugugugugugugaguguuacuuuuuuccaagcagaaaaugucuuuucaauauucauaaaguugauaaauccuaguauuaaucucuaaaagaaacaccuccaaauuauuauuuaugccuuacuugacuccaaauaauuguagcaaauaaaaaacugacuugggauuuggauuugcauucuuaacucccauaguucuuuuuuuguagaaagacauuuagcuuuuugaagcaugguuuucauuggcaagauaaucuaguaucaguuguuauaagaucaggguuucucuugaugaggcuguugcugaagagguuaauaaaaacuggggaaccacuaaagaguugaagaguuggugggguagaaagcugacgauuaauguacagauuugcauuugucggggccuggggccugugucauauaagcccauccccacaauuacacuaacgccuauaaugcgacagugacuaauggcagcggcagcaauuaggagaaucagcucccucuacuggacuaguuaagauaauguauuauaauuagugcaaugaauauuacaaaauuacaguauuuucuuaaaggcacaggcauauguccagacuuguauuuauuccugauuaccucacacuaguauauuagcuaauuaaugauuugcuuuucauaaaaauguugagcuagcauauuuguuuaguaaagggaauaauuaugaacaauuucucauuuuguuauaaaccacgaguaaaacacuuuuagaaguugcuucauuugcuauauuuuauauugccuuuccagauugcuaguauguuaguuucagcuuagaaaaaucagucauuugacuaccuugaggcuaaauugaaagaauuuuuuagggagguacaggcauaccuuggaaauuucagaacaccacaauaaaacaaauuuugcaacaaaaugucacacaaauuuuuuggcuucccaguacauauaaaaguuauguuggccaggcacgguggcucaugccuguaaucccagcacuuugggaggccaaggcagguggaucacaaggucaggaggucgagagcauccuggccaacauggugaaaugccaucucuacuaaaaauacaaaaauuagcugcauaugguggcaugugccuguagucccagcuacucgggaggcugaggcaagagaaucucuugaucccaggaggcagagguugcagugagccgagaucgcacuccagccugggcaacaagagcaagacucugucucaaaaaaaaaaaaaaguuuguauuuacacuauacucuagucuguuacaugugcaauagcauuaugucuaaaaaaaaaaaaagccauguauauacuuuacuuuuauuaguaaaauauuuuauuacuaaaaaugcuaaugaucaucugagucuucagcaaguccuaaucuuuuugcucguggagaaucuugccuugauguucacugcugcaggcuaauccaggugguggcugcugagguuugugguggcuguggcaauuuccuaaaauaagacaauaaugaaguuugcugcaucgauugacucuuccuuucacaaaaagaugucucuguagcaugugaugcuguuugauagcauuuugcucacaguagaacagcuuucaaaauuggagucagucuucgcaaaucuagccacugcuucaucgaguuuaugugauauccuaaauccuuuguugucauuucaacaguguucauagcaucuucaccaagaguagauuccauugcaagaaaccacuuucuuugcucauccauaagagguaacuccucauccauucaaguuugaucaugagaugguagcaguucagucaugucuuuaggcuccacuucuaauucuaguucucuuguuauuuccaccacaucugcugugacauccuuuacugaagucuugaacuccucaaagucacccaugagaguuggaaucauugucuuccaaacucccguuauugcugauguuuugaucucccauggaucacagauguucuuaauggcaucuggaauggugaauccuuuuuagaagguuugcaguuuacuuugcccagauccauuagaggaaucgcuaucuauggcagugaauagcccuacaaaauauauuugaaauauauuuugaaauaauaagaggcugaaauaauaagacuugaaaguugauccacaggcugcagaauggauguuguguuagcaggcaugaaaacaacaguaaucucccuguaccuguccuucagagcucuugggugacuaggugcuuuguuagugagcaguaauauuuugaaaugagucuuuucugagcaguaggucucaacaguggguuuaaaauauucaguaaaccaugcuguuaagagaugugcugucaucccaguuuuguuccauuuauagagcaugggcacaguagauuuagaauaauucuuaagcgcccuaggacuuuuacaauggucagucuuggcuucaaaaacaaagucgccagcugcauuagccccuaacaagagagucagcuuguucuuugaagcuuugaaggcaggacuucucucuagugaugaaaguccuagauggcauuuucuuccaaauaagucuguuucaucuccacugaaaaucuguuauuuaguguagccaccuucaucaggagucuuaucuagaucuucuggauaacuuauugcagcuucuacaucagcacuugcugcuucaccuugcacuucuguguuauggagauggcuucuucccuuaaaccucaugaaaucaaccucucccaacuuuuuuuucuucugcagcuucuucaccucucucauccuucauagaauugaagacaguugugggccuuguucuugauuaggcuuuggccuaagagaauguugugguugguuugaucuuccauccagacaacuaaaaguuuucuccguaucagcaauaaggcuguuuugcuuuaucauuugugugcucacuggaguagcacuuuuaaucuccuucaagagcuuuucuuugcauucacaacuuggcuaacuggcacaagaaucuuggcuuucaauaugccuugcccacuaagcuuaauuauuucuagcuuuugcuuuaaagugagagaccugugacucuuccuuucacuugaauacuuaagaggccacuguaggguuauuuacuggcccacuuucaauauuguugucucucaagggauagggagccugggaguugaggggguggaguggccaguuuggggggcagacagaacacacacaacauuuauugauuuaguuugcugucuuuaugggcauguuucaugacacuccaaaacaauuaaaauaguaacaucaaaggccacugaucacagaucaccaaacagauauaauaauuuuuaauguuugaauauuuaaauaauuaccaaaaugugacacagacaugaagugaaccuguguucacuguuggaaaaauggcaccaauagacuuguucgaugcaggguuaccagaaaccuuuuuguuuuuuuuuuuuaaauacuaucuguaagcacuacuguacaauaaagcuauguaugccuguauuuucauuaaguugcagagcaaacgugguaauauuuagcuuuaguuuuacuucaucuggcauaagaucaacuccuuauauaacaagaugauaaaaguuguggugugcuucuauaauuucauucaaguagauaaaguugaaaaauaaugacuugcuuuuauaaacaguaugaagcaauguagugcaguaaaugaaauuuuauuccuucuuuacaauguucucaaaauuauuuuuauguuuaauccaaauaaagagcaagaauaaagcaacauuucagauuuugguuucuggagacaauaguuagaaagcaugaguuaugagugacuuaaaauucuuguugccuguacuucacuuugaaauaacauuaugcuuuaaaaagcauuacacugcuaaagguuaauuagaauucugcagaauuacuauagcuaaaaguagguaacaagauaucuuuuuuucuauuguuuaacuccuuuguuucagaaugccuauuccugugcauuaaaagugucccuccaaggaaauuaggacaucugcagaguugaaaaacaccuaagucucagucacuuagagucacacaucagggcucagagugcuaugacuaggaaaaugcugaccuccuuucauuaguaugaucgugccuuuccagcuuuugauagauccaagcgcuaucuucccaccacucaccaaauguuccaccugucaaaggguuucaggucccugcagacuucgguuuugaccuguggggaaaguagacuuccucgaacuggggaagccacauguuguacauccuucuauaaacuaugauuaucauucuuaguaggaaaauaugugauuucuuuuuuuuuuuuuuuuuuuaaaguaagcaucaaauauuugaccaaccaguugggcagagaauauacugaaacuuuuuauauaaccucauccaaauguccccugcauuuaagaaaugaaauucuucuaauugcguuuauaaauuguaaauuauauugcauuuagaaauuaaaauucuuuuucuuaauuuguuuucaagguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguagguaaacuugacugcauguuuccaagugggaauuaagacuaugagagaauuaggcuuagcuuuuugcuaagaacuagcuaaguaucucuuuuaaaaaacgaaucagugugcuuccaugaugcuuggguuacaguuguucuuucuuguuuugguuuucauucauugcaacuuaccgugaauauucugcucaagguauugagaguguguguuguuaucucaacuuacaauuuguguugaaguuaucaaaauaauacaaaugauaaugcaugacuuuaaaaaagcaugauuacucuuagacuuuuuuuuuucaaacacaagcaacaaaaaccaguacaagaaguuaaaaauaaaaauagaaguaggaaguugcuuuuuccaaaaaaacuaaacauguuuauucuuggauuucuuuugucuuaaauagucuggccucucaauacaaccagguaauaguaaauaaugugacuuuucagugcagacucuuaccuuuaaaguuucucaggaaaucacacuauaccaaauggcccaccaaaacauacaugauuguuauuugagaguucugcaaccuauuacccugcacuuccaccugaaauaucuuaguuucaaggugcuauacuaaaacaagaaagagagaaagaaaauuuacgaauaaguuauuuuuaugcauuugaaaugccauuuggaugggggaaaaaguguuaaaaucucacaguauaugcaacuuuuuaggaaacugucuugcagagaguauaguguaaacauaacuuuuauaugcacagggaaacugaaaaauuugugugacauuuaauugcgauauuuuaagaguuauggaauuuuuagagcugaaagauuuauugaugaugaccaaucaaauugaucuucucaucuuguagaugagggaacugaggccgagacagaaggguucaaauuaugcaaggucaagcucagaguccagauuuccccucauauuccccauugcuuuuuuuuuuuuuuuuugagacagucucgcgcuguugcccaggcuggaucuuggcucacugcaaccucugccuccuggguucaagcaauucucuugucucagcuuccugaguagcugggacuaugggcacacgccaccaugcccggcuaauuuuuguuuuuaguagagacaggguuucaccauauuggucaggcuggucucgaacuccugaccucaggugauccacccgccuuggcuucccaaagugcugggauuacaggcgugagccaccgcgucuggcccccauugcuuuuuccaucagagaaaaguccagguguuucuagggaguugaagauuccacuauccccaaggaaaugggcucuaaaccauucuugauuagaagaggacaggcagaguuuaaauaaaugaaauuuguggugaagccagaaauuucauuuugcucagcaauuaaaaccucugcagacuacaacagaagcugcugauggaaauugggguggagccucauuuccccauucauacugacguggaugagcagugugaggaaggaaaccaagagaacagcaggcagcaggguggaaaggaacggacugacccauagaucagagugugagcacauaaaagcaaugaccccacugucauguuuggccauugcaccuuuugugauaguaucuaagcuuaugucccucaaaacaguguaagauagguuuucauuaguaucagcuuauuucauuucugcucaaauuaauuuuuaaaaaaauuuaauuccauauuugagcaaauaaagaugucuucauacuugaguaauucaagaccccuuuuuugcugcuguuguuguuuugguuuuuuucaugguuuuguuguuuucuuuuguuguuguuguuucuuuguuuuuugagauggagucuugcucuuucacccaggcuggagugcaguggcaugaucuccgcucacugcaaccuccaccucccagguucaagcgauucuccuaccucacucucagccuccugaguaacugggauuacaggggcauaccaccacgccuggcuaauuuuuguauuuuuaguagagacaggguuuugccauguuggccaggcuggucuugaauuccuggccucaagugauccgcccuccccaaccucccaaggugcugggauuacaggcaugagccaccaugccuggccuucaagagcacuuuuuaguuuauuuaauauaauucucuuuguugccggucuguccguugaaguugccuucuuugaugccagaggccaaagacuuggcuuccucgggcuuccauaacaaaguaacacagauggguggauuaagcaacagaaauuuacccucucacauuucuggaguguaagaucaagguaucagccagguugguuccuccccaggcaucucuccuugguuugcagaugccugucugcucccuguaucuucacaugaccuucacucuguuuuucugcuguguccuaaccucuuccuacaaggacaccagucauaguggauuaggaucaacccugaugaccuuguuuaacuuuaauaaccucuucgacccuaucugcaaauacagucacagguggagguacuggcagcuuaggacuucaacauaugaauucuagggggacacguuuuagcccguaacagaccccagugaugcugagcauaaaagcaaggccuccaccuggagcuccuuccccuggcugugcgugagaccagguccuaccucagaccuaaggaaaaagaauccccaaauaggaggcugcgaaucugaguguugaaaauuuccccaaaugaaugagaugugcagucggauuugagaaucccugacacaucauuuuaacacuccuuccuuuuaguucuccgcgcaagccucagggaguggaaaaugguaucucucaccucccagauaaccgguugccuuuuaagugcucuuccagcugccugaauuaaaacgcucuuuuuuuagucaguuuaccaagcagugucucauuggacuuaaaaugucagaggagaaguugacacuuugacccagauucugacauuaauuuuuaagccaggagguauccuugcaggagcaaaaucgggaaggauggcuguucagcucuucucuccucauuuugcugucuacuggagagcaacuggaagccuuucuagaugaggggcuccaccucauucguguuuguuuuguuuauuuccucucagcuccuuccccucaagaccuuugugacuguccuuccugaaagcagcccucugugcagccccauagugugucuguacagcaauguugaaauagaccacauuccgcuuuucuguccucaaaaaagauguaguuuagcugggaugguagaaccugaacacagggaguugcaacccagccuagggauguucccaggugagagagcacggugggcuuucagagcaccauuuuucuuagcauuccagcgucugcacccacagaagugaugcuucugcaacauccucuuccuaccuuaacaggcacucucacccucaaguacauggaaauaccuuuauuuccggcucuggcuaaccuucauuaaucaguaacccuacuucaguaagaacaaaaaugaguacaucaauauuuccaguuggacucaccucagucacucaggacagaauaccauuguacuuacauaccaucgugccugaagaagucaugaugaaagcuuugguuuccaggagauuuuuuguuuuuagagugaaaaaugcccgcagaagaucacagagauaggaacccuaggaaaaaaacuccugagaacaaauguauaaaugaaacaagccuagaacagucacauaccacuucacacuggagagaacguucugagaaauguggcauggggcgguuugaucgcugugcaaacaucauaaaguacauguacauaaaucuagaugguauagccugcuacacaccugggcuacacaccuacaacuauugcuccuaggcuccacaccugugcagcauauugcugcacugaauacuauagacaguuguaacacacuggcagggauuugcguaucuaaacaaacuagaaaagguacaguaaaaaauacgguauuauggggccaccaucauauguuuggucugucguggacuaaaaugucauuauguggcccauaacuguauuuuuauugguagaguuguuagcauuuggaaaugagcacuugcuaguuguuguuuuuuuuuuuuuuuuuuuuuuucaaauaagcaggaaauauugacuuacugaauuuacuuagccauaaggccagagagucacucugugagccauuggccacgcuuucccaaggagguaacugugccuuauuggugcuucaagcagugaagcaauagcccuuuauuauuaccacuccccaaaugugcccuccaugucagaauagcccucugguggcuggaaaucucagcacuagcugaauuaaccaccuugcuccuguuuuaggacguuccugcaaagcccacuaaucccaggaucuguuuaguagcaagcgguacuuuucuacauucacauacauagacacuggauauuuaaaaauacguauuguagcucuuucugcuacucuccccagacaugucaccuuuaauaaggagaaguugggggcacagcuucucuuuauuauaggaugugaaaaaguuuuccucucacagaucugaucacuugaacaccagaagucuccccgcccccaccuccugguuaucucauuaaugaucuaaauaagaagagaguuccuuuuauuuggcuuuuauggagguauggcauaugacuuuuucuaaguaauaugcugucacacuggugacuguauaaaaagauguccuuagagguccuuucuucccggccagaagcugacccaccaggauacagacgcacugacguuggcauuguagaguaguuggagagaguggucagguugaauggaaagccacgauaaggaaaagugagggggggugcagaaccuaggaguggcuuacagugagcagcaggaagagaaauuggaagaucaaaggaaagcaucaaaaaugaucacaggccaggcgugguggcucacaccuguaaucccagcauuuggggaggccaaggcagguggaucacuugaggcuaggaguucgaguccagccuggccaacauggugagacccugucucuaauaaaaauacaaaaaauuagccaggcgugguggcaugcgccuguagucgcagcuacucaggaggcugaggcaggagaaucgcuugaacccaggagauggaggcugcagugagccaaaaucacgccacugcacuccagccugggugacagagcaagacugucuuaaaaaaaaaaaaaauuaugaagggauagcaaaggaguuccugaaccugccugaagaauugcuugauguuggccauaaacauagucaacugccuucuaguuauauauaacuauagagagauggcaucaaaauuaggaaaacaagcaucuauacaacuagguagcaggcaguuacugggagguuacgagggauaagucacuagcuugaaaacuuccuauuuucuuugcuuuuauuuuuuuuuuccgcagacuuguggcuccuuugaugugucacacuauuguuguauuguucgccuuaguucccuuacccuccuuuacucgucugguccaucucaaugacaggauucugucguuuggccugacucagucccuuguauaaaaggacaucuauuaauccacauccugcugguuacuguacauaauaaaauguaaacgugguguuuccugccucuccuccaagcucacacacccgcauguaaauacucuaggggcaauaggaggagaccuagaaacuaaggucacccaaauagaaucuugucccugcaggcggauagcugagcucuaaauuacucuggauacagugaaggacuaaaugguuccaaugaaucaaguucagggagaaaagggucaggggguauggagguuagccaaagagugucaaacguucuccucaaagcuauuuuagaacaaggcuggucaggcuauuugggcucagcucuuuucagcgugugucauaggcagcagccaguugaagccaugccaccaugcagugcagggguccaggucucaggaaggugcagcguaccgagagucacaugaagaccucagaucauuuccugcugcuguguaauccaggcagucugggaagagaaugaauauucagugguuguauguaugugugucuucaucccagcaagugacagauguuccugcccaguuggaaaauggaaauucugacuucauugucuuaucauuccuuccagaacaagcaccaugggcucaaacccucccuggcucugcuuuaagggaaauaauauugugucugugcagaggcccugucugcacagggucgugguagggcuggccuucacaugguggcccaugccacugcuguagcuuagccaugaggaagagauuggugagccugcuggagaggaaggcuacccuuacuuggugcuccuccuuuauccauagacaugaguacucagauuuucgcaucuagcuuucaaggggcuggagauuaaagauccaauccauacuccuuggaugcccuuuugucaagauaaucccuucuucuguagcuccuaagcccucuaaggucugagggccaagcugccccauggcaggaauggcaaaauguagcuguccucucaguggcaaaagguaauaggauuaucaaguagcaaaacagaagccaagaaaagacaggagaguuagaggucuggauugugcaccagccuuggagccucgcaucucuagcagggcacucuuaagcguuaggcuuuggaguuugaagaggagauaaaccuaucaaauugccagguguuccccugcccuugaugcaugcaaaugauuguugacagccagugugaugguagaugugccuccuggaagaaauaaaaguauaauauuccaacaaucaagcagcauuguggcuuuuuucuacaaucagaaacauagcagcuuugugcuugaucuccuaagcaagauaauuuuuuuuaaccugggcauucuuugaguucucaguuucgaggugauggggagcaaaaaugaugcccaaguucaaauggcguacugcugcagauaggcugucuccuggcacacagauuuacagagugaaugaaaucucucauucauuggugcuaaucuuuaaccaugguuuuuaacuuacaaguuggaggcuaauuacacaguuaccaguuaaagccaggugaccucauuuguugacaacagugcacagcaaaggaaagaggagaggauaaggaaaauaucugugauuugcucccagaaggacagugaagcugagcauccauuugagcagaguccucugaguacuggccuuggucagagcuuguuggugggagugugcuaaggggagaugccuaggucugucauuggaguaagcugaggguuuggaugcaggggaacucaggcagcucugagccacagggugguagaugggagggauucacaguggcgcacagucucuuccauaaauggaaacguaagaaucggggcacauggccauggcggcucaugccuguaguccuagugcuacuuuaggaggccgagguaggcggaucaccugaggucaguuugagaccagcauggccaacauggugaaaccccaucucuacuaaaaauacaaaaauuagccaggcguaguggcgggugccuguaaucccagcuacucgggaggcugaggcaggagaaucacuugaaccugggaggcagagguugcagugagccgagauugccugggcaacaagagcaagacuccaacucaaaaaaaaugggcacauaauggauggaacauucugucccaagggaugagggagcuguauaucuaccuauuccagcugccuugggauuagccacugguagucauuccaccucacucccagacugaaaagagucaaucacuucaugaaguggggcuauccgaagggaccacaggggaccugauuauacugacagauuuauuuuuauuuauuuacuuuuuuugagacagagucucccucuguugcccaggccggagugcaguggcacgaucuuggcucacugcagccucagccuccuggguucaagcaguucuucugccucagccucuggaguagcugggacuacaggcacgugcuacugugccuggcuaaauuuuuuuguauuuuuguuaaagaugggguuucacuauguuggccaggcgugucucaaacucccgaccucgugauccacccgccuuggccucccaaaagggcugggauuuugagccaccucaccuggccuuuuuuuucuuggagauggagucucacucugucucccaggcuggagugcaguggcacaaucuuggcucacugcaaacuccaccccccaaguucaagccauucuccugccuccgccuguggagcagcugggauuacaggcgugcaccaccacgccuggcuaauuuuuguauuuuuaguagagacaagguuucaccauguuggccaggcuggucucaaacuccugaccucaagugacgcacccaccucaggcucccaaagugcugggauuacaggagugagccacugcacccggccauauugacagaucuuuuagucugaauuguuaucagccaguguggucuagucaugacauaucuagcuccaucucgagaccucaugucuuacugcugacacuacauccucgcugguacuuuuucuuccuuggcuucaggggcauugcuguguaggcucagauccaugccagaugggguguguagggggaaaagcugcauaagggaggaaugucacuuggcaacacucaacaagggggaaugggccugcaguauucucccagagaugaaugagcagcccauucuaggaaauaucccuuugaaggaauaucuucucuaugguacauccaaacuuuucucuggaaaacaugccucuucauucugaugacuuucuauuuauucucuucaucuuaccaugguuuuacaaaagaggaauuuuaacauacucauucagcagaguuaaggaccuccucucuucugcgaacggggagagguauaacaaauauaguaaaacaagaacagccacugcccacguuguagggguaaguacccugcccaaccugcagacaguaaaugccacacacagcucuaacagugacagggggagaaaaacgucuucaguuacuggccugaccuuagagguaaagcaacauauuaacagagagggucugauuuuaaacuuugagcugaacauacuucuauaguaucuuaauucucaguuuuuaaaaaauuacaucaucuagaauggcgucguccuugcucuuccuuuuuucuugugccaaauaauagcccccuuugguauauguuauuguuuuaauugauucucaaaccucuccuuaacauuuuaacaaacauaaaauuugauagaaaugggcuagacuaaauucagcaguccaggaaaucgaguauuuuucuacacagauuugagugucacccaagauacaguauacuuugcugaaucucccuccaugauacucuugugguuuuaucuauuuuaccaaaacacuuccacguaaaacaggcuuccguugacucuguuuguccuuuauggacccaacaggggaggaaaaaauaccauugcacuggguuuauccacuuacuguggaguuggggaaccagaaacaaccacuggacacguugcaagcgcgucaagguuuccaccgccaccugguggcuagauggagcacagcaucuguguaacuggugggcaaaggcguucugcuccaagaugucaaagugggggagaaaauuauggguguucugcaaucuuggcaaaagaagaguacuguacuccuuaucuuuuuacugcuucuccauguucacccuuaaaagauugauuuuuauuuuuuacucagcucuccucuuguuuuucagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagca

SEQ ID NO: 192976 - RNA, 261870 nt, Homo sapiens
uuagaaacaagacauacuaauucaccuaagucuuuauuuauuuggcucuaggaagaauuugcaugaaaaugagccuguauggcagguacagaauguacuguaacagcaccagagagguacauccucucuccucuacagagccucaauguuuaauacauacaugugacuuuagucauaaaaccacauaguccaggaaaaaaggagcccuuuagaaaaaaaaaaucaguuuagaaugacuuucaaauugaccauuccuuuucaaauacuuaaauucaaauaacagauacauucagaggcccaaauguuggcauagaauaaaaucauguucauuuauuuuuuucugcaucuuagaauuagaaggcauaaaauuaaauauguugaauguaauaaauucauccauacaagugcaagucuccagauauaaugcauuuuauggcagauuuauuauuuuaaaaauguaccaguaaaucaaaaaagagggaguauguccauuuaacuuuuauugaaguguauguaggaggucuucagaaaucaaaugugagcaugaagauauggccaaacauaaaaucuaucaaauucagugaaaaguugcugacuuuaaauaguaguuguaagaaugaccaauauauauucuuuguuaacaaccccucacucuauaguaaaaaaaaaauaaaauaaaauaaacauucaguaaacauucuuuccuaagguaguuucccuuauauagcagugauuuauccauuucuuuguauacacaaauuuguugaacauaccaaucagugguucucacaauugaaaaauaaaagcacaaaaaaguuuacacuccuguacagguaaauaaaagaucaccuugaauuaaacuggaucuccuuaagggcauaguauaguuucaguuucauuaccuauuacauaauuaguuucuuacauacaaauauugacauauuuggcuugugcuucgaagccuuugugucuaugaaguccacaucaaugcagcucauaacuggaagucacuggggaguucuuugcugcugcuggguuuaaccugaucaugcauuagagucuccucagcaccuguuguggcucugcacaccucuggggcaucgucagugucaggauccaagccuucagggcagggaaguuucagcaacucuucgcggagcugagcagugugacgcuaugcaggagaaaaggacuaauguuagaacugcaaacccucuagcacaacaucauuugaggcaggaacugaauuucaacaaagcccaaagcauuaagccuacaaauauuuacugagccccuccuuaugcaagcuacuguuacaggcacuugauauaguagguaagcaaaacugacaagaauccuuaaccucaaaguaaccgauguugcugaaaagaccucaguaacccaccaguagauccuacccaugcugccaagcugucacagaaacagcauuacugacaauuuaaaggacauuauuagauacauauacucuuuuuuuuuugagacggagucucgcucuguugcccaggcuggagugcacuggcgcgaucucagcucauugcaaccuccgccucccggguucaagugauucuucugccucagccuucugaguagcugggaguacaggugggcgccaccacaaccagcuaauuuuuuguauuuuuaguagagaugggguuucacuauguuggccaggcuggucuugaucucuugacugucauccaccugccucggccucccaaagugcugggauuacaggcgugagccaaugcacccggccuacauacauauauucucuuauuuuguuuuaagauagcucugcuuugucauccaggcuggagagcagcggcacaaucacagcucaugcagccucaaccuccugggcuuaagcaauccucccaccucagccucccaaguaguugggacuacaggaaugaagcaccaugccuagcuaauuuuuuacacagaugggguuucgccauuuugcccaagcuggucucaaacuccugguccaagcgauccaccugccuuggccucccaaagagcugggauugcaggugugagccacugugcccagccuauacacucuuucaaauuaaacaccguaaucccuugauuugucauacaugcugacucuggcuaaacguuuuugagagaaagacaaauccguaaauuaaaauaaauccacugauacuuuagcgaaugaaaaaaauauuuaucagguaguaggccauauguaaaaugucugcaaauguucacacuaauuuucccacuuaaugcucagaauaaaccuuagaaauaauuguaucauuagaauuuuuuuuuuuuuuuuuuuuuuuuugagaacaaggucucacugugucacccaggcuagagugcagaggcacaaucucggcucacugcaaacuccaccucccagacgcaagcaauucucaugccucagccucccgagcaacugcuauuacaggcaugcaccaccaugcccaguuaauuuuuuuguguuuuugguagagacgggguuuugccuucuuggccaggcuggucucgaacuccuaaucucaagcaauccaccugccuuggacucccaaagugcugggauuacaggugugaaucuguacccagauucacccagccuauagaacugcacccagccuaucauuagaacuuuuuaaaaaauuaaguuaaaaagaagaucauagaauuuuaaaaaauuaaguuaaaaagaucauagaagaacaaagaacugcacccagccuaucauuagaacuuuuuacaaaauugaguuaaaaagaagaucuauagagauuaaauaaacuuugcuuugcucuauauugcaguuuacguaaggauauaggcauguuaauugggaguggcugguugucuaacacaugcaaagauuugguucauaauuuucuggugagagagaaaugaccuuaaauaaucacaccaaaggcuuuuaaaauugugucggccgggucugaugccucacgccuguaaucccagcacuuucggaggccauggcgggcagaucacgaggucaaaagaucgagaccauccuggccaacauggugaaaccccgucucuacaaaaaauacaaaaauuagcugggugugguggugugugccuguagucccagguacuugggaggcugaggcaggagcaucgcuugaaccagggaggcagagguuccagugagcugagaucgcacagcacugcacuccagccuggcagcagagcgagacuccaucucaaaaauaaaauaaaauaaaauaaauaaaaacuaaauagugucaacagcugacuuugaaaauuaaacaacauuuauuuacagaacaauuuuuauguaugaggcacuguguuaaauaccaacaacauaaaggcaaugaguagaaugaggauaaaaucuuuaagcuuauggagucuaaaauucuggcugaaauuauaagacacauaaauaggaaaaaacaacucuaccuugcagcuauuugcaaaguuucaaagcacauuuacaugccgguaagugagaauuucccuagccuugauuuuccuuccacuguggacaacaggugaaaucacuaaccagggaaggagaaagaaaaaucuggcaaucaugagaacugaguuaagguuggggauugaucuaguuuggauauuugucccugcccaaaucucauguugaaauguaaucccuguguuggaggugagagaaauggggaucauggggacaguuuccucauggauuggugcuguccugagauagugagugaauuaucacgagaucggguuguuguaaaguguggcaccucccacaccccuacgccuucgugauuccgcuucaucuuccaccaugaguauaagguccuugaggccucuacagaagcagaguaaaugccaguuccaugcuuccuguacagccuacagaaccaugggcccauugaaugucuuuuuguuauaaauuacccagucucaaggauuucuuuauagcaaagaaagaacagccuaauacagggauacuaugauuuuauuguggagucaagcuaaacaacuacauacuuuucauuuauuuuuuaagacagaauuuuacacucguugcccaggcuggagagcaauggcgcaaucucagcucacugcaaccuccaccucccggguucaggcgauuuuccugccucagccuccccagcagcugggacuacaggcaugagccaccacacuugacuaauuuuuguauuuucuuuuaauagaguugggguuucaccauguuggccaggcuggucuugaacuccugaccacaagugaucugcccgccuuggccucccaaaguguugggauuauaggcgugagucacugcgccuggccaauuguguauuuuucuuguguagcacucaacagcaaauguacaguuaaaaugauauaaauuuggauuaauucagagauggaaaauuccaggugacagugacacagaagaaauaaaggaaugcggauauaagcaagacacugaaugaaaagaagcuggacuugagccaguuuuguguaagugaaaaacauaucuaaauacauauuuggggaagaucagccugguaaugcacuaaagaaggaacugaaagggggagaaccugguacaaggaagcuggacaaacagacaaagcugugggaacucaacagaaaucauggguuggggagaggacaguccccucaugaaguaauacugacaggaccuaguacugaccaggggugcuggaugaaggaugagauacauaauacuugaagauucuaagacagagaaaaaugguuuaaaaucaaguaaaauuaaguaaauagaaagcuagaaaacuugauuugaggaaaaucuccuuuaaggagaugaugacaggguaucuauguaaaaaaugucaguaauacaacucaagagaaagcuaacagcugacaacaguuugaagugucacuuuuagagaguaaauggccaaagucaggguuacagacacaaugaaggaaaaacagaaagacagaaaaaaaauaguucugaaggccaaaaaguaagccuucagguaaacaauugcucaggaaaaaagaaaaaggaaaacacacugaaagaauuaagaagaguauaagcagaaaagccaagauagucuacagaugaaaaguauaguacaaaagacaaacauuagacaaauguuaugaguguuuuaacagguagacgcagaggguuagaaaugcuuauacugaaaugaucuaauagucuaucagucaggcggggcgcgguggcucacuugaggucaggaguucaagaccagccuggaguucgagaccagccuggccaacauggugaaaccccgucucuacuaaaaaugcaaaaauuagcugggcaugauggcaggugacuguaaucccagauacucaggaggcugaggcaggagaauagcuugaacccaggagguuaaggcugcagugagcugagaucaagccacugcacuccaggcugagcaacagagcaagauuacaucuaaaauaaauaaauaaauaaaauaaauaaugaaaauaaaaauacaaaaguuagccaggucugguggcagaugccuguaaucccagcuacucaggaggcugaggcagauaaaucacuugaacaagggaggcggaagaugcagugagccaagaucaugccugaguggcagagagagacagugucucagaaacaaacaaacaaacaaacaaacaaaccagucaaggcaggguuccaugaagugaaauuuaagcugaaauaugaauggaggugagcaagcagaagagcugaaaaguagaggaaaauggaaaccauguguaaaggccuggaggagggagagcagaugaagugaauggagaagugagccagggucacuggcguugagaacuggagagaugguaacuuugguaaaauagaagucaaacugcauaagguugauuagugagacaaagguuaaaaaauggaggcaagaagugucaacugcuauagucugacggugaaagaagacaaucuguuucauaauaauaggggcaaaauagaacuagcuuagggaaauuuucugcaaguguuuuucucucuuuuucaaaacauuuuuauagugaaaaaauucaaacauaugcagaagugggcagaagaguacaaugaagucccaugaaucuaucacacagcuucaaccauuaucaacucauggcccaucuucuuucaucuauauucccacacuuuccccuugucauuuuauuuugaaguaauucccagacaucauacacuuugucauucacaaauauuucuguacauguccugaaaagauagggaucuuuuuaaaaaucacaccuaaaaaacuaacaaauccuuaucaucaacuaguuguuugaagugaagacagcuuuaaaguuagaagauaacaagccaguagaaauggaaaaaccugaagauagaaaagggaggauauugguggaggaugaaaugaguaaagacauucagaugcaggaaaaaaggaaggcuguuacaaagaaagaucuccguggguagacagaaaaucuuccaaaccaaucacauuucacauuuccauucuaugaacguccaaacugaaaacaacugcuuucuccccuaacacagccacugccaccaucagcugagggagaaucugcaacucaaaucucccucaucacuccaaguaauaaaauucuggaaggcaggaggccuagggaaagacuaagggaauaaaagaaguccuucaagucuggcacgguugcucaugccuauaauuccagugauuuggguggcugaggugggaggaucacuugagccuagccuaggaaacagggugagaccccaucucuacaaaauugaaaauaaaaaaauuuaacugggcacuguggcagcuaccuguaguccuagcuacaugggaagcugaggugggaggacugcuugagcccaggaguucaagguuacagagagucaugaugccaccacugcacucuaggcugggacaacagaaugaaauccagucucaaaagaaaaaaagaaaaaggaaaaggcauucauggagcacaucuugucaucauuaucuucaaggaacuuuacaaaacucuguugucucaguccuuggacccacuuuuuauuuuaggaacugucaaucuacuaccaaaaaaaaauguaucuuuucuauagacuucugaguaacaauuuauuccucugaacugaaaauacauauuauguuucuuuaauucccucccucccauuaucuucugguaggcaugguucugucaauaauuacacaacucuuaaagcaacaaggcuccuguuagagaggcuuacucaccuugagagcugcugcauggugagacauaguccugccuacccgcuuaucacugcuguacugcuggauauccgcaauccacuccucacauugggccauuaucucaacucuuuucaaguaaaaauguuuguguauuaccuugagaaaaaguaaacaggagaacaagcaguguuuacagucaaauuuaaaagacacaguaaaugacauuacaaagaaguaaaauguauuauaaauacauuuaaauaauuuauucuauaaauacauuuaaauuaauauuuagaauauuauuauaaauacauuuaaugaaauaaauauacagacacugcaauguuuuucuauccauaaaacucaauuugggaggcugaggcaagagaauggcgugaacccgggagguggagcuugcagugagccaaggucgcgccacugcacuccagccugggcgacagagcaagccuccaucucaaacaaaaaaaaaaaggcaauuuaaucaacucuacaauauuagcagggaaaaaucaagcucaugauuugauaugacguguugaaauauaugaaauuuauggcccggugugguggcucacgccuguaaucccagcauucugggagaucaaggcaggcgaaucacaaggucagaacuaaaaauacaaaaauuagccaggcaugguggcaggcaccuguagugccagcuacuugggaggcugaggcaggacaauugcuugaacccaggaggcagagguugcagugaacugagaucccgccacugcacuccagccugggcgacagagcaagacuccaucaaaaagaaaagaaaagaagagaggaggggaggagagaaaagagaaaacaaauuuauagcagaaaagaguguacaauuguggucagacacuuggaaaauuaauccuguccagagaccacaagacacauaugauacaauauacucagaaggcaaaugcuaaauaaguaaccaggcgaaaagauuuaaaaaguauugacaacagagaaauuucugccuuuaaaagauaacucaaagaacaccuagauaaguauauucuaaaugccaaaggcauucacacagaaauccccagaaauggcacuauucuuacuugcuuaauuuuaucuucuguuuaauuuauagaugggauuuuauuuuaggaaguuaaauuuccuuauuauuacugugauuuacauuugcgauuuuuaaauucuaucuuucaauucuaucuuugaaaaacugaguaaaauuucuaccaacauauaguaguaagagucuauuucugacaaauuuaaauuagaaaacaauuaucaauuuggaaacauugcucuguauucugguugagcauugcccagggagcaugucugcccuaaagaacagacaaucaaaccuauaaagggaaaaucacuagaaagcucugggaaugaaugucaaacaccaauacgaucccaccacauuuaauaguuauuggguuugaagccucugggauacagaaguaaguaugacacagcuuuaaaugaagaacagugguaacaacagaaucagaugggacgggaguguaccaaaaaaauauauuuuaaagaacaacaauaaacaaaagcaaaaagcccagggcauucaaagaguagcgaguggcauuugauuaggaaaacugggaaagcauacauggccaaggaguggccccuuuaacgcaagcuagguucuaaagaaugagaaaguugauugucucaaauuauacauauuugcuuuuuguaaaagucauccccuucucugaguucccuguguuuauccuuccugaaaaaaaugauaugcauaaaacaaauuacuuuuuuuuuuuuuuuuuugagacagagucucaccgugcugcccaggcuggagugccguggcgcgaucuuugcaaaaguaaaguauccaacuuugucauucaaaggacacuggaauauaaauuuacucaguaacagcaaaagccaaagaaaaagaaauauucaucagugcuaucugaugaaggagguggcuucauaguauucauguagaacaucugcauaguuauauuaaagaucaauuuuauaucagguaaauauaccauuuuuuccucuaaaauguuaacuuuccagcacaauuuaagaaauuaaugaucaagugaaacaauuuuaagaaagaaaaauguuucuggacacaaucacagcaaguugugaugcuaacgucauuugauauggcaggugaaaaguauaauucuauuuagguauacuauggagagacaacuaaucacaggcaaaaagcuacacacacacacacacacacacacacagagccacacuucaggaugacgugaaaaaaaccacuucaguguauuaauacagguuuuggaaacucauaucauccaauuuuuuuccuaaagaaaaggaaacguggccaggcgcaguggcucacgccuguaauuccaacagucuggaaggccgaggcgggcggaucaccugaggucaggcauucgagaccagccuggccaacauggugaaaacuggccucuacuaaaaaauacaaaaaaaauuagccaguugcggugguaugcgcacacagucccagcuacucgggaggcugaggcaugagaaucacuugaaccggggaggcggagggugcaguaagccgagauuccgccacuguauuccagcacaggcaacagagccaaguccuaucucaaaaaaauaaaaaaaagaaauggcauucuccuuauauauacacauuagaauaagggcaaaauuucuauuugcaagacaacuuuagaaaccaucuucaauaaaaaacaguucaaugagaaauauaucagaaacauauuuagagaguuugcuaguagaaggguaacuaauaaaaauaaagaauaggccggggcgguggcucacgcuuguaaucccagcacuuugggaggccaaggcagguggaucaccugaggucaggaguucaagaucagccuggccaacauggugaaaccccgucucuacuaaaaauacaaaaaaauuagccaggcguggugccacaugcccguaaucccagcuacuugggaggcugaggcaggagaauagcuugaacuugggagguggagguugcagugagccaagaucaugccauugcacuccagccugggcaacgagaacgaaacgggaugggacaggaggaaaggaaaggagagcagagggagaggagaggaaaaggaaaggaaaggaaaaaaacuucucaaaaauuuagucagaugucuuuuagaauauagauaguuuuauacuucaucuguacuaucuacuaccauuuuuuuuuuuucugagacucugucaccuaggcuggagugcagucaugugaacacagcuuacugcagccucaaacucgugggcucaggcaaaccuccugccuuagcccacugaguaucuaagacuacaggugccaccaugcccagcuaaauuuuuaaacuuuuugcagagauggggucuugcuauauuguccagacuuauuaaugaucuuugggauuaacucuaaaaccugcaguuucauauacuagauacauauaaaggcaaauagaauacuaacaaacuauauuuuaaaaugucuuuuuuuuuuuuuuuuuuuuuuuuuggagauggagucuugcucugcugucacccaggcuggagugcaguggugcagucucagcucucugcaacuuccgccucccagguucaaccucacguuccaaguagcugagauuacaggcgccugccaccaugccuggcuaauuuaucuuuuucuuuuuuuaaguagaaaugcgguuucgccauauuggccaggcuggucucagacuccugaccugaagugauccaccugccuugaccucccaaagugcugagauuacaggcaugagccaccaugcccagccuauauuguaaaaugucuuuaacaaaguauuucacuaauuuuauugaacauaccucuuuaaaacauggugaaggguuucugauuuguucuagcauugcccacuuaacuguugcuugucgaauguuuccaucauauucucgagaacucugugugccacugggagugccucuagaccguucauaucccgguucauuaaaauaaggcucagcuacuaauauaagggacuggacagacaccaacaccuaaagaauaaaggaaaagaacagcuaugaugggacauuuuuacuguggguuaacugauauccugcuuuauccacaaagacucuucuuuaauauguguuuccacaaauuucuaucacaauaaaaucaauguuuaugauuauaacauugaaauauuucauuauaaaggcaaaauaaaauuaggcacaauagagccauaaguaauacuuacacaucuguuuuuacucuugaauucuugaauaauaauagauaugaagauagaugauaauaauaauaauagauaugaagaaucuauuuccaaaaaaugcuaaaaaaauuucguuuuuuuaguuuaguuuauuuuuuuuuuaguuguuuuaugaguuuaaacaacucauagcaacauucugcucaaacuguucuuaaggagcauaaaacuagccauguacuauuuuuuuuuuuuuuuuaauaagacugaguuucacucuugucacccaggcuggagugcaauggcaugaucuuggcucccugcaaccuccgccucccagauucaagcgauucuccugucucagccucccgagaaucugggauuacagaugccugccaccacgccagacuaauuucuguauuuuuuaguagagaugggguuucaucauguuggccaggcugguuuugaacuccugacuucaggugaucugccugccucggccucccaaagugcugggauuacaggcgucagccacugugccuggccuagccaugcacucuuaacaauacucacuuauaaaaaaacuaugccugagaccauuuuaaauuuuuauuccaaggacaauuaacugcuacaguaucacaaaaaccuuauuagaaauucuuauuuauuucuuugagauggagucuugcucuguugcccaggcugcagugcaaugguacaaucuugguucauugcaaccuccgucuccuggguccaagugauucuccuuccucagccucucaaguagcuaggacuauaggcgugcaucaccaagcagggcuaauuuuuuuuuuuaauuuuuaguagagacgggguuuugccauguuggccaggcuggucucgaacuucugaccucaggugaucugcccaccuuggccucccaaagugcugagauuacaggucugagccaucauacccggccagaaauucugauugacaagauggucuuauggucuaagaccacuuccaaaccaccacuuauuuacuagaaggcuugucccagauguaacauauauuaagagaggugauuucuagcgaauacaguacuuccaguuaauguaucuauagaagucaauaaaguaacaucuuugaaggcaggaaaacaucagauauuaucuacgcaauucauaaaugaaaaagaacagcaauuacacuuuuguugggcacaacgauuaaacagucccauggauaugcaucuuauaagucaaaguuaaagagaacuuuaaaaaugaguacucgaaaguaacguauuugacccaaaauagaaagugaccauacugaugccaagcucaacuaugggaaaaacuuuaauucauauuauuucugagauaaagaucucauauuuuuaauuuuuauuuauuuauuuuuuugagacagugucuugcucuguugcccaggcuggagugcaguggugcgaucucagcucacugcaaccucugccucccggguucaagcaauucuucugccucagccucccaaguagcugggguuacaggugcccgugaccccaucccgcuaauuuuuguauuuuuaguagagaugggguaucuccauauuggccagucuguucuugaacuccaggccucaagugaucugccugccucccaaagugcugaaauuacaggcaagagucaccucgcccggccagacaucucacauuuacugacacuucugagguaaguuucaaaggcauaguuauuaguuacuguccucuucccucuuaaauaauuguccucuucuguuaauauaaguaggguauaauugcauuuuuguacaaaagcacagaaagaaauuaaauauucauuacaaauuuauaaaaaaggacucuuuuauuuauuuaaccucaucuccuuugagacacaauaugguuuuauagaucucagucaguuauaacaauuuaaaaauuacuuuagauucacggcguauuuuguuuaaaacagcaaagcaaagcccacuaaaggaagcauaaaauauuuugcagacgcuggggccuauuugauggugaaacgugggaggagggaaaagaucagaaaaaaauaacuacuggcugggcacguuggcuaacgccuguaauccuaacacuuugggaggcugaggcagacagaucacuugagaucaggggcucgaggccauccuggucaacauggugaaacccugucucuacuaaaaauacaaaaauuagccgggugugguggugcaugucugugaucucagcuacucaggaggcuaagguggaaacacagcuugaacccgagacgcagagguuguaguaagccaagguugugcccagccugggccacagagugagacccugucucaaaaaaaaaaaaaagaaaagaaaagaaaaagaaaaaagaaaaaagaaaaaaauaacuauugcauacuacgcuuaguaccagagugacaaaauaaucuguauagcaaacccuugugacgugaguuuaccuauauaacaaaccugcaguggaaccccugaaccuaacauaaaaguuaaacaaaaaagaaugaguguuuuguguaccagaaaaaaggaacaaaaaauuacaucugagaaauaaauguggcuauaauuuauugucugcugagagaaaaauauaaaguuuguauuugauaagaauaacaacaaaagauuaucagagaucaauacuuccugcaauuaaauucaaaaaauacuuuaugacauggguuaucuuaccacuggguggcccagcagacauuaccuuuuuggaagaguauaaaugccacuuuauuuuucaauagugaacuuagcuauuuaauagcuauaauacauauuuuagggaauuucuggaccacuggauugucugaacuggacacagucauuuuaaugcacacuacauuuuacuguaggccggaaauaagcagagaaacaguaaacccuuggcaugaaggauuuccucuuuuaaaaaaaucugauuuucaguauuauaaaauaaaacuuuaggccugagaaacaguguacaauauuugaagucauagggaucacaguaaaguuaucuguacauuuagaaccuauauuuucaucaucuguaaaaggggcauaagaucuacuuguguuacaggaugaaugagagaauuacauaacuuuauaauauagaacaaaaucaauucuacacuaaaaauaauuucuauaaauauauuagaggcaugcaaaaaagcagccagcaugaacugucugaucaacagaacgucacuuaaaaagcuauuuggaucaaaccaaaaaguaguauuuauuuuacuuauaccaagcuaaaguguuuucuuagaaucugaguuaaaaaucaauugguaauuaacauaaaaacauacaguauauaugauauauauauacauauauuuauauugauguaauaauaaauauuuauuuuuaauccauaauguaggcucaugauuugagucaauuuguugauauuuucagaguaaagacuuuuauucacaggccaaauuuacugucccuuucguuuuuauuuauugauuuuuauuuuuuagauagagucucccucugucacccaggcuagaguguagugccgugaucucggcucacugcaaucuccuccuccgggguuccagcgauucuccuaccucagaggcgccuccuaguagcugggauuauaggcacgcaccaccucguccggcuaauuguauuuuguauuuuuaguagagaugcgggucuuaccacguuggccaagcuggucucgaacuccugaccucaaaugauccacccaucucagccucccaaagugcugugccaacacaccugugcccccucuccuuuucagcuucauguuagcaucugcacaacuguaagaggcucucauaaucuguucaggaacagaaaucaagaaacacagguaacggugggcacugcgccuggccuggaauuuuuuuugaugggaguuuuggcuaaacucaauuuuuguuuuaugccccaacuugagauuuuagauuacacauaagaugagacuccauuaugcuaacuucucaccuauaagcuauuuaauaugcauuuccuaguaaucuaucuuuuuuuagguuuacuauauuuauucuuggucacuaaaaauuuuuuaaaauacuacacaguucuuuauuucuuaagugaaaaugucagagaaauuuuguuuacuugcaaaaagcuugaggucugaggauuccacuucucuucuggucuuccaugccacguguuuaagaugcuuaaacaaaccugacgaacgaaaaaagcauaaacagaauugaaaaaagagugcuuaaaaacaaacugucauaacgagaaguaaaaacaaaaugcuauccugucaaaauaucucaguuuuauauguccccuagauaaaacccuaaggguugucuguuaaaacaaauuggcaucuucagaugugauucaaauuugugaggcauuauaacuuuuucauaaugcaaaacagaccagcaccuauuauaugucaacacaaauaacauuuuaaugaaaacuaaauuauuuaaaaagcaaaacauuuuuaauuagcacauaguuguacauauuuaugggguauagugugguauuucaauauguguauacaauguguaaugaucaaaauaggguaauuauuguauccaccgccucaaaccuuugaguguugguaacauucaacauccucucuucuagcuguuugacaaaauacaauuuuuauuuacuacagucacccuacugugcuauacaacaacagaaccuauuccuccuaucuaguuguaauuguguauccauuaaccaaccucucccuauucccuccucucuaccuuucccucccagcuuuaguaccacuauucuacucucuacguugauugagaucaauuuuuuuagcuucuacgugagugagaacaugcaauauuuaucuuccaauguuugauguauuucacuuaacauaaugucccaccaggcucaucuauguugcuaugaaagaaaggaucucauccuucucauggcugaauaguauuccacuguguauaaccaaguuuucuuuauccauucaccuguugauggccgcuaaguugauucuguaucuuggcuauucuguauggugcugcaauaaacagcagugcaaauaucucuucgagauucugauuuauuucccuuggauauauauucaauagugggacugauagaucauaugcuaguucuauuuuuacuaaaauaacuauuuuuaauaaaagugguacuauuuuauauuuuuguguauuucuuucuaaauucugaaaaugcaaaauagcuuaacagaagagaccuugauuuaauuaucugccucuacauucaacuaguugcaauauacuccuuugauucaaguauauggaucaaaucuagccucacgcaaacagacccccuaaaagaguauucaggcuucccaggguuccucaaaauauacuuaaagauaacauuagauacuuacucacuuagcaggaagagaacuggggacacuuaaucugcaccuguaacuacucuuguaauaaaaacaaaacugggccaaucacauguguucuucuggcauauauucuaucaacauaaaauauacucaucagauuuuguacacuuuuaauaauuuaauaauuuuauauaauggccaacagauuuggauaauaggugguucuuuuuuuuuuuagacagaauuucgcuccuguagcccaggcuggagugcaauggcacaaucugggcucaccgcaaccuccgccucccggguucaagcacuucuccugccucagccucccaaguagcugggauuacaggcaugugccaccacgcccagcuaauuuuguauuuuuaguagagacgggguuucuccauguuggucaggcuggucuaaaacucccgaccucaggugauccacccgccucagccucccaaagugcugggauuauaggcaugagccaccacgcccggcguaggugguucucguaaaugcagaaaggucugucuccuuacuacucuuucaaugcucugugaaagcaagaacgcaaaauacguuaauucauucaacagguaguugauuaauaauuuaaugaguuguaucugugaagucuuguguauuauucaaagugcugucauacauauaccauuugaccuuuagugcaagcuugugcaacccgcaggccacaugcggcccaggauggcuuugaaugcagcccaaaacaaaaucguaaaguuuuuaaaaauauuaugagauuuuuuugcuauuuuucuuuaaaguucauuagcuauauuguuuguguuagcgaauuuuuguguggcccaagacaauuauucuucuuccaaaguggcccagggaagccaaaacauuggacagcccugcuuuagagcauucuugggacuaacaauggcagauauguagccucauaccuaucuguagauauaggaccuaagauuaaaugcuaacaguguguaaacuuuaaaaauaaguccacaauuguguguaucaaggaacacaucgguaaguaugaugguaaaagaccauuaauuuaagauucccaagcccuuacccucuucucuaugcaacgaagccuugagaauuauuuucuuaaauacaucuuaauauuuuacacuuacacucuauucaaguuccagugucucaaguaaagucaauguugcuauuuccucuucccuacucagcuacagaaaaccuguucuuuguucuuccaaagaaaguucugccucuggucaaaucuuuugcaacaaacccaaaaaacuaauucuaguuuuaugauuugagcuaaugauaauuugcaaccacauaucugccacauaucugaggcaggcuguaccuuuugaaauucuucucuucuagauuuuaaaacauugaauacucagcacagaauuuaccauugaaauucuaucaaaguauccaaaauaccucugaaaaacagauuacucuuuuaaaucuaauuuuaaaagguuuauggucauaugagaugauuuuuauuaugucuuuuggucagcuuuuuuguaaauggaaaugcaucuuccuacuuuuaauauaagaaaauguaaaaacacuugaauauaagguacaccuuaaaauaaguuccuaauagcauguaucauagaacuuuacguuaaguccccgaguaacuucuuaagacuguaagugcuucuuaauuaacacuuaacuguuucugcucuuuucaguuccuucuauugcuuaagcuaaucuggacguagggaagagaaguacaaagaaacccaugcccucuuagcagauaacuaaaacaaaauuuuucuucaaauuacaaagaaccuuuguauacaaucauuggcauuugaaacaaaaaauugcaauuaauuuaccuugccaucauuauaaagguuuggauugaaucgcacgcuaugaccaccaguugucucuagauucacaagagggggugaacugggauaaucuugaggaaaauacacaucaaacucaaagcagccauuugcauaagggguguccgcuggaccaguuauuagaaccuggauauauauaaacauacaaaagucuauguuaacauuccuaaacacugauauuuagaaaaauacaauccaacaugaaauaagaacaaccuucguuuuuggagauggagucccacucugucgcccaggcuggagugcaguggcgcaaucucggcucacugcaaccuccgcuuccugaguucaagcaauucuccugccucagccuccugaauagcugggaacacacgugccugccaacaugcccgguuaauuuuuguauuuuuaguagagaccaguuccccauguuguccaggcuggucucaaacuccuagccucaagugauccgcuugcauaggccucccuaagcacugggauuacgggcuugagccacugugccuggccaaaauaagaacagcuuuuuuuuuuuuuuuuuaagacagucucacuugguggcccaggcuggaguccaauggugugaucucggcucauugcaaccuccacuuccuggguucaagaaauucuccugccucagccucccgaguagcugagauuacaggcaugcaccaccaugccuggcuaauuuuuguauuuuuaguagagaugagguuucaccacaucagccaggcuguucuugaacuccugaucucaacugaucugccuaccuuggccucccaaaaugccaggauuacaggcaugagccagcauaccaggccuuuuuuuuuuuuuuuuuuuuuuuuugagauggaguuucacuccaccgcccaggcugcagugcaguggcgagaucucagcucacugcaaccuccaccuuccagguucaagcaauuccccagacacagccugccaaguacugggauuauaggugccugccaccacagccagccaauuuuuguauuuuuaguagagacgggguuucaccauguuggccaggcuggucuggaacucuugaccucaagugaucugccuaccucagccucccaaagugcugggauuacaggcaugagccuauccaaaaaaucaaaagaagcaagcaaacaaauaaaacuuucuacaagucaaugggccaauaguuuuagcugcguaucuauggaagacagaauguuuaacccaugaauuaaaucauaaauauaaagaaaguuuucuuuuucggguuaaauguuuaacauuuucuugaugcagcagacucuuggaauuuaaggccagauuaucacguguuaaacauaaaaguagagauuauauauuauuguauuaccuauaauucacagauguuaggaauuuaaaaaaaacauaaauuuccuagaaaagacagaaaaugacuaaguuuugaagagugacacuaaaaaacaugagagaaguaucuuggaugacaaaauggaaauccuguaacauuuuuuaacugaucagcauuaaauccuuugauauugugaccagcuucacacaaucuuugcucaaggaugauggcucuuuugauauuuucuaaauguuuuuuucaacagcagcgugauccacacacucugaacuaacauuagaaaagggcucuuuguggaggcugcagugagcugugaucacaucacuguacuccagcuugggcaaaagugagauccugucgccaaaaaaaaaagggggggagggguggggaggcuccuuucacugccgucuaaaaauggucaccaaaauuucuaguguuuuguauaauuuauuuguauaguauuuccaguuuuguauaaaaauuugaguaauuagaugagccaaggagauaagggagagugcuuuauuaucauuauuuuuuaccuucaugauaucaagucgcuccucaucacagcguacaaacacacuagaggaugaagacagaggcagugagguugaaagcgucacagcuuccugggcaaggcggcgagcucuggcagcacuguucgcaucauuagcauuuuucaccugagacauguagugguaauuuacuuuaaaucccaauuucccaucuucaucuucagaaaccauuucaaacguaucuaaaaggagaagaaaaaauaaaacccagaacugcaaaaaauuguuauaaugacaaaaaucacaaacaaucacuaguccuucucccacucaacuggagagaacuuccaaccauggaagaauagcaaaaguguaaauguuuacauaacaccuauauauuagcacugccagauggauuagcacugccagauggauggacucuugucuuucacaugcuauagggauacauuuucuuuaacuuuuauaaaaaacaaucuaacagaugcaagaaaugggcccauuacuaugcccagugggaaaauuuuauaucauauagaggacagggucuauuaacucaaagauuucauuaaauaaaugauucaaucaaagacaauggcuacuugauaaaacaugcacagccuguuuuaaucaaucauuucucuucuguuaauucauccuacagaauuaauccuggauaugcacaaauauuuacagguaaugaaagccacugagauguugcauaugauauuuaaauacuggaaacaaacuaaaguuccacuuacugguuaaacaaauggcagccaaucauauuauggaauuuuaggcaguuaguaaguaucaaguuguaaaagaaugauacuagaaaauguuugauacauaugguugaaaaugcaguuucuuaugaaagcaucaacugaaaacuugcauguuuucagacuuauuuugaaagccaauggggagcaaacuugauuauguuuaaagucacauacuuggagaguuuaugauuuuauguaguaugagagaacucuucuagcuagcuaacauuaaugaaggggucuggacauaugauucuaaauuucugacagguaguaacuuuaaaccagaaucucucacacauaaggauccauaaacacauucauauacaugaaaugacuuucuggauugaaagaacuaguuaaagaauuuguagauaugaaauaugacuaaacgccuucaaguacaagaacacugccauguauuuuuaaaagccauuagcugacauauuuuugaugacccaggaagcggaacgaaaucuaaagcccaauaaaauauuuauguccaacagaaacacacauacacaaacauaugucuggaaacucuuuucugacacucuuccccuccccuugaguguuggcuggacuuagugagugaugcuguacacuuucuaagacaaggucauaacaggcacuauggcuuuuucugaauuccugacccauguaaagagugagauaauaaaggucaugauuuuuuuuuuuuuuuuuuuuugagauggagacuugcucugucgcccagacuggagugucucagcucacugcaaccuccaccucccggguucaaaugauucuccugccucagcuuccugaguagcugggguuacaggcgccugccaccaugcccagcuaauuuuuguauuuuuaauagagauggaguuacaccauguuggccaugcuggucucaaacucccgaccucgugaccgcccaccucggccuccuaaagugcuggauuacaggcgugagccaccaugcccggccaggucaguuuuuuaaagcaaauaaguuacagggguaauuuaugugacaauauauaauauagaacuauuugauaaaauaagccauaaaaaaccuugguaauugcuaauuaaauucauauaaaugaaauaaaguauuugguuuuaguacuuuaauacacaaaggaauuuucaauaaaauaauaaauucaauaaaauauuuauuauuuaaaaaccaaguuaauauuauuacuuagagugaaguuaacagacuagauugccaagcugagucaggcaaaaggcuguaauaucauuagacacugaccaaaacucuuaacaaaaguauaaaucacuuucauauauauuaucucuugugcucuuuauggcaaaccugaaaguaaguagagcaaaagcuaaaugauuuauaaugagguuucaaagacaauaugacaaaaaucuguuuucugaauccuacuuuagcauuuaaaaaaauacaguccaagauuuuuagguuguuucucaaggaugaaaaagcagcauagacaauaauaguuaauaauggucaucaaaauuugguauguguuuucucauaaaucagaaccauauaaaggguacugauauaaucuuuuugccaguucuuacuugucaagaguuuuggaaugggaaaagcuagaacugaacuauguauaacuacauuuucuaaaggugaauugcaaggaaaucuaaaauggcaagaguaacagacuuaguucaaaguucugggucuuggcuuccuucaggccaggauguacagaaaugaagagguaaauaaggaaaaacauuuucugccuguuuuguagacacuuggcuuggauuuauuuuuucuaggcucuuacaguccuucuauugaagucacaguuuauaacuaaaaauacagacauaaauucaagaggcaaagaugauaaaaaauguugauauguaugaaguaaaauucauguuacaagcaauuuuaaaaaucuuuaauuugcuaaaacacauuucaauagcacuguuaaaaaaaaauggaaagugagaucuuaagcaaaucaaaaauuucaucuuaccaaacuguaauuucuucauaacagccacauauuuuucuucaagugacuuuaauacugacaaagguuuggguuucauagccgccuucuuggaguauucacccaguuuuuuuucuguuauuuaauauuucaagauaaauaacauauacauuuuaaguauauauuuuaaaaaauaaaacuaaaaagaauucaccucuagaguucaaauugugaauuccaaaaaauugucaacuucuucacaauuaucuuauuacaaccgcucugagaauaaaaaauuucuauuucauaaacauaacaauaacauaaacauaacaauaaagcaaaaacauaaucaucuuuaugaaaagaggaagugaaacaauagauaauucagaucacuuucuucagcuaacauaggaaaauaucuauccauccguccauccauccauccauccauccauccaucuaucuggaaacagaguauuacucugucucccaggcuuggaguacaguggugcaauuacagcuaauugcaaccucaacuucccaggcucagguaauucucccacuucagccuuccagguagccgggaccacaggcacacgccauuaugcccaccuaauguuuccuguauuucguagagacgggguuucaccauguugcccaagcugaucuugaacuccugagcucaagugaucuauccauuuaguccucccaaagugcuggggggguuaaaggcgugagucacugcgccagccagagauaucaauuuaaacuaaauucucacccauagucuuaauguacuauuuucuaucuaauauaaaggcauuuuuucaauuucaugaauuucagggggaagaaauauuuauaauguauguucucagccuacuaaauuuagcaaucauauauaguagaaauguuuaaaaauuagacuauacaugauugaaaucagauaaagaacaaaaucuaacagagaacaaaauuuuuagguaaaugaacuugcuuuaaaaucauuaacauaaagcaaaaacacaaaggcagguuucaguaaguaaaugaaacaucuuuacaucaaaugaaaaguggcauaauaggaaaaguuuuguacccugauuugcuugccgcaaacuggugguggcugcauaaacuaucucagcagucuuuuggaugucugguaccaaaagaguaaguccuucugguucuugaucagacgcaucugguuuuacuccuguuuuaacauuuucccuuuuagaucugaauuuuuuuaauauggaaagaaaagcaaggaaaauuaagauuuuaggacuaaaacaccuccauaaaucaauauacaaaugagugugugcauuucauuugucacacacaugaucuauauuaacuugcuuuugaagccacuggcuaguaaaguuauggguagguuuucccuucuaauauaaaaucagagaagagacagacauuauauaaaugucauacuguaaaagauccagauaccugauguccucagagacacacuuuuaaaaacacacauaauuauaaauauucagagacagaaaucacuucuacaccuaaaauauuugagaauuaaaggaccacaagcaguuuuuaaauuuuaauacuauuuguauuucacucagaauuaaauuuccaagaaaaaaaaacauauuuuagaguaaaauguagguucauuacugggugucuuaauacaauguguuucuauacauuggaucuuuuaaugagacacuaaguuuuagggcauauucauuuuaaagauauuauucuguuauuuccuaucaggaucuaaaauguacccaauuucauuucacauuguuaucacaauaggauguauuacagcaagguuuaaguauauaggacauuacauuuuuauuuaaauuuucuagauaaauguacuaguaguuuaauacaagagucacugaaaacacaacuaaacauuauuuccuuuucucuauuccaacucucagcacauuauugacaucacaaacaucuuuacacuacugcuuagaauuucaaaaaucuacaucuuuauaauucuuuaaauagaucauuugaaacaaacuaaaaucguauauaaauaaaaguguuuaaaauauuuaugcuaagguaugaucuaaacuauacaucacuuauuuuuuuaguuguauaccuaccuaaaaagggacuuggucauuacauuaaaauacuaucucgcaaaguggucauggagccuuagagaacuauaaaaagaguaacagacaguagaagaauccuuaacaaauaggcugggcaugguggcucaugccuguaaucccagcacuuugggaggcugaggcggguggaacaccugagguugggaguucgagaccacccugaacaacauggagaaaccccaucucuacuaaaaaugcaaaauuagcuggacaugguggcgcaugccuguaaucccagcuacuggggaggcugaggcaggagaaucacuugaaccugggaggcggagguugcagugagccgagaucacgucauuacacuccagccugggcaacaagagugaaaccccaucucccagaaaaaaaaaaaaagaauccuuaacaaauaauacuaugucaucuacauacaaaugaaccuuuccuugucacaaaaacaaaaaucugcucagaagcuauucaauccuuaacucaagguagauaaacaguaaacucagaagccacucaaguggguaggaagaauaaaugaaaauaguaucaugcauguguuuugaauuugguuccuacaauguguaaacaaaaacuaguuucuacagauaucuuuaacuagaagguaaaaacuuaugucaccugacuuaacugaagagguauaauaugucacugaauggcugccuuuuuuccugugcucucuucuuaucuucccugaguuauaagaagucagagaacacauggccacuuuccuuuaccacucaggaaaugacuuggcagauguuauacuguacaccauuucagucaucaacugucgucuauguacauguaucugaauauauguuuuugcauauauaaggagaguauaguguacgucugaagacugaaauaucagagaauuuuacugcucgagucaacuacuauacugugucuuuuacagcuaugaaauuaaggugagacuguaguuuaacagugagucacuucuuaauaaagacaugauucugguagaguaacucaaacagauuaccaacuucugcauuugucaauagcuaauaacaaucagugucaaacacugagaaugaagagaagugcauaagcugcuugacaguacccacuuugaauuuacaaagacucuuacuccccaguuguaaaugauucucuauuaccaggucuugacaaauuauuaaguaacagggccacugaauaagaaaacaacaguaacuuguuucagaaagcaguuaugauuacagccauaauaaaauauaguuuccuaagccuauaaucaaugaguuaacccacuguacucucaauaaagauuucacuuaaagaaacauaucuugcagagaaggaagauaugaaagugaagcucuuuuuccagaaagguuauuuucucuuugaugaaacaagaaucuuuagcauggagcaugaacugcaucaauccaguuuaggucuuuauuguauuuaccaccccaguguguagauuacccuuggaacuacugauucuaaaucucaagcucuauucaugccaauuuccuaaauccacuuuuaaaaagaagauuaguaagagauuauuaaaauaguacacaagguuaggaugauaaauuuuauuuuuuuaccauaauuaagaaaaaguaaaagaaaaauaauugugcaagaauccucagaaguuuaaaaaaauucuuuacaucaaaugugugaaagaaaugauauauauuucauauugaagacaaugguugaaucauaaagcagauauauauuagaccuuugaccagguucuaaugagaaaucuuuacuugaauagucugacaaaaacacaccgaaaaaaagaaaaucucuaaauggugagaauacuuugaauauaugaagaacacacacuaccugccuaucaaugauucuaacuagucauugucugacauuaaacuauagccaguagucucuuuucuauaaaaguugcagguuacugucaacccauauguaggcccagcucaugaaaaaaggccauaccuuagcucacauccugaagucugugugaaaagcuauuugaguucaaggcaccuagcuggaaguaggucuuugagacugacaauggauccaacaugguaaaagcaaucagcgacggccgcuaccaugguauccgcugcuuugugcauacguugaaucugguugugaucacugcccugaagaaauacgaggaagcaacugaaguuuccacuauugcacagaauuaucugcaaacauuuuccacuaugcugugaauuccaacuaaauagcuaauuaguuaaacaaauuuuggcucugugacacauaucugaaguaggaugugagcaaaaugggcaaaucuuucuccugaaaacaaaacaaaaaagcaaacccauaccucaacauucaauuauauugaacugccucuaccaguaucuaccgcccaaauaaaguugaguauuaguaagacuaaauacaccaugucagaauuaugguauuuuauaauccaaaaacugaaaacagcuuaauacagcuauuuccuugauaaaacaagaccccuuuaacccuuugcacuccuaaaucuaagcuaaacauacugcaaaguugcaauaaacauuuaaaaaaggagagccauuugaagaaguuaucuggagacuacaugcugaaauguagauucacaacuauuaagaauuagcacugcagaagaagauucuaaaacuauaagagaaugaaacuucuacauuuaccaaaaagcacugaucacacugugcuccucaguucuaaagcucuuugacaguaauuauaguuuagauuagagguaaacugaaagaguaaauaaaaauauuacugugggaaacugcuucuaguaucuccaggaugcacaaaaauaauucuugaaaugcaccaguaaacgggcgaagaucuccguacuauaaauguuuucugugauuaauuuaaagcuuaguuuuuaacucuaugauccccuuuuguuuuuacuuaaucucuaaguggaaguaccaguuuaauuuugaaugauuuaaaugaauguugaaagaaaaauauuuugguagcauaagugagcaugaaagaagggaauacuuaaaauaguuauaagaagccuuuaaaaauaaaaccuugauuucuauacuagacacaaauauacuaauuuuuaggccaaauuaaacaucaccagacauacggaagguacugcaugcuacuguuaaauagaguugccacaaauaauauguuucagcaguuuaccaggggacaacccaacugagccagucaaagaagagauguuaaaauaaauauuugccuaucugugugaaaaaagacugacaaacaacugaacuuguuuaccaccaucaaaaacaggaauguuuaaagaaauauauggguauaacaaaugcuaucuggcuaagaaaucaggacuuuuucauuuuuagguauaagaagcagagguaaaagaguguuuuucaacagaaaucaaaguaggagggcuggaacugaaauuuuuuuuaacuaaagugcuagaagauccagcuuauggggguuaaaauaaaagagucugguagaaaauaugccuugaaagauguaaaucaagugaucucccauugcuuagguauauaaaaaggaagugggguacuuguacaagugacuucaguuauuuaaaacuaugaugaacaacuuuccauuaggaagaaacuuugagauagcuaggaaaaacggcaauaaaagaugcuugcuucaaugcuguucaaagagaaguuaaauauccagaacacuuuacacugaacauagagucauuugugucaugcccuggcagcaaauaagauuuuuuuauucacaauaaguuucucucucaaauuuuuggugaaaccaucaaauaccaacuacacuaaauacgauuuuugcuuauuggaguacagcagaaaaagucugcacaaaagaucagauauaaaaaaaaggcuuuguuccugcuugaaggaagcuaugaaauaccauauuuauucaaaaguaaaacuacuauggcuauauuuuaauuucaucuuaagauaauaccagcuggaaugaccagcaggagauaaauuucaccagaacuaacuuguaaaugcuaaagggucccaucuucacagagugacuauuuuguggguaacagaaugaauuuucacaauagauaauaauauuuaaauucaaguaaaaacaauauguauguacagauuuaaaguauuauguuauccacgccagaaaucccuuuauuaguggagguaacugagaguuacuuucaaguucugucuuuucuaacagucuaaaauaaaauguugaacaauacucauaaauggggaguguuuuugcuuacucuuuaaauaucaaguacugcugcauaaauccuuuaaccaucucuucuugacaaaggagcuaaagauauuagaaauauaggguacauuaaaccacaauaaaaugcaggaaauggaaaauaauacugugugugugggagcagggggcuucuuuugguaaugccauuuuaucaccaagacauugcccuaaucuacgaaaguggauaccaaaucaucuugaaaagacaguagaaaaguacauccaucaauaauuaagaaaauuucagaaaaaucuuauuuauuuauuuauugagacggaguuucacucuuguuguccaggcuggagugcaauggcagaucuuggcucacugcaaccuccgccuuccagguuccagcaauucucccaccucaagccuccugaguagcugagauuacaggcaccuaccaccacgccuggcuagauuuuuguaucuuuaguagagaugggguuucaccauguuggccaggcuggucuugaacuccugaccucaugugauccaccugccucccaaagugcugggauuacaggcgugagccaccacacccagccuuauuaauucuuauucaguuaauacugcaagaaaaacaucgacagcuaaagcugaccuacucuucauaaaagugauuauaaaguugcuaccugcucauacuagagagauaaccaaacacaaugagucucaguuuaguuugguaaucuaguaauuagacgugacuagaauacuauggauauuuagugaaauaugcugcccuuuaaucuccuaucauaggauauuacaaauucuucaggggagugaaaacacaugaguaaaaggaaaacaguaagaaaauucuguaaaaugcacauuauucuauguauuuuuuaaauuaucaaaaacagguuauuuucuucucuuuuuauuuuucugagauagauucucgcucugucgcacaggauggagugcaguggcgugaucucggcucacugcaaccuucaccucccagguucaagcgauucucaugccucagccuccugaguagcuaggauuacaggugcacaccaccacgccuggcuaauuuuuguauuauuaguagagacaggguuuugccuuguugcccaggcuagucucaagugauccaccugccuuggccugccaaagcacuggaauuacaggcaugaaccgccacacuuagcccaaaagcagauuuuuuucaacuaaaaauauuuuacuucauugccaucauuuaaaaauaauuuuuuuuuugagacggagucucguucuguugcccagguuggagggcaguggcgaaaucucggcuuacuguaaccuccaccucccggguucaaaugauucuccugccucagccucccgaguagcugggacuacaggcgcgcaccaucauucccagcuaauuuuuguauuuuuaguaaagacaauguuucaccauguuggcuaggcuggucuugaucuccugaccucaugaucugugugccacagccucccaaagugcugggauuacaggcguaagccacaauguccggccccuuaaaaauaauucuuaaauauccuaaauauuagaaccagcucagaagcuccaugcucugauuuuuaauuaaucauuuacacacaaaccuaauuauuauuugggagugaaguuuaauuuagcagauaaauguuuugagacauuaggagguaugaguucuuaucauagcuaugucacuaaccaucagagaacugagaacaaauaacagucuguaugaacuuuguuuuucucauuuauaaaaagguggaauuugaacuacccgaaugcuaaaaucuauagauaauaugaacaaguuacuaaauguaaugugcccagaaagaccugcuacgaaguaaauuuuacuuagcaacagacuucaaauucaguaauuaagacugguugagauuuuggccggguguaguggcucacauuuguaaucccaggacuucaggaggcugaggcagguggauugcuugagcucaggaguucaagaccagccugggcagcaaggggaaaccccaucucuacuauaaacacaaaaauucgccgggaguggugguguacgccuguagucccagcuacuugggucaaggugggaggaucgcucugggugguggagguugcagugagccgauauagugccacauagccugggugacagaguuuaacccugucucaaaaaaaaaaaaaaaaaaaaaaaaaaaggacugcuugagauuuugucugagauaauacagugaaaacugucgugaaacauaaagcucauauaaugccauuugauaaagaauaaagugaucauuuuauacuaauauguuaugcuucugaggcagaaacacuaagucaauuuauaauuuuuuuuuaaguuguuuuuuuuuuuaaaucacuuaaguaacagaguaaguuguauuuaggcauuuaaucaguguuuuccaacaaccaauuaaggcuuaaauuuagccauuauacaagcgugaauccuaaugaucaaugaacuauuuggguaguggguaguagugguauauaaaaauagaaguagcuagacuaugggucaaucaaacuaucuuucuucaucaauacuguuuuccaugaugaacaucaacaguaucagaaggcuuagaagcuaaaucucagcuuuauuaccuauuacuaaguuuguaauguaacauucuaagcaacagauucauuuucuaucaaauaagaauaguacauacuuucuugcccacuacauagagcagaaaaaucaauauauaccuaagcaauucagaaacuauaaauccuacauaaaaguuaggacuguauuauuaacuccuuauauucuuauauaacuauacgcaacuauguauuuauuacaaugcaugcuugauuuagggcagauuggcuuauuuucaagaaacaagaagagaaaaaaaugaaagcacagaggcuggaaaagaaauacuguacuaaucggcugggcacgguggcucacaccuguaaucccagcacuuugggaggccaagguggguggaucaccugaggucaggaguucacgaauagccuggccaacauggcaaaauccugucucuacaaaauauacaaaaauuagccgggugugguggcacgcgccuguagucccagcuacucaggaggcugaggcagaagaaucacuugaaccugggaggcggagguugcagugagccaagaucacgccacagcacucuagacugggugacagagugagacuuugucucaaaaaaaaaaaaacaaaagaaccaaauauuguacuaaucaaaauuuaauugguagaacaaaaggaaugcaugaaauaauuuuguuuuguaucugccuaagucgucaaucagaacauuucuaaaauugauuuucaccaaauuuugaguccucacaaucgguauggaaugaggcuuggagucugugcaucaauaaacaucuuuucacagguugucuuuggcccgugugcaacauugcuugcaccugauauauacccuuugcuacuuuucaagucucuuuuucugucuugguccuuaggaaacuauuuccucccacucuuuauaggccuaaaccccaaaaauauuacauacaaaaaugacuaaauuauaaaacuaaagaaguaagccagaaucuaaggcuuuggggauagaauuaaugauaaucugguauauuuuuuucugccagaaagaaagggguuucaaucacaaagcgauugaauauugccagccuaagggcaucuaaaaaaauaaaacguuuaugguuacaggaauuuucaaacacuagcccagggaauggaucucaccuagagugcaaguccuugaugggugaauacuaaguuuuuuucuucugccuaauaugauaguaggcaaguagaggaaauaagccucuuaaacaauuccucugaaauaaaauaaagaacuacuuaacauuauacaggcaaauaaauuaaaaagaaccaauauuuaggguuuaaucaaccauuuucauucaaacuauuauuaaaaauaauuuuaauugaacaagaaaaacauacaaugccagcauccugauaugcuccacuuuuuauuguuuagguuuuaaaaaacuuuuauuuauuuauuuauuuuugagacggaguaucauucuguagcccaggcuggagugcaauggcacuaucuuggcucacuacaaccuccgccuccccgguugaagcgauucucuugccucagccucccaagcagcugggauuacacccacugugcgccaccacacgcagcuaauuuuuguauuuucaguagagaugggguuucaccauguuggccaggcuggucuugaacuaaugaccucaguuaauuugucugccuuggccucccgaagggcugggauuaaaggugagagccacugcacccagccaaaaaaauuuuuuuaaauuuaaauauuauuuuaaagaagagagaugggggucucguuauauuacccaggcuugucuuaaacuccugggcucaaguaauccucucaccucaaccucccaacaugcugggauuacagguguaagccaccgcacccagccuauucuuuagguuuuaagugacagaugauauuagaagaauggucuaagugaaauuuacaggccgggcaagguggcucaugccuguaaugccagcacuuugggaggccaagaugggcagaucgccugaggucaggaguucgugaacagccuggccaacauggcgaaccuccgucucuacaaaaauacaaaaaaauuagccgggcgugguggcgggagccuguaguuccaguuacuugggaggcugagguagaaaaaucacuugaacccaggagguggaggcugcagugagccaagauuaugucacugcacuccagccugggcgacagagugagagacugucucagggggaaaaaaaauuacaauacguuuuagcauuauagguauagguaaaguacacauucaaaaugcuauuaaacuaauguaccaaaugucacauauauuccuuaaaaaaacaccuuuaauuucugaagaaaauccugagaauacuuaacucuaaccuugucuucuaguucaaaaaaugcaaaguguugaauguaaaaucucuauuuugacauaaaauacuggccuaaucuuuuguuccuccagaaggaaugcuaucucagaaauggccuuaauucaaauucugguuauuaguaaaccagccaacaucaauauucaucaguuuaucuguguuaacuuuuacacuuaacaccaugcaguuauuacaaaucacgacucuugaaaggggguauuaggaaagauaguaaauuacagaaacacagagcccugaaccaaaaaauauuaaaacaucaucuuuaugaagcucuuaaaacaaucuguacagugaauacccaacaacugccuaaagaauugucaacuuucaaaacacagacuaaaucaccauuaaacaccccuagcugccaccuuacagugucaauagguuacucuaacagguaagucagaaaagaugaaauuaacuaaaaaguacacucauuccuugagcagugcgcuaguuuacacuaaauaucaaucccaucagaguacuguaauuaucaugcaccaaacuguaagagauuaaucacuuaguauuaagguguaauugaggacaacuuaaaacacggcuuaaagucuacuguuucaaaaauaaaaauucagaggcuacuuuucagauauauguauguauguauauuagagauauuauauauaauuauguaccugauacauuacuauauauaauagugaaaacucuauaauaagagaacuacaagacauaaaagaaaaucccacaguguuaauccugaguuccuucuuuaagcagucauucuaguuuuuuuguuuguuuguuuguuuguuuuugagacagagucuugcucuaucccacaggcuagagugcacuagugggaucuuggcucaccgcaaccucugccuccuggguucaagugauucuccugccucgguagcugggauuacgggugcgugccaccacacgcagcuaauuguuuuguauuuuuaacagagacggguuucgccauguugaccaggcuagucuugaacucuugaccucaggugauccaccugccucggccucucaaagugcugggauuagaggcgugagccaccacgcccagcuaagcagucauucuuaccaaaaccuuuggaugaacagaaaguucagugauauggcugcaauauugguucuaccuacucuacuccacagcacaccaccuaaaaggaguacaguguacaaggcaacucaacuaauauaucaggguuuuacuuaccauguugcccaggcuggucuugaacuccugggcucaagcaaucauccucccaccuuggccucccaaagugcugggauuauacacaagagccaccauauccagcccagcuuccuuuuaaaaauucaaugauacauccaagagcuggcuguuuuuacaucuaaauuauagaucaggccgggcgcgguggcucacaccuguaaucccaacacuuugggaggcggaggggggcagaucacuugaggucaggaguucaagaccagcuuggccaacacggugaaacccccucucuacuaaaaauacaaaaauuagccagguguggugguaagggccucuaaucccagcuacuggggaggcugaggagaauugcuugaacccaggaggcggaacuugcagugagccaagaucgcaccacugcucuccauccugggugacagaguaagacuccgucucaaaauaaauaaauacauaaaauaaaauauagaucacuuuucuuuuccauuguugcacaauuuuacauguaugaauauucuguaguauaaacaauccuccuuuugauggacaugcauuuauuuuuccaguguuucauuuaacaaacaaaaucugaaugauuauucccgauuguacugcuuugcacacauggucuaauauauuucaaggauuaauaaguaaacacuauuuuauucacaguaaaugguucacucauguuuacacugucuccuauuuauggcaaaugauaaugguccauccgcuauggggguaauuugaaguuuccucuuuaaaagccuaagaaaaacuuguuuaauuuuuuaaguugaucugaagaaaaauucuaaguagaaaaaaaaggcaaagaaaaauuuaaguaaacaguagcauaggugguauaacaucuaaaaguucuuccucacaaaugccaagguucugcauucuaacaaagaauuucuaccaagaaaauuuccuucaguuuucaaucaagaaaacugacuuauuuaauaaaauuaauaauaucucaccaucauaugaguucucuuuuagauuuggguagauaggacacaaaauuuaauguuguauaaguguuccaugucuacaacuuuagcugggugacagcuuuaagcaaacaguagaggaacaggaagacaugaacauguauggagucucacccugccauuccaggaccuuaauacaaaagauuuaagaugcuuuuugacuuaacgacuuagcuucuaucaaucgacggaucauagcuuucugccugaguccgucaaauaaccaaguaauaggauuaguguuggaaaauuucugccuaacauuguagacgucggauucguauaugagaacaaaggaagccauguucccagauccauuuaugcuauggcacuuguacucuauugaaggagaucccuagagauaaaucugcaguugccaauaugaacacagauugcuuuuuaagacaaauaucuggagcauggaauauauuucuaccuggaaacuaacuaucuauuaaguccauaauaugagagcaagagugcugaugaguaccaaaaucucagucccccaaaacaguaggacagggagaagacauauacagcucuaucugcugagacaaaacagaugaaagucucuuccaugguaguuuggucuuguuccaacuuccccuccaaccauucaacuacaccugaagaccaucuuucuauaaugcaaaccugaugagagcugcugaaaaccuuucaguggcucaacauuacuuuuaagguaaguaacucugugauauauuccuguuuaucuucuagccccugauuuccucuccaggcucaucucccaccacuaccuuccagcuacacuaugcucaggcacaccaaacuuuucaagguccccugaauaugugaugcuuuccuucacugcuaacauuguuuucauacccuugggacaccaaucccuugccccucuucauuuguacucuauucuugguuaauuccuauguauccuuuaggccuccaaaucuggauugauuuuccuguagugucuugaauucuacuaauaugucagauacuauguuguuacaacugccagguuggcccagcgcaguggcucacaccuguauguacucccagaacuuugggaggcugaggcgggcggauuaccugaggucaggaguuugugaccagccuggccaacauggugaaaccccgucucuacuaaaaauacaaaaauuagcugggcguggugacacacgccuguaaucccagcuacucgggaggcugaagcaagagaauugcuugaaaccaggagacggagguugcagugagccgagaucaagccacugcacuccagccuggccgagagagcgagacucuguccaaaaaaaaaaaaaaaaaccugccugguuauuauuucccccauuuauaugucagccccuuagaaagaagaccaauuuucuaguuaugugcccacagacauuaaaaaaaaaaucuguuaagugaaugcaucaguaaugauuuugugaccaggccagaucucaccuaucaguguuaaucaugaauuucuuauaaucaugaauauguuacaaauuagauaaauguaagguaaaugauaagccuuuccagcuuucuuuuuuauuuucuuuauuuuuguucuuacacaugcagagugggucucacucugucgcccaggauagaaugcagugguaaaaucauagcucacuguaaccucaaaauccuagucucaagcgauccucccaccucaaccuccugagcagcuaggacuacaggugcagcccacgauauugacuaauuuauuuuuauguuuuguagagacagggucucccuauguugccaaggcuggucuugaacucccggcuucaagugaucgucccaccuaagccucccaaagugcuggcacugggauccagauucuuaaugaugucuuuuuaucuccucuuguaaggguuuugggcuugggggcgcacaaaccuauggaaucuccuccauucucugaauuaucagaucaaaauuaauuggguuuaggcaguggccucaggauagauuucaagauagacaggauauucucagcagucacaguuaacauccucuuuacacuugaccuuuuucuuuaauuucucucauccccaaaaggaagguaaaaauucuauuacaaauacaacauacacaucauuucaaugaaaaucauuauaugcaaccacaaucacuaccuagagaucugcagaauacacaaugaaucuauuuucuuuaucuaauauauauauauuagguauacauauauauauuagguauacauauauauauuagguauauauauauuagguauauauauauauuaaguguauauauauauuagguauauaaaaauaaguaguaaacuacgauuucucuuacuuaaaaaaagaaccauaccaaauacauguacuuuauucacccuuggauuucacaguaauagagacagaaauauuguaaaauguuucugagugugugauacauaguauguauguauguauguauguauguauguauuuuuugagacagaguuucccucuguugcccagacuggaguguaauggagugugauggugugaucacugcaacccccaccucccaggcucaagugauucucgugccucagccucccaaguuccugggauuacagguaugugccaccacacccagcugaauuuuuguauuuuuaguagagauggguuuugcuauguuggacaggcuggucuagaacuccuggccucaagugaucagcccaagucagccuaucaaagugcugggauuacagccgugagccacugcacccggccgugauacacagcauuuuuaaaguuacagcuccaaacccucaaaaaacacuaaaauagacccugaaagugauacauuaacagaacacauuuuccugaaucauucucuucucagaguauucuaggauuuuugugaaauacaguugggaaugaggcagacaggugggguggggagcuuugagucaguguuaaaauuaaacuaaggccacuuucuguggguauacacuguaagggaaaaauggauuauuuugugaacucuguuagaaaaaaaaauacaucuuaaguugugacaacuggaaaagaauagauuuuacucucucugugaagcugaaaaugaauucucuauaugguaaaccuugaaaguagagauguaguaacauuauuagucuuuaccggugccgucuuauaacagaggcugcacagauuagcagagaccaugaggguuucaacgaaaaaguauauucaagucuuaaugcaaaauauaauaauguuuaucaguaaaaagaauuacuaaaaauauguacugcacacggucacuguaaagauaaaauaaucuaaugaaaugagcuuuacgaacacucauuauaucuucacaugcauauuuuguugguacauaguuuauaagucugaagaauguucucuggcugaagaauaaaagaauuuaaauggaauaauuucauccgguuaaucaaauagaaaaauaaagagcuccaguuaauugaaacucaguuauccucuaucugaaauuaaauuuucauggugaauuaacugguguauuuuuauaaagaagauuccuuucucaaaaaauuauacaguguuaugugaacaggaaauagauuaagcuaagaaaagcaaauagaccaaagaggcacuauagguguccaaauuuccugcaauaagaauauucuauaauuaccuuagaauucaauacucuauaacuccauuuuugcaggaucuaauagaaauuauagcauaaggaaauacacaguuuaaagaaggauauuauuauuuacugguuuuauuuucacuuuguaacacuauaaaugugugauacuguuuuuaaucaaggcuaaaccuaaaacaacauuccaaaucauuaugcaauuuuucaucuaaaagacaaaauauaccuggguaaaaaacacucaagguuuuauaaauuuucaauuuuaguuauaagcuaacagagucaucucaaaacacagaaauguaagguacagaaauacagggcaagauuccccuaaaaagacaugauggcaguuucaaagcucaguauauauuauacauauugauauacugaaaacuauguuuauucuacaagaauaagcaacacagauggccagggaagggaauaagauguuuuaguagacacuucucaaggaggcauuagcucaaugagacaaucagauguucaguucaauuaugauaccacacuauuguuauauuauuacacuagcuuccuugguuaccagugagaaagauucuggggggggccacaagauaggaggggaccaaauacaacacuauucucuucucuacaaaagaaaaaauaucacacuaucaaagaaaauauaccuuuacauuuuccauuacuaguaacagaguuguaugagucuacaacuuuuuaucucuaccaacuggcucuucauuucaucuuuucuauaauuuaugauucugacugccuggcaaugagccaucaccaccauauaauucacccauguaaucaaaaaccauuuguaugccaaaagcuauuaaaauaaaugaauaaagugauaaugacaacacauuaagccaacaaagucagaauuccuucacaaggugauuucucccucauaggcaaagacuaacaagaauuauucuuccagugaccaauucucuaugaucuuuugaucuacacuauuucuuaagucauagguucuuaaaaaauaagugagaaaaagcaaaguaaauacaguaaauacgguaaaugacauuaauuuacucaaaagguaacugaaaaaggaguaaacuuccauuaacaguauaaaugcuucaaaauucagaauuaggccaucuuugaggaauaaacugacaaccacugaacagauucugccaugagaaaggaaaaggucacugaacagauccugccaagggaaaggaaaaggucuccuagguuauuuaaaaaagaguuuugacagaacucauccucugaaucuacuaagguguaaacaaacuaaaaauaacaauucaguuuuccuuaaagauaagcauuaagacuuauuuuaauuccaucaaauacugaauccuuugacuucuaaaauaaaacagaaguaauccauaaaccuaagaauuauacuucuaagauucuaucugcagagauuucugcaagcaccaaaagauguauguaugagguuauuaugaacugaaaauaaccuaaaaucuacuaauaaauaguuaaauaaaauauagcaccuaaauacaaaggugaauuugaaguauuuagaacaaugucagugguauuuauugacacugaaagaugucucugacaucaacauuaugugagaaacuagcaucuauuugucuaacagguacaaugggacaccauuugggaaaaacuucauaccuauagcuaugagaucacacagggagauacugaauaagcaauugugaauaaauguuucuaaguguauaauuuggguggauacuuuuucuuuguauguuuauuuauugcuugugugugagggugugcauguuucuuucuuuuuuuuuuuuugagacggagucucgcucugucacccaggcuggagugcaguggcgugaucucggcucacugcaaccucugccucccggguucacgccauucuccugccucagccucccgagcagcugggacuacaggugcccgccaccaugccuggcuaauuuuuugguauuuuuaguagagacgggguuucaccauguuagccaggauggucuugaucuccugaccucgugauccauccaccucggccucccacagugcugggauuacaggugugagccaccgcacccagccgaggguguauaugcuuuuaaaaagcacauaucacugaaaaacaaaaacacccauggaguuauuuuaaaaacauuguuagaggcaaacucaagagaaaugaacauuguauauaguaccuuaaacgguugguauagguaucaacacaggucuucauuuuggcuaacaauguaccaacagaaguuugacauucugacuguucuucuuccucuucaccguucucuguagaaaggggcaacaauaggggcaccauggcagcacaagaagcaauggcccgaagcaauuccagcagugcccgauagaguggcacaugucuugccauguccagaacuauaaggagaagaagaaaaagcacaaaaugagcaaauguacaauauaaaaguagguccacaggaauguagcuuuuaccuggaucuuaccaagguccacagcugacccggcugggcacgcugguucaggccuguaaucucaguacuuugugaggccgaggcaggcagaucacccgaggucgggaguucgagaccagccugaccaacauguagaaacccugucucuacuaagaauacaaaaauuagccaggugggauggcgcaugccuguaaucucagcuacucggaggcugaggcaggagaacuguuugaaccugggaggcggagacuauagugagccaagaucaugccauugcacuccagccugggccacaagagugaaacuccgucucaaaaaaauuacagcugacccuugaacaacacagguuugaacugcacuaguccacuuauauacagauuuucugccagccugagacagcaagaccaaccucaucacuucuuccucauuaggcuacucaacaugaagacucugaguaugaagacuuuuaugaugauccacuuccauuuaaugaacaguaaauauauuuucuaugauuuuuuucuuaauauuuucuuuuccuuaccuuacaguauauaauacauacaacauccaaaauguguuaauugauuaucaguaaggcuuccagucaacaguaggcuauuaggagcuaaguucuggaagagucaggaguuauacuuggggccggacacugugauucgcgcccauaaucccagaccuuugggaggccaaggugggaggaucacuugagccugggaguuugagaccggccugggcaacaugguaaaacuuccaucucuacaaaaagauaacaaaaaauuagcugggcgugguggcgcacaccuguagucccugcaacuggggaggacaagaucaugccacugcacuccagccugggugauagggcaaaaucccgccucaaaaaaaaaaaaaaaaaaagaaaaaguuauacuuggauucucaaauauguggggguugguacccuuaauaccugcauuauucaagggucaacuuaauagguuagcugcuaaaugaaagaaugcagcagauauuuaagaagcaccaauauacaaacuauaauaauaggcacuuuuggaaaacaaaaaaaaguaaaguaucaaguuuaggggagaacaagaaauguaacuaaauaucuaguuauauuacauauagaaaugauuaaauacaccagauaauauauuauggcuggaaacauauuuaucaguaugaaguggaaacuuuuuuaaacuaaauugaaugaugaaguuauuuuaucuuuugugaaaacgaaugacagaauugcaauuuauccagagucuauuucaauaaaucaacuuucuuuuuaguaaaaaagaaaauauugccuauguuaacuuccaauuacuagcuauaaaucaaaugaauuuuguauuaaaauuauuuguaucuaagagugaauuccuuacucgaggaacacacguugcuucuaaggcuuuuauaaguuguuuuguuggguuuuguguuguauaccaacuggaauuuacuuuugugaauaacgugagauaaggaucuaacaucucucuuccaaugacaguuacugaacagccauuccauaaacauuuacuggcagggcgcggugacucacaccugcaauuucaccacuuugagaggcugaggcugauggaucaccgggggucaggaguucgagaccagccuggccaacauggugaaaccccgucucuacuaaauacgaaaauuagcuaggcauggcggcacaggucuguaaucccagcuacucaggagacugaggcaggagaaucgcuugaacucaagaggcggaggcugcagugagcugagaccacauacugcacuccggccugggugacagagcaagacagucucaaaaacaaacaaacaaaaaacauuuacugaaaaccuguugcuggacaggcugggaauaagcaguaaagaaaacaaacaaaaaucucuaccaucaaguaucuaacauucuaggcgaaggacaugaguuacauucuuuucagaagcuaguaaguauucugaaugcuauauagaaaacuaaagcaggggaggagaauugugggaguccaacuagagguaggaauugccucagugcccacagagcuauauggggauuaaguuguaacaggauguggcaucaccuagcauccuguacuuuguaugguaacugaugugaaagagaucucuacaacugauguaaaauagagacuaucagagcuuaaugacagugaggcuacuuggagugacguucaaagugauggaagagaaggucauuuuacaccuuccagugaugaugcagaggacaggguaguaugacugccauucuuuccuuguuuccccuuguuuccacauauacuugaguaugaaagcccauuuuccaacccaugaacaaugucacaacauccuacuuacuauaauuuuauaguauuauaagauacuauguuauucaggaaaaucaaaauuauauccaaaaguuacuaacugauaggcauaaaacacaaugucaguacuugugaggauguggaaaagcuagacucacauauagguaaaagcgcaaacagguauagccaacuggcauuaucuauuaaaauuuuaaaugccuauauucuaugacucaauaauagcacuuguuacugucuacccuacaaagaaauguucaauacaauacuguuuucaauagggaaagcuggaaaugaucuaccaguaauaccauaaucaaacaauaacauucacaguaauacaauaauagugggagacuucaacacccaacucacagcacuagaaagauaauugagacagaaaauuaacaaagaaaacauuggacuuaaauuggacuuuggacuaaauggacuuaacagacguaggacagucuacucaacaaugacaguauauacauuccuuucaccaacacaugaaacauucuccuagacagaccacguuaguccauaaaaggagucuuaacaaaauuuuugaaaaucgaaaucauaucaaguaucuucucaagaccacaguggaauaaagcuagaaaacaauaccaacaggaacauuggaagcaguacaaauacauggaaauuaaacagcaugauacugaaugaucacugggucaacaaagaaauuaaggcaaauuuaaaaauuuuuugaaaugaaugaaaaugaaacgcaacaucagaaaaacugugggauauagcaaaugcagugcaaagagagagaaguguauagccuuaaaagccugcaucagaaaguggguaacaaaucaacaaucuuacauguaccucaaggaacuagaaaaguaagaacaauccacacccaaaguuagaauaacacagaacuaaaugaaauacagccccccacaacaaaaauauacaaagcaucagcaaacugaaaagcugguuuucgaaaagauaaacaaaacugauaaacuauuagcuagacuaaccaagaagagagaagauccaaauaaacagaaucagaaaugaaaaaggaauacaacugauacuacagaaauacaaaagaucagggacuauuaugaucaacucuacacucaaccuagaaaaccuagaggaaacaaguaaauuccuggaaacauacaaccuccugagauugaacaagaaacaaacugaauuucuaaacaaacuaauaacaagcagugagauucaaucauaauaaaacaucucccaacaaaaaaaaaaaaaaaaaaaaaaaagcccaggaccacaugaauucacagccaaauucuaccaaauauaaaaacaacauacugauacaaguccucccaaaacuaaaaaaauuaaggaggaguuuauucucucuaacucauuuuaugaggccgguaauaugcugauaccaaaaccaggcaaagauauaauaaaagcagaaaacuaaagaccaauaucccuaauaaagucagacacaaaaauccaaaacaaaaaacaaguaaaucaaauccaacagcacaucaaaaagauaauacaauaauggcauggugguucacaccuguaaucccaacauuuugggaggcugaggcaggaggaucacuugagaccaagagaucgagacaagcaaggucaaaagagcaagaaaaccugucuccacaaaaauaaaauaaaauaaaauaaaauaagccagaugugauggcaaaaaccuguauucccagcuacuugggaggcuaaggugggaggacugcuugagaccaggaguuugaggcuaaagugggcuacgaugacaccauugcacccuagccugggcaacagagcaagaccucaacccuuaaaaauaaacaaauaggccgagcgugauggcucacaccuguaacuccagcacuuugggaggccaagguggguggaaaaccugaggucaggaguucgagaccagccuggccaacauggugaaacccaucucuacuaaaaauacaaaaauuagccggguguuguggugcaagucuguggucccaccuacuugggggugcugaggcaggagaaucgcuugaacccagaaaguggagguugcagugagccaggauaauaccauugcacuccagccugggugacagagcgagacuccaucucaaaacaaacaaacaaacaaacaaacaaauaaauggccacgcacuguagcucacacccguaaucccagcacuuugggaggccaaggugagugaauugcuugaggcaaggaguucgagaccagccugaccaacauggugaaacccugugucuacccaaaauaaaaaaauuagccagucucacaagcugaucucaaaauaaauaaauaaauaacuuuuaaaaaauaaacaacaaaaaaaagauaauacaucaugaucaaguaugauuuaucccagggauacaaggaugguucaacacacacaaauccauaaaugugacacaucauaacaacauaauaaaggacaaaaacucuauagucauuucaauaaauguugaaaaagcaugugauaaaauugauauaaauccccaauaaacugggcauagaaggaacacacagcauaauaaaggccauauaugaaaaacccacagcuaacacuauacuuaaugggaaaaagcugaaagcauucccucuaagaacuggaacaagucaagaguucucauuuucaccacucuuauucaacaucguacuggacaucuugccagaguaaucaggcaagggaaaaaaaaaaggcauucaaacucaaaaagcaggaagucaacauuuucccuguuugcugaggauaugaucuagaaaacccuaaagacuccaugagaaacucuuggauuugauacaugaauucaauaaagauucaggauauaagauuaauauaugaaaaccaguaauguuucuauacaccaauaaucaucuagccaaggauuaaaucaagaaagcaaucucauuuacaauagcuacagaaaaaaaaaaaaaugaacaagugugguggcucaugccugaaaucacagcacuuugggagguccaggcuggaagacagcucggguccaagggcuuaagaccagccugaacaacauaguaagaccuuaucucuacaaaaaccaaaaaggaaauuagucagguguggugguucauuccuguagucccagcuacuugggaagcugaggcaggagaaucacuugagccuaccaggucgaggcuacagugagcucugauagcacuacuguacucuagccugggcgacggagcaagacccugucaaauaaaauuaaaaauaagauaaaauaauaaaaucuaaaacaaaauaccuaggaauauauuuaaccaaggaaguaaaaggucucuauaagaauaacuacaggccaagugcgguggcucacgccuauaaucucggcacuuugggaggcugagguggggagaucacuaggggccagaaguucaaggccagucuggucaacacggcgaaaccccaucucuacuaaaauacaaaaauuaccugggccucguugugggugucuguaaacccagcuacucgggaggcugagacacaagaaucacuugaaccugggaggcagagguugcagugagcccagaucgcaccacugcacuugcacuccagccugagcaacggagggagacuccaucucaaaaaaaaaaaaaaaaagagagagacaugggagacuccuccaaaaagugggguuugaaaaauaucuacuggguacaauguuuacucuuccagugauggguacacuaaaaccccagacuucacacuaugugcaagaaaugugugcuuuuuuuuuuuuugagacugaguuucgcuccuguugcccagacuggagugcuaugacauaaucucggcucacugcaaccucugucuccaggguucaagcaauucuccugcuucagccucccaaguggcugggauuacaggugcaugccaccaugccggacuaauuuuuguauuuuuggucaagaugguguuucaccauguuggcuuggcuggucucgaacuacagaucucaagugacugcccgccucgaacucucgaagugcugaaauuacaggcgugagccacugcgcccagccaaaaaaggugaacuucuaaaaaauaacuuuacauuaauauuuauauuauuuuccuuuuuuuuuuuuuuuuugcgccaaggucucacucuguugcccaggcuggagugcaaugguguaaccauugcacuuuguagccuuggccuccugggcucaaggauccuccugccucacauuccagagcagcugggauuacaggcacaugccaccauguccaguuaauuuuuucuauuuuuucguagaguugggguuucaccauguugcccaggcuggucucgaacuccuaagcucaggcaaucuaccugccuuggccuccuaacguguuacgauuacagugauuaauauuucaaauagauuauccugaaaaaaaaaaaaaaagauaaaacuuaccuuuuaaggcuauaguuucuuuugacuauuucucuccuucuccauucuuguuuguuuguuuuuugagacggagucucgcucuguugcccagucuggagugcaguggcacaaucuugacucacugcaagcuccaccucccagguucaugccauucuccugccucagccucccaaguagcugggaguacaggugcccgccaccaugccuggcuaauuuuuuaauuauuauuuuuauuuuuaguagagaaggguuuucacuguguuagccaggauggucucgauuuccugaccucgugauccacccaccucaaccucccaaaguguugggauuacaggcgugagccaccacacccggccuccuuccccacucuuuuaccugguacaucauuuugguauacauccaucuaauccauuuucuauaugaugauguuucucuguguguacuauuauguggauuagguauuaucauccccacuguguguaugagaaacuaauauuuacuaaguugcacaagcagcuaaauaggaaguaagaagaccaacagugaaaacuugguacauuuagcuuuagugcuuuucccauuaucccaugauacuuccugaacuguccaguauggcagcuacuggccacacgcuaucuaaauuuuaacuaaaauguaagaaaacuaagaauucaguucuucaguugcacuaaccacauuucaagugucccauagccacacaaguccuuaaugaauggcacagauacagaguguuuucaucacaacaaaaaauucuuuuggaaaguagcaucuucaagagacaaauuccugacauucuguuuuauaaauacaagccaggaaagguauguggauauggggauuccccaaaagaaaaacauuuuuuuaaaaaagcauaagaaguggguagaccaggugugguggcucacgccuguaaucccagcagugugggaggccgaggcagguggaucaccugagaucaggaguucaagaccagccuagccaacauggcaaaacccagucucuacuaaaaauacaaaaacagccaggugugguggugugcgccuguaaucccagcuaaucgggaggcugaggcaggugaaucgcuugaacccuggaggcagagguugcagugagccaagaucaugccacuguacucuagccuggguaacagagacucuguuucaaaacaaacaaacaaaaaaagaagugggaaaagaguaaugucuucauucucagaaaacugauucucuauuuggaaaauacgguaaauccacagaaauacuauuagaauacuaaaguauguggaugcaaaauucacauaaaugaauacuguuaauuuuauauaacaaucaacuguaaaauagagaaacugcacaauaggaaauacaacaaaaauacacaaaaaaacuuaugaugaaaauaucuaugcugcaggacagagaugauagucucaauaaacagguauaucauauuuacaaugggcauauacaacagaauaaaaaugucaauuaaaaaaauaugugagcuggaugcaguggcucaugccuauaaucccaggauuuggaaggcuggggcagaagcaucgcuagagcccaggagcucaagaccagccuaggcaauacagaaagacccaaucucuacacaaaauuuuaaaaauuagccaggugugguagugcccgccaguagucucagcuacucaugaggcugaaguggcaggaucacuugaguccaggaggucgaggcugcagugagccauaaucacaccacuguacuccaagccugggcaagauccugucuguauaaaauuuaaaaaauuagccgggcaugggaagcugcaguuagucaugauuacaccacugcacucuagccugggacauagagugagaccuuaucucaaaaaagaaccuauuuauguuuauuaauaugcaacuguuuuaauuacuaaaugcccauuauguagccauaaaaaauuagaauaugcuuuaugcuguacuggagcaaauucgcaaguacuauaaugucauuuugggguggggauaggacaguaagguauaaaaauggguuauaugguaaacauaacccauaaauguuaauaaaaaauaaaugauuauuuggguaaacauaaaacaaaacacaaauaacaaaaacauaaaaagagggagacuaugugauaugguuuggcugugucuccacccaaaacucaucaugcauuguaguucucauaacccccaugugucaugggaggaacccagugggagguaacugaaucaugggggugguuaccuccaugcuguccucauaauagugaguucucacgagauaugaugguuuuauaaggggcucucacugcguugcucugcacuuuuccuugcugcugccaugugaagaaggacauguuugcuuccccuucugccaugauuguaagucuccugaggccuccccagcccugcagaacuauaagucaauuaaaccucuuuccuuuauaauucacccagucucaggcaguucuuuauagcagugugacaaugaacuaauauguauuuauauuuacuuguuauacauagauuuccuauaaagaaauauaagaaauuaguagcacugguuaguacuaucuguaacuauuaguacuauuaguuagauuaguacuauagggauaacuauaguuuaucccuaaugagcuguuauugguaggacagaggcaggaaaacagcuauuuauuagauaccaccuuaaagcuuuugaauuuuaaaauguggagaacagaauacuuaagaaaaaccugauguaauuuaauuaauaaaauaugucuuauaggggagaaguacaugauauuguauauuuagguauguguugaauuuuauaaaaacuagauacuccauagugucuaacuuccucuuucuacccaauaucaagauagaugguuucuacuuucaagaacuugauggauacaaaauauuccacuguaagguucuaaaacauuuaauuaguaggaaagcuugaauauuuuacuugguuuaugagaacucaauuuuucuugcuagcaugagagggaagaucccugcagaucagauccccagugaaacugguacauacucuuuaaaagaacacaacuaucuaaaaucucuggaagugguccuaacaguaugcagcaaaugaagaaacguuuauucaagaaaauguacuaaaacucaguaagaaaagcaagagucugugguaugugaaucaagaugcugcuccuuucuuccccacccucagcucaaugagaaagaaaaaccacucuagcuggcuacagccaagaacacaggccucccucucccagagguccaaguuggaaagcuaugccuuaguacagagcugaaagccugccuuccuagcggggugaggggcaggaugucagcauuucccauccuaccacagcaaccuccugcugcuaaguuagaagguacacauggcuaagaaguugacauucaauccccucuucuagccagcccccacucauggggcagagaauuugaaaagauauuucucuggaaaggauaggugaauagucaaugaacacaugaaaauaugcuuaacauacuuagucaucaaagaaaugcaaauuaaaaccacaaugagauaccaucucacacccaguaagauuauuguaauuuuaaaagucagguaauccauguaacucaacaauuccauccuagguauauuaccaaaggaauucaaagcagaaacaccaauagauauuuguaugcuaaugcucacugcaacauuuuugcaacugccaaaaugcaaaaacaaauagacaucaacugauggaaaagcaaaauguaguacacagccauaaaauggaauguuguucagcccgaagaaguuaucaacuacugauacauucaacaucaauaaacccugaaaacauuuugcugcauggaaaaagccaauuuaaaaagaccacauauuauaugauccaauuuacauaaaauauucagaaaaggcaacucuauauaaggauagaaaguagauuaucagccgcuuagugcuagagaagaugaggggauggaagaugauaacuaaaggguacaggguuuguuuguuuuuuguuuuuugagacagaguuucacucuuguugcccaggcuggagugcaauggcacagucucagcucacugcaaccuccgccucccggguucaagcgauucuccugucuuagccucccaaguagcugggauuacaggcgcccaccaccacacucggcucauuuuuuuauuuuuaguagagacaagguucaccauguuggccaggcuggucucgaacuccugaccucaagugauccgcccaccugggccucccaaagugcugggauuacaggcaugagcaaaugugccuggccaaggguacaggguucuuuaugaggugaaaaaaaaaaauuaucaaauucacuuugguaacaguuguacacauuugugacuauaauaaaaaucaaugaauuguauacuuuaaaugggugaacugaaggguaccgaauuaucaaccauuaaagcugucacuaaaauuuuuuucucuuaaguacuuauucauauacauuugcuccuuuuuauacugaaauauuuauuuucuucaauugcuuuaaaacacuaauacgaggaaaagcacccaguaaacauugcauauauuuuauaaauguuuuuauuuuucaaauauaggaaaacauaagacuugaauguacaaucauguagccucuuuucaacuugagacuggcacaauaaugaagccuuagaaaaaaccuucccuauuccacaguuuucuccugcccccccauuuuagcuacaucugcuggaauggaauccacaguuuugaaugauuucccugucuacaucgaaauauuugaaaaaucagaauuuauacugauaaaaauauagccagguacccaaagauuaccauuugcacugcuuuauaaacucauuuagcaaaguagugcacauaguauuucaccguucucaacccucuucauguaacauacaaagagaaacagaacagaggacacauuguuccaaccaaaaccccagcaaguuauuuuguggcuaucaaucaaaugauuaaguuucuauggaaaggcaaaauacguagcauagccagcacaacauugaagaacaaagucagaggacugacacuauaugacuugaccaccugacuauaaugcugcgacaauuaagacaaugugguacucacgaaagaauaaacaaauagaucagugaaacaaaacugggaauaaaaaucuguaugugaauguuuauagcagaucuauucauaaaugccaaaaaaaggaagcaaucaagauguucuucaaaaggugaaugaauaaacacuuacauguucauacaauggaauauuuuucagcgauaaaaaaggaagcagccaccaagccaugaaaacacauggacaaaacuuaaauguauauuauuaaaugaaagaagccaaucuaaaaggcuagaucuuaugauuacaacuauaugacauucugaaaaaggcacaacuauggagacaguacaaagaacagugguuaccagaggucuggggauuaggaagggaugcaggauuaauagaauuucuuagggcaguaaacucuucugugugauccugucaugguggaauacauaaaauugcgcauuugucaaaacccacacaacuguagaacauaaagagcgaacucgaauuucaacuauaaauuuaguuaaaaauaacauaccacuauuaguucaucaauuauauguacuacacuaaugcaaaauaugaauaaguaaacugugaguaggaacugcauauaugggaacucuguacuaucugcucaauuuucugugaaccuaaaaauacucaacagcaauuuagauaaaauuauaaaagaauacaaguaauacaagauauguuuauguuuuaaaaauuaaauuauuaugaagguauuaagaacaaccaaaaccacaaaaugagaaucuucuucuccauacaugaauaaugaagacagucuagcaugcuaaaguucaauaaggaagagaaggggaaaaagagaucccacaaauuugcaagcacaaauauaacugauaauuccaauuguuaaaaucuagaaauaauaauaauuuuauuuuuuuuuaaguuggagucucacucugucacucaggcuggagugcaauggcaugaucucggcucacugcaaccuucaccucccggguucaaccaauucuccugccucagccucccgaguagcugcgauuacaggggcccaccaccacgccuggcuaguuuuuguauuuuuaguaaagacgggguuucaccauguuggccaggcuggucucgaacuccugaccucgugauccgcccgccucagccucccaaagcgcugggauuauaggcgugagcacugcccccagcaaaaucuagaaauaaauaaauaaauauauauauauauauacaugauuaaagcauuauuucuucauauaaacauaaaagauaaucccagaaacuuuaaaaaaaacuuuagguucaaaaaaaaccuugaauauaauuuacaacuaaaaaaaaaucaaaauaaaaugaaaucgaacgauuucaaauuucauaauuaaugaauacuaauuagaaaguauaucacucaugagcgggcacaguggcucaugccuguaaucccagauauuugggaggccgaggugggcagaucauuugaggucagaaguugcagaccugccugguuaacauggugaaacccagccucuacuaaaaauacaaaaauuaaccaggcgugcugacacgccuguagacccagcuacucaggucgcugaggcaggagaaucacuugagcuugggaaguggagguugcagugagccaagaucgugccacuguccuccagccugggcaacagagcuagacuccaucucaaaaaaagaaaaaagaaaaaaaaaaaaaaguauguuacuuggaggucaauuuuuuuuuuuuugagauguagucucacuccgucacccaggcugcagugcaauggcauggucucggcucacugcaaccucugucucccggguacaaguuacucuccagccucagccucccaaguagcugggacuacaggcacgugccaccacgcccggcuaauuuuuguauuuuuaguagagaugggguuucacuauguuggccaggcuggucucgaccuccugaccucgugauccacccgccucggccucccaaagugcugggauuacaggugugagccaccgcccccggccuacuugcaggucaauuuauaaagcacgagauguugcauaaaaaaaaaaaagucgggcacaguggcuuauguaugcaaucccagugacucaggaggcugagacaagaggauugcuuaaggccaggaguuuugaaacuagccugggcaacauaaugagaaccuauuucuacaaaaaauuuuaaaacuuagcugggcaugguggcaggugccuguagucccagcuaaucaggaggauguuugagccuaagaauugaaggcugcagugcccuaugagcacaccacugcacuccagcccggguggcagagaagacuaugacugaagaagaaaaaagaaaaaauauauaguuacauuauauucacauguaaacaaaagggcauagagaaaacaacacagcuccucugaaauaaaugaaacaugcuauucccucuuauuuaacugguauauauuuuacucuauugaguuagcauuaggagaggccaacugggaaucuuacauuauggaaauagaagaagauauucucuucauaucaaggaguaugaaggcaaaagcuagcaaaacaagguaauaauaagcacuggcacacgagacugggaauaguccaaaaaaugugagagauaaaauuguguguuuauuuuacaaaaaucuuuaaaauuuuaaaaagaacuuuaaauuucauuacuguacuuuaaaaaauaucucaagauaucaaauuucuucauuuuaaacuaaaaauaucaaguuuuuuguauuucuguauuuuucuugacaaccauuaguuacguaaguaugcuuuucuuuaagucaaauucuauauuaaugcauaugacaaucuaugccuaugucuggaaccugacauguguuauuuauaucggauuuauuauuauuguugucauuauuuuuuugagaugaagucucacccuguugcccaggcuggagugcaguggcgugaucucggcucacugcaaccuccgccucccggguucaggcaauucuccugccucagccuuccaagcagcugggauaacaggcacccgccacuacaccuggcuaauuuuuuuguauuuucaguagagacaggguuucaccauguuggccaggcaaacccuugaacucaggugauccaccggccuuggccucccaaagugcugggauuacaggugugagccacugugccggccuuauuuuuuuuuuuuuuuuaaagauuuugaagacccccccaaccaagaggagaacuuggaaaacuaauguagagcugauuuaugcucuccuuuuaagacaugugcuuuuauuguaaauuaauguguaccgguggucagcaagcaacaagaauggauaaagauaauaaacccuuaauaaaaaccugccuguuaaagcacaaaacaacauaaaaacuacuucaaucuugaauucuuucauucuauuuuugccaugaagagcuucaucagaaaacccuuagaugucuucaaauuuagcuccuuuacacauacuucauuguuauuacaggauucaaugugcgccugccugacaaagaacagaggcacaacacgcuguuaugcaacaccaugucuccaagugcagcuugcagcuccuuuacucagcaagcaccaaaugcauguuuaaucaguguuacagcuuacaaccaggcaagugaagucacuauccuuccaauccucaaaagggccuguuugcugauuuaugcauagcuugaagacuaucuuggaauugucaucaacagcuacagaugcgggugugugacauuacaaaacuuaugccaauaaacaauuuuuuucauuuuuauaguaguaacugguaguagggagaggaauaaaaucacuuucugcauuuggaacuaaaacauuucaauggggaaaaguaucuucaaacagcugaaaagaaaaagaacaguguaaagguucaucagacagaaaauucaaaagaaauaaccauaaacauuagcauuuuggaggaaauaugugauucagcauauaaaaaaccuaaaaaaacuaaaaaauagagccuauuuacagugugacuuacuugcagaggcuagcaauuuacaucaaauaguuacagugaaauuuaccacagauuacuaacagcgaagauacaucccuucaggauauacugaaaacauuugccaucuuugauaugaagcuuguucagcuuuuguucacaagcccuccgugaagagaaaagguucauucaucacuauuguggacuaaagcaacauaucugauaacacuuuacuccugaugcaauguaggguaagcagcacuucucuuuuaauuauuuuaaaacucugacauuuaguaacuccauuauuuuaagcuuaaauaugugauguguuuaaucuguggaaauaaaucuuuuauuaagagauaaacucugcuauuaauugcuuuuucaaaauauuaguaaaauggaauuaauuucaauacuagauuauaaaauuaaugacacaaugauccucuaaucuucaaaggaaaaaauuauuuaaaucccuauucugcucaacugcuccccaaaagaguugcuuuaaaaaggaguugauguucuaaacuuaccgaauuguauacacuaaguauguguaguuuuuuguauauaaauugcaguucacauuaaauacaucagccuaguuagauacguaaaaauuuuuaaguaucuaaguaaauacagaauacguaaauggcagaaucuaacuucuacauuuucauuauauuuucggcucuucagcccaaauguuaaaaacaacagauuuuaaauucuauuaaaauacacucauuuacuaucauuuuccaacacguuaacagacuaaaguaggacugcacacugaaaaacuacgcaagaaaugcaacauguauaauaaauacauuuacuagcucucugcuaguaaauacauuuucuaguauuuacuagcuaguauuucuuuucuagcaauuuucuaguauuuacuaguauuuucuagcaauuuucuaguauguacuaguauuuguaauaaauacauuuucuagcaauuugcuucacaaucauucucuuuuucucuagaugaagacauuuucugggaaaacugguacuucugucaucacuacagcagaagauguuaagaagcaagaagagaagaaaaagaagaaucuaucuugacuauguuagguauagcuggaacaguacuuaaccucuuagugauuguuuuggucuacauccauaccacacucugaaggucucguucaagggacugcauucagggcaaaaccuggcucuaacaagaaagauuuagaaacuauccuuuaaaagcacaccuccagaauauuaagacauacaucccaggguaacucccuugcucuaagagcaauuacuauaugaugcuuccaguuugaggaauaaaauuauaacaaagcaaacagguaaauuuuaacuuuacacagaggaaaaaaacaggacaaagcaaugaauauggacacugaagauggacuacuccaaaacauacaagauuuaguaacguauacaagacacaacagcaaaaaugcuacaaccauuuuucuaagaguacauauaaaauacacauuaauuaaaauaaaacugcauuuagguuuguguuuuccuuaagccucuaguaaucuacugaauacaggaaagggaaauuuagucaguauaggaaagaagacuaugaaaauguuuagaaaaaugaaguuuuaguuagcauuaaugaacacugaauauuuuaaaaacugucuuuggaaauuauauuuuaguaacuccaaagaaaugagccuuagcgugacuuuugguaguuaagcaguuguaaagauaaggccacauagaaaaauaaagacuacauagaaaagaaacuuucuuguuucaauaaaauauugacauuauuucucugauaaauguggguaauacaaaauaaaacuaccauuguuaacauuuuaauauauucucuaaguaaacuggaguaacucuuucuuucuuuuuguuuuuugagauggagucuugcucugucacuuagguuggaaugcaguggcucguucuugacucacugcaaccucugccucccggcuucaagcaauucuugugccucaaccucccaaguagcugggacuacaggugcccguccaccacacccggcuaauuuuuguauuuuuaguuuugcuauguuggccaggccgggcucgaacuccugaccucaggugauccacccaccucggccucucaaagagcugggauuacaggcuugagccaccgagccuggccuguaggacuuuuuuaaagcauuucaugauuuaccauaaaaacaucuaguuugcaaaacaauuauauagcggaaauacaacuggcauaaacaaaucuggaaacaaacacagcucacucuuaacugggauguuucauagaagaaauggagaguuauggcuaaucugguagguaguuauguggaaaucugauuaagcuuuucuuaauagcuggacuacagugugaaaggugacaauauaaggauuagguacgugagcagcucauaggagagaaaggacuacgcuggguagucaagaaugguaucccugaagugucugagaugugaacuaauacuuuaacuuuacaaaucuguacaaaucaaagcaauucaaaacccaucuaaauuuuaauuuaagcaaccuguccuccccuuauaaaacuuaccagucauaauuauuuaacacagagucauauauucuauaccaaagucauuuccacauuggaugcccuugacaaaaaugaaaacucuaaauaaaaggaauuaacauuuguugauaagcacuuacguuauagauacucugagucgcuaucaacaugccuugcuagugaccauauauagaaauaaauacauuaaacauaggcaaguguuuuaauuuuuauugguacugcucagcuaacugucacaaaaacuagagccauauuaaaauacuauuaaaauauacuuugggcuaaaaauaaaguggcagguuacucuaccuuuuuuuuuuuuuuuuuuugagauagggucuacucugacacccaggcuggaguguagugguaugaucacggcucacugcagccucgcccuccugggaucccacuucccgaguaguugggacuacaggcgaguguugauuuuuuguucuuuuguagagacagggucuaaguugcccaggcuggugauccucacgcuucagccucccaaagugcugggauugcagaugugagccaccacaccuggccugcuacucuaauuaguagaauaaucugauagauuauuuuauuuuuauuuuuuuauuuuuuugagauggagucuugcucugucgcccaggcuggaguguuguggcucacugcaaccucggccucugggguuucaagcgauucuccugccucagccuccugaguagcugggauuacaggcaugcgccaccacacccggcuauuuuuguauuuuuaguagagacgggguuucaccguguuggucaggcugggcucgaugucccgaccucaugaucugcccgggucggccucccaaagugcugggauuauaggcuugagccacuucacccggccuauuuuaguuuuuaauagagaugaagucucacuguguugccaaggcugaucucaaacucgugggcauaagcaauccucucaucuuggccucccaaagggauuacaggcaugaaccaccaccacagcucccagacucuuuauuaaaacaguacaaagaaauggcauaauuugacaguuucauaugaacuauuaccaugaaaacuauaaauaaggauauacaguuaaguaucauguuacgacagcucgacaauuuuucauuauuuguuucucaggcaguguauaucaacaaaauaaaguauuuuuauaaauaauaaaaauuauguauuuucuauugguaucaaaccuuaucuuuuccuguaagagcacuaauacaauuucuauguccuuuuuaauuuggagagcccugagaccuagcaagauggcuagguuuccaacugcacauuuacuuugauguaacuacuaaguaauucaaauuuaauaaauauggucauauuuaaauuaagauauuugucgugacaacagaauuaaccuuauucucaaacaguauacuuaugaaauuaaauaccuacucuuaaagaaacauauccaaagguaacauaaaguaaaaaaaaaagagcuuuaaacauacaaaauacacugugagaaaaaucagaugguauaucaaaaugcaguaauggguuuugacacauuauaguuuguuauaaaacugucaaaccaauauuagggaaauuaaaaauuuuaauccuaguauauaacaucauuuaacuaagauaaccagccaauucaguagauacuuuauaauuuucccaaugaaguccugugccugcucucucaugucuaccuuacucuaacacaucacuuacucauuuuuauuuuucauaaugacaaaauccauuuauaucuugcuuuucaacuugaaaauaagugaguuuaauaaucaccacguuacuaaccaguuaaacuugagcaacugaauacauuucucuagauuucauuuguucuuuucuaaucugugaauugucagauuaacccagauaacagcaauuucccuugauaaucugaaagaauauucauccccauauaauaagaccacuauuaaaaagguaaagauuuauuucaauaagaauuuguagcauaccccacuaaguuaauggcaaauaauuuaaugugugcugagacuuaauaugcucucuucucaaaaaaggaacauacuauuuucuaaaauaggugagggucucuaaaguaacauucugccuguuaacauuaacaugugaauauuaccaaauacuucuuaaaaugaaacaggaucuccaucuaguggccagagggguaacuccauacuauacaagggcuagagaaaaaaugauuguggccuacaaaacgcaacuuucagaauaccauuucuuaugaaaaguggaagugaaaauguugagaaagaaauuaaaaugaacaaauaauauauuuuccuaucuagaacacuaacagaugucuuuauuuuaguaagcaauaagaaacaaauuauuaaagcaucaaacuuacuauuuugaguaacuggaaccauaauguuaaccuuugauaaaucugauuaauuuagccuaaauaugaagauuuauguuucugcuguaaugccaccaaacgcuuuuuuuuaaagucuccauucauuuacaggcuggguuguggcucaugccugucuguaaucccaccacuuugggaggccgaggugagcggaucacuugaggucaggaguucgagaccggccuggccaacguggugaaacccugucuuuacucaaaauacaaaaaaaauuagcaggguggguggcgggugccugcagucccagcuacucggguggcugaggcaugagaacugcuugaacccgagaggcggagguugcugugagccaagaucauaucacugcacuccagccugggcgacagaaugagacucugucucaaaaauaaaauaaaaaaauaagucuccauucauuuacguaucuaaauuuuccucuccacccauuuuaagaucuacaaaaagaggucaaaagaguaggaaaacuacuguuagucacaaaaaucuuuugcuagaaacaguaaauucaaaaagaugaaauaucaggaauuuaucuuuuuuuuuuuuuuuuuuuuuuuuuuuuuuuuuuuuugagacagaguuucacucuugucacccaggcuggagugcaguggugccaucucggcucaccgcaaccucccccuccuggguucaagcgauucuccugccucagccucccaaguagcugggauuacaggcaugugccaccacaucuggcuaauuuuguuuuuuguuuguuuuuuuuuuuuaguagagauaaaaugauguaacuuauagucaguagguuaaacgguagcaugccuccuaaaugauauuaaauauggauuguuuucaggaaaacacagcuuaauauaagcauauaaguacauauauaauuaaguaaacauaaauauaaauauauaaauauauaauuaguuaucaguuuugguuagaauaguaauaauuuuuuaaguggcuacuauuuauuuauuugagacaggguuucccucugucacccaugcuggaaugcaguggcacgaucuuggcuuacugcaaccuccaccucucaugcaaguaaaaaguucuuacgcaauuauuuaaugacuaaauacaauauacuuaaugauuaaaucacuaaacauaaucagugccuaccucuggagaauaggaucggugucucaguuacagaauugugacaaguuaguaauggaaaaaagguuguccuuuccucuaaggagcuuauaugcucccucuauucugguaauaauuuuacaacuaacaauauucucuuuuuaccuuugaugcaaagauguucagaacuaaaacugaagaucaauuuuaugugcaauuauuguugauccuuauggucagcuuaguauuaucauuuaauauguucaggccaguuuuuaaacuucuauugaaauaaaacagacuuagcuaaccagcuacauaguaaacucauuaauaugagaacuugaagguuuuauuaaaaugaggagcagacucugguauucaucucaaucuuuaacagucauuaaacauuaaaguuuaaagauuacaaaguaucuaacguauaccuguagccaaaaaauaagggcaaaaagggugugggacaguaauaagaaaccacaauugacauuuaaaauuaauggcagaccaaucucugcacugaaaggaaggcauaaacuaguguguuccuauauuuucuugucuugcucaccaaucauuuaaaaacauguuauagaaagaaaaugugcauuauuuuacuaaaguucucagaaaaggcuauuauguuaggccugcguuuuuuuauaucaucugcuagcaauauaagcaaaucaucccuugaauacaaugucucaggcaaaauuaugaggacuacucucacacuuacaaaccaaucuguagaauauucuauaaaauaaaugguuacauucuguaaaaauaucaguauuaugaaagauaaagauaggcuaggaacucuuccagauuacagaagaaaaggacaugacaacuaaauguaguaaaaaaugguggaguggauccuaucacauuaccucaacucccacauugccaaaaauaauacuauauacgcaaaugaaaaaauuggaaaauaaacuuuagacuaauuuuccaaaauagaaauuuuacuaagucuaaggaagacucuggcuagauaauuuguucagguuuuuaaaugccacuuaaggcaggguguguuggcucaggucucuaauuccagcacuuuuggaggccaaggugggcagaucacauggggccaggauuugagaccagccuggcuaacauggugaaaccccaucucuaccaaaaauacaaaaauuagccgggcaugcugcuguaugucuguaaucccaccuacucaggaggcugaggcaggagaauugcuugaaccugagagguggagguugcaguaagccaagaucgugccacugcauuccagcaugggugacagagggaaacccugucucaaauaaauaaauaguagccacuuaaaaaauuauuacuauucuaaccaaaacugauaacuaauuauauauuuauauauuuauauuuauguuuacuuaauuauauauguacuuauauacuuauauuaagcuguguuuuccugaaaacaauccauauuuaauaucauuuaggaggcaugcuaccguuuaaccuacugacuauaaguuacaucauuuuaucuuaauauaagguauuaucucaaaauaaguauuuguuaccacauccaaauauaucaauuagaauuaaccacuggacaaguuaccaaauucaagaacaucuaaagccugaugaaagaaauuucuuuuuuccaggaaaauaauacaucauaaaagaaaggucaaacuucgaucugucacauuaaauuucuaaaacaguuccaagguauaauaucuaagucucugcaauuccauacauuuaccaaaaaucaguuuaacauacacaccuucccaggaagugcacuuacaugaacaacaauuacuguaaauauuauguaaauaauccuggauuuccuuuuugacaaugaaccauaaagauaaaagcucaguguuauaagagagucaauuucagaccaaaacagaaauuuaaaauuuuugguaggucauaucuucacaguauaaggauuaagaaaauaauaguuuaauaauagagaagugagauaaaaagaaaccuaucgcacccuauucaauuguucuauauaaucuaaaauuaaaauguauagucucaaacauuuuaauaaaaaaaaauuaugcauuugacaucuacuuuuuaaaaaagaccagucugauguaucaaacaggucaaucuaaacaaacaaaaaaaucaaucuaauacuuccaugaaggagucugagacagacugggaaauagcguauuuuuaaaggacaacaaucuuccugauacuggggaauacgggcaauaaucccuugaaauacuaauauuuuuaccagacauccaacugugucacuuagcugcuaccaaccacaaaauagacuaccaagauucauuuccauuguuucccuuaucuauucuuccuuaauaaauuaaugaaauauacauguaaauuuucauaagaagauaaagacagagauaagaauaugaguuaaacagaguugaaacaauaaauaauaaagguuuuggcugaaagaaauagauguuaacugcuuguuucucuuggaaauaucuauacauuucugaacauguaacuuucuauucuuaggaaaagaacacauuucuuagauaauuccauaaccaaggaaauaauaaacuauauuauucaaucaauaaucaguuguauacuggcaaaacaaguagcuacaguacuuuuauuauugaauuuuaagaaauuaaucaucaucuuaucaaguaccuauggacuugauucauguaucugccuuucuucaaaaauaacuguugucugcgauaguguuugacaaaaauauuuaaaauccauagaaauuugaccauauucagaucagaaugaugucaugaaguuguuagccuuuguccuaucauuuucaguuacagaugauuaaaaggaaaaaaaguuuacuuucaccuuucacagauaaagacaaaggaauaaugaaacuuuuauuauucuguguucuaugguaagugaugacaaaguaucaaauuaagggcaccaaaaaccaacuaaauauuuccagaauacuuuuuaggaaauaaauccaucaacuauuucaacugaaacuuacuauuagacaaugauaaaauaagcaaacaaaauuauucauccacagacacauuuacagggauuauuuaccugaaucauuucguagauaagaugacauggcugggaugaggcaggacugacugagaagcucgagaaguacagaaggaagggcauuacuguucugcccucuagucucaugagaugacugagcuucuccauuuaccgcacuacugacgggauuuauguaacuggcaagaaccuaaaaauuguugaaauuaauuuggauuucaguuucacauacuucaaaaguuuuuauuguagguuagaaauucaaucugaauacuaagaguacauauuuucuacuuaaucaguaucuuauacuauguuuuaaaauaauuauuuguuuaaauuuucaaaagagaaggaucuguuuugucugagaguguugcuuacaaaggaugguacacuacauaugacuagacauauaaaagcaauacaacuacgaacauaaaaaauguaguagcaacucuguauuauuuacauauuuuauugaauagacucaauucacaguuugaagguaacaaaaucuuagaacuuuauacuagaaggagcauucuagaguugcagaagacacauucaaagcacugacgaacuucaauuagcugaugcaggaagcaaagcuaaccuuuucauuauuuccccuauacauuucugugguauaaagacuuucuauucuuguccaacuugccugaaucuagaaaaguuauuuauuuaucuauucauuuuuuugagaccgaguuucacucuuaucgcccaggcuggagugcaauggugcaaucuuggcucgcugcgaccucugccucccggguuuaagugauucuccugccucagccuccugaguagcugggauuacaggcaugugccaccaagcccagcuaaucuuucuauuuauuaguagaggcagguuucaccauguuugccaggcuggucucaaacuccugaccucaggugauccacccaccucagccucucaaagugcugggauaacaggcaugagccaccacgcccggcugaaaaguuauuuuaaaaaauguaagcaaccgugaaccugggaggugaagguugcagugagcugagaucacgccacugcacuccagccugggccacagagugagcuccgucucaaaaaaaaaaaaaaaaaaaaaaguaagcaaccaaaaugcauauaaauaaauaacacuuaaaaaaaaaaaaaaggccagauacaacacauuaaacaagaaaaugccuguaggaagaugcaucuuccagcuacuggauaauuucaucccugccacuuuccucucagugaagaagcuaguugagagggaagaaauacagagucacaaguaagcaagaacaaucuuuauccagugguaucuuagaaugcacugggaagaaggaccacaagugggcauaaacauagcugaggaaaguuggauuaguuaucaauauuuuaaaauaauaaauacaaaaaaaaagccauuaucaugaacaauaucaaguuuacaaauauaccugcagaaggcagguaacauguuccucuuccagccuuugcuuaguuaaggcuuguuccacaucccacccagaagcuguagagccuguuccaaagccagucccuuuggcccaauauaacuguuguucuucuguugauguaggguuaugagagcuugacaccuguggcuuaaaauaacaaaaaaugaaaauccauuacaauuuguuuuugcuuaucuucaaaaauauuuaucacugggaaaguaaaaugaugaagcuacuauggaaaacaguuugguggcugcucaaaaaaauugaacacagauuuucuguaugacccagcaauucuacuucuaguauuaaaacagauaaaaacuggugcugaaauagacacacacguuuacagcagcaccauuuaaaacaaaagaugaaaauagccuagaugccaaccgaugaauggaucaacaaacaggauauuuauugagccauaagaagaaaugaaguacugauauacgcuacacgaauaaaccuagaaaacauuauacuaaaugaaagaagacagacgcaaggaacaacacauuacaugauucaauuuauaugcaauauccaaaauagguaaaugcauggagacagaaugcagacugguaauugccaggggcugggggaagggguaaauggagagaaacugcuuauauuuaagaaugaaugaaucaauaaacacauaaauaaauacaaauuuucaaauauuuaucaagaaaagaagggauaaaccaccuuagagccuaaaaagucaaugacucaaaauugaauugagaaaacagugaaaagaauacagauaugagcagaucuuuuuaggauaaauauagcaaaaggauaucucagcuauuccugacccuuugcauguuuauauacauuuuauaauuggcuuguaaacuuccuccaaaaugaaucuggaauuguaucaaacuuaaggauugaucugggaagaaauaauauuauugcacuaucauaucuaacccacugaagauauacaugagcacagacagauucaccugccucagccucccaaguagcuaggaauauaggugugagccaccaggcccggcuaauuuuuguaauuuuaauagagauagaguuucacuaugcuggccaggguggugucgaaauucugaccuuaagugaucugccugccucuaugucccaaagugcugggauuacaaacaugagcuaccaugcccagucaaaaauuucauaaagagguauuauacauauuuuucagauuuacucuuagauauuuucuauuuuugguacuauucuaaaauauaucuuuauaaagcucauuuuaugucuguugcuaguauguagaaauuaacuaauuuuuauagacugaccccaugauguauuauuaauaaacucacuuaugccauuaauuauuuugguauuuuuuuuuuucuuuuugagacacaguuucacucuugucgcccagucuggagugcaauggcacaaucuuggcucacugcaacuuccgccuccuggguucaagugauucucuugccucagccucccgaguagcugggauuacaggcacacgccaccauguccggcaaauuuuugcauuuuuaguagagacaggguuucagcauguuagccaggcuagucucgaacuccugaccucaggcuauccacccaccucaaccucccaaagugcugggauuacaggcaugagccaccucaccuagccuauucugguauguucuacaauacaauuaaaucauauugaaauaaugaggaauuuuuuucuuucuuucuugaauuuccugucuuauugcacuggcuagauccccacccacaacccccauucuauaguauuauucuuaaaaguucaaaaaggaaaggaagaaggaucacaguauaaauucaguguaucuugguaaaugggaaagcuuauuaagcgcuuaaaucuuuucugcuuuucaaguagauagguuucuuuuugguuuacugaagaagacuaauagagaaaacaauuaauuuacaauuucuguuuuaaauauccuuuuagaugugaaaauggaacacccaagucucugaaagauuaauucagaaaaaaacuuuauucuguacucccuaauuaaaucuaguuuuuuuaauaacugaaauaauuaaaagugaaccuaccucaguuugauucacgcuagaguuuggaacucguggggaaugguggcucaaagcagagagacagacaagaaugagguguaaggcuccaauuuccaaugccauccgccuuagaaguacaccaucaucaguugucaaagguguagugcuaaacaagcuacgaaggacguggaaaggaaggguuggaagcacauuggcugauggagauugaagaauaugaccuagauugaagaaagaagaggacucaagauuaaaaacaguuaaaaacacauaagaaguuacauacagggucauaaauuaauaaugacacuguaauacaaaaguauaccacuaaauuauuuagaaaaccaaauaccacaaauacaacaguaauaucuuaaaauuuaauaacgaauaaguaucaggaaaaacucugucagacacgguauacauaaaccucaaaaaaauggaaacauauguaugaucauagcuauagauuaugucaaaauuauuacgaacuagaauuuaaacuaaaaccugaacaauagaaaagaagcauuaguaguaucuuacaacaguaagaaaguaacugcuuuucuugggaguagcuuuaaccaagaacagauaaugaacaaguaaaacuauuuuuuucccaacaguguucuacuguguucuagccaggaagggguauuaaaugcaaagaaagcaaugcuacauggaugguacacgagacaauuauuagagagagagauaucauaacuauccuuuuuaauaaaaauucauuguauaugcacuaaaaauagugugaaauuacagaaagccauuuuuuuuuccuuuucuguuuaggguuacaccuacuuuaacacucugugguaacaguguugaaauaccaugguucuuauuacacauucuaugucuuuaucaaaauaucguauguauaacauaaauauguacaacuacuauguaucaauaaaaaauaugguucuuaccccucuaucuacuuaaaaaaaaaucagaucaaguaauuagaaauuccugaccuacuaaaauaaauacaguugacaccugaauaacacagguuuaaacuacaugggcccacuuauaugccaacauuuaugagggauuuuuguuguuaggaaaauauaaaggaaaaaauauuuacuuugaauauuugauagcuucagaguuuugagaucuacacauaaauucauauaguuuuauuagauuaaauauacuuuguaguacagaacuuaacauuuuauucuuucuaaauggcaugugaaagaaaucgacccuaaucaaaaccaugugauuuuaaaauaacauaaggaauauuaauuuucuaauaaauauuaauagaauaaauaguaagugaaaaugcaaaaaaaaaaaagaagaagaaagaaaaaagaaaaugcagacgucacccaaaugaaaaucuacuugugaggcuauccuguaauucuucaguuuuucuauuaaauaacaaugccaacccaauggaaacaaucaucacagcuuucucuuauuauucuauguuaucauuaauacauauuauggcaucauuuuccuaauucuguucucuuuaaucuaaguauugcuaccagauucauuuucugaaaaaaacuauauucaacacaucacuaaucuuaacacauuuuaauaaaccuuuauugcuauucaaaauaaaaucuaaaguuuuuaguacguuuuuuccaugaucuguuaccaauauuagcuuuuaaaaugcucacaaugcucccuuuugugcaaauuuucaucugcuaacuuauccccucucauacauuuuaaccucaaaacacugcucuuuccauuuauuuucugagauaacucaucccaaccuaaaucuaaucuguccuucaaggccccacuaaaaacuaccaugccacuucauucacauugcugaguaguaaagaaauaaucucacauguguguuucuccauaauacugcacucaagaguacugaagggauuuuauaacuugcuaaguauacauguuuauguacaucccuuguuucuauuacuggagaacauuagcuacuuggggguagcucuaaauaacugcuucauguuuacauccccccagugaugcccaacaguuuugucagcacaaggaaaauaauuuuugaaugaacacagagaugaaaaugaagauucuuuaggauuuauuauguauaacuaauacuggaagugagcuaccacuuacaaaucaucuaacagcuuaacuaugaaggaaauaaaugaugaauaauaggcaaugaucuggauaccuuuacacaaccuauucacauauguguugauaaauuuaauacuaaacacuuacuuccuucuccaucaucugucacucccaauaccaaucgaagaaggcacugggcauguuuucucucuuucaguagcacuuccgcauagcccggaagacgaagaaauaauccaaaagcagccaaagaaugggcagguaugggagacauggucuguacugcugacuugauagguggagguucagccgcaacaguuucuggugcuucauaaacuaacuccccugacuguucaauggucacccauucaaacugaucgcuauccuucggcuuuuccugagugguagauguuacaacuggagcacucaccuaaagaaaaagaaaaguguuggcuuggccauucacauuuucaacaucagauucaaaguaaagacuuaacuuuaaaugaucucuuuaaaauauaggauuauaaggauuaauaaagcugcuugcuuuaaaaaacaagcuuccagccgggcgcaguggcucacgccuguuaucccagcacuuugggaggcugaggcagguggauuacuugaggucaggaacucgagaccagccuggccaacacggugaaacaccgucucuacuaaaaauacagaaauuagccaggugugguggugcacaccuguagucccagcuacucaggaggcugaggcaggagaaacacuugaacccaggagguggaaggcacagugagccaagaucacaccaccgcacuccagccugggcaacaaaacuaucucaaaaaaauaaauaaaaauaaaaacaagcuuccaaacaucaagacgcacaugacagcagaaguauggcagugucugccaagugucucuacauuaguuauuaauuccaccuuuauaauuaguuaaguaucuauaugcagauucuugagacuauuuaaacaucuuauuucucaccaaacuuuugaucagucuuagcauuuuuauaauugugccugaaacaauuauuacuaaagugguuaagaaaaggagaacuuucuaauucugucauucuuucuacauuuauuaguuggcaccaagcuauaaggaaaaauauucucuucuuauccauuaauuuuuaucaguauagauucuaacuuuauuacacuguuacuaucauuauuaauuuugaugccugaggggaauaagauuuugucucugagacgccauuaaagcaggauccuacuuccuuauaacuugucccccaucguucuuugagcacuuccuugcuuucuagcacagcaaaacauucuaggcucauguucuaccuacucuuccucaguacuagaauuucuccaaggagcccugauuuccuuuaguagaaaauuuuuaaaaugacaauaugggagauauauaugcauauaucacuagggggagucugcuucuggguccuaucagcaaacauaccuagaaaauacauguauguauacauguguaaauauauauauauauauagacauaauuucuagcauguauucuucaaaacugucaaggccaugaaggccaugaaagauaaauaaagauagcagaauuguuacauaugcaagacuacaagacaacaaaaugcaauauaugauccugaacuaccaguauccucaaaccacgcaaaagaaaauugauuuuucuuuggcccuaaagaacauuagaaggacaggcaaaagcugaauaagauuugcaguuuauaguacagagucagugugaacuucugauuuguauaacuguauaugguuauccaagagaaguuuucugaacuuaggaauaaaggagcaucaugucuauaauuuaaucuuaauaauucaaagaaaaacuccaauucugagcaugguugcccuacaaacuucucauugcauuuagaaauacucuacuuaucuugcuugaccaugaauaaugcacuucacuaaauacuaauuugaaguuccacacucaaacauauaauuaaaugaauagugagcuaaucacagaguuaucucacuauucacuucaaacaucaggaugauuccuaagcuuccuguaugacuuuaguagacugauagguaacucuguggggugauuuuuaaaugaauggugagguaacucugugauuaguucacuauuucuuccuucuuuuacauauauauguagaagucuuaagcugaucuacagcuuagaucagucuuaaguugaucuacggcuacacuacaugcaucuguacacugaauaaaacaggugcaauuuugaugccagcuuauuuucacuacugaagcuuaggccagaaugacaauaugaaauagccuaauuguaagaacauaggaauuugaggcacuuuucacuucuaaaccauuuugaaacccuuuauaggcaaauuuuuaaagauccucuauauuuauuauuuuaugcugcacagaagauaguuucauauaaaaguaccuauauaauagaacauuguuacagaagcagaacuuuaccucaucauaauuguuuucuuaaaggacuauucucauaugaugccacaaaacaaaacaaauacaaugaaagcaaaaagacagcaaaaucaaagagcucucaauuuauagcauucaaauucuuuaacaagugaaagacccucaacuucacgaaaaucagaagagcaaauuaaaaccacuaucauauauuucccaucacccauuauacagauacaaauuuuuaagucuuauauuagauauguauacaauucuucacaacuuuuuucauuauagcuaacaacuggaaauaaaaaugcuagucaacauuaagacuaauacacacaauaagguauaguuaaauauacagcaaguaugcuagagcuauacaaaugagaccaccacaggcuuaggcaucaacaaagauuaauuucaaaauacagguucagcaaaagcaccaaacaguagaauauaaacugauauuuacauaaaugucacaaguauaacgauucaaacagaacuguuuuaggguauuaauauuaaguggauuuaauuuuuuaaaguauuauauucacuuguauuauuucacauuuugaaagucaaaacugaaaaguauaugaaaacaugcuuuuugcucaauuaacaacaaagaaauuuuauuucugauauacuaggauaaaacagcucaauuucccaaagaaaagacucuaauaaggacgugcucacuuugaauaaugucuaaaacacaaauaaauuauuuuaaauuagaugaacaggauaugauuuauaucacaggcuuuuaggaauuacgauauuccaaccaugugaugucuuuaauucugauacucauuauaugucacagcaaacugagaagacaugauacuuucuaaaguagucaaaugcuccaauuuaagaacaaaaaaugaguuucaguuuaaauuggagaaacaugggauuaaugugauuucaaaaucauaaccaugguacuuaaaaaugaaaacagacuaaaaauucuguauguuugauuacaauucugcauaaguguauacauacaaacguauacaugcacuucuucuacugauucugguuguguuuuucaaggaauuuauccauuauaucuaaguaucaaauauguuggcauaaaguugguuauaauaguaccuuauuuuauucuauagaaauuauaauaaugugcuugcuaucauuuguggauguccaauuugugugguuuucccuuuuucuugaaaauuuuucauaguuuaucaauuuuacuagaagucucaaaagacaaaauguacgacuuucuuguuucucuuugauuuuuuuguuuuauauuuaauugauucuggcucuuacuguaguaauuccuugcuucugauuuuugguuaauuguacuccuguuuuucuaguuucuugagguggcaguguacaccacugauaaaucuccucuuuuaauuauaugcauuuaaagcuauaaaaucucucuauagacugcuguagcuauaucccaugucauguuggcauuaucguuuugaaauaucuuguaguaucuauugugauuucuucuuucauccauguguuacuaaaaacuauacugcuuagguuacacauauuugagguuuucuagaucuuaccgcuauugguuuccaauuuaauucugauguggucacagaacauacuggguuugauuuuaauguuuuuaaauuuacugagacuuuuuguauaggccagcauacugucuaucuuucuuuggaaagaaguacauccuguaguugguaaaugcuuuguuccauaaauauugguuacguccaucuagaaguuuugggcguuucccccaacaacuccuacuuccucacuuuguuucauuuacugagagauaaauguuauaaucuauuacugaaauguagauuuaucuaauucuuccuucaguucuauaaauuucugauucauguacuuugaagcuauuaaauacacacaaauuuaggauuguuaugacuuauucugaauuaauacuuucauagugauuuaaugauccucuuuauuucuuaucagguggucuauaauucaacuuugugauacauuaaaaaauagggguagcagcuuuuuucuuucaagcacaucucuuuuaggcagcauauacuugggcuuugcuuuuuccucuauucugacaaacguuugcuuuucaaaugggguauuuaauacacuuucauucauucauucauucauucauucauuuguucaaucauagagauggagucucacucugucacccaggcugcagugcaggggcacgaucucagguucaagggauucuccugccucagccucucaaguagcugggauuucagaggugugcuaccacugcuggcuaauuaucauauuuuuuaguagaggcaggguuucaccauguuggccaggcuggucuugaacuccugagcucaggugaucugccugccucggccucccaaagugcugggauuacuggcaugagccaccaugcccagccauacacuguacauuguugaugagaucuucuaucaacucuugauuugaaaaucuuccuugcaguguguuuaguuuuguuuagcagauacguaaauuauugggagaucacccugaacuuagaggcuuuuguaauuuauuagaagagucuauuuugauuuuucccuuauuucucaagugaaucuuuauuaggcuguagccuuuauuccuaauguaugggccauuuggaauuccaauggaaaagccaacauuuuuaucucugagcaggacuaaaacuguaaauuguauccucucggugacagacagcagcugaaaucucugcacagcuuuuucagcauucuaguucaugccugcucucaaaaugccuauguuuaauaauucuggagcaagcuauggaugugcagaauuuggagcuccucagcuucagcuuccuccuuucugaauuccuauuuuccagccaguagggaagaaucaaacuccagccaauaugacuguggcuuaagucugaguucuaccugucccaccccacaaagacugaggaauacccccagaaaaaagcaguauagacgcuaauauuacugaauugauucuauuaauauuguguuaaaauccucuuuaauuucugccugcuucuaguugcucuuaaagccuuuaaauaauuguuuuuuuuguuugcuuuuuuuuuuuugagacggagucucgcugucgcccaggcuggagugcaguggugcgaucuuggcucacugcaggcuccgcccucugggguucaggccauucuccugccucagccuccagaguagcugggacuacaggcaccugccaccccgcccggcuaauuuuuuguauuuuuaguagagacgggauuucaccacguuagccaggauggucucgaucuccugaccucgugauccgcccgccucggccucccaaagugcugggauugcaggcuugagccacugcgcccggccuaaauaauuguuuuaaaauauauuuugccuagagcuuuuaacuauauagagacaacagaguuaaucccauacuuuuuauucugccaucacugauuuuugagaggcgaugggcgaggugggugaagaauuguagaaaauuuucuccaaugaguauaaaauucuaggaugacagauuuuuuugcuuauuuuguugcuuguugucuucuagcauuuugaaauuguagugaguuucuuaauccugaguucuaguuugauugcacuguggucugagagacaguuuguuauuauuucucuucuuuuacauuugcugaggagugcuuuacuuccaacuauguggucaauuuuggaauagguguggugugguguugaaaagaauguauauucuguugaugucuauuagguccacuuggugcagagcugaguucaauuccuggauauccuuguuaacuuucugucucguugaucugucuaauguugacaaugggguguuacagauuguauaucuagaaaaccccaucgucucagcccaaaaucuccuuaagcugauaggcaacuucagcagucucaggauacaaaaucaauguguaaaaaucacacgcauucuuauacaccaguaacagacaaacagagagccaaaucaugagugaacucccauucacaauugcuucaaagagaauaaaauaccuaggaguccaacuuacaagggaugugaaggaccccuucaaggagaacuacaaaucacugcucgaugaaauaaaagaggauacaaacaaauggaagaacauuccaugcucauggguaggaagaaugaauaucaugaaaauggcuauacuacccaagguaauuuauagauucaaugucauccccaucaagcucauauggaaccaaaaaagagcccgcauugccaagucaauccuaagucaaaagaacaaagcuggagacaucacgcuaccugacuucaaacuauacuacaaggcuacaguaaccaaaacagcaugguacugguaccaaaacagacauacagaccaauggaacagaacagagcccucagaaauaaugccacauaucuacaaccaucugaucuuugacaaaccugagaaaaacaagaaauggggaaaggauucccuauuuaauaaauggugcugggaaacuggcuagccauauguagaaagcugaaacuggaugccuucuuuacaccuuauacaaaaauuaauucaagaugcaucaaagacuuaaauguuagaccuaaaaccauaaaaacccuagaagaaaaccuaggcaauaccauucaggacauaggcaugggcaaggacgucaugucuaaaacaccaaaagcaauggcaacaaaagccaaaauugacaaaugggaucuaauuaagcuaaagagcuucugcacagcaaaacaaacuaccaucagagugaacaggcaacauacagaauaggacaaaauuuuugcaaucuacucaucugacaaagggcuaauauccagacucuacaaugaacucaaacaaauuuacaagaaaaaaacaaacaaccccaucaaaaagugggcgaaggauaugaacaaaugcuucucaaaagaagacauuuaugcagccaaaagacacaugaaaaaaugcucaucaucacuggccaucagagaaaugcaaaucaaaaccacaaugagauaccaucucacaccacuuagaaugccgaacauuaaaaagucaggaaacaacaggugcuggagaggauguggagaaauaggaacacuuuuacaccguuggugggacuguaaacuaguucaaccauuguggaagucaguguagcaauuccucagggaucuagaacuagaaauaccauucgacccagccaucccauuacuggguauauacccaaaggauuauaaaucaugcugcuauaaagacacaugcacacguauguuuauugcagcacuauucacaauagcaaagacuuggaaccaagccaaauguccaacagugauagacuggauuaagaaaaugugggacauauacaccauggaauacuaugcagccauaaaaaaugaugaguucauguccuuuguagggacauggaugaagcuggaaaccaucuuucucagcaaacuaucgcaaggacgaaaaaaccaaacacugcauguucucacucauaggugggaauugaacaaugagaacacauggacacagggaaggggaacaucacacaccggggccuguuguggggugggaggaggggagacggauagcauuaggagacauaccuaauguuaaaugaugaguuaaugggugcagcauaccaacauugcacauguauacauguguaacaaaccugcacguugugcacauguacccuaaaaguauaauuuaaaaaauaaaauaaaauaaaguuguaauucccuggcucauaugguuucuguugaaaggccaguuguuaguguuauugcugcuguuuugaaaauauaggucauuuucuuuauagcugguuuuuauauucucucauugucuuagcuuuuuuuuuuuuuuuuuuuuuuuuuugcuuuuuuggggguaugaggucuuguuauguugcccagguggucuggaacccgugggcucaaguaauccucccgcuucagucuccugaguagcugggauuucagagaugcacugcaguggccagcugucuuuguuuuuaaccacuuuuaccaugacaguuccaggcaugcauauccugcaugaguuaacaguuucuuacauguugaauugagauuuaaguuuuacaucuauuugggaaauuuuucuucuucucaauacuguuucuguccauguuucaacucacucuucuucucggacuauaaauucauguaaguuagaauuuuucacuucaguccauacagcucuuauguucuucucauuccuuacacuuucuaugcuuccauuugaaccauuuuuuuuuuuuuuuuuuuuuuuuuuuuugagacagagucuugcucugucacccaggcuggagugcaguggugcgaucuugguuaacugcagccucugccuccuggguucaagcaauucuccuuccucagccucccgaguagcugggauuacaagcguccaccaccacgcccagcuaauuuuuguacuuuuaguagagaugggguuucaccauguuggccaggcugaucucaaacuccugaccucaggugauccgccugccucggccucccaaagugcugggauuacaggcauuagcugccgcgccaagccgaaugauuucuuuugauacaucuuccaguucacuacuguugcaaucugcagugucucuuuuuuuuuuuuuuuuugagauggaauuucacucuugucacccaagcuugagugcaaugaagccaucucggcucacugcaaccuccaccucccggguucaagcaauucucuugccucagccuccugaacggcugggauaacaggcacccacuaccacaccgggcuaauuuuuguauuuuuaguagagacgggguuucaccauguuggccaggcugaucucgaacugcugaccucaggugacccuccugccuuggccucccaaagugcugggauuacaagugugauuacaggauuacaggcuaggauuacaccaugcccagacagugucucuuauuaaacacaccuaacaguauccuuaauuugauauauuagaaauucucaacccaucccauauagcuaguaguauccugacaccaaaaccagacaaaggcauuacaacuacagaccaaacucuguauuaguuuucuacugcugcuauaacacauugccacaaacucaguggcucagaacagcacaauuuauuauuuuaaaauuccagaggucagaaauccaaaacaggucuuaugggacuaaaaucaaaggaugcauugcuucuggaggcucuuaggaaauaacaguuccucaccuuuuccagcuuccagaggcaacuuacguuccauggcucuuggaugcuuccaucaucacaucauauccucuauuccucgcuuaugcuuagacggcugaggagauccaugaguuacaugccuaaucucuucaaagagcccucuaugugacugaauacucugacuuuugauguuucuaaggcacuagcaaaagguuguccagccucacucuuggcuuauacuuuggagcaugcuuuucugauagcaaauaucuaaauuuuagcaccuucugugaucuggauagguaauuucacaaauugacaagcacugauugcuuguuuuucaacaguucuucucucaauuuauaucuuuccucgcacauuucacuauaagcagcaagaaaaagacagguuguacuuucaccacuuuguguggaaaucucagcuaaacauccaaguucauuacauguucauuacauguaaguucauuacauccaaguucauuacagcagaagugcugcuuucuauauuuaggacacaaaugaguuaauaguucugcuucuauaugacaaagaucccuuuuccuucagguuccgguaacauguuccucauuuccuucuaaaccaccuugucagcacuuuaaacaccuguaugucuaccaagucugcuuaugacaauucagauauucucuaagacacuguagguuuucuccccuaugauccuuacuuccuucugggcccucacuggcagaagcuuuaucauccacauuuuaucuaacaaucuauucaagguaaucuagauuuuuuuuuuaaaucaugcuacucaaaauuauuccauacucugccaaguacccaauucuaaagucacuuucacauucuuagguauguauuaccaggaccccauuuccaguuacuaaucaauauagugaaccacacugaauacuaaauuagaaaaaaucauuuauguugagcaauaauaaugcugaaaauguuggggucuuuucugcuucaaacuuuugaguaauuaugucauugucuaguaagaaaauuuugcucauucugugucaaucaccuuauaacauaguuauaucaucuuauauuuuugaauacuagggaagcaauaacaugaauaaguauuauuguguguugcauuuuguccucccaagauauguucaaguccuaaccccuagcaccuaugaagaugaccuuauuuggaaauggggccuuugcagauguaaucaaguuaagaugaggagauaaugguuugcaggacccuacauuaaaugacugguguccuuauaaggagaaagagauacaaggacacacaggaaagauggccauaugacgacguaggcagaaauuaaagugauucagcuacaaaccaaugaacagcaagaacuacuggcaaccaauagaagccaggaagaagcaaggaaggagucuucccuacagccugaauucagagggagcauggcccugcugauaucuugauuucagacuuacagccuccucaacuauugagaauaaauuucaguuguuuuaagccagcccguuugugguauuuugguacagcagcucaggaaacuauaauagagucuagagcuacuauaccaaaauaaccacacacacacacacacacacacacacacacacacacgacaugaaaucaaagagaauaauuccccuacuucauucaacaaacacaaaguuuuguuuuuacaacucuccaugcaccauacuuccuacugauugauacaagagcauggaaagcacagacauugacagcuucguaaaugaacacgggaauaggucauguuuuuaaaccaccaaaaauggaaauggcaccugaaacaggaauaaaagguaaacaaaaagacauauauugguggcaguauacacugcuauuuuacuucuccuauuuccaauaauaucucuaauaaauaucacacuuaaagcagcauagaaaagagaaugcuaguguuacaaccaugaaaucaagauaaaugcaacaguguaguaagucuggcaagugugcuugaucuucaacauuucuuccauaccuacugaaggucaugaagcucuguacagacugaccauugaaagaguuauauaauguucaaaaaauauaaagcaaaggguauuucuacaaaguuaauccaaguacauuaaaaaacaaacauuaaaaagaaugaagggcuuagcuauggaaugauauacucgauuaggaaaucuuaucuuaccuguugaauuacuucuggauauagcauggguagucuuucagcaauaagagccaguccacccauuccugcaaaaacuuguaauggugacugaauuggacagguuucaagcaaagauucauccaguaucccauccaugcauucaucaccuggagugagagccucaucuucuggacagcuagcaaguaagucuccaugaucuagacaauaaauuacaaauaacugaauagguaagaaaggguauauuuuuauaauauucuuucauuuacaaaagcagguauuacugcuuucuugcuacucaaaaaagagcacaaaacaucauuuauuuagauauagcuguauuauggcuagacgguacaaugaccuuuaaaugacuucugauacugccuucuuuagucuuguuauuggaagaaugguucauggacuaguaguauuggcaucaccugcaagcuaguuugaaaugaagaaucuccauuuuaacaguaugaugcuggucauuuguaagcauacugaaguuugagaagcacuguccuuuagggcauacuuuaacguauauccuauguuaaaauaaauaaguucucaaaguucucauagcaaauaauaugcucuaaaguauccuauuaagaaaaauuaaugacaaagacuucccuuacuuaaaacaaaaaauuauaccauauuaguuuaacucugaauuacucaccaaagaaaaccaaaaggucacguaaccagacccuuuaaacauuaaaacaaaagagagaaauaaucgugcugaaaaacugggcaaagacaauguaccaaaauuugcugaagaauacaaaagaccaauaacuaaagacugaauuuuagucaugagaaagauggaaaguuuaaguaaguucauaucauacucacacuaugaaaacuacuuauauagcauuuauaggaguaaaaauuggaaacaaccacaauguuucgaugauuggggaacaaauaaauuuucuuacauuuuuaugaaaaaauagccaauucaaaaauggauauucaaaaauauuuaauggaauauaagggccgggugcgguggcucaugccuauaucccagcacuuugugaggccgaagcgggcagauaaguugaggucaggaguuacagaguagcuuggccaacauggugaaaccuucucucuacaaaaaauacaaaaauuagccaggcaugguggugggugccaguaaucccagcuucucgggaggcugaggcaggaaaaucacuugaacucgggaggcggagguugcagugaacuaagaucgugccucugcacuccgaccugggagacagaaaaagacucugucucaaaaaaaauuaauggaauauauaaguaaaaaacaaaaauaugugaucccaauuauaugagaaaacauguuuauaugcaagaaaugccacucaauauaaauuauaacaaaguuguaaguugaguuucucacuuuuauuauaaaaugacaauucacauagcucucacagaaauaucagaaauuaaaguacaugcgcucauaaaacaaaugauguuauaagaaauaaugcaacuuaguuuccaaaugaaauaauggccauuuuuuauauuuacaaaaauucagucauaaaaaaauuauaucuuauguugauauaauaaaaacacaagucaauuaagucauuagcuauagaaaucucugccucuuuguaugacagucuguaauuuuuaaaguaguauuaugcacauaccuuuuucaggguguagucuuuuauaagaaucuguuuuugauagacuggggucuguuauaacucuugaucccaauuuaacagucagaucuauugagcgguaacccugaggaaguuuucggucauauaggagaguuaaaagcugggcaagugucauuucagcuggcaauggcuggccuaaaaugauauaacuaaguuaaaucuggaaaccgagaaagaaacauuuacuugguuuaauuauuaucugcuuuuacuaaauuacaggcaagaguuugauucugaaaccaauuucaaaacaauuaaaaaauucaacagccauuggaaaguuuacaaaaagugaguuuauuucugacauauaauaaugaacaauaaugucugugaaaguguuaaaaagucaugggcaaaacguaaacaaaggaacagacauuuccauaaaucugaugugggacauuuuuuucuauaaaaggacagcuaauaaauacuuuaaccugggggggccauauagucucuguuacaacugcuaaucuacauuguagcagagaagcagcuauggacaauacacuaguaaaugggcauagcugcauuccaacaaaacuuuauugcaggcagaaggcaagacucacaucaccuagguaaugggccaugagauaugucacaaggaccucucuggaccaagguauccaacccaccagucgauaguuuguucgccuccaccaugaaucaacaauguaaagcuaagaagaaaaauuccuuugaacugaguuggcaauuucauuuuaauacagcaugaaaauggugauaaaauagaggauggguaucccucauccaaaaugcuugagacuagaacuguuucagauuucuuuuuuuuucuuuuuuuugcauuuucuaauauuugcauguacacaaugaguuaucuuagggaggggauccaaguggaaacacaaaauuuauuuuuguguguauacacacauacacacaucccuuauauacauagccuuaagguaauuuuauaccguauuuuugauaauuuugugccuguaauaaaguuuguguacccugaaccaucagaaagcaaaggugucacuaucucagccacccaugucaacaagagucaucauuccugacucuuaaucuacaugcuaacaauaggcaauuguuuucuuacauuuauucauacauuaaguacuuaacaguaaaaauaugacauaccauuaacacugaaaaaauaaugugucaggacaacuaagcagcauaguagcaucaccaggauaccuguuucagcuauuaaacaaaaccaaccacagagccggggguaguggcucaugccugcaaucccagcacuuugggaggccaaggcaaguggaucaccuaaggccagaagaucaagaccagccuggucaacauggugaaaccccgucucuaucaaauauacaaaaauuagccaggcguggugguggucgccuguaaucccagcuacucgggaggcugaggcaggagaacugcuugaacccaggaggcggagguugcagugagccgagaucacgccauugcacuccagccugggcaacaagagugaaacuacgucucaaaaaaaaaaaaaggaaaaagcagcuacaaacaacagcaggcuuucagucuucaccuaugaugcuguguuuuuauucaaagguuacuauaaacuguguuuuuuaguuaagaagaaacaucagaagcagcugagggaccaggaaguggauccuacgggggaugaagagacauucugcuggaaggcuuuuaaaaaugguucuuguggagucaucugccucauuaacaugguuuuuagcucagaagucucucuucaauuuuaaaaacugacaugguuuuucauucuguuguuaaugcacgcugccguaauccuucaauaugcccaccauacauuuucaccaugucuucuucuauaagcaccuuuucugugguguuaucuugaccuucuucaucacuaucauaacccugauucaaaaccauuucgacuauuuuaccaccagucaaugaaugaauaacugaagcauuauuaucaaaguucaaaacuucuuugacaucuacuucuuccagcuuacugcugaacucugaagguauauuuuuuacauauguaaggaggucagacaucauuuuuuuucacuugacauacagaauccuucaaagucacacacacacaguucaucauuaucacuaaacacaguugcaggccagagguugugccagacaugcacaacugugucuuugucacuguguuccaaguauuggcaacaacauauauggcauucuuuauacuaaacuccuuuugaaaauuuucugcacccaugccucuguucacugcugccagcaugcuguucaagaaaguggauuuauauuuucuguucauugaucuaaagauacccuggucacauggcugaauuaaugaagucacaucugagggaaaguacauggcauaaacauuaguuuugagaauuuuagcuggaggaugaauugggugauaucaaggaauaacaaacuccuacaucauccagucuagcuuaugggcaguacauacaagccacugguacaaaguguuuaugaaaccaaucagaaaagaugucuguggugauccauacuuuugugucagaguaaccauggacugguaagaaauucacuccuugaaaacaacaagugugaaagguuuugccuaucagagcauguuuguacuuauguaugccaguugcauuagcacaucccaggacaguuauucuguccuugguauccuuaauuccuggaggggcugucccaucaacuguagcccagugucuuuuugagacaauaacaccagaacagggauauauuucaucagcauuauaaacuguucuggcagauuuucaucagccaugacuuuggcaaauuuaucaaugaacuucuccauugcuuccugaucaucagaugcuuuaucaccacaaaucuuuaaaaauguaaugucguaucuucucuuaaacuucugcaaccaguguguugaauauucacagcuccuuucaacauucaguucaucaugauagaucguuacuuguuucaugaucagcauaccauuaagaggcacguguucacugccaacacugauggauucacuguuucaauacacaaucaauaucuucauuuuuagcuucauggagugcuuuuucuauuuuucauuaaccucuauucaccacuugcagcacagaacaucaaugguuuaucuuucuguuuguucaggucauguaugguggucacuccaacaccauacucucuugaaagacauuucacacuuacauugcuguccaguuucuccaacagcuuguuuuucugugcuacagauaaacauaaauacuuccucuuuuuaucauuguuacccauaaggguaucuggggccuuuuuuaaauuuccaacaccacagagcaaaaaaacacaguaaugcacacacaucuuggcaucauguggggcaucgugggaaaccugcuguuggcacgucuggcaugcacauuugcaguuuuguuacccacuguggauauguagggaggaaucgggcaugcucaaaaaauaucugaagggggcuggaagaucuuuuuccucuuguggacacugaaaaaacuguguugugugccuguguuuagacuguaaccgucauaugaggucggauguggaauuuuccacuugugucaugccagcacucaaaaaguaucagauacugaauuuuuggauuagggaugcucaaccuguuaucaccuugaacaacagacaggauggugcucaauaaauguguuuuaucugggaagaacauauggcuuaacuaccaguggucuaagaguucuacugcuugaacuaguccuacaaauuugccccacgguguuuccuaaauaacuugucaugaacucucuaaaugucuauuucaucaaucauuucauggcacacugacagaaaaacuuagaaaaccaguaaaguagaaauaaauaacuugauaguguuaaaaaggauacguaauagauuacuccuccuuugcucucacuucucuucggaggaacuguauggaagaagucucacuaacucacugaucucaucaauggcaccugauuaaaaugauuuuggugacugugccucugauuuacauaguuuuaaggcuacuaaaauuucuuugacguuuauucauugaggaauauuaccugccaagaguuugugaaacaggugaaacacugggacaguaauuauuuuguuggcagccucugcuccugaaguacuuccuauuuuaucagguauuguccucccccuccuggauggugggcgaggugguguagcugacacagcacguuuagauugagacuucagcccuaaaagaaaaggaucaguaagauucuacauagucaacacacuaauaugaaggaaaacaguguuccuaaaauauuuuaauaaggcaugcauuccuagcuaaugucagaaaacagaaauguuccuucuaauccaauaucuaaucucccaauucuauucguccuucaugacaacaaauaaauaauuuuggcauugcaucuguaacuauuuuccuaaaaaguaaaaacuguagcuagcugcuauaaucucugaaauacagaugacaaccuauuuaguggaaagugaaaaaaaauaaaaauaaaaagauaaaaaucuaguauuaaaacaucauuacgagucagcuuuuuauauuaguacaauguauuacauaaauuuccuguaacuaaaauucuaauauuuuauagaaacccaaacaaaaucaagauuauaaaaaauagaaagcauaccagaggcaacaacaacacuguaauugucuugaaauccauuuuccgcuuuaacuuuuucuuucucuucaugguuuuucuuuucuuugucaucuuuuuguucacuaauuaauuuagcugugauacuuggaguaucuguaagaagauauuaucuaaaauacacugcuuuuccaaaucauuaagaagagaaguaauauauguuucagagggagauuaugcaagauaauauuauccuuaauacuaaggcaauauaaaggaauuuaggagaaauggcaugagguaaaggccugauacccaaucuuuacugacauugaugaggaagacucaccacuguacuuaagccagaauauuuaagaucuaaucucuguaaaguauuauauacaguauuuuaaugguaccaccuccagaaacaaugaaaaaccaguagcaugaaaacuugcuuuauuuuagccauaguucaaugugcuuggcaacugcaucuaauucaguccucgcaacauagaaaugaauguuauuuucaaaaugaagaaacagccuuagaaaggcuacugauauaaucuguauauggcaaauaugggacucaagcucaagauucagucuauagcauuaaacuagacuucugcuuauauuacaaaugaaaguauaaaagaacaaauuucuguaacagauuuccuguucuguuaauuuuuauuuaggacaaaaacaggaaucuuagacaacaaaguaauauguuuuaaaauuuaauguguuuuacuuuaaaaaaugaguauuaagggcucucauagauaguuauuacucugaauauuccuuucauuacuguggcauacagcacaccacuaaaaauuauaaaauaaaugggugaucauauaaugugauuuaguuauuaagaaauuuaaaggcugaaugaauugauuugaaauuuuaauuuuuuucacuauauaacuguuaucaagucuccaauucucuuuuuuuuuuuuuuaagauaaggucucgcuguguugcccaggcuggagugcagugguguaaucgcgguucacugcagccucaacaucccaggcucaagugaucaucucaccucagccucacaaguaacugagaccacaggcacaugccaugaauuucuguauuuuuaggagagacgagguuucgccauguugugcagacuguugucaaaauccugggcucaagccaucugccugccucagccuacuaaagugcuaggauuccaggcaugagccacugcaucuagcucaauucucuuuuuacuucccuaauuuagcacaauuaugacccggucuuuuauguuaaaaagguugagacaauaaaacaauaaacaacaucuuuuguaauaacucucauuuuacaguuuuuaguauaugaaagugauuucaauuuauacaacuucuuaauacuaauugcuaauugccuauagacaguuuugugaaguaaaaaauuuuauacacauaacaaaugcauggugcaacaauacauuuuacuuucuaacaaaaacaaccaagcaacuaaaaauggcaaacauacugacacaggucagagugaaacauuuaaauaauaagaaauucacaaaauuaauucauagcauaaucagguaagaaaagcacacaaagaauauuagguaauaauuuacuuagugcaauuagaaguuuagccaauuuucauuuauuacccuuauuucaaaaguaaauauaaagaauaaaugccauucaaacacuaaaaaaaaauuucucaacuuccuuuuaaaaaugcucugguuucuaauauuaauuuacuuuuuuauuuuuuaauacaaauuucuguuuuauuuuuuucucuguacuugaacguaugcaaaaagcugcucuguuuuagaauuccacuucuggaauuauaaggaucagguucaucucccacgugaaauaaccuuaacuagaaauauauauuaacaauacuuuucagacacugaguaucaggcagggcagggcagugaugccuggguaaguggaaaccaaugaggugaccccuaggauugugugagcugucuggaaaagaauuccuaggccacagcucagcacaaccuaguugucacccuagacugaggauguaagagccggaaauccaggaagaaaauauuugcaucuaugcagauuugcaucuagagaucuggagaucccuggaucuccagagaucuauacagggucuucaagacuucaacauguacugacgaaccuaugugagcaaaccacugaaggccaggaaagguacuaucgaaaaguagcagggcaagcaaccccaggguuucagggaauaaaaugcuuugugcucuuagacaucuagugaauuccuaacagaguacucauaaggacagagccuuaauaguggggucaaaugggauuuagaacugcauuuucaaaccugguaccuuaauucuauucuaaugagguacauauuuaaagguaaaauucauuaaaauuaaaaauucaaucuaaaaauuuaguuucuuagucucauuucaugugcuuaacaguuaccaaacuagacaacauugguuuauaaaaauuaccaauaauuacaguaagucuugccuuagauuaaaagcugcucugauccuacuuacaaagauuaaaagcaagucuaaaagcaacaaacuguuuucaaauaauaucauuauauuucaugaaaaaauaaaauauauauauuagaauacaaaauauucagcaccccaaaaaguaaaauuuacauugucuggcauccaagaaaauucuccaggcaaauaaagaagcgagaacauacaauccauaaggaagagaaaaauaguacaaacagacuacuauguucaagaaagcugaagaaaaccuauacacuuuaaguaaggacaaggagauauaaaacgucuaacagaucagacacaggaaauuauccaaaauuuaaaaauagagaaaaaaaaugaugggggggaaaagaggaaacacagauuuggggugucaaacaacuucauacagccuaauaaguaacuguaauuauaaaaaaaggggaggcaauuauugaagaaauaauugccaaaauauuucgaaauuuagugaaaucuaaaacacacagauucaagaaacucgacaaacucuaaucauaagaaaugugaagaaaaaauuguaaggcacacaaucaucauacugcuuaaaaccagugacagaaauuuguaaaagcaaacagacugacacauaaagguuauuauuugaaaguaauauugucggccugaugugguggcucaugccuguuaucucagcacuuugggaggccgaggaaggcagaucacuugaggucaggaguucgacaucagcauggccaauaugacaaaaccccaucucuacuaaaaaaaaaaaaaaaauacaaaaauuagccgagugugguggcgcgugccuauaaucccagcuacucugcagacugaggcaggagaauugcuugaaccugggaggcagagguugcagugagccgagaucgcgccacugcacagccugggggacagagugagacuccgucucaaaacaaaaaacaaaaaacaaaaaaaacagagagagagaaaaaauaauaggucacuuccuuuuuggccaguuuuaauauucucuuguugucuuugcuuuuuuuuuuuuuuuuuuuuuuuuuuuugagaugaggucuugcuauguugcccagguggucuggaacucaugggcucaaguaaugcagagaaagacuccaucucaaacaaaaaaaaagaaaguauacugucaaaagcuacagauagcagguaaauuuacugaggcaauacuucugaauuacuuauucuuauacauguugaucuaauauaaacguacaaguaaauauaucagaaaauauggcuaaagaguauaaauccacuuuaaagaaccaaaaaaaaucgcuaaguagguuacauucagcacauauaacuuuugaggucguguacuuccaaagcgauuagcuuuuauuuuuaugcaauacagaaaacuauuuuguaaaauauuuugaaugcuagaauguuuuagaauagcauucuuccacaguaaagacuaauuaaaauguucaauuuucaguuauuuuguauuagaaugucuacuuuugcacuucaaguuaaacauaugaaauaucaauaucaauaacugagcuucagugcuccuccccacuuucuucauuuauuuaauuuuguuuguauguguuuugagagagucucgcucugucguccaggcuggagugcaguggcgcaaucucggcucaccguaaccuccaccucuaggguucaagugauuuuccuaccucagucccccagauaggugggacuacaggugcacgcuaucauacccaacuaauuuuuguauuuuuaguagacauguguuuccccaucuuggcagggcuggucugaaacuccugaccugaggugauccaccugccuuggccucgcaaagugcugggauuacaggugugagccaacaagccuggcccauuuauuuacuuuuuaauuuucauuuuucuucaucauguagaauggacaauuucaggaaacugauagaaaauacugucuaacaucaaauuuucaaaaaaguuucucuguaacagauaaggcagucauuuucaaauaaauuuuuuuuaauauuuauaacaguaugcuaacaaccuauuguauaaguuguaaaacgguaggaaagaauuacgauuuuaugcacaugcauauuagacacagcgauugugaagcagaaaacaaucuuuccuaccuauaaugauuauauccauucacaugguuucacuuaccaucuaugugugguaacaacucccaaaucucuuuaacucucucuuuuacucugggcuuuagauuuguauuuuuaacugauagacauuuccaacuuuuuucuuagauacuccuauucuugcuucaguucacagcuuccauuaaaaacuuaggucccuucuuauguauacagauagaaauauaucuacuuauauucauguuauaaugcaaacagacauuucuaguuuauuuuagaaguugacaacagacauaagaucacaacuaucuugugagguggaaugugugucuugcucauguuuauaaucuuaggacaaauuauagugauugcacuuugcagaugcucagcaaguucacucacugauuaaccagaauuucacaguggcaauacacuccaacuaucuaaaguugauaugggccaggcgcgguagcucacaccuguaaucccagcaauuugggaggccgaggugggcggaucacuugaggucaggaguucgagaccagccuggccaacauggugaaaaucagucucuacuaaacaaaugaaaaaauuagcugggcaugguggcacaugccuguaaugccagcuacucaggaggcugaggcaggagaauugcuugaacaugggaggcacagguuguggugagccaagaucguuccacugcacuucagccugggugacagagugagaccccccucucaaaauuaaauaaauaaauaaaauaaaaaguugauaugccuuugccaucaaaaacugcuuuuuaaaaaacuaucccauauguuguuuaaagguaucauccuauaaaauacaggcaagaaccuaggggaaaauguucugucugcuuucuucacugacuacgauaaacaaugaggugaccagucaauucuaccuacuccauuuaugucuugaucacugaucaccaccuucaauuuaguaaauguguauuaauuagaaucuugcuauucaaccaaauauccugcaauuaaucuaguauaaaaugaccagaugguuuauugugagaacaugccaucaauuauuugucuguauuucuagcugcccauuucucacugugacacaauaaaccaaaaaauuaggggugccuaaaaguauuuuacauuuuguccacuugacuggcuucuuaugcuucaaacuauaaagaugucuugaacuuuccuagucaucaaugguugcaaaguggaugcagaaaauaaaguuauaaaaacaauaaaccuccauauacaucaaacauaaaguuaaacaaaaacuaauacuuaaaucugacuugccugacacucugucaagaacaucugauaauguuguugagacuggcaaaugaagaguacggaauuuguggccugcuccauacauuggaugcuggaugacguggcuaguagcauuaauucuaccuuuguacagcugaaaaucaagaaaucaaagaaaucaggaaguaacuuuuuggaauacauauuguuauaaaauaaucucaaaagcaucuaagaauaaaauacucaauaaauccuacaagauauaauuaauuuagauauggcauaguugccaugauuuguuggucaacuuuugcauuaucacucuguaccuuuuuucauuuuuuuccacaaaucaaacuauacuucucaggcuaagguaaaauuauguuauuccuaggcaugagggagagcgcuauccugaaauugucaaguucugucauuagguauaaaggcugugcuaguuucacuuugcuauacucgaaguuagaacauaggagguaacugcaggcucugauacaaaauuguaaaauacauguauacacagccaaugauuaaguguuaaauacucacuggacauggagacugaagaaacauugucacuuucucaucuuccagcaucaacuguaaaaauaaucuucguauaaacccugaaauguucccagauguuggaagguucccucuuugaggagaugucugaaauaguucacaaagaaccuggcaagacaaaauauuuaaaaaguuaaaugcaagauuuauaugcagcuuuuuauuuugaaagauaaaaaggaaacagaaaauaugaauaaguuuauuuuaacauaucaaaucaguagcuaaagaacaaaugucucugggggucuaguaguuaaguuuuuuuuuuuuaaggaggaaagaaaugauuuuaucuuaaaauauaugaauaccaaaggagauaaaaguguaagaaacguguccaggguuagaaaaaauuaguacuaaacgguuugcacauaaugaauaccuagcauaacgaacucccguuaacuuuagucaauauuggugugguuaucuuaaaauaaaaauuaugagaaaaagcauauuaaaaauauauaacaaggccaaggucaugcugauaaucucagaacuuugggaaacuaagagaagagaucauuugagcccaggaauuccagaccagccuaggcaacguggugaaaccugucucuacccacucccccaaccaaaaaaaaauaagcugggcaugguggcaugugccaguagucccagcuacuugggaggcugaggcaggacuucuugagcccgaaaguuucagugagccacggcucacugauugugcaacugcacuacaggccugggcaacagagagagauccugccccaccucacccccaaaauguauauaaagccuuacuaagaaaccaagagagaaaucaaugggacacaaagaguucaugcuacccagaagcacaaaccaaauuuucaaauaccuagaaucaugcccucgggugaaguugguaauuuaagcauuuccuuuuaaugcauauuuagcagagauauuuucccaguaauuaauuacuacaggcaguuaaauaucuuucucuucuuccucuguuuuguuuagguuuuuguugagacagggucucgcucugucgcccaggauggagggcaguggugugaucucagcucacuacagccucaaccuccuaggcucaagugauccucccaccucaagccuccugaguagcugagaccaaaggcacguaucaccaugcccggcuaauuuugguuaugauuucuuuuuuugguagacaggagguuuugccauguugucaaaacuggccucaaacuucuaagcucaaguguuccacccgccuuggcuucccaaagagcugggauuauagguauaagccacagcacccgaccugcccuucuucuuaauaaaacuaacuccuucaauauuuuauaaaaauuauauuaucuauuuuucuagguacuacuaaaguuugacuugaaugagcacuauuaaauaacaaggagaaaaguuauuuacuagugucuaccauaucucauauaggcucuaugcuagguauguuacacaaauuaaaauauuuaacugucucaaaaaauccuugaggcagguauugcuagccccauguuauaagauuaaccaauaugcccaaggucacgugagguaaccaaaagcaaaauuuggcaaaaagccaacuagaauuacucuugaaauaauucuaccuuucaggauuuaauuuauuaugauaaauaauaaauuaugauuaucauaauauaugacaauccaccacacccagcuuauuaugauaaucauaauauaugauaaauuaucuuccacuuuuuuuuuuuuugagauggagucucacucugucacccagacuggagugcaguaugauaaauuaucuuccacauuuuuuuuuuuuuuuuuugagacagagucucgcuuugucgcccaggcuggagugcaguaguaagauuucagcucacugcaaccuccaccucucugauucaagcaauuccccugccucagccucccgaguagcugggauuccaggcacaugccaccacacucggcuaauuuuuuuguauuuuuaggagagaugggguuucaccauguuggccagacuggucuugaacuccugaccucaggcaaucugcccgccucagccucccaaagugcugggauuacaggcaugagccaccacaaccagccuaucuuccacauuuuguaugugauuuauguggagucuccuaucugaaaccuaaucuaaugcccauguaaagagaagcaaacuaucaguauggcaaucucguuacacaaaaacacaaugccucaaggcacauacaguacucagugaucaguguccauacuguuccagcagcugaaauguuuuuuugggcuuuuucuuuuuguuuguagaaauuuuugaaaauaaggguuguaugaucuagcuagcaucccaaugcaucugcuagucaucucaucauaaagaauaagugauuccagugacagcauauuuugagggggagaaaggagauaucaguacuuuauagcuuaaauucagauccuuaaaggcacucaacccucacuaaauuuauuauuaccuggccuuuauacauggcccuuucuuauguaauaaaacaacuaaaauguaaguuauuuuuuugucuuaccugugccaucagcuuuugauuauuaggauggcaugaaaugcacuguagaaagaacgcaacaguugcauucucaauugcugugcgcuguugaguagucaguccuguuguagcagcugaagaaagagaagcugaucuugcacuggucuguugugcaccuaaauuauggcuuccagaaguggacccagagugacacaauaaaaacagaagugcuguccauaguggauugacuucagaaccaccaagccaaucuuucauaauauggcuauugccaacuucugucaaaaaccuaagaauaggagcaacuaggucggcugugauaggcaucuuauuacauuguugugggacaugauggcgccugaguuuguccugggaaauaucuauugacugggcaaugcuuucugagcuagaaauguggcuaaagcagaaacuagccagacuccucacaagaagagaaggcaaaccugagucuaguaauuguuuaauagcuucaggagauugagaagaggaagcaaggguagccaaaugugauucaguuaaugcgagaggugcuugugcauuuuuagagucaucuguuaaagaugaacuaagauccugcuuuuugcuaucaucugucauggacagucuaugaugacauugcacuggaggagggguaauucccauccagcccaugagcaaagaaaaauaguuuggguguacgugacacauugagcaaaguagacugucaacagcuuucuucaaaaccauauugcagggaagagacauggaccaauuaaaaaguaaccuaaaaaauaaaagauaucauauuaaugauacaaguauauuuuuagaagaaacuauuucaaauauuucuguuauaguucaaaguauacucugacauuauauacuuuauuugacauugaauaauaaaacauuguaagauuuaagacugcauauauauauauauagacacacauauauauauuuaaaauugaagaauguagguacaaugcaaguugaguuagacuugucaaugaguacagaaaaucaaguaaauuauuuuaaaaugguucuaucauucugugugaccugaaaaggucauguagagaaacaaacaaacaaaaaaaucaugccaaacaaauguuuacguuaaauuccacaugacaaauggcuuaaauucauguuugcaaauaaaaaacuaccagugaggcucaguaauuaagucauggauuaugccaaucgcuaaggccaaauaugaugaccuaccagagaacaauaggccuacuuuuuauguguuacaggaacucuucaaaaauguauucugcugcagacuuaauaguuagcuaucaguaaguucagcaaagacuuagcuaaauauggugaagaaauguggguaaauaaaaacuacuugucaaaaggacaaucuagaaaagucucaaauuuucuagcuuuacauuuuuguucuuuuuugagaugacgucuugcucuguugcccuggcugcagugccaguggugccaucaucauaggucagugugggcucuaacuccuggguucaagugauccucccaccucagcgucccaaguaguuagggauagaggaacaugccaccaugccuggcuaauuuuuaauuuuuuuguagagauuuggucucucuauuuuagccagucuggcauuaaacgccucguuucaagugauccucccaucucagcuccccaaaguuauuuuuuuugagacagagucucgcucuguugcccaggcugggguacaguggcgugaggcagcauggcgaacuucugcagacucaaacaauucuugcgccucagccucccaaguagcuggaacgacaggugcauaccaccguguccggcugacuuuuuuuuuuugagacagagucuugcucuugucgcccaggcuugaguucaauggugcaaucuuagcacacugcaaccuccaccucccagguucaagugauccuccugccucagccucccaaguaacugggauuacagacacgcgccaccacgccgggcuaguuuuucuauuuuuaguagagacgggguuucaccauguuggccaggcuggucucgaacuccugaccucgugaucugcccaccucggccucccaaagugcugggauuacaggcaugagccacugugcccagcuuucugacuucugcauuuuuguacagacaacguuuugcauguugcccaagcuggucuugaacuccugacucaagcgaucuucccaccucggccuccaaagugcugggauuacaggugugagccaccaugcccacccccaaaguugucuagcuguacuauccugccagaguuguacauuaaagauaaucuggugggaaaauuugcaacugagaauaaacacuaugaaccacagcaacaucuacauuaagcauaauuuuagguuaaaaaaaagaaggcaguacugcuaacauaucuucuuaaaacacaaagauaaauuaauauuugacaauucauuucaaaaguauacuugauuauauuugcuacuuucaaaauauuauguuucuccuaauaaacauguaaaauauuuuguuuuaucaagugaacacuaacugaucuaguacugggggauaaaaaagauuucacaaaucauacuuacucaaagagcucuugguccaggagugcugguaagucauauucuacaagcagcucauaacuaugccacagaauggcugcuacacagugcaaaugagaaggagauggcaucagaagaccauacucuacuguugaggaguuaggacacauguaguucauccugccacuucucuucauagcagccacucuugcagaaucacuaacccauuuuaacaaggccugaauucuuaaacgaagaaaacgaauucauauaaccaacuauauagugcaauuggcauuucauauagauaaauaccaucucugcauggugaguaggguauuuaugagaauaaugcacuaauuguuuuugauuauuuuaaucuaaaauaggaaaaaaaggaaaucucucggcaacaaagacauacuaguuccaguuccaauuuuccaauaaccuuaccaauuucaaccaucaaaagguuugagauaacauacuagaacagugaucugggacuaauucuucauugugcaaagucucaugaaauacagcacguuucacaucccuggacccuagcauuaaauacuaguaauagccacccacacucauucauucugacaacagaauacacucucaacacuuacauauuuuuuuuaaguauaauuuuuauaagauggaaauuaagcuuaauuuauuuucucugcauaguacuuuuaaaaauacagguaucugucauuuagaacuaacauuaauaacaagauuauaggucaacuaaccccacuaaucccaaucuccuggaguugggaaccaguaaaacacacccaauuuugaaccacaaccugggagcgaaagacuuuuagauuucucaaguucuuaaaacacuguguuuacauuuuguuuauuuuccuucaauuucuauuucagaauauaagauucuuggcuucacacuaaaagaaacagggauaggaagguauauaauacuaauucugaaagauaagacuuucaauuucacaugauggggaauaaagagaauucagaagacaaggaagacauuuuucucagucuaacaaccuugucauuaaugucaguuuuauauaacaaacauucauguuuuaaaaaguacuaugcagagaaaaugaauuaagcuuaauuuucuucuuauuaaaaagccacaacaauauuuaaaaauuaaauaauccuaacagauuucaagcaaccuguucuggaaaaauauuuaacacugauauuuuaaauauauuuuaaccacuacuaacgauuaugauucaaauuuggcacaaauuguuauucacuucaucaaaaacaauugcaaucuauguuuaaauguaauccauaauuuuaauaauuuauaaagauauuaauaaaacaucaaaugacuucauuuuaaacauaauuaaucaaaauauuaaaaaguaacauaaaucaggaagaaaucucucuguuuuucuaauauggaugcuacacauaaaaacagagaaugccaaauauuugcucaaaaauuuaucaacaaaaauauguuucaaaacuacuucaaguuggccgggugcgguggcucaugccuguaaucccagcacuugggaggccugaggugggcggaucaugaggucaggagauugagaccauccugacuaacacgguaaagccccgucucuacuaaaaauacaaaaaaaaaaaaaaaaaaaaaaaaaaauuagucaguuauagugguggucgccuguagacccagcuacucaggaggcugaggcagaagaauggcaugaacccagaagguggagcuugcagugagccaagauugcaccacugcgcuccagccugggcaacagagcaagacuccaucucaaaacaaaacaaacaaaaauucaaguugguaucaauuuggaaguagaagacaucaagguagaaugacauuaggacaacucauuaaaauuaccuaaauguaaaaaaaaaaaaaaaaaaaaaaaaaaagaaaagaaaagaaaaaaaucacuaaauauuuagccaauguguucaaaugucauuuacauguuaugauauuguuucauucuguaaacagcaggaaagggugcagaaagucaugaaaagauuucgaugaauacgauaaucaauaauaaauaaacagaaccauuauaaaaacaguugaaguaccaacuacagacacaauaucccuacauucauauacacauauaaaguacuaccuaagacaguaugacucugauaccaucacuuuacaagguuccuuucacacguagccaacuuaaaaauauauguuuuauuccauuccucaaaagcaguauuaacaaagaauucuauuuaaguucaaauuugcuuaaaguauguccaaacacauacaaauguaugucuaauguucaugaauacuugcagaaguuacaucgugugaggcauaugguaaacauacaauauaucacaguauugucuuuuaugagaucaucuaaggaaaaacugucagaaacauuuacuauagcaugauuaugugcaugugugugcuuaauuaaaugaaaaauaaaaucguaccugucuuuuguaccaggauccugaguuguuccaagcugguaaagaauaucuaucguagagucagaagagaguccauuuagucuuccaaaaaguaaaggacuauucaaaucuugcaacaaagaauccaaagaaaaaguuugcuaaauaagcaaguuaaccaugggaagauuuacuuaauugaauuaaguuauucauuaaaaaugaggcuuccauaaauuccaacaacacagaacaaacucuaaaaauaaugaaacuaggcugggugcagugguucacacguguaaucccagcacucugggaggccaagguggguggaucaccugaggucaggaguucaaaaccagccugaucaauauggagaaaccccaucucuacuaaaaauacaaaaauuagccgggugugguggcagaugccuguaaucccagcuacuagggagguggagguuguagugagccaagauugcgccacugcacuccagccugggcaacagagugagacuccaucagagaagagaggagagauaaacauaaacuaaaagaaaaaauaauucccaaaacagaguuaagcacgaagaucgcacaguucaacugcuguuacuuuacagauauguaaacauuuaaauaucaaaguuaauuaucaccuguaggaucacugccugaugcugcacaauuucucaggagaaugucuaugagcuucaggccaauucuaguagacugcaguccuaucuuuacaagcacaaccucgauguugggugaaugcauuccacaguaaggugacaucaauaaggccgcacaagucugcagcagauuagcaguaggugcagcugcacuugccaucauuccuucuagaucacuuaugugaguaaggcaaugauguaauaaccguaaccauccaauacugaaaauacaaaaugacuuguaugaucaauauaagucgcucaaaucacuucgggguagaacauaacuuuuuaaagaucagcauguuguguuucauaaacagcauuaaccaaucuaagacauguuuuuuuagaaugcugcaaauuaaguaaacagacaguaaguuuccccuauaagauaaaucauggccaggcacgguggcuaacaccuguaaucucagcacuuugggaggccgaggcagguggaugacaaggucaggaguucgagaccauccuggccaacuuggugaaaccccuuaucuacuaaaaauacaaagauuaguugggcaugguggugggcgccuguaaucccagcuacuugggaagguggggcaggagaaucauuugaacucgggaggcagaaguugcagugagucuagacugcaccacugcacuccauccugggcgacagggugagacucugucucaaaacaaacagaaagauaaaucacauacaaaaguacuuguauucauagcacuuagacaccauggguuugcuuuuuuaggcaaucauccagaaacuuucuuuuacaugcaauuauauauacugauaaacugauuacuaucauagacuucuaaaacuguguagucuuagcaccuugaaaauagaaauccuaaauucuuuuuuuuuuuuaaagacagaguucacucucacccaggcuggagugcagugguggaaucguggcucacugcaaccuccaccuccuggguccaagcgauucuccugccucagccucccaagcagcacaccgccaugcccggcuaauuuuuuguauuuuuaguagugaugggguuucgcccuguuagcuaggaugguuucgaucuccugaccucgugauccgcccgccuuggccuccccaagugcugggauuacaggugugagccacugagccaggccuuaaauucauuuuuaucaggcagaacuuucaauaaaauccaucuauaaaacauccagcugucaaaauuuaucagaaaaauguugauuaaaaaauauauuuggguccuuguuaguuugguucagacauaauccuucuguuaacuaacauuuaggaauuaccauauaagacuaggucgcuguuucuaaggucaguugguaugguucagaugucauaggcuggucauaggcauuugcaaauucccgaaacagaguaugauacaaaaaauuacaagccagaaaauuacaauguacaccuacauguagcauacagaucaucucaaagacuaaacauauauacaccuuaauuuuaaucagugucagcauucuguuuccacaaaacugucucuauuacaccuaauaaaauuguauuauacagauaccuauggaacaaagaccuuccuaagaccuaaaaaagaaaaaacccacaaaauaauuaaguccccuaucucccaaccaugccaaaaaaaaaaaaaaaaaaaaaaaaaaaggacaaacaaaacauaccuuguuuuggauaccugaucuucagauggaaggaauggauuauuaacuguugcagaagaggugguaccaaaagcagugagccccaauaauuuaauuugugaaaggccuaaugugcuggcaucccguggacgauguagucuaaggcagacagcagaagcuacuucggcuuuuacaagcugaauuuuuauguaggugaggccacuugugacaacaggaguggacaaagguagcauauuuaccccaucugcacuuacuucaacagacacugaggaagggcaggcuauaaaaagagaaaacugaaucaucacaaaagacaaaguauacuagauugaacaguuuauuaaaaucccaguaaaauagcagcuuucacaguuguauucaucaugaacuuguaaaaggaaaacuuauacaacaaaauauaguuugacaaugacuuucaccauaauuaauguuggagcuauuuuucaacacaaaauauuugaucuacaauaaaaauuauacuuaaacagucuaauauucaccuaaaaaaagaggaaccaaagaugugugaugcacauguaccugaugcucccuaugaauaaaaccagccaaauagguaauuaugucaucauuucuauuuuacucaaaauuaucacaaauaauacaaaacuaccuuugauuaauaugcuaugguuuacuauuuuaaauaauuuggggaaaaauguaauaaaacuuguuuaucuaccaauuauucuauuacuacuagauugugauuuuuuuaaacauugaguuuaaccucacagcugaguuuagaaauuuuuuuuuguuuguuuuguuuuguuuuccugagauagagucuugcucuguugcccaggcuggagugagugcaguggcacgaucuuagcucacugcaaccuccaacucccagguucaagugauucuccugccguagccuccagaguaguuggaacuacagguaggugccacuacaucuagguaauuuuuguacuuuugguagagacaggguuuugccauguuagccaggcuggucuugaacuccuguccucaagugauucaccugccgcagccucccaaagugcugggauuacaggugugacccacugcgcccagccuccuuuucaaauuaaaccaaauauccacaggauuuuuuuuaaaaaaucaauucuugcugaaauuuaaggaguccccaaugaacuaccagaaaauuauuuauuucuagcuuaacauggaaccccaucuaauaaauaugucaacuaaaacuuuugaaauuugguuuuauuuuuaauuucagugguaaaaaaagaaggaauuacaugccagcuuuacacugauuacuagacagucaaguuaauuuuuaaauuucuacuucaaaaccuuuugaggaaaguauuaucuacauuuuacacaagcagacauagcaaaaagagauuaaguaauccacgcucccacaagaaaugucacaccuuagauucaaguccauguuugauucuaaagacuguuauuuccacuguaucacaacauauuuucaacuucugcucuaauccaauaauaaaaccaaauuuuguaaucaaguacacuuaaguagggaacaccuaaaccaauuaauuuuucacagggguucccccuucauaauaugcuuccuguuucaauucccauaugaaaaauccagcugaacuucaaaagccaccacuuaugaccaaacuccuuugcuuuccaaauaaaagcaaucucuuuccaauuuuagagguagccuaagucuuacauugacuuauauuugccuuuuaauauaguuauuuuugaccuccuaaaacaccguguacuagcauauuuuccuucuaccuuuauauuaucuguuuuuuaucuaaggaguguggaugccacaaguaauuaagcuauaucagucuaaucuugcaaacacauagaaaaaaauuguuuucuccaaagaugccaggaaucuacaacauuucccacagcuccucaugcaauuauugagugauauuugauagcaaugagaaucaaucaauaaauguaagcauguguauuaauuuaaacaauucuggcaaaauuauaacuauauugaaagcauuugugaaccauauaaaacacaaaaugggcugggugcaguagucacaccuguaaucucagcacuuuaggaggccaaggcagguagaucccaugagcccaggaguuugaaaguagccuaggcaucauaacaaaaccccgucucuacaaaaaaauacaaaaauuuagccaggcauggugguacaugccuguggucccagcuauacaugaggcugagaugagaggaucauuugagccucaggggucaaggcuacagugauauaucaaaacugcacuccagccugggcaacagagugagacccugccucaaaaaaaaaagcaaaugaguauuucauauucuuuauaaauacuugaaagaguucacgcucuuaagugauaguauuuuguaaaaauuauuuugaauuauuugccuuacaaaguucaauaaaauguauucaaugaacaugcaacaaacgaaugauacaauauuacaaggauacugacauauuacaauaaacacaguaugaaucuuaaaaucacacugaaguagucaaaauauaauauuauucaaaaagguaguuaucuuguaaagaaguuggagggcaggcacacaaaucuaugcuaauuucacauuacaaggcuaggacugaggucugggcugaaaaaacuaacaugguaaaaaauggguguguagugaacucauuucagcuuaauacugaagcuuaguaaauuugagagaaaagagaaagcgaaauaauauauaacuggaacauauuuguuuagacuucauuacauaaucuuuuugucugagguuaacagucauuucuccuaaaaugacuugguaguauuaauuauuucaauaaaaacuguucagaaguuacacucucugguaaucacaccuaaguguauuuccgcuuacuaaacauuuuuauuuucaaauauuucuaaauuaaagcuuguucucaugaugcuucuuuauaaaauauuacucacuugcaagagaugcaagaugaggcuggauauguaucuccuuaagcagcacugcugcaggaaggugaaugguaaggucacaccaagccuccucuggaagaaagauguaggaccaagcagcagagcgagcucuucugugaggagguguggccugcaauagcacuucagcugguugggcaguaggacugcuagaugugauuguaccuagagaagauauuuuacauaaauuauaagaacuugcaaaagaaacauaauaaagcuuuaaaaucuauacaaauacaauuaaacuagaaaaauuaauugaaaacaugaacaauugaugcugguaaugcacuuaguauccuaagcaugaccguaaagguauucacaaaacaugaggaaauccugucaacuggcaaggugacaaguucauuauuaacugcugucuacuuuguacucauaugauacacgaaaacuaaagacacagcaauaaacguagcucaauaauuuucaaacuuuuuuuaaauuuuuuuuauuauuuauuuauuuauuuauuuauuuuucagauggagucucgcucugucgcccaggcuggagugcaguggugagaucucagcucacugcaagcuccgccucccagauucaggccauucuccugccucagccucccgaguagcugggacuacaggcgccugcaaccacgcccagcuaauuuuuuguauuuuuaguagagacgggguuucaccguguuagccgggacagucucgaucuccugaccucaugauccacccgccucggccacccaaagugcugggauuacaggcaugagccaccgcgcccagccucaaacucuuuaaguaaaaaacaauguccaauauauccuucaccuuuaaaaaaaucaucuuuauucuaagaugucaaugucuaugauuuagaaauaugaaaagaaaaauuuaaaagaaacuauguaaacuagauaaaaaaguaaauaccuaaauucaaaacuuuuaaaaaagauaguacuacuuuaaggccaggcacaguggcucaugccuguaauccuaacacuuugggaggccaaggugggggaucacuuggggccaggaguucaagaccagccuggacaacauggugaaaccccaucucuacuaaacacacacacacacacacacacacacacacacacacacacacaaacacccccccaccccccgccccaguguggugaaacacgccugcaaucccagcuacucaggaggcugaggcaugagaauugccugaacccgggagacacugugccacugcacuccagccuaggugagagugagacucucucaaaacaaaacacagcaccacuuuaagaaggaaaaugagauuuaaaauugauuaacauuuaaagagaaaacuuacggaagaaucucuguuuaguuucuuaaauugugcuucuauuuagacucacaaauaaaaacaaacuuuacugcuaaagaacuguuaaaacauucccucucggccaggcaugguggcucaugccuguaaucccagcacuuugggaggccgaggcagguggaucacuggaggucaggcauucaagaccagccuggccaacauggugaaacccugucuccacuaaaaauacaaaaauuagccaggcgugguggcaggugccuguaaucccagcuacucgggaggcugaggcaggaaucgcuugaacccaggaggcagagguugcagugagcugagaucacgccauugcacuccugcuugggcaauaagagcaaaacuccgucucaaaacaaacaaacaaacaaacaaacaaacaaagcauucccucucauaaguagaaugucgagauauccacuaccucuaaaauaaacuguuuguaauuaaaauagugauauauaacaucaucaacugacuucaacuaauuuuguuucauaccagcuaauaaacuagauaauuucacauaaguaagauuuaguaacacuuuucuuaccgaggggugcaaaguuaugaaucccuucagcauugucaggcucagaagcuaguauucuuguuuucaaugugcugucaacagcuuuauuuggaccagagucaagaaauuucauaauaguugauaccauacuucuugcaguguucacaauagcccuuguacuaguaaccauauuauugcauaugagcugaacaccaccuaaauuuauaaagaauaugaaaugaaaucgaucucaggacagaugguucaacaucaaaaguaaacuuccacaaaagacuacaaaaaugaaaauguaacauacuaucacauaacuacacuuaaaugauaguuauugaaauauuaucuuacccauaucaugaaaugcuuucaaggcaucacuaguauccaauacucucaaaaugaaccacaauaauggcucagauaacuggcaaguagcaagagagcccuaaaaaaugaaauaugcauauuaugacuuuauauauuccugugaauaagaacuaaacucaaugcauguaauauuccuuccuaguuaauuuuuguaaacugacagccuuaaauacgcuaaauacaaaaugucugccaaaauacauaagaaaucuuaccugaauaaaaaaaccaucucccugaacucagagaauuuuuuaaagcaugugucuucauccauuauuaucuuuucucuuaauaugcauuuagacaccaauuucauuuaaaauuugaaccauuuaaaguaccuuuguauuuucuaauagagaaauauacacauucaacaaauguuuacaaaaaugauaauuauacacugcuauauaaaagacauaagaaacuguucuaauaucugcauuucaaaaugggaaauggacaagaaaguaaaauaaucugguuccuacaauuucauuuguaaaaaugaaauacaaaaaggaaaaauuuuguaaccuauuuucuuuaauuagccuaaucucuuuuaauggaaaaaaaagaagcugaauacacaacauaaauuucaaaagauuucacauuacuucuucuuacauaacaucuauggagaacaccucaguauuacacuaugcuacuuuuaggaaaaagagaagaacuucuugagacuauauuaaaaaaucuaaaacucaggaacacauuaaauguuuuacucuuauaucacuguggucaucucugaaaauaccacuucaaagaaacuuuauucuccaacuuuuauuaauaauccacagcccucuuguacugaugcuuuucauuguccgauauauaauaaauauacuuauuuaucuuuguccuguaauuuuccacuuacaucgcaauaaauuuauuugaaucacugcaacuguuguuggcuugaacuuacuugucugcccauauauccacaggccauguauguuaaaauuggcugcagcaucauguggacuguagaagcuuuuuuacuaaggguugucaguaugguaaauaauccauccccaacugauauggcauccaacccaccaugaaaguuuucauguuuagugagauguaauccacuugcuccuaagaaaaauaaaagauaccacauuaaaaguauauauauccagccaggcgcaguggcucaugccuguaaucucaacacuuugggaggccgaggcagguggaucaccugacuucaggaguucaaaaccagccuggccaacauggugaaacaaauaauaauuaaaauauagaagcugaaaagucacuuuuuccaaaacugcugaagaaugaauauauaauagcugucuaaacccucuacacauaacccgaauggacucuuagagauuaaaauaucaaugacaauauucaguagagcacgguuuauggcuaucuucuuacaugacaauaccucuauaucaccaacaauaaaaauaaguuguucuguuauaugacugagaacaucacucuacauacaucaagaagagaggacaugaauagaaaaauaugugauaccagcauguaacuauucuuuuuaaucuaaucaaacagaagauguggcuguuucucacacacugacaaagaaaaaaauaccaacaggcaaaaauauauuagaaaaggauuuugccacaguauacaaauguucauuuauuuuaaaaauuuaauguaauguauuaacauuccaagagguaaaagaguuaagcaacagcauauaaauuuaacacugguuugugucauagaaaauguuacaguaugaguaaaauuuuacauuuuauuuuuaaagcaaaugugaacaaauaauacuugucuucaacacaaaaugaugugaaauaagaguucaagaccagccuggcuaacauggugaaaucccgucuguacaaaaaaaaaaauuggcagggcgcaguggcucacaccuguaauccuagcacuuucggaggcugaggugggcagaucaccugaggucaggaguucaagaccagcuugcccaacauggcauaaccccaucucuacuaaauacaaaaaaucagccaggccugguggcacaugccuguaaucccagcuacuugggaggcugaggcaugagaauugcuugaaccuaggaggcggagguugcaaugaaccgagaucacaccauugcacuucagccugggcaacagagcaagacuucaucucaaaaaaaaaaaaaaaaacaaaaacaaaaacaaaaaacuagcaggggcaugguggcacacacgccuguaaucccagcuacucgguaggcugaggcaggaguaucacucgaaucugggaggcggggguuacagugagccgagaucgcgccauuguacuccagcgugggagcaagacucuggcucgggguaaaaaaaaaaaaaaaauuagcugggugugguggcaggcaccuauggucccagcuacuuggguggcugaggcacgagaauugcuugaaccugggaggcaucucaauaaaaagaaaacaaaccaaacugacaugacauuugucaauauuucacuuucauucauuaauugaagccccuaaacagaaguccucaccaauaaaaaucagucaugaaaagcuuaaagcaguuuuacacuauaaaguaaaaagaaaaugaauccauauauugcuuaaaaaaaaaccaguuauaguaucagagacaaugguaagauuaauauucucaauacauaccaauuaucauugccauggcacugcuauuacacaggcccagagcagacaaaaucuggcucauaauuuguugguuggcuaagacuaagucagcaacauaugcaggcgauccuugaacacugguacugcuuccauugccaucuuugccuccugagacuuuuucuucaucugaaacacuaucuguuguauuuguggucacagacacucuugcacuguauucccuauugccugaaagaggcagcugcacuaaaauguuaacaaguuuuaacaaaucaaacaugaguugaucucuugucauuucgccacaaacugcuuuugcaucacccggacgaauaagauuggcaaagagucccccaaagcaugcucgagcacccacggagcuaucugauccacuucuugacauuacuuugucugagcaagugauauaguggugcacuaaaaauguaaccgauucuaucacggcagaaauaguacuaacugaaacgacuucaaaauucugcuccagagugaauucuaagagcuucacuugggcaucgagagguccuuggccugucuggaaagcaccccugcagagagagagagagagagacagaaaaagagagagagagagagauacaacaagagaaaggauuaaaaauuaaacgauuuuaaguaguucugaaaguaguaacuuaucacaauacaagaaaguuaaacaaauucuugauauucacuauuucauuagguagcuaauaguuuucaucucuuuuggaauucuuguucuugccuccauuuuagacaaacucaaaaacaaccucccuuccaaauacaaaacuaagggacaaguauauccggaagugauuuugaagcuacagacaaaaauacuucaaaaucacaaggcacuucuuauaaugaaaugaguucuaauuuuuuccauucucaaauaacgcuauuguaaacauuuccuacugauaaugauacauaaaaauuaagauucaaucaaaucauucucaaguaucaaaauugaaugcucuucaaauucuguuuaugccuaagauauagaaugcugaaaagucuaacagcaagucagucuaacagcaagaaaaaggcaaauuaggccaggugcaguggcucaugccuguaaucccaucacuuugggagccccaggugggcagaucacuuguggcgccaggaaguucaagaccggccuggccaacauggugaaaccucauuguuacuaaaaauacaaaaauuagccaggcaugauggcaugugacuguuaauuccagcuacucaggagacuaaggcaaaagaauacuuuugaguuugagaccaaccuggccaacauggcgaaaccccaucucuacugaaaauacaaaaauuagccaggcauggugaugggccuguaaucccagcuacucaggaggcugaagcaugagaauugcaugaacccaggaggaggagguugcagugaguugagaucacacaacugcacucuagccugggugacagagcgaaagucuauuucaaaaaacaaacaaagacugucuaaagcaaaaaaauaaaaaauaaaaaaaagguugcacaguauuguguuuauagcauauauaaacaguaaaaacaugacaacuaugucacaaaagacggaagaaaggaacugaaacuacacuguuaaguucugacauuauacaugaacggaauaauauuuuaaaguggaaugugauuaaauaaagguauaucuuguaaaacuaggacaacuaauauuaaaaauuuucgguuauaggccgggcacaguggcucaugccuguaaugccagugacacggguggauugcuugagcucaggaguucgagacuacccuggccaaccuggugaaacuacgccuacaaaauauacaaaaauuagccguguguaguagcauagcagaagccuguaaucccagcuauucggcaaguuaaggcacgaaaaucacgugaacccagaaggcggagguugcagagagccaagaucgcaccacuacgcuccaaccugugcgacagagcaaacaaacacugucucaaaaauaaauaagaaauucaguuauaaauaaggauggaaaugaaauuauuuuaaaaguugcuuaauucaaaagucaacagaaaaagauuucuuaaaaggaaucaaaaauagaugaaauaaauagaaaaauagcaaaaugaucaauuuuaauccagcaugucaauaauuacauuaaauguauguagucuauauagucuauauagaccaauucugacuuugucaaaugcuuguauuagaaaagaaaggucuaaaaucaauuaucuaagccauaaagaucaaauuaaauucaaagaaaguagaaaagaagaaauaaucuauaagcugccuuuuuuugaaauaauauugaugaacuucuagccagaaugaccccaaaaaaagauaaaaauuaccaacaucagaaaugaaggaaacuuauagauccuauaaacauuaauacauauacauauuuccacuaacaaauacaacaauguaaaggaacaacuuccuucacaaaauuaccaaagcucaaucaagaagagaaaaccugaauaguccaagaccuagaaaauaaguugaaaauuuuuggggcaaagaaaacucuagccacaggaugcuucaauggcaaaugcuaccaaauacuuaaguaagugacaauacacauauuacacaaccucuuucagaauaaauucagagaauaaauucagcaaguuauaaaauggacugauauguuaugaccaagggugucuaccuugagaaugcacauuaacugacacuuagcaaaaaaaaucaaacuugguguaguggcauaugccgauugggccagcuaagaacagaaugagacugaaagccugcuugaacucaggaguucaaagccagccugggcaacauagugagaucucaacucuuuagaaaacaccaauauaauucaacguaugaacagaugaaagaagaaacaaucuauguucauuucaacagaugcagggaaacaucuaacaaaauccagagacauucauaauuuuuuuaaggucuuagcaaguuagaaacaaacuggaacuuccucaacuuacuaucacauaucuaaaaaagagcuccagcuaguaacauaucuaauuaugaaagacaauguuucauaagaucuuaagauugagaaaaagaaggaagaguaacuuuuaccauauguacucaacagcauacuugaaguccgaacgaguacaacuggauggggggaggggaacccaugagacauaugcauaagaaaggaggaaauuaaacuaaccguauucucugacaauauggccaaacaagcaauacaucugcccaaacugaucuacagaaugaugcaaucucacucaaaaugauuuuuuucuggaaaaucaauaagcugauuguaaaauuuauaaggaaaaaggaauggaauuaaaacagccaaaauaacucuaaaaauaaagaacaaagguggagagccuacacuacuaaauuucaaaaaauacuguaagggaacuaagacagugagguaaugcauaaaaaacagacaaaaacauaaauucuauauaauacacuguaugaacaaaugaggcugggugugguggcucacgcuuguaaacccagcaauuugggaaauggaggcagguggaucucuugaggccaggaguuugagaccagccuggccaacauggcaaaaccccaucucuacugaaaauacaaaaauuagccaggcauggugaugggccuguaaucccagcuacucaggaggcugaagcaugagaauugcacgaacccaggagguggagguugcagugagucugaaucacgccacagcacuccauccugggcgacagagcaaaguugucucaaaaaaaaaaaaguguaugaauuagaucaaaacaaguaucauugauugauauuugaaaaacuacaaagggaauccaaugaaaaaaggaaaguauuuucaaaaaauggucuacgaaggcggggugcgguggcucaugccuguaaucccagcacuuuggcaggcugaucacgaggucaggagaucaagaccauccuggcuaacacggugaaaccccgucucuacuaaaacuacaaaaacaaaauuagcagggcgugauggcaggcaccuguagucccagcuacucaggaggcugaggcgggagaauggcgugaacccaggaggcggcgcuugcagugagccgagaucguaccacugcacuccagccugggugacagagagagacuccgucucaaaaaaagaaacaaagauauaggaacaguuggacauccacaggcaaaaaaaaaaaaaaaaaaaaacuucauccugaaagcaaaaaauaacaagccuaaauauaaaacauaaaauuguaaaauuucuagaagaaaacauaauauucugugugacuuugugugaggaggguauuuaagacuuugugugaggaggguaacaacaacaaaaaauacauaaaaguugacaauuuagauuacaucuagaauuuuaaaacuucugcuuuuugaaggcuacuuaauaaagugaaaacagaguccaaagaccaauagauaguauuugcaaaacacucaucugauaaaacugaaugccuucuuuauaccgaguauuucuuucaguguauauuauuauaucauuaaucuaacuaaagagcugcuggaucuuucacagaauaccagagccuuuauuaaaaacaaacauaaacuaacauucuucuugggccacagcuuuguggacccucuuaaauaaacuaggccacaaaaauguacaggguauauguguggugaagugagguggagaaaauuccuaaacaguuucuguggcguauaaaccucaaaauaucucugcuuaaauauuagaugugacuaaacuacaaacaagauuaauaauccuuuagaaaauguuagagcaaauauauuaaaaguuuaguaugaaaaucuucacuguugugaacucuguggaucggauuaugcuaaagccugcagaguuaaaauuaaaaagccuaguuaaaagaaaaauaaaacaaaugaugacuaaucuuuauuccucacgggauuuuaauuaugucauucaaaauuucacaaaauccucacaaaguauguauaaauacuguuuauuugaauaaaauuagauaaaaaaguggcaauagucacuacugacuuauuccugaucauuaauuuauuugagaaagaguguuguucugucacccagguuguagugcaguggcacaaucaggacucacugcagccuccaccuccugggcucacugguucaaucaaucuccugcaucaggcuccacaguagcugggauuacagguguauacccacacccuagcuaauuucuuuuucuuuuucuuuuuuuuuagagaaggggucccgccaugugacccaggcuacucucaaacuccugggcuuaagcgaucuucccgccucagccucccagggugccgggauuacaggcgugagccacugagcccagcccuauuccuuauauuaauggggauuuuuuugaaauacucaguuuuauuguaacuucaaaaacaaaauaacacuuuauaauucauuaaaacuuuucggccaggcacaguggcucacaccuguaaucccagcacuuugggaggcugaggcgggcggaucacgaggucaggagaucgagaccacccuggccaacauagugaaaccccgucucuacuaaaaauacaaaaauuagcugggugugguggugcgugccuguaaucccagcuacuggggaggcugaggcaugagaaucgcuucaacccaggaggcggagguugcagugagccaagacugcaccagugcacuccagccuggcgacagagcgagacucugugucaaaaaaaaaaaaaaguuuucaucagaaaguaauguuggauuuuaagaaauauagaauaaaaaaagacauuaauaagagauauaugauauugaagcauucaugcauuauaauaaucaacccauuauggucaaaauuuauucuuauaacauggagucugauuuuguuaauaaauuuauuuagaauuucuacacaagauuaguauacaauuuucuuuuauaagcucuauuuuucagguuuucuuacauacaaaaucacugguagcuuuagaguuuaaacagcuucaaaauaaauuucaccuuuuaaaaagcuuauaauaacuaaucuauaaaaccauuaaaagcaagucaacuguauuccuuucauauuaaagagaguagagguauaaggacuugagaaaaccauaaugaaaugaaauggaaacaaucaggaaacacaccaauauauccuucccccuuaauuacuaccguccuccugcuuauuuguucacagauaaauucccaacaaauguuaaagaaaaguauauuuggagaauuacauguuacuucuauaucaggaacaaauuaguacacaaaaauuuaccuuucaguugaaaguauaugaauuagcuugagcaaaaauucacugaauaucugaggacauguugaagaaagaugcacuuguaaucgaguaagaaauucuugcauagcuuguguagcuguaggaccaaccuaaagagaaauguauauucacugaaaacugcuuacugguaacauguaaaaaaucauucauuuaaaaauuaucaaguagaaagucaaaagcuauacacuguaacuuuucguacgaggaaaacaaaaguauuaacaaugauagcaggaaaugaauuuuuuaggucuugauguauuuauuuugaauugcaaauaaaaauacuguuaauacuuuuucauuauaguuuauacaccacaacuauauuagguuuauugaacucaauacuaaaaaaaguucaccugaauuacacaauaaauacuuuuauaaugcuuuuuagaguauaaauaacuucaacauagauuuucacaaauaaccuucuuaauuaccccauuucaaaaucaaauaacucaggagcagagagguaaaaugauccauaaaaggucauguuucuaacaacuagcaaagcaagcauuaagcuaagugaaaaacaaaacaaaaacuaaauaaaaauaaauuuauaccaagucaaaaaaaaaaaaaacugcuuucccaaacuucuaauucaucaaugaaagaaaugauagugaacacuacauuaaguaaccugagguagaagugugcucuaacacuucuacauauuauuuuauuugauccuaauuugauuugaugaacaacucauaaaaccuuggaguaguucuggaaaaauaaaauacaauauaauccuccaaacuauuuuagaguuaaauaaaguuaauuucugauacugagcauacaaauuauagcuuucguaucagaacuuccuauauaaaaccaagguaucaguaggaaagcuugaucuucaguaacuuaaaaaguuuuaaaaaguuauuuccuccuuucuuuuauucaaaaacagaaagaaaauauuauuuuuugcaaugccuuguucacugauaccuagcuauacagauaacuaguuauguaauuuggggcaauauagcugaugcauguuuucuuacauguaaaacaauuaagucagaauuggugaucccgaggagucuuccuguuugaaauucaaucaaucuuuaaguacaauaaucacuugauaacaugucucugccccuaccaaaacccugucccaaucuaacuguaaguuaguuucuucucucuuacuuguuccuugucucauuuauuuuauuaagaucuguaaaauuaaaauauauuaaguauuagaguauuaacuaaagcucuaugaaggcagauauuugaucuugguaaauacuguaugucuaguaccuagaacaagcacacagaagccuccuaaacacugaauaagugaauuaauagagaaacugggcuguugaggacaacuaaauuagaauuuaucugacggcaaauccaagaaguuuaaaaugauaaacuugcaagauaaucuugaauaaucuugauuuuaaaagauguuauaaaugcuaaauauauuuuuacuuuaaaagaaauauaaugaaguacaaauauuuacacagaagcaguacaacauaacaagaaauuaaauugauauaaaggaaaauuuacagugaaacagaaaauguuuauaaguccugagcaauauuguuaucuuuugcuaagcaaaaucauuaacaucauaaaaugauuaaggugaauugauaaucuugauaguagaaguaaucaaauaugacauauuaaaauuuauugauuccaaaauuuuugaaaugcuucucuaccuuugcaguauuuacucagaauguuuccaauuauccaaaauuaaugccaaaaauauguaucuauaugaaaaccuaguaucacuguucuaagagguuaacuuaccaccugcuauuauuuagugucaguauagcuauuauuacaaauaacaaaaccuuuuuuauuauauugauacauaaaaggcuauuauuuaauacuuuagcaauaaaaaaguuacauagcuuuacauuacgaauacuguuuauugaauagucugggcauaugccaggcuaaacaucauauuaccuguggacuguguugauuuguuccauguggacuggugccagaaagaaauuucacuaauacaugaauuagguuuggaucugaaaccaacaaaugagcaguacucuccugaguuccaauggcacugcuggaaccagcuauaaaacauuuuuuaaaaaccucuuaagaaauggaccaugaaauaauggaaaugcaguaucugaaagcaucuuuuaguuccaaggaaaauucauacauuccuaguaauuacaguuuauuaaagggguuucaguuucuacuauauugacuaagcaggacuucccucucuaucuaccaucuaucucuucugcccccuucugauucugaaaacaccucgagcuuaauguacaucuuauuuaguacagucaaacagaaaagauauaacuagguccugacucuuauuuggaaagccuauucuaacuaacucccccuuccagaaacagucagagaucuacuuuucagguaaacuuuaaucaaguuuucuaaaauaaguuguagcaaaauuauuccuuuuugcauguuaguuguauacagguuaacugugaacuaacguacagguaacacaacaguuuucugagaugaauaaaauauccuuugcaugaaauccaccuucaguaucacagugaugcuuuugaucucauuuuuggaaaauacauuccaaaugaaaaaagauaauagcauuuuaaagcuaagcaaugauuuaaauuauuaaacaaaacccaggaaucuaguuaugcauguuuaugaauauaauaaugaauaaaucauuuuuaaguacaaagguaucuuaaaagaauaacauaaaaacuuagaugaaauguaaaaaccugccuuuguacucuaaaagcaaucaauuuucuuuuaaucaguuuuuaaaagguaaaaaauaugauuugaacauccaacgagacauaugagacuauauuaucaaaguaaacaagcacaaaggauauauaagaacuaauucagaagagacauguuagaagaaaaaacucagucacuuuuauuggagacagagucucacucugucaccuaggcuggugugcaguggcgugaucuaagcucacugcaaacuucgccuuccagguucaagugauuuucgugcgucacccucccaaguagcugggacuacaggcgcccacuaacuuuuguauuuuuaguagagauaagguuucaccauguuggccaggcugcucucgagcuccugaccucaagugauccacccgugcuggccucccaaagugcuggguuuacaggcgugagccaccacaucuggccaacucaaccacuuugacaaguauaccacuccuuggaaaacucuguuuuaagaauccaauaguagaacacuaaaguauaugucagagauuuaaaugaauaaauuuaugaacuuacaauuaagcugcauguuugucaugaguguuaggcuaugaagcacaaggcaccauguccggagcaaaguauugggauaccaagcuaacacugugagaaagcuaguuauugaugcuaugcagaaaagagaaagggaaaauauuuuucagaaaaacaauguuuaugaagaacuaagucaaaagaauaaauuuaaaaacaagacacuauuucuuuaaauccgcuccuuaaccagugucuucaaaacaugcaaauaaaaggaauucuccauuaaauacaacuaacgcauuaagaaucaguaacauuuuaggauaagguuuaaagcucagcccacaacaccugaaaugacauguuaucacucucaguauguuguacuuuccaaaccauaggcauuucuacuucaauacaauuuacuaaaaauccucacacucuacaaaacuggcaacugaaaacaguaacagauacuggaaaaacugguauuauaggcaugcgucaacacagccggcuaauuuuuguauuuuuuucaccauguuggccaggcuggucuaaaauuccugcccucaagggaucugcccaccucggccucucaaagugcugguuuuacaggugugagccacugugcccagccaggaauaacuauuuuuuacucuuuuauuuuuuauauauauuuaauauuucucauaauaaaauuaaaaacagaugaaaacaaauuuuauuauaauaauaauauaguugaagagauggaaaccuauaaauuaaagaagggcuggcuggugcugagacagugcagauguaaguagaaucugugcgugacucaguggagcuggcacucacauuggaaaauacaccauguaagacccaagcaagcuacaggaugccucacuauagagagaaagcaucaggaacagauucucauuuuuauuuuucuuuaaauauaacuaaaauagauuccuguagcuagagcugaacgcuaauucuuuuccuguuguauuauuuuacuaccaccauucccauacucauauuuugccaagaaacacacacaacuuccacaggaaacugaccaccuucuccagcugacuaacuccuccaggggcuaacucauaguuuuaaaaaaugaaaaaaaaaaauaauaaaaaacugaccugcuuuuacagaucagacaaaacuucaagaaaauauaaaggaguaacagaacauuguaaauuuuaguugcauacaggcauaccacagaccagagaguaggagucuucuauucucaacaaggucucccuguaucuuuccugcuaaucgguaaguuagugcaucuuuuuaaaaagguauucuguuuuuuccccacuagaauguuauaaccccuaaugacaaagauuagguauauuuuaaccuaauaauuacguuuuaagcuugcuauuuagacuauaauguuuuucuccuaauaaaucuuaccuugauuuaaugaaauaacagguauccuauuagcauuauauaaaaauaugucugcuccauuuucuuuguuuccaguugaacuagaauucaggcucagugugagccacaauuggagaagugacuccaacugaaaaagaaugaaaaucaacaggagaaaaauguaccuauuauaauaugaaauacaauuuaaacaaaaaucuuauguuuaaauucuugucacgaguaaauaaccuuuucuauuaaacacuucuucacacuuaaaagcaucuucuaguuaauuaaauuaguugaucagcaaacacaucuuaaaauucuugaagaaacaaaauuuaccugaauuaaauguuagaaauuaccucauaaaaagauucuucuaaauuaaaacaggugauucaagucauuuuuuuuuuuuuauuugagacaaggucugcuauaucuugaacuccugggcucaagccauccucccgccucagccucccgaguagcugggacuguaggcaugugcuacugcaccugguuaauuuuuuuuacuuuauuagagacaggaucuaguguuauguugcccaagcuggucucgaacuccuggccuuaagcaaucuuccugccucagccuccugaguagcuaggacuacaaacucaagccaccaugcccugugauucaaucucuaaucacagcuguguguauguguaguaggaauuaaaguacugaagcuaaaaaucuuaaaaauuaucaauguuccaucauugagaaacugugauuacuuugguaaucaaaguauuucuaauauuuuuccaacugaauauaauaaagaaaucaucccugacaggauuagaaugaacuucccaauuaguuucaucuuuuaccaggcuaacaauaauauguaaaaauacaccauuucuccugaauucauaccugaacaugauggacuugaagcauggaaaaaaguuuguugaaacaaacauuuaacauugggacagaugauaacuguauaauaagcuggcugguuugguuugcugcuuguaaacccccuagaagugaaucaucuguuccagugggagacugugauacugaaaauuaaacacaaguauaauuuuauacauaaaguaucaggauauguguuaacugguuauucauauguauaaauagguuaaauuguuuuuaaaaauuaaaacugcauucuuuagaaugguucaaaacaauauuuaguauuugaaaaacguguuuuuauaacauuacuugaaaguaaaaaagacaaugaccaaagagagaaguucccaaauucauaggacucaaaccaacaaaaaaaggcaaagaacuuuucuagcaauuuuuauuugcauuuuuuuccaauuaauaaaggagggaaaguaaagggaaagaaauaagacuccugacuaauuauugauaagguaguuuuagaauaaucuagauucuaguucauucaucuuuaaccuugacuauagauuagaaucaucuggggagcuuucagaaguucugaugcccagguuacacacaaaacuaauuaaaugagaauauauucaugggaaccagagaaauacaaggauacuaagagcuuuaucauauauuuagagccuuauuuuauuauuauacuaaaaagagagacagcugugugcaggauaaucaaaagauaaagaggagacaccaauuucaaacagauuuucuuuuuuauucuuuuuuuuuucaaauauccuuucagaauuacgaaaagauauucuaauaagugcuuuuaaauaagaaaugucuaacaaagaaaaggguuacuuugggcaguaccgaguuaucucuaaucaugcagacacuggacccuacaaaagggauccccauauugccugggagauaagauacaagaauauuuguguaccaauacugagauuauagaacacuagaccauuccuucuguuuuucuuuuuucccuucuuuugauacccucuaaagcaagaaacaaaugaagauugcagacugaaagaauucaauuuaacauaaggaagauguaaaaacucaaauuucucuauugaaauggguugugaacucuccauaagagaagcaucuguaauuuuauucgguucuaccuacuaucucuaccccuucuucacucugaccuagagaaggugaagcaauaugcaggccuaagaaaacaaaaaccagcacccucuucuaagcacagcuccccaaucuguccuugaaaaacaccgugcuauuucaacuguacuccuccgaggucuacccaguuccagacuuguguagaccucaucaaggaaaacaaaccguaaugugauggccagcucuggcaggcuaccuguuucuuguaacacagccauacccauucauuuacauauugucuauggcuguuuuccugcaaccaagucagaguugaguaguuucaauacacaccauauggcaaggaaagccuaaaauauuuacuauuaguccuuuacgaaaaaguuggccuuucuuuucuguagguuauuagguaguaaauccucucaauucuggcuuucaacuaacaggccuauuuggcugucauccuacacuauauucucuauccuagucuuuaaggaugauaaagauguuacuacaaaaaaucuacuucaucauaaauuuggaauagugcaaugaacucacaggcagguaugaaggcuucuguaggaauuuuauuaaccuuacaacaauacaguaaacaaaacacaauggagguuucugcacugaacugacagcacuacauggaaguauuuugcaugauacucucugcauuuguuaauccuuugucuuaguuuucaacuugcuacuaacucggagccaggaaagugcuacauacuaaguccccucagacucacaucauggaauuuaaaaaucuguccuugaugaauccaccugaaaaugaugaagagcugaaucauucacugcaauacucuaaaaauggucauuuuacuuacauguaggagauguauuuguuaaugccuguaaaauggaaucugccuccagaguagacaucauuuucaacaucaguucugcuugcuguucaaguccaacuucuaggcgagcauccagggcuacaaaaagcaauugaaagaaaaagaaaacauugacaauuauuacucauguccuaccuccuacaauaaaaugaugacaucugaacccaagagaggaugaagaguguguucuuacagaacagccaccuaacaugcaguaucggagccacagcaggggaagaauaucuguggaaaggaggguagagacaggcgauugguuauauagagacagaaauauuaaauaagugaaguaacaauaauggaaacaaagacauuaaggauaaugagaaccagguuucucacugucagaauaaagugcuauaaauacagacaagaagaaagcuaaaaugaacccuauggaguuagauuaaauccagauacacugaugugaauucaucauauucagaauagauagacagauacagaaauauagaugccaaguguguguguucacacgcacacacaaacacauacucccuagcucuguccaccacgaggaaaugaaaacagucccaaaauagcaacacauauauccaugacgaaaucaugguuuguuaaccacauuucuccuuuaaaagguuuugaaauaccaugcuccuuuaagaagugacuaauucccgggguggggcagauuaaaguaaaggaugagccugggcuaucauguuuugccagagaacaaggaagugcuaaaaugaugagaaaaucucaagggggauccuauuggucaaauuugagacaaucugaacaucaaaaaacagaugacaacauugugaauaucuucauuaacagugaacuauacacacacaaaaaauggucaaaauaauaaauuugccaggugugguacagcaugcuguaaucucagcuacuugaaaggcugggguugaaggacugggcucacccaggaguucaagaccagccugggcaacauagugagacccuaucucaacaaauaaaaaagaaaaauuuuauguuauuuacauuuuuccacaauuuaaaaaaaugguaagguauaauucacugaauaaaaaaaggcaaccaugaguccguucaaaacugaacgaauaaacuauuacaguaauuuuuucuuucuuucuuucuuuuuuuuuuuuuuuugaguuggaguuuugcucuaucguccaggcuggacugcagcagcacgaucuuggcucacugcaaccucugccccaggguuauagcaauucuccuaccucagccucaguucccaaggauuacagguacccgccaccaugucuggcuaauuuuuuuauauuuguaguagagaugggguuucaccauguuggccaggcuggucucgaacucuugaccucaggugauccaccugccucggccucccaagugcugggauuacaggcgugaccaccgcaccuggccaguaauuuuuucaaaaagaaacuuugugaggaacaggauaguuauaguuuccgaguaccauucugcuccccagcccccaaaaaacuuuuuacagcagccgggcacaauggcucacaccuuuaaucccagcaauuuggaaggcugaggagggcggacugcuugagcucaggaguuugagaacagccuggucaaaauggugaacugcuucuugauucuaggaggcagugacugcagggaacugaaaaucaugccacuacacuccagccugagugacagagcaagaccauguguguacccccaaaaacccaaugagaacaaaacauuuuuacagaggggaaaagaauaacuuuacaagggagaagcccagaagacaacucauucaucaagugguuaaacuuaacaucaccaauaaugagagagaucaaaaucaugggccacccuaauugaaugaaauguugggggggagcauuauuuguggaauauuccuucgaagaugcauuaacucaauauucuauucacaaggaaauagcauacaaacacaaacugaggaccauucuacaaaauaacuggccugccaucuucaaaaguaucaaugucaugaaggucaacuaugaggaacuacugcagacugaaugagacuaaagagacgugacgauuaaaugcaaugcauuauuuucccugggcucuugugcauaaggaacauuauuuugacaaccgcuauaauuugaaugggcucucaguauuugacagcaguaacguuaauuuccugauuuugagggaauauacuucuugauauguauauauggaagaauguccugauuuguaaaacaaaacaaaacaaaaaugacaucaaauuaccaacguacucucaaaugguucuagagaauaaacauucuccgcauuuaacuugaaacauucugguaaauguguguuucaaauuuuuaaaaaauauuuuauaacagaaggagcagcguugaaaagggaaaaaauguauuuuauuaaaaaauuaaacacaucucauauauucuacaugacuaaaaaaguguaaaaauaaagccaggcaugguggcucacuccuguaauccaagcacuuuuggaggccgaggcaggcagaucauuugaggucacaaguucgagaccagccuggccaacauggugaaaccugucucuacuaaaaauacaaaaaauagcugggcuugguggcaugcaccuauacucccagcuacucaagaggcugaggcaagagaagccccucgaccugggaggcagcgguugcggugagaugggaucacaucacugcaccccagccugggcaacagaacaagacuccaucucaaaaaaaaaaaaaaacugcaaaaauaauacuuauuuaauguaguuucauucucuuuauaaauaaaauacaaguuuacuauuaaagucaacaauuaaaauacagcacaguucauuaaaaucauugccaaucccauacaacacuugcuagguguuauucugacagagaaccaaaaagauagaaguuccucuaaagugacuacaaagaaacagcucugaaugguacucacggcacagcugugauacuaaacccacuggcauacacccaggcucaacuucucaagggacaaaguauacauaaaugacagacuuguuuuaagaauagcauaugucuuaaaauauaaacauacacuuacccugagagacugaaacgcuaacugucugugauccguucuucuccguguuugcugguggcuuugcuacaggaauucccagaccuccaauguaaggguuguaauuguaggucccauaaucagcaccccaauaaucauaccauguacugcuuauuggcuuaaaagaauggaaaaaaaacugugguuuauuuuugccucuuggcugaaugacacguuauuuacauuaucuaaacccaaacagaacuacaaaauaaauauucuauccacccuuuaaauuucccaaauccccuuauaauuuuaaugauuuauaagaaugguccaguaauuuucuccucacuuucugccaaaaucuaaaaauaccuuauauguuuagaaacugaaaguagcaucccuaauaaaaucucuuauggaccaaagaacuguaccaccauaaauuauuacaggugauucuccuuuaaaaaaaaguaggcuaacauacaaguagacucugcaaugaacacagcucggaugaaguuuagauggcugucugaaauguuggugaucuauaacuauacuucuguauacuuaaauguaguucucauuauuguaugauaauuaugaguagcuacauuaauaaaaauguaaguuuucuuuauacuauuccauugauuguuuuuaaacuacaauaguaguaccuauagcaauuucauuuugaaaaugcugaauaaugaguugcauuagugguaauguauguauauuuuccucuuuuaaguaauuacuaagccaaaaguaugagacugaaaacuucccuuucaaagaauuuuuuuuuuucuuuuuuuuugagacagagucucguucugucacccaggcuggagugcaguggcaugaucuuggcucacuccaagcuccaccucauggguucaugccauucuccugccucagccucccaagcagcugggacuacaggugcccgccaccacguccagcuaauuuuuucuauuuuuaguagagacgggauuucacuauguuggccaggauggucuugaucucuugaccuugugaucugcccaccuuggccucccaaagugcugggauaacaggcaugagccacugcgcccggccuccuuucaaagacuauucucauguaucauaccuuaaaaaccuuggcugcaagaggguccuuuuccaaaucaauaucuaaaggaucaaugucaacuuccauuagauccugaaguaacucaaggucaauuucuuuaucuuuuuccaaagaggacagaggaggugcaccuucaaauaauuaaaagugaucuuauugguggaguguaucacauaaaauuuagaugacauaaugcuuuuaguuaaaaaaaguuauuuuacuugcauguuacauaugccuaaaaaaaaaaacucuauguaugcaaacauuucgcuccauaauacacgauaaaaacaaagauucauugauauuugcuuuccuagagaaaagaccacaguauuagcucuuauugaaguaaguugcauaaacuuugcuauuaaaaauaauuaccaacauuacuaaauaauauacauucuauuacaucuaacauguaauucauuauuacagguaauguuacccaguauuaaagagaaaagcaaacaggacugaaguuguaagaaugccauuuaccggccaggcaugguggcucccaccuguaaucccagcacuuugggaggccgaggcagguagaucacaaggucaggaguuugagaacagccugaccaacauggcagaacccugucucuacaaaaaauacaaaaauuagcuggguguggugguggccgccuguaaucccagcuauuccaggggcugaagcaggagaaucgcuugaacccaggaggcagagggugcagugagcugagaucacgccauugugcuccagccugggugacaagagcaagacuccgucucaaaaaaaaaaaaaaaaaaaaaaaaaaaaaaaaaaaaagccauuuaccuuauuuuucuguuaugaauuagaaauuauugucucucagaugucuccaaauuuuuaaguagcuuucuuauaacccuuauaaguaccccucuauaacucuuacuuuuccaucauuccuauccucuuauucaacauaacuuuauagaaugccuaguaaaugccagccuguaugaggguuugaguauaaguacaugaagauuaauaaaacucuccaauccaauaaauuaagagaaauucagaggugggggugcacuauaauuaaaacugacuacaacaugauaugugcuagcagagauauuugagagcgcaagggaaguacagauggcaaagucccuaacucugcugggaaugacagaaaaagccucuuagagaaaggcacgcuuuaugugaaccuucgauaacgaaguguucaucgugcacacaggaaaucuacuccagauaaagagaauaucaaguaaaaaauagaaaaucaugagcaaacauaagauuaaggaaugacaaaugguugaaaaugacugcagcaucugacauauacagauuaguacccaaaacagacuuuugaaaaguaagggguauggagaugauaaaggauuauacaugcuaauuuauaaagauacuuuuuaaaaaggaaaaaaaaagaaaaaguaagaaaaaaauacaccaaaaaaaucacaugcuggaucuuaaagaauaagagcuuuuaaaacugcugucuucaucacuuuguauuuuuacauguuuucuacauugcauuuucuucaucguugccaaaucacacuauaucaacauaauuaggauauuaugaaauuauagcauuuuguuguaaugagaaccaagauaaaauguauuuaccaggaaaauaauggaucuaguuuauaaggccaaagaacuaauagaaaaauauaaaaaucaacuuuauuuuucucuaacauucuuuauuuugaaacauguuuccauuuaauagaauaaagaagaaacauaauguaaaacuuuaccuguuaugucaugugucaaagguucaucuauaguuuccagcaacugaacugaggacuguugaagggagucaucagagucaccagcugucgcaccuacaucaucacccacuguuccuuccuccauggcuucugcggcuacuggagccaguaauucuccuguauguaaggggauaguccuguuuuaauaauuuauacagauuucgaaaauguauuacagcacauuuuuuuccuccaguuuagucacugacagaauaaaugcucuacuaacuauaaaagaaucugaggcaaaugaguucccacccccguaaggaaugcuaggacucacuccauuacuuucaaaugcuagagacaaguauccaguaaacacauaacauguacaaagaguuauuuuaauuacuguacauacauuaacacgcuuauucauaaaaacaaccuuauacaaagauuauccuuauuauccuuauguuauauaugaagaaaaugaggcaaagugauuuccccacccaguaagcagcauaccacugauguuaauaauaaagcaggcuagcuccaauauucaugcacuuuaacaacccaaagccuuucuaaagccuugcauuuaucgcgacuaucaauauacuuaaauacaaaaguaauuuucaaugguugcuacugcuauaacaucacaccgauuaaacagaccuuuaugcuuuuaggggguuaaagaucccucuagggguuaaagaucccuuugaagauucuuaguugagcaaugacaagguaauuuugacauacucuaugaagaaaaauccuaacacaccugcuaaaauaucuuguagcaugcaaguuaaggaauacugagcccaagcaccaccccaagauauaucuccucuauugaagucaguuccaaccaaaaguaacagcagucuuuccagcugggguucguucacaaucucacacagaugaauaguuggccucguggcauuugcaaugcgugcaagaaccuguaauacauuuuauaaaaucauacacuuaaauagcaauuacauguuuuuucaaacacuaacagaagucuaccaauacuuuagcacugaacaauagguuucaacaaugauguaugagucugguaucaaaaaaaauugcuugagauggaaugcaaaaaagaauguaauuucaugaaucaaauauuaaaaucugguuuaagaucuaauuguauaguuaagaauuaaauuucuacgaacagugaauaugccacagaaaagcaaucaugacauuaaaaguccuucuucuuuuuuuauuuuuuugagacagucucggucugucgccaggcuggugugaaguggcgcgauuucagcucacugcaaccucaucgcccccagguucaagcaauucuccugccucagccucccgaguaacugggacuacaggugcaugccaccacacccagcuaauuuuuguauuuuuaguaaggacggguuuucaccauguuggccaugauggucucaaucucuucaacuugugauccgccccuccgccucccgaaguguugggauuacaggugugaagcaccacacccagucaaaaguccuucuuuaauauaauuugacacuuacuuguguauuuccuauuuuaauuaauauaagaaaggcagguuggagauaaacauauccacauuacuuacauuucaaacccucaaguuuuaaauaaauuaaaauauaaaucagauuuccuuaaggaaaaauuugaaaagaauuuuuuucaucuuuuaagacacaauaaaaaaacuaacugcaaaaaagcaaaaccaaaagaggcaucauuucucuuaaugaaaauugacuaaaaacaucauccuuugcuaguuuuuaauuaaccuauaagucacuuuuuuuuuuuuuuuuuuguagagacgggguuuugccacauugcccacacuagucuggaacuccuagacucagauaauccacccaccucagucucccaaagugcugggauuacaggcaugagccacugcgcccggccaacccuguaagucuacacuuauaguuuacauaccuuacaaacaaacaauaagagaucugcaugacauguaaaguccauggagagaagaaacagaacaaguuucuggacuacugagauacaacgcucaugggccagaguaaauggaagugguucuaucucaggacuuucuuuugcuguuguaacuucugugucuaaauuagaacgggaccauucugcuguccgacguaaacgaauuaaauccuuaaagugcugcacacaaaaauguauaguguuuaaaucaauguuuacuuaaugaaaauuuuuucaguauagauuuauguaaugaaaauauccacuccauauuacaacuucuaaagagcaaaauuuuuagauacacuguaaguuucaaaaguaagaauauuaaaagcuaaacugaccaauauaccuuacuuccuauuuggaguaaaguaucagauauguaacagaguuucagaaaagugaaauucuacagacauucaauguagauaauauauuaaguuauuaagucaaaucuaacaacauaaauauuaccguaacauccuaaacauaauuuguaaaagcuugaagguaaagaaaacuaauauaacaucaaguacaaaauauuaauucgaguuacuucaaaaucuggcggaauaaucauaauuucauguuauagaaagacuacaaacuuguuugauacauacacgguaucccucaaaauuuuaaaaaguaaacaccaagguuuuaaaacuuacaaaucaguugaacuucacuuucacuuacaaaagacauacuacauuugagccuugugagcaccacuggacccaaagaaguuucaauucuaaacucagccaccaaaauauuccaauaacaauacuaaggguaaagagaaugccacauuuuucacuuuacauauacauuuuauuugugaggcugauacaauaauauuugcaaucaucuuguauaauuuuguauuguaaaauggaaauaaacugcucuaucaaugccacauuagcaaaacuauacauuccacuauccuuuaucuucaauuuacuggaacucaauccacaaugaagguaauacauuacaauaauacuuaaauaccacauuuaucauacauuuccuucaguuaaacuaccccaccaaaaaaaaguccagaguagguuggcuucucuguuaagcagaguaauguauauuuaaguuucucgaucguaauuaaagaucauaacuccuugacuuuucugagauaacuauauugaaaaguauagaucauaccuuugaaguggccugcuuuaguuuugcuuguucuaccaggaguuuauaugaugauccuuuguuacuuuguauuuuuucuuuuuccaucuguucuaccaaugccuucugcuuugcuuuuaguagguuaaguugcuuuauaaaacaaauaaacaacuuaaucuuuaacaacguuaaaaacaaaaaaauuauuauacuccucacagaauucauacaucaaacuaauggaaugcacauuaucuugaaagauguaguauaauuuuaacugugaugauaauuuuuuaaaaaaucauuucaaauccugacuuugagaucucucccuguuuucauuaaaaucucccuuacccaugggaguaagaaauaacuggaagacuuucuuauauaagccacuaacauaaucgagcgauauauauuuuuuaauagagagaaaaaaauuuacuuuuaauuaaauaaaugagaaaaauauuuuauugcuuaauauuucuuagcuuuguuuuuauggaaaucucaagaguaguacacauuuugguaugucuauauuuuuuauuaaaauuuggauugagaucauuguaguuuuuugcuacaauguagcuuaagaaauaauuaagcuauauauaaauaaauuaagaaauaauacagaaaucucuuguacacuuuacccaauuuucucuaaugauauuuugcaaaaacuauaggauaauaucacaagguauugacauugacagaauuugccaaccuuauuuuuccauuuuuaguugcacucauuuguguuugucuguguacguauuuaguuggauacacuucuacauguguuaguucauguauccacaacagucaauaccaaaaaaugccaccacaagguucccucauauccuuuuauaaguauauccacacuucccuccuauccuaucucccccaucccuaaacaacagcaaucagcaguugacaacaaugaacaaacagaccaaagaagagaaaaaacucucuguucauaaagaccuuacaaucuggugacuguguucuccauacagcauguacacagaaaguuacuuuaaauauaaaguacuagaaagguauagccacaauuauaaaugaauaauaauugaguuagcagcuuauuaagucuuccuucucagagaacacuuucuaaauuacuacuauugacacuuuuuuuuuuuuuuuuuuuuuaagauagucuugcugugucacccaggcuggacuaguggugugauaucagcucacugcaaccucugccucccagauuuaaggauucuccugccucauccuccugaguaacugggacuacaggcacacgccaccacauuggccaggccggucuugaacuccuggugccaacugauccacccgccucaaccucccaaagugagcccugccugacaccuguuuuugguaucaggaaaaaaaacaucacuaacguuauuuuuaaaaauccacuuggcuguuaucuccauagaugaaaaaaacucuauccuaaauuaaaacuagcauguacacauaauuuuuaaaacguuaacugagaauuucuacaaaucaguauuuucagaaaauaauuuccaaaguucuaccauuaacguaugcaagaaauauaaucaagaaaaaaaucauuuuuaauuuuuucugaaacagccaguuuuaauuauuguacaaauacaacuaguuuucacuaagccauuuggcaguaaguuaguaaccugaugacuaaucgcccugauuacuuucguuuauaauuccuagaaauaaaaaccuucuacaaaucacaguuacaaccaucaaaaugagagaaguaauacugacaccugaccaccaauuaucccucaaggcaccuuuuaaguuuugccaacugucccaauacugucauucauaaugaagaaucaaauaaugauauuuuacagacaaauauucacucagagacacacuagguuuuguuuuguauccuaauuaaaugcacugaguauaaacauuaaaagauacaaauuacuacuaccuaaaauugguuaaaggucucaaaaagaaaagguaauugaggaaaaugcuucucauuuuuccugcaaaggauugaacuagcucauagcugaaaaacuuagaagugaaaaauaaaaaacguauugccaagucuaccuuuaaaaaaaagccccauaaaucaaaaaauuuuuuaaauauaaaaaacaaaacaaaaaauuugaaaagcccaaagcuuucacaacaugccagagcuaaggauuuucauauagaaucuucuuacaucuuaaagcaauaauaaaaauauuguguggccggacacaguggcucagaccuauaaucccaacacuuugggaggccaaaguagaagaaucgccagagccaggaguuugagagcagccugggcaacaaagcgagaccccaucucuacaagaaacaauuuacaaauuagccuggcacuguggcacacagcuguaaucccagcuacucggaaagcuaaggcgggaggacugcuugagcccaggaauuuggagacugcagugaacuaugauuguuccacugcacuccaaccuagguaauagaaugagacccugucucaaaaaaaaaaaaaaaaaaauacacacacacacacacacacacacacacacacacacacacacacgaaaaaggagaaaaaagacauggaaaaagaaaccaaaauuaaaaucuggaagcuagauagaggggcagaagaugaauacccugaagccauguuaaagaguuugaccuucauccaaaggucaaacaaaagccacagagaauuacaugaaggaaaauggauugaauuaaagcagaacaaaggaagagagguuuuuggacuaggcaaaagauaaugacaaccucauuuagaauaguaguaauagagauguauaacaguaaauguuaaaggaacaucaacaaagucuguaaacuauacauugucgucauuuuaacaauuaaggaaauugaagucuccaaaguguuagaugauuuuccuaagcuaagagcccauuaaauguuauaccucacaucugauggcacaucugucucaugcaaacuccaaaacaauauucucaaacauuaaaaauuuuuaaauauauugacaauuaccuguuuaugaugaacaagcugcuuucugauuuuucuggaauauaaucuaucaaggcuacugcugccuuuagaagaucuauuuaagcucugaguguguagauuauuguuaauaaaacuccacugauuaccuacaggcgaaggaaaacuuguauuaauaauucuguuaaaugugauuuuaaaguaccuuuccuacccagaaaacaaaaaacacaguuauacaugugucaaucaugaaaagcaguuuuaauaagaaaaacauuguaaagaaauugcuagaagaucugauucuauaaagacuggauaacugucaauuaucuaauguagacccuaaaucauuuuaaaaccagaguucccucugucuccaaucuuucauuuagauaauagcuauuuuccuccgcaauuaagauuaaucucuauacaacuuugaugaugucauucaauuucaacaacaaauacuacuauugccuauuucaaacacagacgcuuuuaaucaggaaccaaaaaaggauacucaauaauuuaacuaauaacuaccaaaauaagguuaaauaguucagaacgcauaacugucuaacuauacuuacucuccuuuuuuggaauauuuccagacuauucuguuucauucaauuugggcccaauaacacacuuuacacccauuuccaaucccaaaacaucuuuuccuaauccuaaaaacauuuuucucucuuuccuaccuacuuaucaaaucuuaguucaaguucuucaaacccuaaaacucuuccaccaauguuuccauaguagccacauguauaaacacaaucccaauacuguuauauuccaagauuacauuacaguuuauuuuauauuuuucuuuuuuucaagacuguuucucagccaggugcaguagcucacaucuguaaucccagcacucugggaggccgaggcgggugggucacuugaggucaggaguucaagaccagccuggccaauauggugaaaccucgucccuacuaaaaauacaaaacaauuagccgggcguggugguacacgccuauaaucccagcuacuugggaggcugagacaggagaauccugugaacccaggagguggugguugcagugagcugagaucgugccacugcacuucaaccugggccacagaacgagacaagacuuucucaauaugaauguaguuuuauuuauguuaauuguauuucuuaccucuauauccuacaacugaguaaacuaaucauagauauacauuauuuuuuaaaaaucaauauaaagcaaauuccuuauacauaugaauuccccaucaucuuccuaaacauaauaugcacuauaaacaacugauuccacuauaacaucucaagggaacucuuaaaaauacugaguuccugacaauguacagaauuccaaauuuuauggauuucaauggcuuacauacuacauguaagccauauguaagcauauguaggcuuacauaucucaauggcuuacauacuggauuuagguaucucaaauccuuuauuuaaaaacccuuauuuucagaacaagaaucucugaggaaaaauaaaaauaaagaaaaauaaaaagccuuguuaacugggaagaggguaauaaaauaauguugcagguugauuuccuuuaauuuuuaaauuuuucugugcuuugaaccuauaaagaaagcuuacaacucaaaaucugagaauuucuguauuuaaaaauacaggccauuuguaguuaauuaguagauaccaauaaugcuaaaugaaaugacacaucauacuaagaaaaaauaaaaacucugauuucccuuucauaacuaacuuacaugcaugcuauuauaaagucuuuaaacaagccugagggaagacaccuugcaaaagucauagcugcauuuagaaacuaaaagucauguccagacaaaggagcuugucuauaaaguccaccaaguauaaauguuaucuuuaaacagaauuguagugaaguucauuuguauuuuccuuaaauuacauacagcugguagcuccaggccaauagccaguucuggaacaacugcgaagucacucaaaauccccaccaacauauuauuauaaacuucugauaccugucagaaaccucucccugucuuuaccauucaaagguuucuuugcagcugcugcuucaucuucaacaguugccacauaauccagcaaccuggacaccagcauaacaacccaacugaucaugggaauaucuaguacuccuggagagagaugacagcaaaggaaaaacauccagaugacuuuaggauuccuaauuagaucugauaauauaagugaaacaaaacauucuauaaauccaaaacauaucuuaucauuacuaacacuaauauuuauauguaauaagucuaaaaaauagacaccaacagccagaaacugaguagaacaucaaaucuaaugaaagacaaagacuucaagguauaagaacagauuaagugcaggcugaauccaaaauggacuauauaaacuagaaagcaagguauaagauacuauucuuagauucacaggaacugaaauaaaacaucuaacucucaacuuauaauucauauagcacuaaacuagguucuaauguuuuuauuccuauaaaaaaguguguucaaacaaaacucauuauuguugaugggaacaacaacugugccuuacagcucaaacuuauguaagggaguuugacuuuaguuauaauaguacaggaaaaacauacuauacuaaguucaaauaaugaaaaggaauaaauuuuaaaaguauuaacuauauggcagucaaucacaugaggguugcucauucuuaaaagcuuacaucauaaaaauauuaaaugugcugcaaauaauuauuaaaguauuucagagaagauauuuuauaaaagaaauauuugcaggaauauuguuuuuacuaaagaacacugcuuucucuuaauaccuucuguccuccuaugcauggguaacuguggcugaagaggugacaauaaauuauccaagagauuaaguaagcuuucuaauacuccacuauuacuaagugaucuuugaccaaugcaggaaaguaacaugaagacccuaaaaacaaaacaaacaaaaaagaaaagaauaagaaucaauucgauuguucaauuuuuaaaauaauuuacauagaaauuuaacagaguaaugauagaauauuugcuuucuuaaaacauaccauauuucagacugggaaagcaagauuuguaucuggagguaugaagcuaaaauuaguuuuuuuucuaacuacugguuacauuuucuaauguuauuaacaagaaaucaagcacuuagugaaugagagaauuuuauuagccacaaacaaacacauuuagcauauaaagcaacauaaucuaauagaaauacuuauaaacacagaucuaugaaguccacaaguucaauuagaaaacuaaagaguagacucuaauuaucacuuauuaucuucuucgauacacagugcuggugcccuucacuggucauuucacaaacucugagaucugcuucauauucacaacuuaguauccacauuucaaagauuucaaaagcuaaccaguaacugugaaaaguacacaucauuaauaacaaauaccuccaacauuuucugaccuaccuauccuguggaaagaugagaagcuguuccgaauuguacaauuccugaaggacauuagaaagaaauugaccccaccaccuuucaccaccacacaguugaacaagaagaagaccaguauguaaccguaucuuugggguuccacugaugcacaaguguuuaaagagcucuucacaggccugggcaugaaaugugcucugcaaaacugcaggaacagaguguccuauuacaagaaagaaaacaguaaacuuuccuauuuaaauguauuguauaauauuaaaauacgcaugccuaaauacacuuuccucuuuucuaguaaucaguagauaauuauauucuauuuauucugcaauguauuuacuccuuguauguagaaaucuguuacauacuuggagacgaaaauauuuagcacuuaaguaaauuacauuucuugccuauggagcuggaugugucagauggcugugucagugaaugugugagcucguguaaugaucaaaaauaccuccuggcuagaaaaugauagcucuauauuagguuagcaauuuaugaaaaguuucacuguucaacuucaaugcaauacuuaauacuuugccaguagcacaaugaugugcaugucaauaccagaaacccaaaaaaaacacacacaacuucauuuaagaaauguuuaaaauaacagggagaaauagauuaaccuaaagagacauuucauaaauacugacauuuuuuaaaauaccaaaauuuacaauagaaaauauugacacagauccuaaaacaugcagcgaaaucacaucaaguauauucccagccuuuaaaauauguaagccaaauacaaaccauuagaagcaugaagcaggcugagcaaaguguccaguaaauaucugaugauaguacguaacugcucuguggaagaugucugaauuaaaucuucuggauuugauguuucacucaacaucuuccggcuugcaccuagcgccacuuugagccucugcacugcauuaugagccaaauuuaguugaagcuguagcugaauacaaucuugauaagcagaaaaaacccuacugucuuccucaacugccuuaucugguuuucguaaaaaguacugugcauuguuagcacuguuuagaggaggaagaucaauacuuugcaaaaggguuuccagacgaugacaagccaaguuauaccuaaaguaaaaaaagauugaacaaaauaauucuuguaauguccucuuuauguacauguacaaauacuaagaauuaaaucucuuaaaccuguuaacauacaaccauuaaaaagaauuacccacuugauagguacuaauaaauggagcccauuaauuaaucacaauauuuucacgcauuaaguguuauuguaacgugcuaaucuccuacuuccucuugcucucuuaucuguacaccuaugaaaagacauuucuugacagaauuauaagcaagacauuauauaaaauacaaaguuucaauaacauuaaaauuugcacucuguacuaaccugcacuguauauccuccugcaaagcaaccaucauugcuaaaugcuggucaauuucuggcugguuugcagauucucccucucccuuuagaggaucaugcauuaacuucaguucacuuucccaaggcaagauguagguaugaccauaguaaaauccuaaugggauuuuggcucuggcauuuguacucccguaacguccaauaacagugaucugaaaugaaaaauuauaaauauacauauauacacaucugccacaauaaaaaucugagcaauguauuuaaaaagauaguuauauuuuuuaauuauauauucauuuuucauaacuugucagaaacauagaaagcguaucaauuuacuuucuuaaaguucuuuaccuucaugaaucugcacacgggaggugguauuaagucaugaagaauuagugaaugagugcuuauaucaguugccacuaccaaccgccuuccauccaccucuucuccuaauguccaaaugucaauugacaaagaggccaagucuccacaagugggaaucaauacaucagucaacaauauaggccucccaaaauccaaggucacaaaucuucuugcuccuaugagagaaagaagaaacaguugaccaaaaauauaucaauuaaccaaaugauacacucaaaaauaauuuggagcacucaucuuaaaauaugaaagcaacucacuaaacuauaaauaagaggaaaaguaaauauguaaaaauggccuugucaauugauucaaaaauuuucugaaaucccagucuguguuaguuuugaaccccaagacguaaguagaaaauuaagaguagcugggcacaguggcaagugccucuagucccagcuacugggggaccugagacaggagaauugcuugagccgaggagcuccaggcugcaauacacuagacugcuacugcaccugugaauagccacuauacuccacacugggcaauacagcgaaaccccucuuuuuuuuuuuuuuuuuugagacggagucucgaucugucgcccaggcuggagugcaguggcgcgaucucugcucacugcaagcuccgccuccuggguucacgccuuucuccugccucagcaucccaaguagcuggcacuacaggcgcccgcugccaugcccggcuaauuuuuuguaguuuuaguagagacaggguuucaccaagcuagccaggauggucuuaaucuccugaccucgugauccacccgccucggccucccaaagcgcugggauuacaggcaugagccaccgcaccuagccacccgucucuuuaaaaaacaaaaaccaaaaccaaaacaaaacaaaaaaacaacaguaagacugcuacuguuacaguuaaggcaaucaaccacuauacaaacaagcuucuuuaaaacaucagaguuuuaaaaaauuaaaucagcaaaugcaguauauuaguuaauuuuguaaaggaucaaucugcucuucuuucagccauuggcaacuuuuuuucuuaauuucacaacuagaugcauuuaaauaccaaauaguauuauuugauuuaguuuccuuaagcccugcuuaacuuccugugaaguugcauauugcauucauugggguuuagauccaaagugaaagcaggacuacaaucauauauaaucaaaauaccacugaaaaaggccuugggaagguccucuaauggaucucaaacaaugcuuuuucccaguauagacauaucccagucucuucagcucaaugccagaugagauagguaaagaaaaagcagauuuacaucccucauuucacccacauuacaagaauaaguucaauuaaaaaacagaaggcagaucauuaauaaugucauaauucuuuuucuuccuuauuguuuuggggugggucagcuaguaaucuuaccagcuacauuuuauagugaaggaaaacaacuaaauuaaacuucuaggaauagugcuauucucgacagagcuaguuuaaaagaaaacaaggcaguuacuaauacuucccuaacaagaaaaauuauuaaaaaaaaagaaagaacauaguuauccuccucaggaggcuuauguacuacagucauugcuauguauaaaaaaacaaacuacaguguaaacaacugcucaucucccauaagacuucagaauaacaaauuuccacucuaaaugucaucaacacuaauguuguuaccaaugaaugauuaguugggcagaaaauacuguaagacuuuuauuuuagcuuucaaacucccucuuacaaagaggaaacaaccacauugcaagaacgcaaauacuauuuaauucuucauauaaugauacaugcuacaguguauacuauaaccauguuauuucccugaggauuuuguugaauucuacugcugcuaaagcacaaaaauguuggugguaguuaaaaccaacuguuuuaagagaaaaguugccuagaguuuauucacaaauauguugugauugaaagcaucuaucccaaugucaguucuguagcauauaagcagaagacaaacucagguaacauucaaacuauucagagccuaggauauguuauuauucuuauccaguuauuacaguaagcaguaguucuguuugcucuucucaagaaagaguucuacuauaagaaggcuaguuuuaggaauauuuugaguguaauuucuaguauaauggugauuugaccaacuacaauaaauuauuuaugucaauaauguaucagcaggcaagauucauauauagaucaaauccauuacucaacagcacucuuuaugcaauuuggugagcacaaagcuugaacauguaagugcuuauucuugauaaaauguacuuaacccaagaggaaacgcgauuugcaaaaaaaaaaaaaaaaaaaaucgaacugaagaauaaugagucuuuaaaaggccggcagacuaagcaaaaaaaaaaaaaaaaaaauuuaagaaaguaaaagauuaccugaaugcauucgcucuauaauaauggacuggugaggcggagguugaagaaaaugugaagcaugagaaauugcaagggcuagaccagaaccaaguggauucuagagcagggaaaaaaaaaaaaucuaacuuuauauugauauuacuauaguucuauaaaaacuacuaaccauaauagcaaauuaauaaguuucuucucuuaauguauguacuguaauauuuuauaaaagaaaauaacuugauacaucuaguugguauuaaaaauuuugccuucuaaaguuagaguauauuucaagauauuuuuaaaugucuaagccaacaccuauuuaaaacauaauuuaccauucuggacuuguuggaauuuuuguuaugugcagcaagauugacugcugggggaucaaugacugagccugggaaaagcugugcaaguucggcauuaaucacaacggaaacugcuucauuggguggagugagugguggagucauaaaaagagguguuguuuuuggaguggguggaauaacaucagauggaugaaugaagaauccaggggcagccacuggguuggaaggcacagaguugugaacaggaccuacugcugaugcugcugcagcugcugcagcuguugucugauguaacuuggcuuccagcuuugcuuucugcaaaagaaguaaaagcaacauauauagacuaauccugccuaccuaaauuguggcagaauaccacauggacauauauuaugaagauaaacaugauuaaauugaucauacuuaaagaugaaauuaaaucaaaacuggacucgauauaaauggaucauugcuuugcuauauacacuuuaaauguuuaacacaaaauuuccugugcauuugggaacuaggacucuuucaagguaguggugaaaaggaagcagaacaauuaauguaaauaaggaauaucugcucaaaacaaaauauuauaaggaguugaauucucauguugacuaauguaauacaauuugucaccuggaauugccaaagauuucauuuaaaccagcgguccucaaccuuuuugacaccagggaccaguuucauggaagacacuuuugccacggaugcggggagauguggcagaggcgcaggggacugguuucgggaugaaacuguuccaccucagaucaucaggcauuagacucucauaaggaacaugcaaccuagaucccucacaugcacaguucacaauaauguucaugcuccuaugagaaucaaaugccccugcugaucuaaaaggagauggagcucagguggugcuugcuugcccaccgcucacaucuugcugugcagcccaguuccugaaaggcuauuuauugguacugguccauggcccagggacuggagaccccuaauuuaggccacaauaaaauuuaugaagcaucugucauuauuagugaauuuuaagucacauuaaauuuaacuguucuauaaaauuuuguuuuaggaacuauacuccauauaaauaguaacuaguaacuguacauauucuuugaucgaguguguagagaauggauuuacuucaagauugcacaaaaaauaucaaucauauucccucaaauauguaucaaauaagauguauucauacaauuuuaaccaauuuaaauaucacaaagacuuuaccucaauuuuuguugaaacugauuagcucagaucagucaaccuacguuucuuuaugaaaauaauggucauuuuuaaaguacuuuuucagcuuuugaaguuuagagacagcaugaacaaagagccaaauagucuccaaccuguugcugaagcuucaaaagcugcugcuguuucucuugcagcaccuguagcuguugcucggcugaagccauugcaugagagagagacugcaaagcuaccugggcugcugaacucagggcugucgaggcuuccccaacugucccagaugauaguccaccuacugcaggaguaaccccgaaggaacucacuggcauaagacaagggguaaaaacaaaaacaaaaaacaccaggaugaagaaaagguuaaagacaaaacauguucaaauauuuuggcacuauuaugaugcuaaaacuauaguuaauuuucauucuaaaaaagaaaucuggaaaguauaaauaaggaaacaaugguaaaauaaaguauauugauaauacuaucauucaagaucuaggaaauacaggaaugacuuuuuuuuuuuuuuuuuugagacagggucucacuccgucacucaggcuggagugcagcggcgugaucuugguucacugcaaccuccacgucuggguucaagagauucuugugccucagccuccugaguagcugggauuagaggcaugcaccaccaugccuggcuaauuuuuguauguuuaguagagaugcggucucgccauauuggccaggcuggucuggaacuccuggccucaagugauccacuagccuuggccucccaaaggcugggauuacaggugugagccaccacgcccagcccagcaaugaugaguuugcaaauaucuuuguuauaguaaagugaucauuaaaaaugaaaguaaucuuauuacacaauuugaggguaagaaauaaauuugcuuuacuaaguuuucuuauugcaacaacacaccccacuucaccuaccaaaaggaccccagaacaccaaaauggagagaggcauaucccacacacaguaaaacuagcacacacuucuuacccaugaacauuaucaguaauaaaggcucugugaaacccuacaacagauuucuuugauuuuccauuucauuguuauucaaacaacauuauaaauaauucuuucugcauuguuuuccaauauuuaugagaaauauauuggaaaagcugggauaaaaacuucauuucacaacuuaauccaauaugucagcacaaaacaaaagguaguugccaaguuuaauaacagcauaaauauuucuaacaggccuuuacuacaaaguuacauugagggaaaagauaacugcuauaagaauagcaaauauuuaguaugcauuaccauguggcauuguuuuaaagaauaacuacaauucacuuuaugggcaacuuuauggcccaggcaucaugaucccccccaccuuuuuuuuuuuauuuuuauuuuuuugcugauuaaguaaagaaggcucagagaaauuaaccuguaaacucacaguagaacuaggaucagaaccaaagcguaugugaagccaaagccaaugaagggcauaguguuaagcauggaagcuacaucagcuuauuuaaucucggcaagaaaaaaguauuaaguacuaacuaggcaaaguuuuuguugcuacuauuauacguaugagguacaaaaauaaucccauuuucuacaaaaugaaacuaaagcugagggaaguaauuugcucauagguaguggauaaaggggaaaauccaggcaaucuaacagcccaucuuuuuaaaagcaaacaagggcuauauugugccagaauucuaauaaaauuaaaaaauaagcuaaaauaaacaauauaccaauaacaaaaacugcacauauccucuuauaauuaaauuuccuuauguuaaaaaaaaaaaaacaccacucauuacagugcagucauacugugcccuucauuuaguggacacaaauucaacauuguaagcuuggucaaugagcaauuggcuaggcaugguggcucacgccuguaauccuaacacuuugggaggcugagguagguggaucacuugagguaaguaguucaagaccagcuuggucaacauggugagaccuugucucuacuaaacacacacacacacacacacacacacacacacacacacacuagccaggcaugguggcacaagccuccaaucccagcuacucaggaggcugaggcaugagaaacacuugaacucaggagguguagguugcagugagcugagauacugccacugcacuccagucugggugauggaguuagaaaaaagggaaggggaggggagaggggaggggagaggggaggggagaggggaggggaggggaggggaggggaggggaggagaggagaggagaggagaggagaggagaggagaggagaggagaggagaggagaggagaacagaagagaagagaagagaagagaagagaagagaagagaagagaagagaagagaagagaagagaagagagcagagcagagcagagcaauugcaucucauaaaacaugcguagucccaaaauaaaaucaucugcuccuucaaguguuccacagcaaaucgacagcuauuaaucccaacagucaaggggaaacuguuagacuugcuaaaucauucauaccaugcuuguauuuugggguaauauauaugguuuuuaauacugugaacauuuacauuuaauugauuuuaaaaucuaacgcccaaauaacacagggaaaacuaagugaaucacuacaagcaaacagaagacguaaacaauccaaggaaaaauaagccauccugauacuauagaacuaaucagaaaucuuuugcacaauccgaguuuucaauaucuuuuucuauuuuuauacuacaaagggccucaaaaacucuaguuauaaaaaaauauagggcugggccaggcauggugccugaugccugcaaucccagcacuuugggagaccaagacagguggaucaccugagguccggaauucgagaccagccugaccaacauggcaaaaccccgucucuacuaaaaauacaaaaauuagcugggugugguggugggcaccuguaaucccagguacuggggaggcugaggcagaagaaucacuugaacccgggaggcggagauugcagugagccaagauugugccaucacuccagccuggcaacagagcgagacuccaugucaaaaaaaaaaaaaaaaaaaaaaaaauauauauauauauauauauauauauaucauauacgagauauaucauaugagauauauauauaucauauaugauauauaucacauaugagauauauauaucuauaucagauauaucauauauauaauauaauacauauaugaacaagaccaagaugaguacuacuauuaccauuucuauucaacaacauauaggaagaccuaggaagcacaaaauaacacaaggaaaaaacgacgauaaaaugaugagaaagaaaaaaguaaaacuauuaauagacaacaugauugcaacauauuaaaaauucucuaagaaacugcaaacuauaaacuacuuuuaaaauuaauaauauagcacugucaccagaugugacaguaauauauacaaaucaauuauaguuuuauacacaaauaccaaaugaauggaaugauuaagaggaagaucgcuuauaacaacauaacaauuaaauauauaacuaagaaucuaaaaaaaaaaauguaaaacuauguugaaaaccacaaagcauaaccaagagaaaucaaagaccuaaauauauuauagaauauauaccaccaguguguauucuggauuuaaggggacagaaaaacacacacacaaguguuaaugcauuuaaaaagucaauauuaggaugccaauucuccuaaacugauuuacauaaaggcccuaaauuuuaaaaacaaguauuuuguguagaaauugacaaaugaaaucuaaaauucaaacagaaauacaaaagaccuagaauagcaacaacaaucuuuaauaaaaagaauauuuguagguuguacucauagguacauacccaagagaacugaaaacacacauugaccaaaaaacaaaaacaaaaaacaaaacaaaacaaaaccuacacaaacauguucacagcagcauuagacauaacagccaaaaagaagaaaucgccuaaaucuuuacccguagaugaaugccuaaacaaaauggaauauucagccagaaaaaggaguaauguacugauacaggcuaaauggaugaaacuccaaucuacugguugccaagugacuggaaggguuuggggggaaugggagaaaacgcuaauggaugaagaguuucuuccuguagugauggaaauguucuagaauuagauaguggugauaacugcauaacacugugaguuuuauuuuaaaaaaaaauuagaaaaucaauuuuuaaaaccuaccuaaaaagaacguugguagauuuuuacuaucagauauaaacacuaagacuauuguuacgcuaagacaauagaggcugggcacgguggcucacgcuuguaaucccagcacuuugggaggccgaggcaggcaaaucacuugagaucagggauucaagaccagcugagccaacauggcaaaaccucauuuaugcuaaacauaaaaaaauucacugaugguggugcaugucuauaaucccaacuaucaagagguugagguggaagaaucacuugagcccaggaggugaggcuacagugagccaagauugagccacugcacuucagccugggauacagagugucucacucuguaucagaaaaaaaaaaaaaaaaaaaaaaaaaggcaauagaguauuaacaaaaggccaaauaaaugaccaaugaaacagaaacagacccauauauauauaugagauacuuacuacagaggcaacacugcaguaaagugggagcagaguaguuuucccauaaaugauuagauagcagaagauagaacaaguauaaaaaaaagauggauuagaagaaaauauccauaauuaacuaaggagagauaaaacaauugaaaauucuaucaguuaugaugaugagauacaacauauauaaaaauggagacucaaaaagacaggagacaaaauagagcagaagcaauauuuaaagaguuaacuggcuauuucccuaaagcugugaaagguaucagcuaaaacuucaggaggcuaucaacuaaagauucaagaaguccuaucaaucugaagcagaauaaacacaaaugaaaccacauguagaaacaucacagaaaaauucugaaagcaaaaaaagggcagaagggcaaucucagaaaguuugagaaaugaccuuuaaaaagcaauaauaagacugacagaugacuucgaacaaauacaaacuaagcuaagagacaaggaaagauuaccuuuaaaucaccaguaaaaauaacuaguaacuuagaaucccuauagaauucuauauuauauuguuuaaucauguauugaaaaucagaugacacugcaaaacugauuguuuacaacaacacugguuucauaauaaauuauaauuaauuuagguaauuaucagauauuagaucuguuuugaaguauuuuggcaaagaaaaaagaauagacaaaugugaaaaaauaacaaugauauuggaaucuggauaauggcuaugcuguuuguucauuugauuauucauaaaacuuugaacuuuuucccaaaaaaccuaauugaaugugucaucaguagauaaguacaaaaagagaucuuaagaguauuuuucagaccuaagaaacaucauaccagauaaaagcucaaagacaaaggaauaaaaaucaaugaaaauggaauuaugagguaaauccaagugaauacugaauauaaaaaauuauaauaauguaucaugggaauucauauauacuucuggaaucuagacuauauaaucuggauuaugagcauuaauaauguauuaugggaaaaaacauauacuucuggaaucagaguacauacugugaucucaaugauacaauuacuaaaagaacgguucaagaaaaaaauggaaaaauugaccaguaaaaaauauaaucagcccuaaaaacagaaaaggaggaaaaagaagcauguaaccaaccaucaggacaaugagaaauagaauaguacauauaaaaaaucauggcagacuuaaacaggaauauaucacuaaucacauuaaauguaacugaauuaaauucucccauugaaagacaaaaaugucaggcuggauuuuuaauaaaugcaacuacaugccacuuauaaaaaguauaucuaaaacauaaggaaacacugaaaaguugaaaguaaaaagauggaaaaauauauaccauacaaauagcagccaaagaaggcugguguuagcuaaguaaacaucagacgagguaaauccucggagaaauagcaaacuuaaagauaaaaagauaacuaaugccaggugcaguggugugugccugcaaucccagguacuugggagacaggggcaggagggacauucgagcccaagaccagccugggcaacauagcaagaccccaucucaaaaaauaauaauaaaagauaauucauaaugaucgaagaauucccaagaaagacacaaccauucuaaauuuauaugauggucucaaaguguauaaaacuugaugacaaaaaauaaacaaaucuaccauuuuuuaacauacuggccucauuaacuaaaaaacaaacagguaaaauaaccaauaaagauagagaauuugaagaacacaacuagcaaacuugaccaaaaggauauauagaguacacuucaccaacaagugcagaguuaacauuauuaaguauggauggaauauuuauagaauuugacccucuacaauucucaacaaauuugcaagaucaauacucugaguauuugacuccacaguauuuaaagaggaaccaguagcaaaaagguuacuuacuuacugaagcugaauauaugaauacccuaugaagcagugaaucaacuuccacauucauauucaagacaaaaauauauccaucaguacuauuagcuccacaaugaaacaacucaaaugucuaucagcaguauacaaaccaauaguggauacauaaauuuuguugcauucggacaaaagaauccuaaacagcaaugaaaaagaaccaacugucuauaugcaaugauauagauuaaugccauaaucauaggauugaaaagaaggcaaaccaaauauacauacaugugcaauucuauguuauacagaccuuacucaaccacuguucaagaaugcaucauuaagugguuauucaaagaaauaaacaaaaaccaaaaaguaacuacuccaaaaggaugauguuuagcuucuggagaaaaugaggaagaaauaaauggaaguggucacgaagacaccuuuuggggugcuggaaauguucuuucuuuacuuauuggucaucacacagacaauguguaucaugauaaacugccgagcuaugcaauuauuuucugcacuuuuccgcauagauauuauauuaauauuaacauguuucaaaaaaguaaacaggauugagagacuacaaucaucuuucagcuccuuauaaucacuagucagcacuuugccucaacauuuaauaaaaaucucucuuuaggcaguuucauuuugggugaaauaaagaggugauggcauauauauacacagacuagcccuguaaagacaagaaacucguuccauugcuugcuuugcagggggagaaauggguggggaguguggagaaaaacuuuuucaaaccuaaccuuuuaucuuuuaaaaauuaugugccuuuugcaaacacaugaauuuuuguaaaauaaaauaaaaauccaggauacuuaauuucuuuuucuuuuugagacggagucucacucugucacccaggcuagagugcagcggcacaaucucagcugacugcaaccuccaccucccagguucaagcaauucucguaccucagccucccaagaagcugggacuacaggcaggugccugccaccacacccagcaauacuuuuuguauuuuuaguagagacgagguuucgccauguugaccaggcuugucucaaaccaggcuacuuaauuuuuuuuuuuuuuuuuuuuuuuggagacagagucuugcuguuugcccaggcuggaaugcaguagcgcgaucucagcucacugcaagcuccaccucucacguucacgccauucuccugccucagccuccugaguagcugggacuacaggcaccaccaccaugcccagcuaauuuuuuuuguauuuuuuaguagagacgggguuucacuguguuagccaggauggucucgaucucuugaccucaugauccgcccaccuuggccucccaaagugcugggauuacaggcaugagccaccgcgccaggcccaggauaauuaauuucaauacaguuccacgaaagguccugauuuauaauaaaauaauuuucugaaaguucaaauuuuuugucauggcauguuucuauucuaguguaaauguaaaaguuucuacaaaaugacuauauaguccaagaaaacaaauacaaauuaauucugaccuuucuagaaucaccauauaaaggaaauauuagguuuuuaaucuaaaaagcucauauucacuacauaaacugugaauuucacuuaguagcuaccuccacaauuggauauauaaggcaauuccuaacaaaaagacacucaaauaaagaacugauaaauuccuuuuaaaaccuccugcuauucuggaaccagcuaagauuauauuuuucacgacuucucuagcaaaccguuuuugcuuuuuguuaaacuguugaggagacuaagaugguacccaaugacacaaaaccaucaacagaagaaucacguuaagacaacagucaaacccuucagugacuaauacagauauaaaaucauaaaccaaucuuaacugaaagacuucuauuauuuaugcugcaauagaaguaacuguaaauaaauaccgaucuuccuacgugagaaggaaaaaaaaaaucacagaaaacaagaaagaaaauaaacaaguuuccacugauugauggucaaaaacuuaauuuuuaagugaagguauuuaacacaccaagaacaucacauauucaacaaacccaaauaguuccucacauauucaagguuguuuuaaacuaguucgagaaacaguauucccucuuuacucaucucaaccuucucaaaaacaucauucaguaguagaaacacguagucuauuuuuacucuuccauuuccaacauauuugauauuuuucaaauuaaaaaauuucugaaagugcauacacauaaaaacagaaugauuuaagacacuguucuaaguggguacagggggaaaaauaacccugugaauugacuuaggaaagaauauaaaacgauuuauauuucccccaaaugccccucccacaaauaaauuuccacuuaacagcaaugaaaauuacauaauuagaaauaauguuuaaauauauaaauaucacuuuauuacugcauaaaguauauaauaaaagaagguauauaccaguaaacguacuugcaucaucccuuucuauucugguuccaucacuaguugacacacaaguaaagugcagagguucaacuuccaaaaguccagugagagaugugaaacuacccucagcagcugugcaacuacugaccuuuccauuuccuaauggcaaaagacaaguuuuauaacacgugaagauaauuuuuaaaaagcaauagucacaacaauaauuauagcugcaacuucaauuuuaauuagaacauauaaauacacaacucuuacacagugcuugaaucaugggcaugguauuaagaaaacugacaaaacagcaggcacgaguuucccugcuacaaaagcagauuuggauaaaagcaacuuaguagcuccucacauuaacagaaacaugagugguaguuuccuguaacaugaaacuuacauuuaguaacaagugauuucaaucucaaauggggugaaaaauuucaaucucaaauggggugaaaaaaguaguaaaucagcuagucacauuagcuaucaccuaaucuguuggcuauauguaaaaucagaauacauucuaagaugucaacugcauaaauauaagacacaaaacaaaggaugaacauuucaaaauauuaacaagguuuaucuacacauuguuucuuguauuuuguucauauuaucaguuuuauagaaugaggcacacuacuucauggucauaaaaauaguuuaagcuagcauaaguaguuuuuaaaagaaaaaaccauguagccacaacuauaugaccaauaaaaccacagcaagaagucuagagggaagaacacaaaugaauucacagggacugcguaugcagcuugggaaggcaaggauuauauucacuacuuugcaauuuuuuuuuuuuuuuggaauuagcacucauuuaaacagaauuauuuaaaucacaaagcaaaacagaauucacagaugaaaagaauggggagguauaaaaacugucauuaacagcugaaggacuaucaaacacaagaauaaacugucauaaccuuguuuuccaaugucuuauugggggucagcauagggccugacacaugcuccaaaaaaugcuuauugcacacuuacucaauacaagaauugggagacagaagaauaaaagguaagucccaguccucacgaagacuauauucuauguuagugguuauuaggaauuaacgcaacuuuuuuuuaagcugcaagguuuuacuuaagagaaauuuaaaggacuaguaagucaaggggcaaucaguccuaaguuaugggauaauaaaaugcuucucuaacaaaaugaggggauucauaggaagaauaagagaguuucauacauuugcucccuugaaguggcagaaaagccaugcagaaagaacaugagugaaauccccauagcaaagaaacauggcacauuuaaggaacugaaagaacaauaugccuagaggaacaguucucaauucuaagaucccucuacauaucuuuaaaauauuaagcacccugaagagcuuuuguuuccuuguuuuacugguauuuaccauaguagaaauuucaaggugugaaauuuaaauauuaauucauuuaauaauaaacccauuaaauguuaaaauagcauaauuugaugaaaaauaacuguuuucugaagaaaaaaauaauuuaaugaaaaaagugacaauguuuuaccuauuuaaaaaucucuuuaaaaugugaaguaucagaggauacuuggauucuccuaccugccuccguauucgacguguuauaaaauguuguuuuagcagaagugggugaaaacaucugacccaacacaaauauguaguuggaaaaagaauauuuuaaaaugcuugcauauucaaaaacuugacaagugguaauuucuuaaagguuacaaugugguaucugaaaucuuaccaaugaacuucucaaacucuguuacauuaagaucaacugauauauuuuauacuuuuaaagaacuuuacccaugcauacuggugaaacaucaugcauugaucauuuggaaaauauugguucaccacuguauacaaauauuccaaauguugacacauuucauuauccaguauuggaaaauuacacucucuaauaucagacuccaugagaaaagucuacauacugggaagcuaucaagcucacuaugggagauguuucucauucacuuuucaaaaaacaacugucaaauaacgcagugcaaaugggcguaguuugucugucagucauuacugcaaauaaaaaugguauuccaagaaacaagcaaguaguucagcuuguaacugaacuucacaucucccugaaacaagcaugguacuuuggcaugccacagaaguacucuaugcauauguaucauucaucucagaauaaaagauguguauucauggguuaaaauuuuaauaaaauuaauaauuuuuacugcaacgucaagggcauuuuaaaaugaaaccgacauuuuuauuacaagugcacagugaauaacaccaugcuuuuucacaaucgauaaaaaugucaacgaaaucaaaaagacaaauaacaucauucuacuaucaucaaaauaguuaugaccauauagauccccuuaaugaucucaggaacccuuugggggucuauagaacacacuuugagaaucacagggccaaaaaagacuaaacggggcaaugacacaagauaaaguggcaaggaaaagagagccaaaucauuuaggauuuuauaugcuguauuagaaacuuugaacuucagaagaugggaagaccugaaaaguacucuaaggagaaagguaaaguaacugaaagaucauacucaaugcaauguggagaaugcacuaaagugaggcaagaacagauguaggcagaccagugugaaagcuaugauuguaguauggguucaagaugacuguaacuugugaucaugggagguaacagagugagcaaacuugacauacacucagcucucuguaucuguggguuuggcauccauggauucaaccaacuacagacagaaaauauucaggggaaaaaaaugaauggcugagucuguuacagccuuuuuuucuugucauuauucccuaaacaauacaguauaagaaguacucauguagcauuaacaucguauuagguauuauaagugauguagaaaugauuuaaggcacacagcaggauguguguaaguuauacacaaacugcacuacaucauuuuucauaagggacuugaguaucuacagauuuuguugucugcgaggaguccuggaaccaauuccccacggauagagaggaacaacugcauacacugguggaaaaauaggugccauauggugauauccucaaugugggugauaagaaagauauaaguaucaugaaugacauuuacauuucugucuugugccacugaugccauuaacaacaacaacaaaaaaugcuguagagagacuaauaaugaggaacaacacaaugagacauuaaaguggagacauaucaugauuuuuuuuuuugaggcggagucucacucuuucgcccgggcuggagugcagugacgcuaucucagcucacugcaagcucugccucccggguucacgccauucuccugccucagccuacaggugcccaucaccgcauuuggcuaauuuuuuggcauuuuuaguagagacgggguuucaccguguuagccaggauggucucgaucuccugaccucgugaucugcccaccucagccucccaaagugcugggauuacaggcgugagccaccgugcccggccgacauaucaugauuucuaaauuccuuguucugagucuucuuuacucauuugcaaacuugaugaccucagagcuuggaaugaaccuuacaguccuucccuuacgcuuucacccuaacagauuucacugcuucuuuugguauacugaaggcauugguaucuccaguucuagucucuccuacuaguuccaaucauaaauuacaauggucuaauugaugcaucacuuggauagagaagacagaaaauggugagaugcguguaaggcaaucaagagccuaagucaucaaauaguaauaacacauauauucaaggcagcauaagcaauuaaaaagcaagugacagaccaguauguguaguaugcucuuucauuagaaacuauauuaacgaauacagguugcaaacaaguuuaaauagcuaaacauccaguuaacaauaguaaccuaagaggguggaaagguugggguugaggcauuuuacauuucauuuauauuuuuguauuugaucuuuuuaauuuugcuuuuauuacaccucauaaguuacuuuucaacaaaauugaacuucucucucaaaauuuacuuauaucugguuauuaccuuaaucuguuugcaaauuuucuaacauuuuuguauccuaacaacaucugcaauaaguacaauuagacggaagaaaaaaaugaaauggucacucuuuuaucuaacaaaaauaaacagcaaauuuuagcacuuaaaaagauuauaaaaauagugucaugcauacauccgaaaaacacauucuuuagaaaguauaaaaggauauacguaauguauacaaagcuuaccucaagaaagugacagaugcagaaaauuaucuuuuguuugugcauccuuauuacaguaaguauauauuacuaauuuuguauuuuugaaauaggaaaucuuuuuuaacuuuauagaggcagcaaagauacaucaaauaaaacugaaaaggcuacaacaaauacauuuuaaauagucucauaagcauuaaaaucacacugaaaugaaaugcauaacaaaaacaaaaaauuaaagucacaacccuuucaaauaugacuuuaauauacugggauuuucuucagagggaaagaggaaguuaagaacuucuaggaaacauuuuaauaauucauaugauaaguucuaaggaauuuuaguuuucuaaagacaaaacaucaugacuauaaucuauuaagucaaauggcaacuuaaauccaagauacaacauucagaauuuccuuuaauaaaagaaaucacuaccugaaaggacaucugauaaaucaauuucaucugacuggacaccaaugcugcuguuauaaacauuuuuacaagaagagccacucaucuccaaaucaaagaggacuggaucaaauggugagcuauauaauccauaucugaaaaauaaaauaaugcacuaacaauuuuccuuucagccaucuaauuaacaaauuaccuuuacuuaguuuuaaaagcagucugacuaacagcgcagagggcucucccucuccccucuccccucuccccucuccccucuccacgguccccuuccacggucucccucugaugccgagccgaagcuggacuguacugcugcgaucucggcucacugcaaccucccugccugauucuccugccucagccugccgagugccugccauugcaggcgcgcgucgccacgccugacugguuuucgguuuuuuuugguggagacgggguuuugcuguguuggccgggcuggucuccagcuccuaaccgcgagugauccgccagccucggccucccgaggugccgggauugcagacggagucucguucacucagugcucaauggugccaaggcuggagugcaguggcgugaucucggcucgcuacaaccaccucccagccgccugccuuggccucccaaagagccgagauugcagccucugcccggccgccaccccgucugggaagugaggagcgucucugccuggccgcccaucgucugggauaugaggagccccucugccuggcugcccagucuggaaagugaggagcguuuuugcccggccgccaucccaucuaggaagcgaggagcgccuauuccccgccgccaucccauuuaggaagugaggagcgucuuugcccggccgcccaucgucugagagguggggagcaccucugccccgccgcccugucugggaugugaggagcgccucugcccggccgccccgucugagaagugaggaaacccucugccuggcaaccgccccgucugagaagugaggagccccuccguccagcagccaccccgucugggaagugaggagcgucuccgcccggcagcgaccccguccgggagggagguggggggauaggggggcccgcccggcgagcggccccguccgggaggugaggggcuccuaugcccggccgccccuacugggaagugaagagccccucugcccggccagucgccccgaccaggagggagguggggggggucagccccccgcccggccagccgcccaguccgggaggggggagggggggucagcccccugcccggccagccgcgccguccgggagggagguggggggaucagccccccgccuggccagccgccccguccgggaggugaggggcgccucugcccggccgccccuacugggaagugaggaccccucugcccggccagccgccccguccgggagggagguggggggaucagccccccgcccggccagccgcccaguccgggagggagguggggggucagccccccgcccggccagccgccccguccgggagggagguggggggaucagccccccgcccggccagccgccccauccgggaggugaggggcgcuucugcccggccgccccuacugggaagugaggagccccucugcccggccacgaccccgucugggaggugugcccagcggcucauuggggaugggccaugaugacaauggcgguuuuguggaauagaaaggcgggaaggguggggaaaaaauugagaaaucggaugguugccgggucuguguggauagagguagacaugggagacuuuucauuuuguucuguacuaagaaaaauucuccugccuugggauccuguugaucugugaccuuauccccaacccugugcucucugaaacaugugcuguguccacucaggguuaaauggauuaagggcggugcaagaugugcuuuguuaaacagaugcuugaaggcagcaugcucguuaagagucaucaccacucccuaaucuuaaguacccagggacacaaacacugcggaaggccgcaggguccucugccuaggaaaaccagagaccuuuguucacuuguuuaucugcugaccuucccuccacuauuguccuaugacccugccaaauccccuucugcgagaaacacccaagaaugaucaauaaaaaaaaaaaaaaaaaaaaaaaaaaaaaaaaacagcgcagagggagaugcugacuagauuugacccaucaaauucagugaaucucaacuauguucccugcaaucuauacucuaaaagacacuguccagagacucaacaaaugugauuccaauaagcuggcaacuaagguacuaagacugccaccugcagauugaagcgagggguaucaggcaccauucucucccgugaaucauuacgacauagccucaaguacaaaggcuuugaguaaaaugucaucaaaaucagaacaucuaaccuaggaaauuauaaaaucacugcucuaaauaaaggaacgccuuacuucaaacguagacaaucaggcaagaacuuaaaucuaaccuuuugcuauugcuuaauucaucacguuagaaguuuugaaauacaaguagcagguagaagaauacuaguuaugggacaauaagugacucacauaauuccaccuauaaagugcacagagaaacagacacauuacauucuucuuccauuagcagggcauaccacuuuucauuauuaaauaaaauuagcccucugaauaaccaucauaaggauuuaucaaacuguuaaagaguaauuucuggccgggcacgguggcucaugccuguaaucccagcacuuugggaggcugaggcgggcggaucaacugagguugggaguuugcgaacagccugaccaacaugaagaaaccccgucucuacuaaacauacaaaauuagccaggccuguggugcaugccuguaaucccagcuacucgggaggcugaggcaggagaaucgcuugaacccgggagauggagguuguggugagcugagaucacaccauugcacuccagccugggcaacaagaacaaaacuccaucucgauaaaaaaaaaaaagaguaauuucugacaaaacagaagaaaguaaaaccucaggcuauuaucguauggaaaaaguaagguauaaacuaaacauuuuuguaagaaaaagacuguuaucagcauauauauauuaaauaacaguucucugcaaaagcgugaucauacucagagacgccuauuauuagucauuagauauacuaaaauaccuugucugaaguaaagccuccauugguguuagccuguccuguaacugucuggacacugcaguaagcaaagaugcacaagcuguacugcauccagccagaucuucaucuuucacauaauucaguaagacaaaauaccaauagacagaaccuggaaacaauaaaaacaaaauaaauguuucuuuuuccuccuuuuccucuaacaaugagaauuuaagauuaccuauuuaucagaauacuuccuuuugcuagaaagauacucccuuuucuggaaagacaaucuuauaggcaauuuacaaagauaacuccuuggagggaucaaagaggacacuuaaaauauaaacaacacacugaggcacagucuuacacuaagaauuucaaauauuucuggagaguuuuauaaagucauuuagguguauaauaauguguauuuauuuagguguauaauaaugugagaugccucugagggacacuucgaaauagcugaaaaagugaggagacugaagguccuucaaaucauccuuaccaacauacuguuucucuguacuaaacuuuaaaaaauaguggauggcagugagcuucaaacagcccauuuuagugaaugaauggggaauaaaauuauucuauaaugcguuagguacagaucgacauugcuuaaaagauuaucaugacaguguauuuuuacuuuuauuaacugcuacauacaugccaaaacuuaagcgucccaacuuuaaaacuauccuuaagaagcuuuuaaacauuagagacuaucguaaugagcaacugagucaaaauguucuauuccauagaguuaaugguuguagccaaaauauguucaauguaaauauaaacacgcuuuaccuaaauuaagaaaaugauauaacuuuucaacaacucuaaacaagcauuuuuuuuguuuaacacaaagaugaaaucuuuaugaaauauauaacucacugagguaacuuguugaauggguuguuuuuuuaaacuccuggccucaagcaauccucccuccauggccucccgaagugcugggauuacaagugugagccacugugcccagccugaaugguuuguuuuuuaauaaaacagauugugaaaaaugucuaucaauaaauaaaauuuggcuuaaaaggccaaguuaguagcccuucauaguaacaccauguacuagcaaaaacaguaagaaucuuuaaaaaucuucauuaccuuauauaugugcuauuuuagagaacugcuuuaugaauuccuacuugauaacuaccuucauucuuuuuugauacauaauaauugcacauauauaggggguauaugugauguuuugaaauauggaugcaaugcacaaugaucaaaccaggguauuuaggauauccaucaccucucugcauugggaacacuuuaaaucuuuuaacuauucugaaauauaccacaaauuacagucacccuacugugcuaucaaacacuagaacuuauuucuucuaaccauauguucauacuaauuuaucaaccucucuucaaaucccacucacccucccagacucugguauccaucauucuacucucuaccuccaauuacauucauucuugaaaggcauuuccacagaguccucaggugcuuuaaaaaaaaaaaaaaaaaaccacuggucccuuuuaggaaauuccaguuugccauagucccuaccaaucacacaaaacauaugcaugugcaaugacaccuggaccguuuuacuuauuuaugucaccucccuggcacaugcuggaauucugguuucuggcaucugaucuguuacagucaguaaacaaccaaacaacucaaugauuguaaugaaguacagaaaaauaguuaugaauugagaugacuugauauuaacguaacugcuccaugaaccuuuuccuuggaguacuauugacggaguauaugaccacccagcuacaaucuaucgaucccuucaaaaaauacagauaagccacagaaaagugaacuuuaauagagaaaaaguaguuaugaaauaauccuaaguauacauaugagauguuccauaugacuauaacuauuugugauuaaauuaauuuuacauaccaccaguuguugcugcagguaaaaaugacauauuaucaaguaaagccuucaacagaacagguccaaaugcugguugacaugggucacauuugccauuacugaaaaauuuuuaaaaagaaaaauuguaaagacauuacucaaggucuaaauucaacccuaaaccuggugugguaccuaaaaaucuuuaaaauguauucuauaccgauuaaaagaaaaaccugccuuaaagcuauauaaaauaccaaaagauagcgggaacugauuauacuaaggaggguuguaaauauuuucuuaugcauuaaacccuuaucuuuacaacagucaauacugaccauuagcucuuagacacuuccuagauacaguagcaaguaggaaccuuuaaacauuaagaacccguauaugcaguuucaauuucuaaaguuucaguuacacauggucaagugcagucuaaacacaggugaguacaguacaauaagacauguugagagaccacauucauguaacuuuuaucauaguauauuauuauaacuguucuauuuuauuaguaguuauuguuaaucucuuacuaugccuaguuuauaaauuaaacuuuauugcagguauguauauauaggaaaaaacaauacuauauauauggcucaguacuagcuacaguuucaggucuccacuggggaggggaggggucuugggacacaugcccuggggaucagggcagacuguucuaauuuguuucaggguuuagaaaaaaagggucugcacaaugcuacaaaaaaaagucgguaagauuguuacauaacagagaaaacacuuuagggcaagaaaagacaaccaaggaaaguaggagugaaaaggguuuaagaguucccuugccaaauucuccaaacugcuacuaacaggcagagaagcucagcagacuucuuuucuuaaaaguuaaauagacuuauuuaacaugacacuuuccccuaagaacccaaaauucuugcuaagauuaucaacaaucuucaucaacuuuugaaauucucuuaaauuauacauacauuaaacaaggaucaaaucacacuauaaacaagguaucacccacuaaauugcagguguaccuagaaaguaugcuuucaacuuaaaaacauaccaaccuaaugcacaaggcuagaaaucgggcacacuuaugggcuauacuucguccugccucaaagaagcaaacacguacgaugucugacagaaauuuucguguuuuugaaaguagguucucauuuccuuccuuugagcugcaaaacaauagcagacauuuagacucauccugaacuuucaaucauaacaucuaaaaggcaaucaacagugguaagcaaaauuuuaauuauuaaccuuccggguccauuugaaugaacuccagcuaaccaacagagaguauccaacacaaggcucugggcauguucugugaucuggccaucaucuguuuuucugcaaagaguauuaacaagcuucucaugaaauucugaaaacuguaacauggcacaucguugcacucuacaaaaaaagaaaauauaaacacauuaccaaacaaaacagaacaacuaaagcuaucacaaccuggcuggaaaggcaauguuuaauuuuaauucaugaacaucucaaguacauuuaaaaacaaucaauagcuauaugucaaguauuucauuuguagaaaauuuuuuaauaacauuuacaauaauguguuguaauguaacauggaauguguauaauuucuuuuuguuuuguuuuuuuucuccagagauugggugucccucuguuguccaggcuggacucaaacuccuggguucaagugauccuccuacccccacgucuugaguagcuaggacuauagauacaugcucccuugccugacgaguacgugucaaauuaauaacuaucauccauuccugcuauacaacaagcacugugcggacacuagagauaaaccaaugaaguauaaagacaacucauauucucaucaaaauuauaauuauuuaagaaaaauggacaaaaaaaauuuucagguaaaagauuuuuuauuuguguguguaugugugugguguuaugcucugcacuuucauuacuguaagaauaacaagauaaugcaaugaaauuaccuuuccuuagaaauugagguuuucuuaaaucuucgaauggugacugagaccucuugaaguaaaucacagccccggagguuuucagauuuacgggugccacuuguauuuucauucuuaacauuagaugauuuuuccuaaacauuacaaauaauaaugaauuuuaaaaaauaaacuaaacuaaaaaucauuuaccauugaaguuauaaaauaaaggaaaauaacugaauuguggccaucaaaauauaaaucucaaguuaaaaugauagcuuguacccucauauucaguaaaugacuaauuuucuccagaauuauaauaggggaaaaaaagacagacacagccacuauuuuaaaggcaauaacccaaugauuacagaugauaaaaccaaaguccugggucuaauuccgcugggugcaguggcucaggccuguaaucccagagcuuugggaggccgaggcagacagaucacagaacucaggaguucgagaacagccugaccaacacagugaaacccuaucucuaccaaaaaauacaaaaguuagccaagcauggguaagugccuuuaaucccacuacuugggaggcuaagucaagagauucacuugaacucaguggguggaggcugcagugagcugagaucacaucacugcacuccagccugggcaacagagcaagacucugacucaauaauaauaauaauaauaauaauaauaaaucaauaaacacaauaaaauaaaauaacuacgugagauaugucaggcuccccaaucgcuaagguucacucacuuucaguauuuaaaaaagggagguaacagaaccugcuaugccuacuucagaguuauaaugaagauuacaucagauaaaguacacagaaguccuugaaaaacuggaagaccuauauauauguaaaaugccugguauuacugaucaguaucaguaugauuccuuauaaauaaugaugauaaacaaaaccuccuuccugacuuccaggaaauccaagauaagucaauuguaaggagcugcaugguucacagcuacuuucagaaaaucaaccaugaggauuagaaccugucuuaaaauuacgccccaacuucucuuucuguauacucccaaauagucaccaaaaacaagauugugaguugccaacagagggcauaugaagaaacucucauaccaaaagaaauaaauauuauggucuaaaauaauuauaaagggaaauaucugcuaacaauuacucccuauucaguauacauuacaaaagcuagguaauuugccuaaaguuaauucaggcugggugcaguggcucacgccuguaaccccagcacuuugagaggccaaggugggcagaucaccugagguuaggaguugagaccagccuggccaauauggugaaaccccgucucuacuacaaagacaaaaauuagcugggcaugguggcacacgccugugaucccagcuacuagggaaguugaggugggaggauggcuugaaucugggaggcagagguugcagugagccgaguuugcgccacugcauuccagccugggggaaagagugagaccccgucucaaaacucuaaaauaaauaaaaugaaauaauaaaguuaacucaaacauucuucuucccaaauauauuuaagucacuccaaagacaaaauacaaacaaaccaagcguauaguaaaacaucacugaaaggucauacuacuucuaauaguguguuaaaucugauccacaauguuuaaaacuguauuguuauuguucaaaaugacaguuucauaccuugccugcugcaacuuuagccaaaagugaagcaagugaauaacccuuguuacucugguguuuuagggauggaagccuuacuacaggacgcauaccaccauuacaaaucucuucuguuccucuuucauucacugccuugacauggauuaaaaacgaacgauauuuuccuccugccauaccuagagaaguggaguagaauggggaaaauaacugaaucaccaauaaauuccacuguuuuucaucuucauagaacaagaucaacaacuaacuccacaaaaaguacaguaggccagaacuuucaaauuauacuguuugagcagaagaaaguugaaccaccuucacacgcugucagcaaaaaacaaccaacaaaggaaugauaugaauagcauaaaaccauuaucuuugacuaauugagauaaacauuuggcauguuuuuuccccaauauuauucauuuuaaugguaaaaaugucaucaacuacacacacacauacacacgcacacacacacacaaaacugucauuaagcuaucaucuagauaauaacagaacguauauccauccagucuucuuaugcauacauguacacacauccauauauaugugcacauauacacauagcauuauaguacugacgguuaaaaaugugcaugcaggcuuuggagucacuaccuggguuugaaaaauggcucugccauuuauuaggcacaugacaaauuauccucucuguggcucaguuucuucuaauguaaaauaagaguaauauuuccuaccucagagucaacuaaaccacuguuaacugugcuuggcacaaagaaagcacucaaauaggccgggcgcaguggcucacgccuguaaucccagcacuuugggagggugaggcaggcagaucacaaggucaggagaucgagaccauccuggcuaacacagugaaaccccgucuacuacaaauacaaaaaaaaauuaguggggcgugguggcgggcgccuguagucccaacuacucaggaggcugaggcaggagaauggcgugaacccaggaggcggagcuugccgugagccaagauggcaccacugcacuccagccugggcgacagagcaagacuccgucucaaaaaaaaaaaaaaaaaaagaacacucaaauaauuauuaucacuaguaugugauauuaaccaaauugggaucauacuauacaaucuauauauaaaauacauuucuuaauuaucauuaaauuacuacaucugccagcaaacuaucagucuauuguugcauuaccagguauuaaaucuuucaugauuauaaaugcuaucacucuacuuagcuaccugccugcugugcuagcacuacacuguuacauuuuucuuaacacuacuguacuauucucuguguugugguaucugacauucuguuucaaaauuucuuuggccaauguuaccccuuuacucguccaaaaaaacuuagcacuuaucuuauucaguuucaaagaugcuggggagaauuuuauggaaaaaaauaucuuaguauauucuaagaaaauuaauacuuuccaaacacaugccauguaauucuacacuccauuuugucaaaaucaguauuuuugaccagacgugguggcucacaccuguaauccuagcacuuugggaggccaagguaggaggaucccuugagcccaggaguuggagaccagccugggcaacacagggagacugugucucuaaaaaauaaaaaauuuuuaaaaacaccaauauuucuauuuccaccuaaaaauuuaagaugcacacucucauugaacaaaaccuauaaucuaaacaauuugagauuaguuuuuguucacuacuguaucccagcaugaaaccuaacacauaacaucucgaaaaccuaaugacaauaagaaagcacaaaacuugcauauauacaggcugaguaucccuaaucugaaaauccaaaaugcucuaaaaugcaaaacucuuugagagccgauaugaugcuaaaaggaaaugcucauuggaacauuucauauuuuggauuuuuggauuaggaauacugaacuaguuaaguauaucacaaauauuccaaaaccagaaaagaaucugaaaucugaaacacuucuggucccaagcauuucagauaagggauacuugaccuguacuaugucugcaauuaaaugguuaugugugaauguggacaaacauuaggaagcaaauguacacaaauguaaauagcugauauauaguuggucaguuauuuucuuggguuggagaaggaucucuacaucccaccccaccccaaauuucuuuaacaauugaacuagucauuuuguguugguuuuuuuuauuuacccccagaauacaaaagcugaaaacguccuaccacugauauuucuaaauuaucaacaugauagcccauuaucucaaaacauucauuauaaucugcauuuguuuaugacacucaaaucauuguauaugauacuggcgaagcucuucuaauaaaaauccucuuuuggccuggagcgguggcuuacgucugcaauccuaacacuuugggggaccgaggcaggcagaguggcugggcucaagaguuccacaucacccugggcgacaugaugaaaccccgccuccacuaauacaauaaaaaauuagccaggcauuguggcacacgccuguagucccagcuacucagaaggcuaaggcacgagaacugcuugagccugggaggcggguguugcagcaagcugagauaacagaacugcacuccaaccuggguaacagagcaaaacucugucucaaaaaaaaaaaaaaaaaaaagaaaaaacaaaaaaaaccucucuuggccaggugcggugcugacgccuguaaucccaacacuuugggaggccaaggugggcagaugauuugaggucaggaguuccagaccagcuuggccaacauggugaaaccccaucucuacuaaaacuacaaaaauuaucugggcguaaucccugcuacuugggaggcugaggcaagagaaucacuugaaccuaggaggcggagguuucagugagcaaagauagcgccacuacacuccagccugggugacagaaugagacugucucaaaaaaacaaaaacaaacaaacaaaauaccucuuuuaagggaagauacuguaauaauauauaauaaaacucugaagagacgggacucugaugugaugggaaggguaaaaauggcagaacauuaugucugcuuacucaaaagagcucuguuaugucacacuaagucauccuguagucauuucuucaacguuuuuucaaaaagcacugagaccucuuaagacacaaaaaguaggaucagauaaccauacaguuaguuacuuuaugacaggaaaugaccucagcuaccagaaaacugaugaaauuucgaacgaaagucccaaagaaaacaaucuuauuuuuuuugagaucaguuuuuuuucgucuuuuuuacaacugugguauuauuaauucugcuuuuguaaaauguauuacuucaccuuuaacaaguuuggggcuuguuaacgucaacauuccagcaugcccugauagaucaaggccacuagcaagccauacuggcccacauagaaugucuucuuuaugauccuccaaaaauggacauaaucuaagaccuaaaaagaaaaauacauauuuuucuuuuaaauucauucauuuaaaauguaauauuuaauaagcaaauaucaucccauuuacauauaauaccaccacacaaaauaucauacuuagaauguguuaaaauaagaauugucaugcuaaggaacuauaaucaauuauuuguuauguugcuuuccauucccauauuauuuuacaguucaccuuuauuuucaaaaaaauuauaaaccacgacuugauuucaaaucccaagguauuaaaaaccaagaaugcauuagcgcagcuguggucacaaaagaugagcugaaaguuaaagcauauugccaaagcagaauuauagguuauuuuuuaauuguguucuugaaaccaaguuuuugcaagccauaaggaaaucuugcccgacauguugcauucagaucacuacuccuuuuacugucauggacaacagcucuauaauuuaacucacacugugauuccucuacauccaugugcugcauuucuucauucaaaucaaccagggacgguuucccauuuuguuccacuucaauguuaagagcuggagacaaaggaaaggugaucugccuaucuacugcuguuucuagaggauaaaaauauuaguaaacuuaauuuucuuuaauaucaaugauuuaugugccugaaaaaucuaaaauuuccuguuaacuugggaacuucugugauuuucaucacagaugcuauaaaaugauuggaggaaaauuuugauucaauuguuuuauacauucuucucucuuuuaacgguaauaaaauauuugccuaaagaaacaaucugcuggcaacuaaacuaaaaguucuuacccuaggcugccugguacaagcacuugcagagcuuugaaacuaccaaauccugaguccuccacccaauuaauucaaaaucugucaaaagacugcacacauaugaacauauccauauacacacagacucacauaaauauacagacacacauauagucauccaucccucaguaucugugggggauuaguuccaggacccccacagaugucaaaauccacagauguuccagucccuuauauaaaauggcauaauauuuguauauaaccuuauucauauccucccguauacuuuuaaucaucuuuaguuuacuaauaaaaccuaauacaaugugaaugccaugcaaauacuauuuauuuauuucagacagagucucacucugucaccuaggcuggagugcaguggugcagucauagcucacuguaaccuccaaauccugggcucaagugauccuccugccucagccucaugaguacugccaccugaguagcaccacaggugugcaccacuacacccagcuaauuuuuuuaaaaaaauuuuguagacaugugcuugcuauacuucccaggcuggucucaaauuccugggcuaaagugauccuccugccuuggccucucaaaaugcugggauuauaggcaugagccaccacauguggucuaauacuauuuuuuauuuguauauuuucuuacugucguaauuuuuuuuauuuuuucccccccaaaguauuuucaauccacgauugguuguuucugagguugguugacuccugggaugugaaacccacagauagagagugccaggcguauauguaauuuuucaaaaaggaaaauuuucaaguuucaauguuugaaacugggguuaaguugccauuuuaccgugaaauuauccccagccucuuaaacuaacuuauuaaggagaaaacacucaguaguaacaucuaguuucuaaccaugcuaaauguguauaaucuacuuuaauaacucaaugcaacaaauucugaacuuguaagaaagauaaaaaugaguguauuuuuagcauuacaugaaaggcuggcuucacuaauaaccuuaaaaguaacuuccauaacaguucuauucacaauuaagucuucuccuaggaaaagaaauacauaaagcuaguaaugcuaaaagucaaacuaauuuacaaaggaacuaaucucacuuccaaaaaaguauaauuauaugauucaaguuuaugcaauucugaacauuacuggguuacugaaaaguucugaaauguucucugaauuacuuuuuuaaauaaaaucacaaaaaguaaagcaggcaaauggcaacaagggacagaaagggacacgaaacuuagccaaggugaaaauuaguuuucagaaaucaaccacaaaauaaaaucuucaaagauaaauuuugauacauucuuaccauugacuuucccuaauccuggagcuuuauuuuucagcagugucacuuguaucuguggaauauuggugauguuugaguucaaaacgaauuugaaguccacauguccaaccauacaagcuuuagguaguacuaauucaaauacauguucaucccagcuguugcugucaaauaaggggaaaaaugcuaaauaaagcaaaaaucuuucuucagccacaaccauauuaucauuaaggucaccuuuccuacuuuuugcuuugcagcuuccaacaaaaucuaguguuucucaaugggaucaagagagaaaauagcucccaauggagaagguuaaacaaagggcaaugaauaaucuuacuuuagaaaucuacaccugccuugagacuugcauauaccaauacauucuuauuccucaaagugugaacaauuuaaugugaauuacgugcaaauuccugguacccacccuagaucuaugaguagggucccagaaucuucauuucaaaacaacaauuuauuguauuucuuauauauauucauucuuggguuuuaaaugcuauauauaugcuggaaaaugaaaaucuccaaacuccuccacuaaauuuaaggcucauauccaaaugucuacuagacaucucaaacucauuaugaaaaaacccacuuccaaaucucaguaaacagaaacuucauuuuucagugaacucaggccaaaaccugaaagcuauccuuuauucuccccugucacacaauauguucaauacaucagcaaauucuauuccuuguaccuccaaauuauauccagaaucuaacgacucuuuucacuaccuccaucacuaucacaaugguccaagcuaccaucagcauuccugaaucagcacaacagcaaccaaacuaaaaccaaucuaucacugcccuccccaccacaaccaucauucuaaauacagaagucaaaguaaucuuuguaaaauauaaauuauaccacaucacuccuguauucaaaccugcuaacacuuucccaucucacguagcaugaaaguuuuuuuuuuuuuuuuccgaaauggggucucacucugucacccaggccagaguacaguggcacaaucacggcucacuacagccucaaccgccugggcucaagugauucucccaccucaguuucccaaguaucugggaccacaggcacauaccaccauguccagcuaaauuuuuuuuuauuauuuauagagacgaggucucccuauauugcccaggugggucuugaacaccugggcucaagugauccuccugcgucagucucccaaaaugcuaggauuacagaugugagccaccaugccugaccuuuuauaaaggcauucaugauccagcucccagguaccucuaccucuguuuuucuucuugagauggagucucacucuguagcccaggcuggagugcaguggggcguaaucuuggcuuacugcagccuccgccucccaggaucaagcaauucucugccucagccuccugaguagcugggauuacaggugugcaccaccacacccagcuacuuuuuguauuuuuaguagagacagcguuucaccauauuggccaggcuggucuuaaacuccuggccucaacugauuuaccugccuuggcuucccaaagugcugggauuacagguuugagcgaccaugccuggcacccagcuaccucuuuggaucucccucccuaccacucucccuuauauucacagcacuccaacaacaauggucauauuucuuuuccuagaacucacaaaauauaguccucaggguucuguauugcuauuaucauggaagccuuucuuaggucccuuauauugaaaauaccauacacauugucucucuuuuucucucacucucucacucuuacaugcaauuuccuauccaacuacuacucuauugccauacucuguuuuaacauucuucauagcuuuuaugcccauauggcaugguauauguaucuguuuacuuucuauugccauuaggaggcaaauuccaugagacccacauuacuagugacuauaagagugccugcuuuuauuaaauacaaaacaagcauuugaguauuuguuaaauaaaucuguggacuaagugaccaaacuaauugcaguaguaaauuacucucauuauuuuauccuaaaauuaagaauaagaauauaacaauuuccaaaagcaauaugacaaauagaaggaacaaagucaucaacaugcaaaaauuagcuuauauauuuguuagagacaacacagaauuccuaaguauauuacuguauaucuuuuagacaguuuaaaacacaaacaggccaggcaugguggcucaugcccauaaucccagcacuucgggaggccgagguagguggaucaccugagaucaggaguucgggaccagcauggccaacagagugaaaccccaucucuaccuaaaauacaaaaauuagccggacguggugaugcgcaccuguagucccagcuacuugagaggcugaggcaggagaaucacuugaacccaggaggcagugguugcagugagccgagauugcgccacugcacuccagccugggugacagagugagacucugucucaaaaaaaaaaaaaaaaaaaaaaaaaaaaaaaagauaaacaguaauauaccuaggaauucuacguugucucugacaaauacacaagauggacuuaaaauuaauuaucuugggaauaucuuuuaccugucggucuguaguuuccaaguucgaguaugcugagcagcaucaccaugguguugcugaugcaaauguugaggaugccuccuuugcugcuguucuuguugaacuucuacccagcauggaggaacagucgcugaaaaccuuggagucaaagucucaaagcggguuagcuccacuagggaugucaagauuucaagggugaauggcugguccaccaauaaaucaacuccuuaacauuagugagagcaguauuugaaauagguguggaaaaaaaaaaaaaaaaaaaaagaagacaaugaagugaaguuuuaauucauggguagguuuucuauugcaacacuugccaaauauucugaaaguuaauaaagugggcucagguaucuauauauaacuaagauaacuaacucuggcuaaaaaauagcaaagaagaaaauucuaacuuaaauauuuaaaauuagagacaauacucgcuauugaagaaacccaaacccaaccuguuagaaaagggcuuacugaacuuuagcccuaauaaggauggcaagaaaagcagugguacuaaagugcaagccaauguacaucagaccaauaauuaacuuuuagacccuauuuuuuaaaaaauaaaaugcuagacaucaagcaaguacauaacauaugaauaaaacacuaaaacagucaaaagcuaugugguaaagaaauacuuacaaacugaaaaauuaaauuguuuuuucuauuucuguggcaguuaagaaaaucuugcauacaugcuaguauuauaagaguaauaacgugcuucauacuaauuaggcuucuuuacaaaugcuauacauguauucacaucagugaaauguauaacauuaaaaaaugcuaagccauuguucccauuuuaaaaaauuaauaaaauacuaaaauauaaaaucugguagguuuagaguauuuucacaauaaaaaaaugacagcaaguucuauaaaauuauuacaaguuuaauucaaauuacaucuuuuucucaaagucuagacccuuuuaaaucugcuuaguuuguaaauauuaacagcaugucaaucuucuuucuuuccauuauuuauuucuucauuacaaaauucaucuuuccucuacuaaaaagcauuuuucuguacuuuauaaaaaaucuucuccauucaaccaauaaccuauaaaauaugagaauauucaguauuuuagcuuuuuauaccaaguuguauacuuaaccaagacaccuugguuaacucaaguaacuggagauugagaagcaggcuacuaugauuucauaaaagucuacaaggcaaauaaugauuuuuuggcagggaguagcaugcuagcaaaacuucuuuugaaaaauuagcucuggagggcaaugugggucaaggaugggagaaaaaaggcaaaaacaacaaacaaauauaaacaaaccuaucgagagauucaggauggggcaacguaugugugaauauaccaccuaaauauauccucagugacaguauuuuuuuuucaccuuuucaauuccaguaguaauauuaauaauaugagccagucuacuaauuuuauucuuacuuaaugaauucucuuuuauaugauuuuucccuccucuaauuagacuaaaagcucauuaauggcugaaauguuuguuuuaaccucuuagaugacuucacaaauauugaguaacauaccauacagguugagaaucacuucuuacuuuaauauguuuacaucuuccaacaacuagaaaaaugauaaauacuaccuauucuuuuuuuaaaaucauuuaaaaauuuaauaucauaccugaaaugccaggacuugaaggauuugauaaagguuuggaaccuucugaagaugguucuauuccuuuagaaagagauccauccacuaguauaucagcuucaucaauaucaucacagguuccuccaauuuggagaaaaugaagcucaccaccuacaguguaguaaauuucauagauacaugaaaaauagguaaacauucaaauauucaaauguaauacuacuuaggaaacaacugaaugucacuucauaggcagauaaggaaagcuaccaaugugauguauuuccaagaguuuagaaauuuaauugccaaggaauuacaaauugaaaccaaauuuuuaugaagaaaaugauaaauacauaaacauacaugaaaacagguauuuaucuaguauuuacuuuuaugagacaguauuuuaagugcuuuaauuaauucauuuacuuuuuaccaaaaacccuugugguagaacuauuacuguggccauuuuacagaugaggcacuagcuauacuggaauccacagccagaucucuuaaucucaacaauaacaaaacuuaacaaauacucuuauuuuuuaaagcauucacaaugaaaugaaggcaacucaaauuucuaguuuaaaaucucugucacaggaaaaaaacugacagcaaauuuagcuuuaauuaagacaaaaaaauuaauggguaauaguauauucuaacauucuaauuuggagauucacuuccagcauagcagaagaaggaagaugauaaauccccuuccugaaaggcaacuauaaagcuagacaaaacuguaauuuaacgagggugagguaagcagugaaaaccagcacauucacugcuaucuccagaugggacuugauugauggagagcguccaguuuaaacaggugauuucaaugggaaacaaacaaggagaucugcuacuugaggucacaauucuguguggggcaagcaaagcacuggaaacaccagggauuuaacacagaauuacauguagugagagaagcacagggggccugguaaacucuccacaaaucccaccuugaucagaggcugugcacguguccagcaaagaccagagggagccgaagccauuauuacauccucagucaacuaagccucuaugccuaugcaaaagagaccugagaaagcacaacagaaaauaaaagccagggcacacuugagcacagccuuacuggcuaaagguauuuggacaccaaaccuaucaaucuuuggcugaauacuaagcucugcugccccaaaagaaacaaaauaagaaacaagucuuaaaaauuaaaacuaggcagaauaaaugacagaaaucagcagcugcacaauacagaagagauuuuacagauucagauuucacagauucaacaguuuguuuguuuucacaaaacaaacaaagcaacaaccaccuggcaaaagguagggagauacgaauccagauugcuauaguguuguuuuaaauguccaguaaauaaauaaaacauuacaagacaugcaaagaaagagggacccacauucaagauguaaaacacacacacacacacacaccugaaaaugucuucucggacuucagauuuagcaaagaauucaaggaucuauuguaaauauuuuuauagaauaagaggaaaccagggguauagagauuacaggaaauaaugguauaaacgacucaacaaacaaaaauauuuuuaaaaaaauuaaaggccaggagcaguggcucacgccuguuaucccagcaccuugggagacggaggcgggcggaucaccugaggucaggaguucgauaccagccuggccaacauggugaaaccccaucucuacuaaaaauacaaaaauuagacaggcgugguggcaggcgccuguaauccccugagcuacucaggaggcugaggaaggagaaucgcuugaacccgggaggcagagguugcagugagcugagauagcgccacugcacuccagccugggcgacaagagcaagacuuugucucaaaaaaaaaauaaaauaaaauaaaaauuaaaagaagcuuggagaccuacaggacagauaaaauauuaagaacauacauguaaugggaauuccaugaagaagagaauuccaccugaaaaaauaaugggcaaaaacuuaccaaaucugauagaaaaccacaaauucacucaaguucaaugacccucaaauaggauaaacacaaagaaauaacacauauauauauaagcucuugagagucaaaggcaaagggaacaucaugaagacagcaagauaaaaauuauucaucagacaugaaaacaacagcacaaauuaacagaucacuaugagaaacaauggagaccagaggcaauggaaugacauuuaaaguacagaaagaaacugucaacagauucucuauguagcauuaauccucaaaaaugaaugugagaugaacacauuuccagaaaaacaaagacugagagaacuuuaugcuagcaaccugccuuaugauaaguaacaaagaaagccccaaagaaagccccuuuaagaggaaggaaagcaacaucaaauucacugaaaaaauaaagaacagaaaugguaaguaggugaauauaauaaauaaauguuuuucucauuucuuugccaacuuuuuaaaaagauaaugguuguauaaaauaauuguaacauguuuuguuggguuuuguuuguuuuuuguuuugagacggagucucgcucuguugcccaggcuggaguacaauggugugaucucagcucacugcaaccuccgccuccuggguucaagugauucucccugccucagccuccugaguaguugggauuacaggugcccaccaccacacccggcuaauuuuuguauuuuuaguagagacaggguuuugccauguuggccaggcuggucuugaacuccugaccuuaggugaucugcccgccuugaccucccaaagugcugggauuacaggcguaagccaccacacccggccauucuguuggguuuauaacauacuuaaauguaauguaugggguggggagagacaagagcaaaguuccuacauauuuuacuagaauaaaguauuauucugaaguagauuguauuauuaauuaaaccaccaaaauauaacucaaaaaaaaguaguaucagaaaaagaaaccagaaucaacacggggaccagugauuucaugccaaauggcagaguaggaagcucuagggaucagucccuccaccaaagcaaccacucaacuagaaaguaugauuggaaucaacuauuucagaacuaugggaccuaacaggauaucuacaauaaacagaggagacugauuucugguaagaggguggccuaaaugaaccagcuaccccuccauacucagcccugacacagcugugggggaaaguggcacaugugcuggaagcagcuggcuggugccagggcggacaggagggaccuucucuucccaauauauaggguugugcauuuugguuggucuagcaguucccuaagggaccagaauagacucuugccuggguuucacccuucugagacugcagcugcuacuccaagcagcagccaccagaagauuuaaggggacaaagccgaaacaggaucuacaggaagauuuaaagagauagaacucuuuuuuggaaggauaagaguggggagaggguucucuagccuuuguacaaauaguuugaaaaugucacaaauggauggcugcagcuggaaacaagcaaaaucucccagagugagagaauaagauuucuagagguaccacauuacaauacucagaaaguucugacuacaacaaaaaauuacaaagcacucaaagaaacagcaaaguauggcccauuuacaggagaaaaaaaaaaaaaaagaauuaccagaaagcauaccugagaaagcccagauauuggaauuauuagucaaaaacguuaaaugaauucucuuuauauagccaauuagcuaaagggaacaauggacaaaaacuaaagaaaaacaggaaaaugauguaugaauguaagauuaucaacaaaaagauaaacuggacuuuuucaaaaugccaauguuuugugcaucaaaggacacuaccaagaaaguaaaaagacaacccacagaauaugagaaaguaaguauuugcaaaucauaucuauuaagauaugaauccugaauuucuaaaaauguuccuacaacucaaucaaaaaaaaaaaaauucaaaaguggacaaggacaugaauagauauuucuacgucuauuauagaaauacaaaucaccaauaaacacaugaagaaaugcucaacaucacuaaucauuaggaaagugcaaaccaaaaccacaacagauaccacuucacaaccacuaguugucaaaaagaccaaaaauaacaaauguuggccaggauguagaaaaacugggacccuuccaaacugcuuguggaaaugcaaaauggugcagacucuguggaaaauaacuuggugauucucaaaagguuaaacauaggccagacgcgguggcucacaccuguaaucccagcacguugggugggcgaggugggaggaucaccugaggucaggaguuggagaccagcauggucaacauggcgaaauagugucucuacuaaaaauacaaaaaauagcugggcgugguggugcgugccuaaucccagcuacuugggaggcugaggcaggagacucacuagagccggggaggcaaagguugcagugagccgagaucgcgucagugcacuccagccugggcaacaagcgugaaacuccaucucaaaaaaaaaaaaaggguugaacauagaauuaccaugugacccaacaauuccacuccuagguauauacccaaaacaacugaaaacggguacucaaauauuuguacaccaauguuuauagggacauuauucacaauagccaaaauguggaaacaacccaaaugcugaguuacaauagucaccccuuacaguagucacaguuccaagaccucgcagugaugacugaaacuguggauaguaucaaacccaauauguauauauauuguuuuuucauauauauauauucauauauauacacacacacauaugauaaauuuaauuuauaaauuaggcacaggaagagaugaacaacaacaaaauagcacaaugauagcaauauacuguucacaauuucacaaacagaagauuuguucuuaccauaaaucuuagaaaucugcacauaaaauauuuuucuuuccaagucaaaaauuucgccuuuucaacauaaagaaaaaacuucaaaacggcuucacuuuggcauaucccauagcuagcauuaccauucuugaacuuuagggccauuauuaaguaaaaugguuacuugaacacaagcacugcgauaccagugacagacaaucugauaaccaagacagcuacuaagugacuaacagacagguaguguauacagcauggagaugcuggacaaaaugaugauuuguguccuggaugggacaagaagagauuuuuaucacacuacucagaauggugaguaauuuaauaauuaucaauuguugauuucugaaauuuuccauuuaauauuuccagaccaaagcugaccacagauaacugaaaccacagauaaggggcagggauuggggggguggaugggcccuacuguaauggaauauuauuuggcauaaaaaggaaccaagaugugauacaugggugagcauuaaaaacauaaaaaauaugcugagugaaagaaaccagacacaaaaggacaaauacaugauuccacuuauaugagguaucuacaauaagcaaagucauacagaaguagaauugagguuaccagcagcggaggguagaaugaaugggaaguuacugcuuaaugguuacagaguuuuuguuuaggaugaugggaaaguucuggaaaucaguacuggugguuauacaacauugugaauguauuacagccacuacauuacaugcuguaaaacaguuaaaauaguaaaccucauuauauauauuuaacacauuuuaaaaagaaaaaaaaaauuauaacccaugacccaauaauucuacucuuaagaacugagagucucaggccgggaacagugggucacgccuguaaucccaucacuuugggaggccaaggcgggcggagcacuuaaggucaggaguuagagaccagccuggccaauauggggaaaccccaacuguuuuguaaaaauacaaaaauuagccagacgccuguaaucccagcuaaccuugggaggcugaggcaggagaaucacuugaacccaggagguggaggcugcagugagcugagaucggcaccacugcacuccagccuuggcaacagagcaagacucugccucaaaaauaaaaaaauagagagccccuuacauaugugcaccaaggaacuuacacaagacguuuauagcagaaaaaaacagaaauaaacaagauguccacugacaggaaaaugcauaaauuauuuguggguuuuuugcacauuggaguacuaaguauaagugaaaauuaaaugaucuacaaggcaugcaacaaaauggguaaucuuaaaacauaguaagagaggaaaaucaagucccccaaaacuaguuagaguuugguaucauucuuauaaagggcaaaaacaagcaaaaucaauaaaauauguugaaauauucacauccaaagcauaaaaccaguuuucuuuauaaaaggaaagacauaaaaauuauugaguaacaauuaucuguaggaaaagggcagaguuugggagaggggaggagggacacauucauagaugcaagauauccauacugcuuuaguucuugguuugacaguaggucucugggugucccuaacaaauuauucuucacuaauguuauguaaauuuucuucuaaaaaaaaaaucaacagagggauuaaaauggcacacuaaaaauauuuauucaacacaaaagaaugcagugaaggaguaacaaaggaauguaaagaacauuuuaaaaacucaaaauggcagacauaaaugcaaccauagcaauaauuaccuuaagcguaaagucauucaaauuuaaaagguacagguuauccaacuguauaaaaaagcaagaccuaauuauaugcaucuaagagacccacuucagauucaaaaucacaaguuaguugaaaguaaaauuguggaaaagauacauaauacaaacuguaaccauaagaaaaccagagugauuuuauuaguaugacacaaaauagagacagaggaauauuucauaaugacaaaagaaccaauacaucagaacgauguaacaauuaugaaacagucuaacaaaagagccaaaagucaagugaagcaaaaacagacuuaaaagugaacaauucaacaaaaacauaguuagggauuucaauacuugcucucaaaauugauagaagaaggcucaauauaaaaucaggaagacuucaacaacuaaaaaacauacacguauacaagugaaauuuauacgacacucuaccccaugggugcccaacacaaauucuuuucaagugcacacagaacauucuccaggacagaccagaugcugggucaugaaaaagucucaauaaauuucaaaauacugacuucauauaaauuauauucucugacagcaauggaaauaaguuugagauccagaacagaaagaaaucuagagaaaccucaaguauuuggaggcuaaacaaaacacuuuuaaauaaucucugggccaaacaagaaaucacaagggaaauuagaacauauuuugauccaaaugaaaaaaaggaaaaacacaauguaucaaaauuuaggagguaucacuaagacagugcuuccaaaaauauuuauggcuuuaaauuuccuauauuagaaaacaucucaaaccaauaagcuucuacuuuaagaaacuaaagaaggccagcgcgguggcucaugccuguaaucccagcacuuugggaggucaaggcgggcagaucacgaggucaagagaucaguaucauccuggccaacguggugagacccugucucuucuaaaaauacaaaaauuagcugggcgugguggcucgggccuguagucccagcuacucgggaggcugaggcaggagaaucacuugaaccugggaggcagagguugcaguuagccaagaucgagccacugcaguccagccuggcgacagugaaacucugugucaaaaaaaaaaaaaaagaaagaaagaaagaaagaaagaaacuagagaagagcaaaauaaacccaaaucaagcagaggggaggaaauaauaacaauaaaauggaaauccaguaaaugggaaaacagaaaaauaacaaagaaaaaaaugucauuuaaaucagaagcugguuguucugaaaaaaaaaaaaaaaaucaauaaaacagauaaaccucuagacagaugaagcaggaaaaaaaaaauacaaaucaucgaucaguaucacaaaugagaguggugacaucccuaaagagucuacaaauauuaaaaggaauguaaggagccaggcaugguagcucacaccuguaaucccagcacuuuaggaggccaaugcaggugaaucacuugaggucaggaguucaagaccagccuagccaacagaguaaaaccucaucucuacuaaaaauacaaaaauuaaccaggcauggugguguaccuguagucccagcuacucgggaggcugaggugacagaaucacuugaacccaggaggcagagguugcagugagccaaaacugcaccacugcacuccagccugggugacaaagcaagacucugucucaaaaaaaauaaaaaguaaauaaaaugauuguggggaauauuaugaaauucuuuacgcuaaaacuucauaacuuaaaaacugacaaaaagacugucagaacucacuaaaaaauaaaaaauaaaaaaccuuaggaagucucuauaaacauaauugaauguguauauucaaaaucuucccacuaaaaaaaaucucugggcccaaagagcuucacuggcgaauucuaccaaauauauaaggaaaaauaagaccaauuauacacaaacuuuaccacaaaauugaagagcgaauacuucccaacucauucuaucaggcaagcauuacacugauaucaaaaccagauaaagauuacaaaaagcaaaaacuaaaaaagaaagauuacaaggaacauauaauaucccugaugaacgauaugcaaaaacuaugaacaaaauuuuagcaaacuguauccaacaauauauaagguaaugcauuaugaccaaauggguuuuaucccaggaacgcaaaguugauuugauauccaaaagucaaucaauauauuuuaccauacugaacuaaaaagaacaaccaaaugaucuccauggauguaaacaaguauuugacaaaauaugacguucauuccuauuggaaacucuuagcaaagcaggaacagaagacuaaaggaauguuuuccacaagaaacaaguaccaaaacaaggaugugaccauacaguccaauaaucccagauagugagauuauuaaagacuuucaaagcaauuauggcucaacuuauuauccuccuucugaauaucaguacagguauauaggcuuuauguuguuggggucauauuuauauucaguauuguuauauuucaugauauguucccuauuaauugcggccuuuuaaaaaacuuuauuuuuuaagcauuuuuugucaaguaucauaacugcacccuaucuuauacuccacugauacaucuuagucuucuuucucauuuaagucuuuccuguugauuuuaaauguauuugcaccaagcagaauaccaauuuaucuuucacuuuaaacucucaauuuuugaaauucauacuuuuuuauuuuaugccuuuuacaaaauuuuauauguaguguguauauauucuauuccugaauuaucaaagauagcuuaacaaaucuacauuuaguauauuauuaauccuauauaaaauuaacuuaaaacauauauuaacuauagauuuauuuuuaugaaaagacuugauucuccacaagaaaaauaguuuuauguuauuugaauauacucagaagacagggucacauccauuugauucagucugagaugcuuuuuaaaaaucauacauguacauacauuuuaaggcaucaacuuuucuuuccgcuuuguuauuaucuuuucaaaugcaccuucaucagucaaucccugaagaauuaggagcucauuuugaaagcaacuaacuucucagguuuuucuuaucuuucaucaucuggauaaauucccuaucacaugagaucauguucuaggaauuccggacuguaccaacuccaagaaaaccaccaucuauuuuaaauacuuuuuuguuuguuuguuuuguuugagauggaaucuugcucgguagccuaggcuggagugaagugacgcgaucucagcucacugcaaccuucuccuccuggguucaagugauucuccugucucagccucccaaguagcugggauuacagguaugcaccaccacaccuggccaauacuuuuauuuaaaugcuaaaaaacuuaauaacuuaaauauuuaagguguaaauacuauuucucuucugaguuaccuaaagcauagcucaucaaauaauugaaagcauuaaaaacccuuauugcauuucuggaaaauaguaguuucuuauaaagaugugcaccggggugccaugucaccuagguuccaaguccagcuccauuuuagaugaccuacagcaaguuaaauaauugucaauuuuuaaaucuuucagauuaaaagaaugcaaagaauucaguguaagauucuucaucuuuuguuguauuauggcaguauaaugccauuuaaagugcucugauggaagacucccagguuugaaugcuggcucugacauuuauuagcucuauuacuuaauaaguuacuuaaccuuucuuuccuucaguaucauuauguacaaaacggagacaauaauaguauauuaaaguuggugugaugacuaaacgaacacagguaaaguucuuacaacaaugaacuggcacauauaugaccaauaaauucaaauuaucucugauaccacacagaauuuuaaugguuguucugaaauucucaacuguaauuccaaguuucauuagucuaaaguuacuagacuacacugcucauuuucuaaauuaaucuaguuggauuuuuaugauauuuaaagauuuuuuuccauuauacuuucacuagaaauuacagaaauuucacuggguacaguggaucaugccuauaaucccaacacuuugggaggccaaggcagacggaucgcucgaggucagcaguucgagaccagacuagccaacauagugaaaccucgucacuacuaaaaauacaaaaauuagccaaguguggugacgcgcaccuguggucccagcuacucaggaggcuaaggccggagaaucacuugaaccugggaggcagaaguugcagugagccaagauugcguaacugcaccccagccuguugacagggugagacucugucucaaaaacaaaaaauaaaaauaaaaaaauaauuucacuacauauaguucaaaaaaggcaaucuaaccacuacauuucaccauuacguuccuuggcuaaacucuugaaaucuauuuaaagagaggaaaaacagucuaauuacuaucagaaccacagaugagaugcaugcguaacucugcucagauccuaauuccucugccaugccuuaguuacagucacuuaggcuucaacuaucuccuaguccuaaauuccugcuagacaaucaauagaacuauucauuuugccugauauugucaguaauccuuuucaaaaacugcuuuaucucccuaacuuaaaauguauauaaguaaaaaaaauaggccaggcacaaugccacacgccuguaaucccagcacuuugggaggccggggcaggcagaucacuugaacucaggaguuugagaccagccugagcaacauggcgaaaucccauuucuacaaaaaaauacaacaauuagcugaacaugguagugcguagucccagcuaugcacuguagucccagcuauucaggagaccaaggcgagaggacuacuugcacccaggagguugaggcugcagugagcugagaucaugccacugcacuccagccugggcaacacagugagacccugagaaagaaaagaaaaggccuggcaugguggcucaugccuguaaucccagaacuuugggaggcugagguggguggaucaccugaggucaggaguucaagaccagccuggguaacauggugaaacccugucucuacuaaacauacaaaaaauuagccgggcauggugccacgugccuguaaucccagcuacuugggaggcugaggcaggagaauugcuugaaccugggagcggauguugcagugagcugagauugggccacugcacuucagcuugggcaacaagaaugaaacuuccucucaaaaauaaaaggaaaagaaaggaggggagaggacggggaaagaaaggggaggggggaaagaaagggggaaaggggaaaggaaaaggaaaagaaaggagaaaaaaagaaaaaauaacugcacacuaucuuaaucuauauagugcuucaaaauuugcaaaacuaauucacuacuagccaaagaucaggaauaaaucagacaaaaaaauguauuuagcaaaacuaaaaauuguuugcuaaguauuuuuauuucagaaggaaauaaggaccaauaacugugccagaaacuuuacauaauuucauucuaauaagccuaggaaauggacuuucuuauccuaguuuauaaauaaauaaaaacagguuuaaugaauuuaacauaacuugcccaaggucauaaauuugagcagaugcagagucagggacucacugaaauaaaagcacgugauuuucuugagguuaaagcagaagauacuugcuaagugacuuacuaacuuauuuacaguuagaauccuuaccuagggcaguagaaaaaaguuuuaagaacaguuuaaaaagaaggauuuaccacuucauuacaaaaaaauuaauuccuccccaucuauuugaaccuaaaauucauacuagguuugcacauaaacaaaugccauauauacauggauuuuauaagauuuauagcauaaucagacaacuuaccuuuggugcaugcacacagccugucugugccagaacaguaaaucacagaaacaaauguguccuguuccucagugcccuccuuuuugggaggcuccacuuuggccaaaauuucaaaguuugaaagaucuaguauuuuuacauauccucccugagugguuauuaccagguguccaagaguagaaaugucagacguuuuuucucucucaaaaccauucuuugagguuaacugcauguccucaauagguuccucacagucauccucucgauuauccaauauaucggguggaagcaaaaugagcgagguaauuguguccuggggaucuuugauauguuguauuuuuauuggcuccucuucuaaagucacuauccgaguggcauaauucauuuuauaaagcacuaaauauccaccacuaacauuccucugcucaggcugaauuauuaaaggagucuguacaucugcuggugauucauguuggauuacacuaauauuugcaccauucacuacagcaagauuugauuccagcucaccuuuccgucuauuacauagugcagaguuuaauuuauuuaaauuauucaaggccucuacuugauuuauugcacucaaggauucaacagggcauguccgcaguccuaccaacaaaugaauuccgucagcacaaggaguuauugagucuauacaaagauucuccuccucugcaaacuuuggcagccucaagcacugaaccaaagucccaggcuugggaaacacagaguuccacuucucagaauccggagagguaagguuggcugcugcaucugcaaauugcugaauguaagucacaggaggauccugcaauaacaacugcuccugacuauccagcuccauuucaauaaucuguggaacaguaaaaccaucaucaugcaaacuuuuacucauaauauuguucaucugugaaaagaucuuuccugcuuucucaucagauuccuugaugcuauaaagaagcaaaaccgguaaaguccuccuuaccagaggagaauuuaguucugaauuagugcaggauucauugucaguugacccuuguucugauauacuuucacccugaguucugcuuaaaccauccagugaccugugagaauuacuacuaaugggugagguagcaggagauuuauauguuaauaaaccuccagcuaauaaacauggaaaaggaauguuguguugcuccuggugcuuuuccuuugucuuuucacucuuagaguuuguuaaacaaggauuugccccaaguucuucaagauccuuaacaguaucuucaagcacauuugcaacaaucucccacugaaguuuuucuggcuguuggagaaugcugagugcuguuauaucaaggcuuacuuccauggcuuccuucugugauguaugcccuuuaaaaaggaacaauauucauuagauauguuucuacucauccagucagcacauuaugaauacacaaguaaaauuauuuauuuauuuauuuauuuauuuuugagacaaauucuugcucugucacacaggcuagagugcaguggugcaauuucggcucaccacaaccucugaaucccagguucaagugauucuagugccucagccucccaaguagcugggauuacaagcucacgccaccacacccagcuaauuuuucuauuuuuaguagagccuggguuucaccauguuguccaggauggucucaaacuccugaccucaggugauccacccaccucagccucccaaagugcugggauuacaggcgugagccaccacgccuggccuaaaaaaauuuaaagugcagucagcccuccauauucacagguucuacauccacggauucaacuaacugcagauggaaaacauuuuuuauuuacuuauuuauuuucuggagauggaguuuugcucuuguugccuaggcuggagugcaauggugugaucucagcucaccaaaaccuccgccucccagguucaagcaauucuccugccucagccgcaagaauagcugugccaccauacccagcuaauuuuguauuuucaguagagacaugguuucuccauguuggucaggcuggucucaaacucccgaccucagguaauccacccgccucggccucucaaagugcugggauuacaggcaugagccaccgugcccagccggaaaacuuucuuuuuuuaaaaauggauggcugcaucucuacuaaacauguacaacauguacaaacuuuuuugccaauuaacaauagagcauaacaacuuuuuacucaguauuuacauuguaguagauauuauaaguaaucuagaguucauuuaaaguaacaggaaaauguagaugugcauagguuauaagcaaaacuauaccauuuuauacaagggacuugagcacauccagguuuugguaucuagagaggguccuggaaccaaucccccauaaauaccaggcuguuuuuuuucuuuuuuuuuuuuuucuuaagacauaaucaaaucuaagaugagcuuacucagaaaaaccguaaagguauucaagggacucaaaauuauuuucaacuuaggccaggcagguggcucacaucugucauccuagcacuuugggagguugagguaggcagauuaccugagcucaggaguucgagaccagccugaguaacauggcaaaaccccgccucuacuaaaaauacaaaaaauuagaggcugggcgcgauggcucaugccuguaaucccagcacuuugggaggcugaggcgggcagaucaccugaggccgggaguuugagaccagccugaccaacauggagaaaccccauuucuacuaaaaaugcaaaauuagcugggugugguggugcaugccuguaaucccagcuacucaggaggcuggggcuggaaaaucgcuugaagccagaaggcggagguuguggugagccaagaccgcaccauugcaccacagccugggcaacaagagugagacuaugucucaaaaaaaaaaaaaaaaaaaaauuagccgggcaugguggcacaugccuguagucccagcuacucagggaggcugaggcacuagaauaaccugaaccugggagacagaaguugcagugagcugagaucacgcaacuguacucucuagucugggcaacaagagugagacugucuccaaaaaaaaaaaaaagucuuuucaauucaaaauauauucucuuggcaauuugugagcaaaaccuuuuuucaaaaaaguaaugugauuaaagaguuaaaaaauauuauuuauacauaacuuuaaauuaauaucaaaguaacagaauuucugcacuucaauucuaaaccaaagagagaauacuacuuaugcaucugucauuuaugcgcuaugcaaaauauccauuaaaaaagauuguaaucucaguuuccuuucuuucgccacucugaaggaguuauaagcaccauuucuucucucucaccccauccucugcugauuaucaguggaaugucagaaaauacaauucuaaccucaguuuagaaaaaaaaaaauaacuaggaagaaaaaguuccaaaacuguaucaucuuuaugugaaacauucagugucuucuguauuaucugcuaaucuuuauuucauuuaaagccacacaacuacauuacauuauaucaucuuauucaccuuuauucuuuucuuuuuuuuuguuuuuuuugagacaaagucucacuauugccacccaggcgggagugcaauggcauaaucucagcucauugcaaccucugccacccagguucaagggauucuccugccucagccuccugaguagcugggauuacaggcaccugccaccacgccuggcuaauuuuuguauuuuuaguagagauggguuuucaccauguugguccggcuagugucgaacuccugaccucgugaucugcccaccucggccucccaaagugcucggauuauagacaugagccaccaugcccugcugaccuuuuuucuauugugccuucuuuaaacuauucccuuaaaaguaguacagucucagaacucaguuucuauacugaaacacaggacugaguuucucagucucaaccuuuaaaccugugauauuaaucacaaagccaggcguuguggugcaugccuguaaucccagcuauuugggaggcugagguggaaggauccuuuuagauuaggaguuccguucaagaccagccucagcaacacaguaaaaccccguuuccagaaaacaaaaaaaggaaagaaagucuuacaauagaugucagucaacucccaaaucaaguauaaucucuugacgcuaaacugaaaauucuuuccacugaucugucucuaucucaauggcagaaacuucuuucagucaggcagcaacaucauuagcaauaauaccauaaagaccacuacagguuaggccagacgcgguggcccacaccuguaaucccaguacuuugggaggccaaggcaggccagaucacuugagcccuggaguuugagaacagccucuccaacauggugaaaccccgucucuaccaaaaacacaaaaaguagccaggcauggugguacaugccuguagucccacugcucaggaggcuguggcaagagaaacugcuugaacccaggaggcagagguugcacugagcugagaucacgccacugcacuccagccuggacaacagagugagaucccgucucaaaagaaaaaaccacucuaggcgauuuucgaaaauacaaaaaauagaaaauuuaaaaaaaaaaaauaaaaaaauaaaauauauauauauauauauaauugccuuaaugauuuagauuggaaaaacagagaaaaggaaauaaauauaaaagugcucaaggcugggcguggaggcucacaccuguaaucccagcacuuuggcagggugaggcggguggaucaccugaggucaggaguucgagaccagacuggucaacauggugaaacucccgucucuacuaaaaauacaaaauuagccaagcgugguggcaugugccuguaauaccagcuacuggggagggugaagcaggagaaucguuugaacccgggaggcagagguugcagugagccaagaucacgccauugcacuccagccugugcaaaaaagcaaaacuccgucuuaaaagaaaaaaaaugaacucaaggugacuccaugaagguuugaaaguugcccaaauaggcugggcgcgguggcucacgccuguaaucccagcacuuugggaggccgaggaggguggaucacaaggucaggagaucaagaccauccuggcuaacacagcgaaaccccgucucuacuaaaaauacaaaaauuuagccgggcgugcuggcgggcaccggcagucccagcuacucaggaggcugaggcagcagaauggcgugaacccgggaggcggagcuugcagugagccgagaucgcgccacugcacuccagccugggcgacagagcgagacuccauuucaaaaaaaaaaaaaagaaguugcccaaguagagcaauaagcaacugagauucaugaagaaccacuuaggguaacucaaagcucuguuuacaccauuuuacacuauuuuauucaugaucucuucuacaugcucacuggcauaucuagaauuucccauaaucuggggaugaugucauuucacauaacaugacuacuacccccuaaaacggaaauauuuucuagcuacagcagaaaaaaauuuucaguauaaacaugauuuaauuguauuaaugaagcuguucacuuauuuaaauacucauuuggcuauagucacaugcagccuuuuuucugucauucaauauucauguauauuuucucuacaauucagauuggaaauugaaggcugacugaggugguuuuguuuuuuguuuuguuuuguuuuagacggagucucacucuguugcccaggcuggagugcaguggcgcgaucaacugagauauuuuuauaacauguacuauaccacaauaaauccugaggaugcccaacuggacuaaacugacaaauuuacuuaaauguuuucuuucuaaucuauguaggaaacugccaagaaaaaacaauuuuggucuauguauauacuaugacaaaauaaaccauaaauuacauauauuaacacaaauuucagucaauauucaaaguaaaugguaugugaggugagacuuuauuaaaaaggaaaauauuacaaguggcauuauuacuuugcugcuucucaaauauuuauucaacaugugggaagcagcauaaacuauacauucuacucagaagggugacaaagcacacugaugacugacaaacgcccugcagaacuugucaacucuaccuauuucagaauuucuaaaaccuacuaggccaaaaaauaaauuuuuacacaaauaccuacaaacaagcaccagcauaauauucuucagacaaucauuuuaaaaacccuucucuauucugcuuauuuggguaguguuaaccaaacuuccucagguaagcaauuagguuuuaucuaggcacucuuuuaaaacucaaauuucaauuugagcccuucuuuaacuuccuaccaaacauucuucucaaucuucacaagaagccauguauacuuaauucugaucugugguucaaauaccaaacuuuucccuaugcaguccucuuagauaucuucaaaccucauaaccuccaacuaaaaaacaaaugucucuuuaucugcacucacauuuuugaaauuaagaaauauauuucaauaggccgggcacaguggcucacaccuguaaucccaacacuuugggaggcugacggagguggaucacuugaggucaggaguucaagaccagccuggccaacauggugaagcccuaucucuacaaaaaauacaaaaauuaggugugguggugggcgccuguaaucccagcuacucgggaggcugaggcaguagaauugcuugaacccaggaggcagagguugcagugagccaagauccgugccacugcacuccagccugggcaacagaaugagacuccaucucaaaacaaaaacaaaaacaaaaaaaaacagaaaauaaauauauuucauaauucuucagauuguaucauccaauuugaugaaaaucacuuagaacugugauuuccaccaaauuggauaugcucugauaagucugaaaugguaccuuaucacuuuuuagauacuucaggaagagaagacaccaaucauuaauaucaaauauauauacaugacuacucuauaagccuccauaaagucaccaauggucuuccaauauaacaaaauuaguuuagaagauacauacuuuuacugugaaugaauaagcuacuuacaaauccucaaaugaggcaauuaaaaauuuugaacuggaaagauauuuucucuuaccacagcuacuguuuaauacauaaagacaauuuuuacaccccuaaaugaagugcuauauguagucgacaaaaauacaugauaauuuucaagacacuauuagcuaaaguaaacaugauuacaguaucuuuaaaaugugugaaaaaucaaacaggcauagaugaaaagaauaaagguagaaaaaggguaagaaaauuggccaaauacgaguauuguaacuguaaaaacauguacugagauccuuagacccagggaaaauaacaaaacuauagcacacaaaggaaagguuccagugacaaucaaaaaaaacuuaacauagcaaacacuuuacaaaggaaaaacugaagcccacaguuuaaguaauuuaacaagaccaaggaguuauuuuuugaaagaguucaaaaacuuggccgggcgcaguggcucaccucuguaaucccagcacuuugggaggcugaggcaaguggaucaccugaggucagcagcucgagaccagccuggccacagagggacacuccgucucaaaaaaacaaaagaaagagccaggucuggccgggcacgguggcucacgccuguaauccuagcacuuuaggaggccaaggugggcagaucaccugaggucaggaguucaagaugagccuggccaacauggugaaaccccaucucuacuaaagauacaaaaauuagucaggugugguggcaggcaccuauaaucccagcuacucacgaggcugaggcaagagaaucccuugaacucgggaggcggauguugcagugagcugagaucacaccacugcacuccagccugggcaacagagcaagacucugucucaaaaaaaaaagaaagaaagaaacaaagaaagaaaauguaguaguaaccucuuauguuuuugcaaaagaacaaaauaggaaaagagcauuagcuuccucagucuauguuuuuuuaaaagaaaaaaaaacaauuuuuaacuucucuagaacgaauuacacauuugcacauuuuuaagggcauuuuccugccuuauuuggugauuuuuuuuguucauugcuaagaacugcuucaaaagacugcuaaagauuaacccaaaauuguccaguguuccauuuagugccuuucaaaaaaaucugaugauaaaauuuaaagaauauuuacuaccaaauguuaacuauaauuuuuuugaacuguacuauacaaaaccauuccucuucuaaaaagauuuaaguuauauauguccauaguacacagcaucuaacauuaaacaauagccacaauuuaauaauggucacuuuuuaaaaauacuggguacuucccaggcacuacacuuuauaugaacuuaucuuaucuaaaucuuuuuuuuuuuuuuuuuuuuuugagacagaguuucucucuuguugcccaggcuggagugcaauggcgcaaucucagcucgcugcaaucuccgccucccggguucaaacgauucuccugccucagccuccugaguaacugggauaggcaugcgccaccacgccuggcuaauuguuuuuuauuuuuaguagaaacgggguuucaccauguuggccaggcuggucucgaacuccugaucucaggugauccacccgcuguggccucccaaagugcuaggauuaccgacguaagccaccaagccuggccuaauucuuaaaacucuaaauaacagacuuuaauaccaccaugcuauauaucaggaaaugcaaucagacuauauuaaguagaagaguuaggauuuaaauucugacauaguaaaacuauuuugaaacauacuauuagcuuuuccuacaaaauaacauuaaaauacgaaguauauuauuuugcccuaguaucuuaaaagcuaguaaggcagcauuuacuugauguuuuaaugucuauaauuucacacauuaaaauguaguucuuuauucaccuacaugaauaaagagcuuuaaacacuacuuuuaguuaacagaauacauuauacaaauaaaaacauuuaauuaccugacauaugugacaaaacuuuaacguaacuauccacuguaauuccuuuggcucaaauagguaccauuuaaauuuuaaauauggaacacuauguacauacuacuaauuugagaucucugacacacaauauuucagucuucuguguauacuagcaaaaauuuagaguuagcauuaacuaagaaauucagaauuaagugguaguuagcuguaugcacaacuguguaaagaauuuuuuaaauacauuaucuaauacuuuuuacauaccugucacagaaucugaucuggaaugcucuucacugucugaauccuccaguaaaucaucacuuaaaucaaaaaacaaaguaaacaauuugaauuucaaaaaaaguauacaucauaugagaaagcaaagaaaaaagaacaguugguuuuguggguuuuuuugagacagggucucagucugucauccaggcuggaguacaguggcaggaacacagcucacugcagcccugaccuccuccuggccucaaccaauccuccugccucagccucccguguaggugggaccacaggcacacgccaccaugcccagcuacuuuuuucuuuuaauuuuugcagagacggggucucaccauguugcccaggcuggucuugaacccuugggcuuaagcaaucuucccaccucuaccucucaaaguccugggauuauacgcaugagccacuaugccuggccugaaaguacaguguuaaaaucacuacuacacaucucaaccauauaauuaaaauaggcuuaaaugauauauaaagaguaguuugauaucauaacugauuaacaacacugacaaaaaucuucuuaaaucauuaaauaaaugccuaacugaaauaggguauggaaaccuccaagaauccauaauaacauuuguaggaauuugaagacuacugugugacuaaggacaguuugggcaaacaaaaauauaaaagacagcagcaacuaauaaaaucaagcaccagcuugcaguaguaaagcauuaagaacuauucuauuacugaauucaggacagccuaaaaccaaacauaauaguuguauaagcaaguguguauguuuguguacucacauguacaugcaauuuuauuuuuguucuguauuuuguuuuggagaggcuaagaacuccuuuacauauaggaaaacuaugacaacucagaagaugggggucaucaagacaagacaaagucuugucucuaucuccugaccuugugauccucccgccucggucucccaaagugcugggauuacaaacauaagccaccgcaccuggccuacgauguuauuuuauacagaauaugaagugguauuccgcacugaaaaugcuuaaggauauuacugcacuccaaggcaauguuugaaauauuuugcggcggcugggggaaauucacuuauauauuuuugaaaaaguuucucuguuuuaguuuuuucaggugauaacaguugcccauaaaccaauuuaaugcuguaauuuacaaaagcaaaaaaugcaaaaaaaguuuaaaaucagcugcuaauucauuagccuaauuggcugguuucagagaaacagaguaaguguaaaaaugaaucccaagaagaaauauuaauaauugggaauuaucaagaaugaagaaguccaaaccaagaaaacagguuuuaaguauagaauggcugcccauuaaagaaaaauaaauaaccaaguauuaaccugcuguacuaagaugaacaauaaaauuaaguaguaguauguuuuaaaggaauucaggugucuugauauuucaaagacaguugccagauaaaagccuuaaauuagcaaagaauguuuuauucugaaaguucucaaaaauauaaucaggcaacaggcacagugacucacaccuguaaucccagcacuuugggaggacaaggagggaggacugcuugagcccaggaauucgagaccagccugggcaacacagugagaccccaucuccacaaaaaaauaaaaaauuagcugggcauggugguacaugccuuuagucccagcuacuuagaaggcugagguagaaggaugacuugagcccaggagguaaagggugcagugagccgugagcccgggugacagagcaagaccuuguuucaagagaaaaaaaaaaauuauauauauauauuuguaaaaucacauucuuuuaaaauauuuugugacaaaaacauuuuauggcuaaggccagaugcaguggcucacaccuauaaucccagcacuuuuggaggcugaagcaggcacaucacgugaggcccggaguuugagaccagccuggccaacauggugaaacccgucucuacuaaaaauacaaaauuuacccaggcaugguggcacgggucagucccagcuacucaggagacugaggcacaagaaucacuugaaccugggaggcagagauugcagugaaccaggaucgcaccacugcacuccagcaugggcgacagagcaagacucucucaaaaaaaaagaaaaaaaauuauaugaauaaaauaacuaaauuguacacuuacaugaauuguaugguuugaaaauuacacuucaauaaaacuuuuuaaaaaaucacaugcggcugggcguggugcucacgccuguaaucccagcacucugggaggccaaggcagguggaucaucugagguccggaguucgagaacagccuggccaacauggagaaacccuuucucuacuaaaaauacaaaaaauuagccaggaggggucgugggcaccuguagucccagcuacucaaggaggcuaaggcagaaaaaucauuugaaccugggaggcagagguugcugugagccaagauugcgccacugcacucuaaccugggcgacagggugagacucugucuccaaaaaaaaaaaaaaaacacacacacauuuuaaaaagaaacuagaauacauauaaauguuaccauaaucccauagugugauuaugacuacucuauauuucaucaauuuccacuccugcauuuucccauuuuccugcaauaagcaugcacuauuuauauaauaggcacuguauuuacuaaagccuucuacauuuugcaaaaccuuuuacaaagcaauaaacaugcaaaauaaauauuaugguuaaaguaaaaauguuuaguuaagauuauauguguuucugaaaaacagacauacuaauauuguaacaguaccuugguuuacagcaaucccauaaacaauuucauuuacauucaaggaauuuuuaccaacuugaccugauauacaaaugacaagugaaucaucuagaagaaaucuuaauucauuaaaauuaaauguauuagcauaucuucuuccuuaauucagaagacaaauauagucuucuaagaaaaaauugucaaaaacaauuccuuaguccuucaauguaaauaagaaauaaaaacaaauuuuacaaaaacuauucuaagcaaacuauauugcuaauuacuuuaaacuucuuggauaagcuuagauuuuuccaauuaauguauuauucuucaagcuaaugaaacccacauaguauauuuuauaaccaaacauauuggaucuugugucacauaaagugagagguaguguggcucauuauauucacuaucaauuccaacaggacugcuccuacuucuuggggaggggaagugaagagagggggcuuaagguuagggaugaaguuucaccucuucagcuuccuccuaccacaucaacuuaauguuuuuguaugauuuguuugagacuuucuucagagaaaauugaccuucgacccuagauugugaauuucuuaaaagcaaguagagauuaccucaacucaagcacauuaccccauauaauguugagaaguauuuccacuaauaauacagaauacauguuuaucuaaaaugcagauuuuaccuaggagggugugacuauauguguauggguguauguaauccuagaaguauauuuugauuccauuuuuaauccccaaauuacaaaacuucaagacaaaguucaaauuaaaguaagugccuagaaggacauauaaauuucauuaucuucuauuacuuuuccacuaacuucuaagaaaucacagaaauuaagcaugcuuaauaucuaguccuauuggcaaaauauggucagaaacucagacaacaguuaagcugcuuucccauuaagcuuucacagagauuuauauuaauagaacaaccacaaggcuuuaaucaacauguuauuaccaagaggaacuagacagaaguaacacauauauuguaaauuuuccacuaauuccauuaaugaaauaauuuccauuaauaaaacuuuacauuauuccuuaaugaaaggacaucccaccaaagggguugugaaguaaaaugauaaaucacugacuacagaguaacacccaucacaugucaguaacauaaggagccccuggaagugaaauggcagauauucucagucuaucaagacaucugaucacaguuaaauagcuccauuucacauggcugccuacacaaucuucuuccccuccaccuacagaaucuuacuagcccaguucagucaaaaccacagugguucuuaggaaacaagugggugaaagagggugauacuuugacucucccaccccaccacaaaaaucaggaaucucucagagaaguugagugaaggagaauccagaacagcaauuuuaccaaaauauuucuauagcaauaauuaugguaucucaacucacugcugacuacugguacacuguuuuaaacaauuagauccucuugccucaccucaggucaucccauuauuauuauucauuagcacugccauaauuugaggugcuaaugaaaaaacggaaacugaaaucaucuaguucgaaugcucuaugaaaagauuuagcagaaggugaaacuacaauagaauuucauuucauuauuuagacuuuccaauguugacuuuucaucaucuauuguucaauguggcaauuauuuccaauugacauagauugugauagaaaguuaagcauauuuuauaaacuacgguguuucugaaugaagauuuuucuucaagaaucacagauuucagauuucuaaccaaacauuuacucucugaucucuuaacugcguaacuuuuuuuuccuccucuuuaauuauuagaacuaugagaauauaaaauuuaggaaaacauguaacaucuauuaaauacuacuaaaacaaacucacauaccuaucuccuuccaauuuugguauaucugagcaacuagaggaguccuccagccacgccaaaguuggucuccuugaaucaacuccugagcuugggucuccugauagaauaagcuguuguacaauugcuggaucauaggcauuaauuucaaacuuuaagugcaccuaaacaaaugaaaagccuaaguuuacaacugaucuuuuuucaauuacuaauuuguuacuucaaaauucaaacauaccuucauaaguuuggaaacaucccauaugcagaucuuuccucguuuaguugcagcagcuagaaaaugagggcagcuccccgacccaaagcaagauauucugucaguuccauccguacaaggaaacugugcaggacuuguugcaagagugacugacaauggcacauucugugugugcucaccuuucacaaaugggcaguuuggggaaugucuuucguguucagaccuuugcauagauuuagaaaggaaaaguuuacuaaaaauaaagcaauucaguuuguacauuaaaacagaacuccaggaucaucaucuuuuuuuaacugaacuuaaaguauucaucauuaaagacuuaauauaaccaaaucauucaguuuuaugaagaucacucuaacauguucaaccguuuacaaauucacacauucaauauuccaaacauucaacaauagcaguuguuacucacuuuaacugauuauaaagucaaucucagaaaaaacugaaaaaccaauacaaugcuauauuacauacuacaaaauuguuuaaacuccuguuauuuccucacacugguuuccuacagcuuugaaugauuaacuacuauguuucaauuuaaaauucuccauaucuaucaggggccacaacuauaaaugauauacagcugaaacucgauaaaugccacucauaacacaaaaaguuauuuuacuaaauauuuuacuaaauuauuuuacuaaaaaguuuuuuaguaaagaucugaaggcagccgggugcgguggcucaugccuguaaucccaacacuuugggaggcugaggcggguggaucaugaggucaggaguucgacgccagccugaccaacacggugaaaccccgucucuacuaaaaauacgaaaauuagcugggcaugguggugggcgcccguaaucccagcuacucaggaggcugaggcagaagaauugcuugaacccaggaggcggaggcugcagugagccgagaucgcgccacugcacuccagccugggcaacggagugagacuccaccucaaaaaaaaaaaaaaaaaaaagaucugaaagcagaaagaucucuaguaugaauaaaauaauauauauuaagaacacagaaauauaccuuauguauucacuauaggaucaaaucagacaaauaacuuuuaaauaaaauuuauuuccuaagagccuuaggaauguaaaguucauaaauuauacacuacuucuuucaaauaaaugcuuacugagcgagaagaaauguuaaauuaaaaacauaacaaguuuaagaaauauaaaauacaggcugggcaccguggcucacaccuguaaucccagcacuucggggggccaaggugguuggauccuugaggccagaagauugagaccagccuaggcaacauagugagaccucauugcuacaaaaaauaaaaauaaaaauaauuagcugggugugguagcaugugccuguauucccagcuacucgggagacucagguaggaagaucccucgagccuggguguucaaggcugcagugagcuacgaucgugccacugcacuccagccugagcaacagagcaagacccugucucuaaaaaauaaaaaauuuaaaaauuuaaauuaaaauauaaaaauaaaauacuaggaccucauaucaagacugguauaaugacuuuaagaauuaucucaaauauuguaagcaggaucaacuuagcaccuaucugcucaacuuuaugauuccuuuauauuucuuucugguuauuccuuauuuuuauuucuauuagcuauaauuauaaggcauuagaaaugucaggauccugcuaccaaaacaagaacccaugagccaggcgugaugguaaagcauauagucccaguuagucaggaggcugaggcaggaggacugcuuaagcccaagaauaugaggcugcaguaagcuaugaucacaccuguguauagccauugcacuucagccuggacaauauagcaagaccccguaucuaaaaaauaaaauaggcugggcgugguggcucacgccuguaaucccaccacuuugggaggcugagaugggugcaucacuugaggucaggaguuccagaccagccuggccaacauggggaaaccccaucucuacuaaaaauacauauauuagcuaggcauuguggcgcacaccuguagucccagcuacuugggaaacugaggcacgagacucucuugaaccugggaggcaaggguugcagugaaccaagaucgcgccacugcacuccagccugggcaacaaaguaagacugugucuccaaaaaaauaaauaaauaaauaaauaaaauuuuaaaaauaaauguuucuuaaagaaccauuguuuuuaaacucauuguuuuauuuccauggcaaagaaagaacuuuacacauaaaacaugcuacuccuuaaaauguauguauuucuuuuuacaaugcaccuacaacuuacauauauaaauccaucuauaaauccugggcaauuuuuaauauguagaugucuuuccuaaauccuuuuacagugcacuuccaagcaaaugacauuugggccagguucccucccagcuaaaucuagcguaccuuaccccuuuccgucucucucucuuuccugaguuuuaacuuuuucaauaaaauuuuauuuauauaaguuacacgcggcuauauaaaauaaagcuaaagacccacaucaauuuuaaaaucuaaucccaauaauuuccaaucccaccuccaggaaaccaccauuauaaauuuaagugauacauuucuaaaauauuuuuuaaguuuacauacauaaauguacauauagaaaauacaugauguggaaguauguaugaaaaaaaauuuuaaaaauaaaauacagggucuuaaauuguuaaacaauuggugucacuguacaugacacauauacauuuuaucauguauccaaucaucuaccauucuauuaacacgaaagauuucuugauacaguaacauaucugaaaguuacugagggugauuaacagagaucuuacuguucauuccccuuaacuguuggaccacagucuauuauaugaacauagcacauucuauuuggcuauuccccuccugauuggcauuuaaaaggauuccgauuuuuaacugcagugaccauccacuuuaugccucugugccuacaagagcaauuaacucccuaggguacguaaauagaaguggaauugcuaguuacuaggguaugguccauuuuuuauguuuuuaacuucaaccucccuccaaaguaacucucuaucaacucgcacagucaaaauaugagucccauucgcccuuucaaauuuuuccuuuccccuuuacaauucagaaggugccuagguuccccagccuccaucaauccucuucccuccuacccauuuggaagacuugccccaggucuuaagagaccaaaucaacuucuugaguguuugaggaaucccaaaugcuggugcaaagaagagguagacucccugaaucccuggccaugucaagaaaacauggguuuucaguaucccaaguuagaaauuuuaaucaacuuuccauagaaaauauuuacaaagaaaauaauauuugauaauacuguauaacuuuucagguauagguuaaauaacuuuuugaggauuggcauagggaccuaaaaaauauauacuaaaaugguguauauauguguguguguguguguguguacauauauauguguguguguauauauauauacacauauauguguguguguguguauauauauacauauauauauauacacacauauauacacacacacacacacacacacacacacacagccuuuacggggaaagacaauuccaaacagaaacucaacuuaaacugaaaauugcucaugcaacaggucccccucuuauccacagcuucacucuuuuuuuuugagauggaguuucacucuuguugcccaagcuugagugcaaugguacaaucucggcucacugcaaccuccgccuccccaguucaagugauucuccugccucacccucccgaguagcuggaauuacaggugcacaccaccacgcccagauaauuuauuguaucuuuagcagagacgggguuucaccauguuagccaggcuagucuugaacucuugaccucaggugauccacccgccucggccucccaaagugcugggauuauaggcgugagccaccaugccuggcccacagcuucacucucuaugguuucaguuacccauggucaaccauggucccaaaauagaugaguacaguacaguaagauauuuggagagagagaaacacagacagacugaccacagucacagaacuuuuauuacaguauauuguuaaaauuguucaauuuuaggccgggcgcaguggcucacgccuguaaucccaacacuucggaaggcugagguggguggaucaccugagcucaggaguucgagaccaaccuggcaaacauggcgaaaccccgucucuacuaaaaacacaaaaaucagccgggugugguggcccacgcacaccuguacucccagcuacucgggaggcugaggcaggagaaucgccugaacccgggagguagagguugcagugagccgagaucgcgccacugcacuccagucugggcaacagagcaagacuccaucugaagggaaaaaaaauguucaauuuuauuaguuauuguuauuaaucucuuucugugcuuaauuuaugaauuauacuuuaucauagguuauggauguauagggaaaaaaauauaguauguauaugguucaguacuaucugcuguuucagguauccaauggguccuggaaugcaugcccugcaaauaagggggacuacuguauucaacucucugccugcagauagauacaacuugaauuuuucauacaguauuuuccaaucugaacuccauagguacacugcaauacguuuuagcaaguuugccccaugcacaucagcugauuuaacauucagagacuucaaacuaauuuucauacaaaauaagcaacauauccuaaaaccaaacccuggcucuaucacuagccauaugcccuucagcaaauuuuauucucuucauuuuaaaaugggauaguaacuccuaucucauagagugacuguaaagguuaaacuggaaaauauucauaguucccuccuauaaaauggagauuacaauaguaccuacuucacagggaaacaugagaauuaaaugauuuaaaaauacauaaaguauucagaaugguaccuaguauaccaucuuauauaaauauuugcuauaauaauauacuauuauuucuauuaauaagaccucagaauaguuauuuguaaaaaugaaguuucaauacaugaucucuaauguuuaaccagguucuaaaauuucaugcacuaaaauucagagacaucaaagacucccuaaaauuacuucaaaauuagaaauguauacuauaaggcucucuccauggauucccuacugacaacaugcucucaacagaccaagauucaacugcugaagcucacgcuggaguucacuuuaccauagcuuuccgguuuucguuagagcgugguucuacuguuugguacuucccuuguguacaauuuuuagaaagucaaacuuacagacacuguaugccaaguggugugccagaguauagacagggcuagcucauucucaggacaaugacaaaaauauagguggcaaaaaggcaaaaaauuauaucauaagcagaaaaguaaaauuuagaagcauuauuuacacgacugacuuagccuauuaugcccagaaacaucaagacucaccaagguucaucaguagguucccaacaaacgaggcauacacuacaaguaaaacacauggcucuaucaucuccagaugaggcaggcugcaaaauuauaaagaaaagagacagaaaagguaaaucauuauuaaaauagcuuuauaauaaaaguuauuuuuaaaaguucauaauuuuaaguaaaauucuauacugaaaauaagaaaauuagccuauaauauuagguccaacaauacacugaaaccuccaaauauuuauuaauugccugcauuauuugaaaauucagaaaaugaccacuaaaucaaagagagguacacauauaugcaaucccugaucuaguacuuuucucauugcuauacuaaagcaucugaaauauuaaguauaagagaaagagucuggcugguuuacacuauuuguuucuguuguugucguuguugcuguuuuugagacugagucucgcucugucacccaggcuggagugcaguggcgcaaucucggcucacugcaagcuccaccuccccggguucaagcgauuauccugccucagccucccgaguggcugggacuacaggcgccugccaccacgcccagcuaauuuuuuuuguauuuuuaguagagaugggguuucaccguguuagccaggauggucucaaucuccugauccugugauccaccccucucagccucccagagugcuggaauuacaggcgugagcccugcacccagccucuuguuguuuuuuuaaagagacagagucucuuuaaaacuuucucuuuuaaagagacagagucucagacuggagugcaauggcacaaucauagcugacuauagcccugaacucgugggcacaagugauccuccaaccucagccccccagcuggaacuacagaaguguuucaugacacccagcuaauucuguuauuuuuuuuguagagacauggucuccuuacagcauccaggcuggucucaaauuccugggcuuaagcgauccuccugccuuggccucccuaagugcugggauuacaagugugagccacugcaccagccaauggguuuauuauuaaauacucaaucacauacaacugaacaagaagggcaaguaaaaagggaaagcaaaguagucaaucuaauucacauaauauggaaucuaauucauacaacauaggacaaaaugcuauauauauuucaauucaagggccaggcacaauuuauauauauauguauauauuuucaaaaccugaacugaaauauaccugaaaacuaauauuaauauuugugaacauuuacguuauagaugcaaauuuacuauacauuuuagaagauuaaaauaaucagccccuaacauuuccuagaaucagaguauucuaggaaaccuauuauuugaccucucugcaaagacagaauauaaugaacaauaacucaacagaaagaaaaaaaaaaaaucaaggcaucacuuaacagagacucuuagaaaauuacaccaaauuaaaagaaagacaaguugcuagaaaaaugguccauguucaauccuuaauuuagagaaauuauuucacugauucuaauauuagccagucuccaaacuuaccuaucuguaacaggaaaucugacaaacuuugaauaaaauauucauauauauauauauauauauauaguuuucugguuuaauuuuaguaaagauguucagaauacuugaagauaacgaaggaauaaucaaucuucagauucuaaaugacaguuacuuuaacguacuucaaaauguacuugaauucuuaaauuaggccaggcgcaguggcuuacaccuguaaucacaauacuuuagaagguuaaggcaggcaaacugccugagcccagaaguuugaaaccagccugggcaacacagugaaaucucaucucuacaaaaaauaaacagaauuagcugggaaugguggcacaugccuguaaucccagcuacuugaggggcuaaggugggagaauuguuuggaagcugaggcugcagugagcuguggcacagugagcugugaucaugccacugcacuccaacuuggguugacagagcaagacccugucccaaauaaauaaauaaauaaaguuaaauaaccaugcuuuauuuaaacugacauauaaguauuagauuucuuagauucuuuuagcagugguaacagugguaagccacucuauaccacucaguuuaaguuuccuauuaaauaacauauuacaucuagcuaaaaucauuuuucuuaacuucccucuaauucagcaaagcuuuuuauaaugucccauucuuaugccucuguaucguguuaauccuuacacuuuauacucuccucuuuuccuacacaaaacuaugacuguuuuucuugacuaauucuuccucuaccuaugcaacuuaaucaguucuuuaaugcacagauauucaaguugcaaugcacuaccuguaaugcugcuucuguaguuaucuaguauauggguaauuuguaucccaacuaaaaugagaauuucgaaacuguaaaacugcuuuuauugcauuacccuaagcaucuacuacuguguuaugaaugcagaugucaaacacuggaaauaaacaugcaucaaaagagaauacuugucagaaaccaaaucugaagaauacuauuuguugauuuuauaaaaaaaauuauggccuagcacagugucucacacuuauaaucccaacacuuuggggaggaugaggugcguagaucacuugagcaggaguucgagaccagucugggcaacaccagaaacccugugucuaccaaaaaaaaaaaaaauuagguuggugcaaaaguuagccaggcccaguggcacacaccuguagucucagcuacucagggaggcugaggugggcggaucaccugugccugggaagguugagacugaagugaguggugauagggccacuguacuccagcgugggcaacagagugagacccugucucaaagacaaaaaauaaaaauaauuguuuuuuaaaaaaguuguaucuaaucuuaaagaaaauacucaguuguuaauugcuuaaacaauuuuuuuccuggccuggcaugccuguaaucccagcacuuugggaggccgaggcaggcagaucaccugaggucaggaguuugagaccagccuuggcaacauggugaaaccccaucucuacuaaaaauacaaaaauuagccaggugugauggugcacaccuguauucccagcuacucaaggaggcugaggcacaggaaucacuugaaccugagaggcggagguugcaguugagccaacauuguggcgcugcacuccagccugggccaaaaaaacaagcauccaugcauacaagcaagcauacaaggugcacaaaauaaguuucugaaaaaguuaaaaaaaugugauaauuuugcugagggcuacaaaggccuacugagaaaaguauuuuuuuauauucuuuuuuuaccugaugauaaaauccagcuugagccaugggaucugguugugcccaccuauagccuacaugaggccaugagguaaaugucucccgucuguuagcuucacuauacaucagugaucuaaaaguaaacauacuuuauguaauugaaguuaggcaucaaaucacagugaaacuucuauuuaacaaugcaaaaaauaauuuuacuggguuaucagcaaaaacugcaaauggucugaugaacaaguucaauuuuuuacuuuaaacuaaaaacgguaauuuuugggaauuucccuuaaacagaaagggaaggagaaaaccugauugguggcugcaguugauaaacaacuccagggguagauuacauauguuuucauauuaaaauauaucagcucacuaagagucaaacuauaacagaaaguaccagaguaauuuuuuaaaggacgauaguaaacuuuuugagaaguccaaaagauuuuuaguaagaaaggauugauaagcaaagcuuauucauccuaacauaaaauuacaacugauaacagaaagaaaaagugguaaaggucaugacaaagaaaacaggaaaauacucuucuaaauucuucccuuaaauuagcacaugauuuucuauaaaauugcuaguaacuuuagguuuacucguaguuguauucagguuuuuaaacaaauagcuguuugguuagaaaugcauucucaguuucacauuauaugugucuuuaggaucagucuuagaacagaagaccuaucucauuucguuauauuacccaauaaaacagcaguagcauccaauagacccuaacucaaaccuuccacagaccuaaguucaucaaagccuucagaggcuccuagauugauuuuuaaugaaaaaaacaccacagucuguaucaaaauuaauauuuuaggacauuuuuaacaccucuaaaaauacugaauaucccaucuaauggcugcauuuccuaaaauauaacauuuaccacagcuugcacugauuucuuuagaaacacugcaacuguuugcaaagaaaauagcucugcagagcugacucuuuuauaaucucaaaauaggcauagaucucagacaagaagcacuuguucuaauuacguauuuuucuuuuuucccaucucaggcauaucccaaagaauauuuuaaugacagccauagcacauaucaccagauaaucugauuaaaaaugauagucugcauguugcccaagagauuacuacuacagaauauaaaaauucugcccaauuguuaauacgacuaauaaaaguuauauauguaacaacaaaaucacuuaacuaacaaaaagaggguaagugauuacgcagaaaucaguuuaccaaaagauaaauuaauaaauauugcuacugaacuagaagagccauacuaaaaauaauagaaguuuaaaaugaauuuauucaguagugccuuugauaacaucugcacauacuauuuauaaauguacuucagaaagaugcuuaggaaauuacaagucacauccaaugaaaauguaaaaauauaaauacuacagcugggcacaguggcucacaccuguaaucccagcacucuaggaggccaagacggguagaucaccuugaggucaggaguucgagaccagccuggccaacauggugaaacccugucuuuacuaaaaauacaaaaaaugagccaggcaugccgggugcaguggcucacgccuguaaucccagcacuuugggcggccaagguggguggaucauaaggucaggagcucgagaccauccuggcuaacacggugaaaccccaccuguacuaaaaauacaaaaaauuagcugggcaugguggcgggcaccuguagucacagcuacucgggaggcugaggcaggagaauggcaugaacaugggaggcggagcucgcagugagccaagaucaugccacugaacuccagccugggcaacagagcgagacuccaucucaaaacaaaaauauaaaaaaaagaaaauuuggcugggugccauggcucaugccuguaaucccagcacuuugggaggccaaggcagguagaucaccugagguagggaguucgacaccagccugaccaacacagagaaacacugucucuacuaaaaauacaaaauuagccccgguaugguggcacaugucuguaaucccagcuaccaaggaggcugaggcaggagaauugcuugaaucugggaggcagagguugcggugagccgagaucgugccauugcacuccagccugggcaacgagcgaaacucuaucucaaaaaaaaaaaaaaaucagccaugcauggugguggacgguuauaauuccagcuacucaggaggcugaggcaggagaaucucuugaaucugggaggcagagguugcagugagccaagauugugccacuacacuccagccuaggcgacaagagugaaacuccgucucaaaaauaaauaaauaaauacuacaugaaaaggcaaacaaaaaucuaaucaaaauugcugcguauuauauuucaguacagcauuucuaaaccuugguacuuuuuguaagaaccucaaucgucauuucaaauagcaaaucauuuaaguauuuaaaugaaugugucacugguuuuuuaauuaauuaaacaaaauaggcauucaaaaaaaccucuaccaaagaaaaugaugguuuagguaugauuuuuguaauacuguuuaaauccagggcgagcagcauaaaaaauuguuaacucaaaauuauuccuauuauuuuuuaaacuggucuuuuuuuuuuuuucauuauaaaaugauagcacuuuccuuauacucacauuagggcaugguaaguuaggcaaaauuuaucucaaaggucacaaaaugucaucaauggaaaaauaguuauuaaucauuaaauaauuauaguaauuuuaauuugacuaaaauauuuacuaagcaaguacuaaacuggaauuuccaaaauguggcuuuauaaucccuucaaauaccuuuaguguacuaaaauauaguguuuaaaaauagcaauucaaguagcaguuuacuuuaaaucugguuuucagauucuaauucauauugauuuuuuuuuaauuucaaaauuaggcuagaaauugugaaauuuuuaaaaaucauaaccagauuuucuaguuauuccuuguuuaaugcaaaaacuaaucaauucuaucucacugucaccuuuguuagcaagguucauaccugucuacagaacggccuggccccacuccgaguucuggacgugcacuagguaagagguaagacaaucuguccaucacugaggacgccacagguaaggcagcaacauuuugauuuauuuucuugaguucauuuacaauggcacuggcaauggacuucaacacaugaugaggaagaugaaauguaacuguggcccacugaaagaaaaugggaguauaagcaaaggaaaauguacucaacaguuuuaaccaaaaucauaacuuaaccauuaucaaauaaagaacacucaucaguuucaagucaguuuucuucauuaguuuaucauuuaaaacagaaacuugcaguuauaaaaaaaaauaaaauauuuuacaaaagccaagauauggaaccaaucuaaguauccaucaaugggugacuggguaaagaaaaugugcaguaaaggccaggugcaguggcuuacgccuguaaucccaacacuuugggaagcuuaggaggaauuaauuuuagugaucuggugacugcaguuacuaaucauguauuguauauuucuuuuuuuuuuuuuuuuugagacggagucuuacucugucgccaggcuggaaugcaguggugcaaucucggcucacugcaaccucugccuccuggguucaagugauucuccugccucagccuccuugaguagcugggauuacaggcaugcgccaccaucccuggcuaauuuuuuuguauuuuuaguacagacgggguuucaucagguuggucaggcugaucuccugaccugaugaucuguccgccucugccucccaaagugcugggauuacaggcaugagccacugcgccuggcccacguauuguauauuucaaaauugcuaaaagaauagauuuuaaacauucucaucacaaagaaaugguaaguaggugaguugauagauauguuaauuagcuuaauuuaaucuuucuauaauguauacauauauuacaacaucacauuauaccucauaaauauauacaauuauuuaucaaugaaaauuuuuuaauuuuuuaaaugaaaccucaacuaacuauucuggaaaagacaauucagaaccagacaguaacacauguucuuauauauaucaccaaaaauuaaggacaacuaaaaucaucugucauuuuuccuauucauccaguacaauguuaagcacagaguaggcacucaaauaccuccauccauaagaauauauuuagacaauuaccauuacugggguauaugaggauuuaguucagcuuagcagaugcauuguuuuuguugcuguugucaccauaauccagcaauagcaacuaaaaacacaggccuuauagucacacaucuggauucugggcccagcuucgccaucagcaauauucgauaaauguuagccaugauuauuuaauauuacaacaauuacugaaguuagaccacaaaaaugcuaaguacuauucucccagagaaauaagucuauaauguaauugcaucuuuauauccuguccccaguucacccaugaaugguuucuacucuugucuaguauacucaaggcagccuaguaaauuauuauuuaucuauacaauacuggaaaaacuuguagacaaaaacaugacuugaauugcuaaaaaaaaaaaaaaaaaaaagagggagaaugaaaacuucuagaccuaauuaaucuguucacagaucagagcuuuuuauugaaagggaggaugacuccccuugagaaaggauccuaugauaccccaacuauaguugguacuguaaaucauacuccaaaccuucccucagaaagaccuaugggcauucacuacagugacugugcaugggggaaaagaucuuucaggcauuacaaaaacauggcacugaacugaccuaaaacaucacugugguccaagaaagagggcacguaggauggucaagcgauuaauaaaguuucagcccaaagcugucucagagaguucuaugggucuguaaauccuuauuguguaauaguuacuuccccaguuccugaaugcauaauauaaaacaggcaacugaaaacaauccccagauuagcucucugcucuucucugugggccaguaauauagaaaacaugaaguauaagccccuagaacuuuccuucucuacaaagauauuaaacuaaagcaaugcuacauuccugaagaaauuuuuuagauuaaugccacuguaaaagauuugagguugggcacagugccuucauaccuauaauccuagcacuuugugagacugaggauggagguucguuugagccuaaacgucugagaccauccuggucaacauagcaagaucucaucucuacuaaaaaauaacagccaggcgugauggcaugcacuugucaucccagcuacucagaagccuugaggugggaaaaucacuugagcccaggacggcaaggcuacaguaagccaaaaucacaccacuguacuccagccugagugacagagcaagacccuguauuggaaaaaaaaaaaaaaagagagagagacuuaaaagauacagagguaaucaaaugaccucguccccuuuacuggacuguuguaaaugaaucuugaagaaugacuguggaugguaaacuaucagguggcgacuuccauugcagcugcuuuuccaaaugagguaucuuuauuaaagcaaaucaacaaauccccugauaucugguagguaguuacaguucuauccaauauuuuucuaucuuuacuuuuaaggacuauacaaaaaguccacuuuuaccuggcaggaacaauaauaaaucuuugcaaucuuucccuaagaccacaucucacauucuagaaauccugaucauccuaacauccugcagaucaacauaaugguccacuacaucaugacagcacgcugauugguccagaugaaaaggaaacagcaaggaaauuaaaugccugaguaaggugcaaaccagagaauaagaguccccagaaaaacucaagauucugcaaccaugguuaaguuucagagguccagaggucuggucaugucaggauauucccuccagacugaaagacaaguugcuccaacuuguaacaccaaccacagaaacaaaagccacaguacuuagugggccuacuuggauuugggagccaauauuuagcauacuugaaugugugcucuaauccaaguaucaagaaacauauaagguugccaauuuugaguaaggugcaaaacaagaaacucugcaacaagaccagacuguacugcaagaugcucugccacuuuuaccuuaagagcacuuucaaugacacugacacuagaaguccacagcaaauaaugaugcuguaaggagccuguggcaaccuaauugggacaaucacacagcagaaugcuagggucuuggagcaaagccacacccucucaugcaaauaaccauucuccuuuugaaaaacagcuccuaguuccuuacuagucccagauagagauuaauaucuaucuacgaaacuaaugucuacaaauucagagcuguccaaauguuaucugacacaccaaccauaauauugagcaccagcaacaaguauccuucaucaaguguuuuauaaaagaucugucuucacaaaguccaaaaggcaaaaacugaauaaacaaguggcucagaauucaauaccuacucccacuauaaugucuccuccuuguucuacaucaauagcuucauggggaacuccuuaugaugaaauaauaugaggggaaaauacucuuggcccugauuuacagaugguucugcaugauaugcugguacuaccccgaaguggauggcuacagaaucauagccccaaucacaaggagaguggugaagguaaaucuucucaauagauagaacuucagucaguauguaugacuguucuuguauggauuuagaguuggcuagaaguaaagauccucacuaguuaacagaguugcuaauuuguuagcuagauggucaggcacuuggaagaaacagaacuagaagacuagcagcaaggaggucaaaaacaaaggucuaugaauagaacucucagaggguaaaaauacguaugaaauaugucaaugcagaccaaaaggcauccauuucagaagaaaugggagaaguuauacacauuauauacaugacaguaagccucucuccacgggcacuccagugcuugcucaauggacuugugugcaaaauaccauggcaacagauauggaggcuaugcacaggcccaaaaauguaaacuucccuguaccaauacuaaccaggcuacagcuguugcugauugccuaaucugccaaacaguuaccaaaguuggguggcaaauaucacgucauuucccagggggaacagccagcuaucugacaguagguugauuauacgggauuccuagucauggacuaggcagcaauuugucuucaacauaacaaauauauauucuagguaugcauuuaccuguucuguccauaguuuucugccguaauauuauauaguccauugccuguggacugacagaaugucaugguauuguagaaaacuuugcuucugaucaagaaaaguauuucaaagcaaaaaaaaaaaaaaaucuuuuuuccacuggucuuacuguguaucauccugaugaagcuggccuggcagaaaagcucaauggccuacuaaagacucauuuucaacgcuaaccgaaagagacaugcugaaagguuauggaguucuaccuuacaagaugaagcauaugcuuugaaucaaccaaaaauguaugauacaguuucucugggcaugcccacuauuauauuuaauaaacucauucacagauuuuuuuuaaagcuuucagcucuacaggucuuacucccaagggaggaauguuccagcagggguacaacaacacuuccauugaaguggguguugagauugcuacccagcaacuuugagguccucuugccacugaauaaauagucaaagaaguucuacuaguuuguaugacuggaacugacaagcggaaaccuggauugaugcuaaguaacaggggcaaggagaacuuaugcagaacccaagagauucucuaggaugccccuuaguacuuccaaguccaauaguaaagaugaaguaacaauuacaacuuaaaauacagcaccagcugggcuugguggcucaaaccuguaaucccagcacuuugggaggccaagacgguuggaucaccugaggucaggaguucaagaccagccuggccaacacagugaaaccccgucucuacuaaaauacaaaaaauuagccaggugugguggcccgugccuauagucccagcuacuggggagacugaggcaggagaaugacuugaacccagaaggcggagguugcagugagcugagaucacugcacuccagccugggugacaaagugagacuccaucucaaaaaauaaaauaaaauaaagacacagcaccagugaggauucagauucuucaagaaugaagaugggucguucauguacguaaagaauccugaccaguugagaugcugaaugaugacagagcuaauaaggaacagguaauacaaaaaaaagaaauuagauaucuucuugacuauuauacauccucuugaccaauauauccucuugaccauuauaaacugaggacuaggcucacgccuggaaucccaccacuuugggaggccaaggugggcagaucacacggucaggaguucaagaccagccugaccaacauggugaaaccgucucuacuaaaaauacaaaaguuagccaggcgugguggcacgcgccuguaaucgcagcuacucgggaggcugaggcaggagaaccaccugaacccaggagguggaacuugcagugagccgagaucacaccacugcacuccagccugggugacagagacagacuccgucuaagaaaaaaaaauuaaauuaaaaaauuaaauaaacugaggaccaggccacgugcgguggcucacaccuguaaccccagcauuuugggaggccaagguggguggaucaugaggucaggaguucgagaccagccugaccaacauagugaaaccccaugucuauuaaaaaugcaaaaaguagccaggcaugguggugcacaucuguaaucccagcuacucaggaggcugaggcaggagaacugcuugaacccaggagacggacguugcagugagccaagaucgcaccacugcacuccagccugggcaacagcacaagaccccaucuccaaaaauaaaaauaaauuuuuuaaaaagcauaauaguuuuguuauaugaaaguucaaauauauaaagugugaauggagaugcugaguagccaaagggguagacugugcaguuaauuaaacuguugucucugagcuccaaaucuacccuuuaauucucugcucuaucagguuggggcuaggacucugcauacuguauuuccucuuuucaaccaguuuccuggcuuuuagguucucccagcaacagcacaggaaggaaacuggaaagaaagaugaagaaagacuugcuccuucuuauuuacuggccauugccaucagcacuguuucagcaaaggacaugaugcaguaguugauucuuccagucuucagcauuuuguuuugguuugguuguuuuagcauuccgagauccaguuucauagaguucccucagagguacuaccaucagucaaguagcaucucucuucagagaucugagucccaguuuugcaacgcccucguccaagcuccugaguuaccaacuggguagcacuuccuagucccagauccacggggccuauucucuaaguuucuagguucugauaaccccuaaucucuacucuuuguuccuccagaccuaggugaaaacugcuuccuauaguuaucucuguuaucucaggaucuccuuuucacuuuuucaguuuucaaacaccaguuaauuucuuacaauaaauuaucucuguugaaacucauaggacaguuucuguuuuccuaaauaaaaugccccaucaauagaguaagguauaauacaaucaugacaaaucuacaaaaaaaaauucaaugcaacuacuaagaagaacauagaugaucucugaggauaugagaagauauccaagacaaauucuugagugaaaaaaagcaagguggccaggcacgguggcucacaccuguaaucccaacacuuugggaggccgagaugggugaaucacgagguuaagagcucaagacaagccuggccaacauagugaaacccaauuucuacuaaaaauacaaaaauuagccaggcaugguggcgugugccuauaaucccagcuacucgggaggcugaggcaggagaauagcuugaauccacgaggcggagguugcagugagauaagaucacaccacugcacuccagccuagguuacagagugagacucugucucgaaccaaaaaaaaaaaaaaaaaagagccaggugcagugguucacaccuguaaucccagcacucuaggaggccaaggcaggcagaucaccugaggucgggaguucgccaccugccugaccaacauggcgaaacccugucucuacuaaaaaauacaaaauuugccaggcgugguggcgcacgccuguaaucccagcuacucaggagacugaggcaggagaaucacuugaacccgggaggcagagguugcagugagccgagauugugccauugcgcugcagccugggaaacaagagcaaaacucugucucaaaagaaaaaauaaaagaaaaaaagcaagguauaucauaacacaauauuaguauauuuuaguauaguuacaacugcacuugagaaaaaucuuugcaaaugcccaaguuacuuauaggaaaauggcuuuuaccuucuaccuuauauccuucaauaacagggaaguuugauaugcaguauaacuuagaaaaggccuuaaaagaaaaaucuggaggaaauuaauaaaaauauacccaaggauuuaauugaaagcacugucucucauauacaucccaguaugccaaaaaauuucagagaaagcacaaaauggcucaauuuccaaagacauaguccauucuuauccaagcauccaagcucacaaccuaacaaggaagcuucuuucaucagccucuugaccaauccagguccaucaggcacuaagaaagauuuaaggaagcaucagaaaacacaauaagcaaaauaguucccacaaacugaaguuaagcuucgauuaagaaguuucaaaguuucaacuuuuuucuuuuuuuuugggcaacagagucucacucuuucccccaggcuguagugcaguggcgcaaucucugcaaucucagcuaacuccgccuccuggguucaagugauucucaugucucagccuccaaguagcugggauuacaggcgccugccaccacgccuggcuaauuuuaguauuuuuaauagagaugggguuucgccauguuggccaggcuggucucaaacuccugaccucaggugaucugcccgccucagccucccucagcugggauuacaggugugagccaccgugcccagccaguuucaacuuuaagaugacuuauaagcacauucugcuuuuuaaaagaaaaaucuagaauuagaacauuuccaaaaggagaggaaaggaaagugcaaaagaauggagguguccauuguaauauaaccccaaaagaggcaaucuauuaacuucuuaccuuagcaacuuugugguuugcugcagucucaugagauguauuuuuuaaaccaucuuugagcugugugaugaacaaaucauaacccucuguacuagaaauaucuaccuuuucuaaacaugcugauaagagcugcugugccuaaauaaaaaauaaaaaauaaaaaaaucacagaaaauucaacacaagaacaacaaaaaauuaaauucagauccucuuucagauauuuuaauaugcaaugauuaugacagguacuauacuaaacuuaccuuuuaacaaaucuacuuaauuaaacaauaauuuaaagggcuauuauaaaauuaaaugagauaaagcaauguauucaguguagaaauacuacaugguaaaguuuaaacacaaaguaguuauuguaaaccaaaucaagauagaaaaauggacaagcugaaaccauaagcaaaaauaauacaggaaaaaaucugaagagacaaacuuaaaguccuccaaugagcuuuaaauacucaagcuauauaaagucauaauagaggacacuaagucagcaaguaauaugaaaaagcccuuugcauuguuauccacauauucaauaugaacuacuguaauaaagauauaugcuaauauaaggaaaagaauauaucuacacugagcaaaucaaaccuaagacuuuagggaagacagugacaaacuaaucugaugcaguaaaggaagccuggaaugcuggaagaucuacaaacaauauuaucugaacaacaguuacagcugugauuaaaguacaaagagaaaaaaaacaguagauuuaacaguaaacuagguggaggaagggauagaagcuaaacagcauuucacuguaguaggaaaaacacugacuugagaguuaauaaguguucaaguauuuuauuguaauucuuuaauuguuuguuaaaccuaaacauaguuugauaguguuuuuuugcugcugauuauauauccugauaucagcugguuuauauuccuuaaauuagggaaaaauguucaauuuuuucaaaugguuuuucaaaguuucuacuuguucaaaucaaguagaacuaauuaauucucuauccaaagauuuuagacaugccuccagacccaaauacucugaugagaaaaagacagcuucucuguuuuuggaacucaaacuuucagcaacaugcuuucaauauuaacauauaauagacuacuguuauaugacacuaaauguaaaaucuaagugaauauacuuuauuggacauacuuuuuugauaacuuucauaacaaguuagcaugaacacaaauaauaucucacuuuauuauagaacacaacauaaucuuuuacauucuauuuaaggugaugcaaaauccaguaauuaugaaaaauguacuuucaaacugcaggauaugaagccacacaaaagaauuuaaguugggcuagacuuaaaaauuaaguaaagaaaauuuaacacuacagaaaaguauauauggcuaaaacuuaaaacucaaguuauugaaagacaugaugcauagcaaaaauuacugguuguguggcugggugcgguggcucacgccuauaaucccagcacuuugggaggcugaggcgggcggaucaauugaagucaggagcucaagaccagucuggccaacauggugaaacccgucucuacuaaaaauacaaaaauuagcugggugugguggugcaugccuguaaucccagcuacuagggaggcugaggcaagagaaucacuugaacccgggagaugaagguugcagugagccaaggucaagccacugcacuccugccugggugacagagcaagacucugacucaaagaaaaaaaaaaaaauuacugcuguuuuaccagagucuauuccucucucauuuuaaaauauuaaaaaaaagaaagaaagaaccaccucuuucccagucucccucucagcuugguguggucaugugacuaaauucugucuaaugggguaaauaugaggcuauaugagagaguauuugaguugugaaaggcagaaagagaacaagaacaaaugaguaggagagggggcuggggguuaagggacagggaaagggaaggagagaagagagagaugccagagugcucuccucuagccucuugcccucucuuucccugugacugggaaauaaugacaccuagagcagcugucuuaaacucccaagcuaacccaaguguugagguuggcaaugauggccauacacuuagcccuggacuauuauuggaaacaagcuauccuguuuaagccauuguuuuuuugggucucgguuacagcuguuuaaccugugcugaugcaccauucacaccuaaaaacaccacuucaacaagaauuaauuaugcagagaaaaggugaguauuaauauuuaaaugaaguuguggucaauaaguaaauuguuuuuauagcaauauauauaauaacguccuuaaaggaugacuuaauuucauuuaacaucuaauaugucuaagauuacauuaaguagaggaccacauugauacuuauuucaacuuaccucuguaacggguaauucaagcugaaccacaucauccugcuuugaaacuggaguuugcagagcagugucuaacaacaagauuccauuaagguccuuccuacacccuacugcauaaucauccacaaauauaacuuuauccacagcagagauauacugacauuucaccuguccaccugguuuagcuguuaaaagaacaaaaauucaacacuuaagauuuucaggccaauggucuauuaaaaauaaauguuuacauagugacuaaacacaauauauuauccugaauuggaucuuaaacuggaaaaaacuucucuaaagaacauuauugggccaacuggauuaaauucaaauauguaccauaaauuagauaaaaguaucaaugugaaauuacuaaaauuugacaaccaaauugcuauuauaaaagaacaucauuguucugagaaauaaacacagcaacaguauagggaaaaugagcaugauauaugcaaccaacucucaaguagaauaaaauaugauguguauacacacacacacacacacacacacacacacacacacauauauauuaagggaauaauaagcaaauguaguaaaauguuuaaaacuaguagagcuggguaaaggguauauagggaaguucuuuguaacauucuauucuugcaauuuuucuguaagugcaaaaugaaaguguucaaaaacaaaacuuuuaaaaaugaauuauuggaugucauuuuuugcaaaacucaauaagcauaaagacagcauggacaguuauuagauacagcagugccccuccuuaucugcaguuucacuuugugcaguuucaguuacccagucaauagaagcccaaaaacagguaaguaugguacaauaagauauuuucaaucaaagguccaaaaguacaguacauaagauauucugagagaccacauucacauaacuccuaauauauuguaauuguucuauuuuauuauuaguuguuaaucugucacuaugccuacauuuuaaauuaaacuuuauuacagguaugcauaagaagaaaacccagcuaacccucgaaccauacaaguuugaacagcaugagaccacucauacauaaauuuuuuuccaauucauacauugaaaaaaauuucagagauuugugacaauuuaaaaaacauguagacaaaacacguagccuagaaauaucuaaaaaauuaagaaaacaguaugucacugaugcauaaaauauauguagauauuagucuauuugaucauuuacugacauaaaauauacacaaaucuacuauaaaguuaaaauuaucaaaacuuacgcacacaaauaguacauggcaccagucaagaaaaauguaaacaaauguaaaaaauacaguauuaaaucauaacuaaauaaaauuagcuguaguacauauuauaaaacugugauaauuuuguuccuauugcagugaguucaaguguuaugaguaccaccaugugacccuaaucauauccaggugagcaguucaucucucaauuguuaauugguaaucgcaguaaaaagugaucucuccugauucucauguauuuuccuuuuuuuuuuuuuuuuuugagaccgagucuugcccugucccccaggcuggagugcaguggcaugaucucggcucacugcaagcucugccucccggguucaugccauucuccugccucagccucccgaguagcugggacuacagaugccugccaccucacccggcuaauuuuuuuguauuuuuagcaaagaugggguuucaccguauuagccaggauggucucgaucuccugaccuccugaucugcccgccugggccucccaaagagccgggauuauaggcgugagccacugcgcccggccaucucauguauuuucaucggguuuagugcaauaccauaaacccugaauaacacuaugaaacccauaaaagguaacacuagugaugcucgaaguguucccaaaaggcagggacaagucauaugauuacaauaaaaagcugaauugcaaaaaaaaaaaaaaagagagagaaagaaaauacauuuacggcacuauauugcacuuaucaauacgguaaauguaugucaucuguuuacaaaaugaauccugugccugaaauggcacgcaaccacagcuggagaccucagucuaugguacguaucaagcaauuuggcuuuuucggccuggcaugguggcucaugccuguaaucucagcacuuugggaggccgaggugggcggaucacaaggucuggaguuuuuuggggguuuuuuuuguuuguuuguuuuuuuagagacagggucucguuacguugcccagggcaacgccuggggcucaagccauccuccugaguggcuaggacuacaggagcacaccacugugccuggcaugucaacauacuuauugguaaaagacugaauacuuucccauacagaucaggaacaagacaaggauguaugcucuuaccauuccuauucaauacuauacuaaaagaucuagucacugcacuaaaaaaucaggauauaaaaggcaaacaaaucaaaaagaaauaaaacugucccuuuuuacagaaaugauuacccguguagauaaaaaucaaucauacuuuucuauacgagcacugauuaaucuaaaaccaaaauuuauuuuuaaaauaccaguuuacaauagcucuaaaacauacuuagacauacauauacacaaaagguguauauguaugcugaaaaguauaaaaggcugauuacacaaaucaaaagccuaaauaauaccauguucauggacugaacaagucaaucugguaaaaaccucaacacuccccaaauggaucuacagauuuaacggaauuucaaucaaaaucccagguggcgucagcaugguggcucacacccauaauacaacacuuagggaggccuacacggaaggaucgcuugagccaggaguuugagaccagccugagacagaccccguaucuaucuuaauuuaaaaauuaaaaaaauugccgggcgcgguggcucacgccuguaaucccagcacuuugggaggccgaggcagguggaucacaaggucaggagaucgagaccauccuggcuaacacagugaaaccccgucucuacuaaaaauacaaaaaauuagccgggcgugguggcgggcgccuguagucccagcuacucgggaggcugaggcaggagaauggcgugaaccugggaggcggagcuugcagugagccaagaucacgccacugcacuccagccugggcgacagagugagacuccgucacaaaaaaaaaaaaaaaauuaaaaaaauuuagccagguguaguggcacacaccugugguucuagcuacucggacacugaggugggaggaucacuugagcccaggaguucaaggcuacagugagcuaugauugcaccauauaaauaaacugacugaaauguauuugaaaaggcaguaccacaagaaagugugguacuggcaaaggacagacauauagcucaauggaacaaaauagagucaagagauaugacuauauaaacauggccauuggauuuuuuucaauuauguaguuuuuuuaauugugguaaaauaaacauaaaauuuaccauuuuaucauuuaaguguacaguugagugguauugaguauauucaugcuguuguuuauccaucaggauaaagggaaacucuguacgcuuuaaacaguaacugacuuuuauccccucuccccaaagccuggcaaccacuuugcuacuuucugucuucaugaauucgacuacucuaaauaucucacaugaauggaaggaaucauacaguauuuuuccuuuugugacuggcuuauuucccuuagcauaauguccugaagguuccuccacauuagagccuaugucagaauuuccuuccuuuuauccauucaacuaucaauggacagacacuuagguugcuucugccuuuuggcuauuucgaagagugcugcuaugaacacugguguacaaauaucuccuugauucccugcuuucaauucuuugagguacacacccagaaacagaacagcgaucauaugguaauucuauuuuuuccuuaauuuucugaggaaacuccaccaucucccauaauggcugcaccauuuuauauucccaccagcagugcacaagagugccaauuucuccacauccucaccaacacuuauucuccguuguuguauuuuguauaugguguuaaaguccaacuuuauacuuuuugcacgugaguauccagucuucccagcaacauuuguugaaaagauugucgcuucccccaaugaauggucuuggccuccuugcugaaaaucauuugaccauauaugcaauaguuuauuucucggcucuauauuccuucagucuauauguccaucuuuaugcugguacuuugcuauauugauuacuguagcuucauacuaaauuuugaaaucaaguguuaaucuuccaacucuguucuuugucaagauuauguugaacuauuuagggucccuugagauucuauaugaauuuuagaacagauuuuuuuuuuuuccugcagaaauagaaaaaaguuacugggauuuugauaggaauugcaaugagucugcaaauugcaaugagucugcaaauuguuuggggcaguauagauaucuuaacaauauaaagauaguaugaaguucuggcaaggaugcagaacaacuggaacucucauacauuucuaaaggaaauacaaaugguacagccacacugguuugacaguuucuuacaaaguuaaacacaaacuuaccaaauggcccuguaaucccacuucuguguauuuacccuggagacauaaaagcuuauguucacacaaaaaucuauacucagaaguuuauagucgcucuauuuauaaucaucaaacauugaaaacacccaaauguuuuuuuuucuuucucuuugucuuuuuuugagacaaggucucacuaugucacucaggcuggaauauaguggcgaaaucacugcucaccacagcuuugaccuccagggcucagguaauccucccaucuuagccucccaaguagcugggacuacaggcgcacaccaugaugucuggcuaauuuuuaguauuuuuuguagauacaaaguuuugccauguugcccaaccuggucucaagugaugugcccaccucagccucccuaagugcugggauuacagaauaagccaccacacccagccccaaacauauuucaaagagugacuggcaaaacaaauaaugaugcaucaauacgauggaauacuauucaguaauaaaaaaggaaugaaauauuaauacaugcaaaaacuugacagaaucucaagggcaucaugcuaagugcaagcagcuagcaucaacagguuacauacugaaugauuacauuucaguaacaauguagaaaacacaaaacuccauaguauggagaacagaucaguggucccaaaagauuagugguaaagggaagaugugacuacaaagugauaccacagggaauuuuuucagguguugaaacuggucuguauccugacugugaugguggguuacaucaaucuaugcauguguguaccuguaugacaaguacacaaaaaauagacaacuuuacuuuauauucuauaaaaaauaaaaauuuuuaaaugauauuguaaaggaaaaaacacacccaagcgcaaugccuucacaccuguaaucccagcacuucaagaggccgaggcgggcggaucacuugaggucaggaguucgagaccagccuggccaaccuggugaaacccugucucuacuaaaaauacaaaaauaacugggcacgguggcaggcaccuguaaucccagcuacucaggaggcugaggcagaagaaucacuggaaccagggagguggagguugcagugagccgagaucgcgccauugcacucuagccugggugacggagugagacucugucucaaaacacaaacaaacaaaaaaagaauaaacauguacacauggagcaauagccuauuaacuaugcuauuaacuaaggaggggguaguucauaacacaucacuaugauccaaauucuauaaaaauauauuaaacaauagaagaggccaggcaugguagcucaugccuguaaucccagcacuuugggaggccgaggcgggcggauugccugagcucaggaguuugagagcagccuggguaacacagugaaaccccuguauuuugucucuacuaaaauacaaaaaauuagccgggcauggcggcaugaaccuguagucccagcugcucggaaggcugaggcaggagacucacuuaaacccagaaggcagagguugcagugagcugagauugcaccgcugcucuccagccugggcaacagagcgagacucugucuccaaaaaaaaauaauacuaauagaagaaaguaaaaagaaaugccaaaauguuaacaaugcccaucucuagguaaugaaauuauacguacuuacuuuuuccuuagucugucuaacauccuauaagguaugucccuuuuaaaacugaaaauuuccuuuuuuuuuuuuuuuuuuuuuuuuugagacagggucucacucuguugcccaggcuggaguggugcaauggcgcaaucucaacucacugcaaccucugccucccaggcucaagcaauccucccgccucagccucccaaguagcugagacuacaggugugugacagcacgcccggcuaauuucuguauuuuuuguagagacaggguuuugccauguugcccaggauggcaaaauugaaaauuucaaaggaaagaaauuuuaauuaguuaccaauucuaauacuuuaagaaauaauguacaacccuaaaaaacuugcaaaaauguuacaagaaauacauuaucuuuucaaacugacaauacacuguaaaacuccauuuccacugacaucucaucagacuucaacgcuauuuuaaaauagccuauuaaaagguacuauaugcaaagaucauucaaagucaauaaagaagauacaagccuguaucagaacaucuccuguaacccaaaaauauauacaccuacuauguacccacaagaauuuuuaaaauuuuuuaaaaagaagguacaaaauuaauguaagguucucacaaagcuuuugauauaauuaaccaaaaaugaaaucauuuaauaagagaaaaaauguuaguaacacuauaguauuaaaagccaaaaugaguauuccuaugaagcagaacucacugcaaaacaaguuugggaaaggucagugacugcaccacaaagaaagggguaacacaugauaaaauacaacauaaaacacaaugcagggacaguguuguuucaggcaagagaaccaacaucuacuuaagcacagaagagguucuccaaaagauacaaaauuacuggaauuaagaguuccaaguuaugauucucuucauucacauuaaccaaaagugucaucagaccacuuacuuugcuauaaucuuuaguaucugacaucauuuguuuugaaaauauaaucaccacgaaaaauuuaucauggagagggcucaaucucuaaagaccuacuacuccguguaagauacuugcugugggguuucuucauauacauuguucaauuuaucacaguuauaucucucaacgucuugggacacauaaguuauauuauuccuuuaggaugcugaacuuggcacacccgugcgugcuguguguguguguguguguguauacauacacacauauauauacauacauauauauacauacauauaugcauauauauacacacacauacauacauacauauauauauauauauauauauauauauauauauauauauuuuuuuuuuuuuuuuuuuuaagagacagggucucacuauguugcccaggcuaaccuggaacuccuggucucaagcaaucuucucaccucagucucccaagcagcuaggacuacaggugugcaaccuggcuaaacuggcuauaguuaaguaaaauuugaagacuaacuuccccaacugauguugggcaagagaacccuuaaccgucuguaaaucaauggcgccgggcgagauggcucaugcccguaaucccagcacuuugggaagcugaggugggcggaucacuugaggucaggaguucgagaccagccuggccaauaaggugaaacccugucucuaccaaaaacacaaaaauuagccgggcgugguggugugugccuguagucccagcuacucgggaggcugaagcagaagaaacgcuugaacccgggaggcggaggguguagugagccgagaucacacuacugcacuccagccugagcaacagagccagacuacaucucaaaaaaaaaaaaaaaaaucaauugcuacugcugcacaaaggugccaaugugagaagcaacucagcuacuaaucaauauaauaauccuacgguuuggaacaugugcccuugcgaauuucuauuuagagcucauauuugaaauuacuguuuucuguuuaauauagaugccagauaucuccugaaugguagucacacagacaucuucaucacuccuuauagagccuacauuuuaagucagcccaacucgaauuccauccaaauaugaaaaucuaucuagcuguuuuugucuauuauauaacagacaaacagaaauguccccuggauaucuguacugaugcuaucuugcaucaugcagaucuuuacucaaacaccaccucaaagaggccuucccaagacuaccuaaaagcacaaauuuaauauaccaucauccucauaucagcuguaauuuuccuuauggcauuaauuacuauaguauaucaagagguaauuaaugccauaaugacacaguggcucacaccuguaaucccagcacuuugggaggccaaggaggacaggucacuugaggucagguguuccagaccagccuggccaacauggugaaaccuugucucuauuaaaaguacuaaaauuagcugggcauggugguacacaccuguaaucccagcugcuaaggaggcugaugaaagagaaucacuugaacccaggaggaagacguugaagugagcugagaucacaccacugcacuccagccugggagacagagugagacuccguuucaaaaggggacaggggcgggaagcucucauuuaucccagacacacuaaacaaacuucucuaaagucuagggaguuagagaguuugaacuccuguuuuauuuuuuauuuauuuauuuauuuauuuggugugggggacaaagucucgcuaugucaccuaggcuggagugcaauggugugauuucagcucacugcaaccucugccgccuggguucaagcgauucuucugccucagccuccugaguagcugggauuacaggggcacaccaccacgccuggcuaauuuuuucuacguuuaguagagacaagguuccaccauguuggcuaggcuggucucgaauuccugaccuugagauccauccaccucggccucccaaagugcugggauuacaggcaugagccaccaugcccagccagggaguuugaacuccuaaaccuaacugcacauuagaaccagcuggcacacuucugagaagaagaagaaaaaaaaaacaguaugccugggcugcacuccaggccacuuaagucagaauacuggggcccaagcgagguauuuucuuaaaauuuccccugaugauucuaaaugaacaaagguugagaaccacugcccugugccaucucccagucuucugucucuccuacuucauaaaucaaaguaaaaguacauaaacaaauuaugaagauuuaaauuccugcugcccacaauaaaucuugaagaagacauucccaucuuccccacucaaaaauucauuuccucuaaaaaguaaacauaguauuuaccuccucuaagaugcaucccugauuuaacauacucaaaccugaugauaauuacuuuuggggggaaggugggggcagcagggagacagucucacucuucucgcccagacuggagugcagugcugugaucuagacugacugcaaccucuaucucccggguuccagcgauucuccugccucagccucccgaguagcuggaauuacaaguguacaccaccacacccagcuaauuuuuguauuuuuaguagagacgggguuucaccaaguuggccaggcuggucucaaacuccugaacugaucugccuguccuggccccacaagugcugggauuacacgcgacagccaucaugcccagccuaauaauuacuuuuuuuaacagcgcugucccagccacagacuguuuuguuguuuuucguuuuuuuguuuuuuuuuugagaugguguuucacuguuguugcccuggccggauugcaauggugcaaucucagcucagugcaaaccucugccucccagguucaagugauucuccugccucagccucccgaauagcugggauuacaggcaugcaccaucacacccagccaauuuuguauuuuuaguagagacaggguuuuaccauguuggucaggcuggucucgaacuccguaccucaggugacccacccaccuuggucucccaaagugcugggauuacaggcaugagccaccaugcccaggccacagacuguuuuauaaagcaauuacuguauucuuuuuauuuguaucucuauuaucuccugucuguauuuccuucuuuuugcaguuuguaucucuauaugauauucucuucuacacccaaguuuaucuuaacuuuuuuguaucccuuacauuugaagugcuacaguucuacaguaugcaaaaaauuucuauguuuagaaagguauuaaaagccccuuucuccccuaggcuggagugcaguggcacaaucacagcucacugcugccugaagugcuggacucaagugauacuccugcuucagccucccaaguggcugggccuacaggcaugcaccaccacacccagcuaauuuuuuuuuuuuuguagagacggggucucacuauguugcccaggcuggucucaaacuccuggccucagacaauccucccaccuaagccucccaaagugcugggauuacaggccauuagcccauuuuaaaguugguaucucagagaaguaucuugccaaaggcacccuuuucaugaagccaucagcaauacaacacacauaucagagaggucacuccugcuugcguccccacuguucuuacauacuauauuacagaaaucuauuauuuuuuuaaguucuauauauacuuauagccaacauuccuaaggacagacuacuaaauguuuaacaauguaaguauaguuacaacuagagauuuucaguuuaaaaauaauaucauacauccacauuuaccucugcucccucccaagaucccacugaaaagacaguaaaggaauaaagaagguauugaacaaauccaaaaagacaaaaagaacaagugaagagaaaauagcaacaaaauuuuugaaguuggagggcaaauggaaaagcauuaacuaaucuguuuccucuccuccccaaaaaucuuaaaagcuaagccagcagggaaagaaagcccaaaacauucacguuguauucuuucucacauacauagguaaaagaggucuaauaauuaaaauugcuggcugggcaugguggcucaugccuguaaucccagcacuuugggagaccgaagcagguggaucaccuguggucaggaguccaaguccagccugaccccaucucuaguaaaaagacgaaaauuaccugggcaugguggcacgugccuguaaucccagcuacuugggaggcugagacaggagaaucgcuugaacccaggaggcagaguuuacagugagccaagaccacaucacugcacuccagccugggcaacagagcaagaauucaucucaaaaaauaaauuaaauuaaauuaaauuaaauuaaaaaauaaaauaaauaaauaaaacugcuuaaaagcaguuguuuuuacaauauuuucucaauuaauuaauacugcaaccaagcuccaaucauaauagggcccuaauuuuuuuaccuuaaacugggaguucuuguacuuuaaaauaugggaaucauggccaagguaguucaaauuaaccuuguuaccuacauaaggcagacaaacacuuguugaacugaacuauauaauuuaagacaacaaaacaaaaaguaggaccgggcacgguggcucacacuuguaaucccagcacuuugggaggccgaggcgaguggaucacaaggucaggaguucgagaccagccuggccaacauugugaaacccugucucuacuaaaaauagaaaaaauuagcugggcgugcaggcgcacgccuguaaucccaacuauucaggaggcugaggcaggagaaucgcuugaaccugagaggcggagguugcagugagcugagaucgcgccauugcacuccagccugggcgacagggcgaccucucaaaaaaaaaaaaaaaguaacauuuauugacuguuuauggugagucaagcaguauucuguauguaucaguuuauuuaaucuuuacaauaacccagugaguuaaguacuaauuaugaagcacagagagagguuaagcaguuugcauaaggucacaccuggaacuuaaauugucuggcuccagagccaauauucuauucuuucuuaauaucacuaaagucagucaccagaaacagagccaaaguacauauucauagcccaaaaagagauucugcuaaauuaaguuuuuauaaaaacucaaaugcauucauaagacaucuucuagggcuauugagauccgaauucuauaucauguuuaucucucaaagaauaguugagaguaggaaugccgcauguaccgaaguuagccaggaauuagaacuguuuugaaucauuuacaguuuccaucacugggagacugcacauuuuagccaaaaaaaauuauuucuugaggacuaugcaggcaccaugaccucucagagcaggcagcucugggccugaaguuugaucaagaagcucuuacaucaggaaagaaaaaaaaaaaaaaaacacccgaucuaaaccucacugaagcuacaguaaaguacaaagaucuuccucuuauuuaugaccacauacaaauuucucaaaucaaagucauuaucuguauuacugagggacugacucuaaaaacccaguggaaaaaaaaaagucacuaucuauauaggaaaagaaaaaagauacaaagaaauguaaaacuggaguguuugucuaagaacacugagcagggcugggcacgguggcucacgccugcaaucccagcacuuugggaggccagggcgggcggaucacgaggucaggaauuccagaccagccugaccaacauggugaaacuccaucucuacuaaaaauagaaaaaaaauuagccaggcaugguggcgcacaccuguaaucccagcuacucaggaggcugaggcaggagaaucgcuugaacccgggaggcagagacugcgccauugcacuccagccuaggcaacagagcaagacuccaucucaauauguaaauaaaauaaaauaaaauaaaaacacugagcagguuuuuucuucuucacugcaacacagaucuggaauucacuucggaaacugaagagacaugacugucuccuacccauauacugccauauccauugauuaauaccugcacacauauaccuucacuuacauauguauauauacuacauaaacaaaucuguauacacacagaacuaguaauacaacuaucuuaacuucauucugacauuuagccacaccaauacacuaaaagauauuuauccaaacacagauuacuguauauuuguuacaaacauuuauauuuccaucuacaucugccuauccucuauguauaaacauuuagugaacauuuuuuaaaguaaucacgaggaguguggcaauauugaccaagcagccaagagacucaaaggaauuagcauuugcugagcauccccuauuuuacauuugucaugcacuguuaggcacuuuuaacauguuugaccacuuagucuuccccaccauccuauuaaacauuaaucuuaauuuacagaugaggaagcugagguucaggagguuuaaguagugaguucauaaaagaacuaaaauucaaaauucaggacuaccuaacauaaagcgcaugcucucuccacauaaucucaaaaaagcuuauaaaaaagacaaacgguauaaaauguacuacacuggggaggggcauuauuucaggaaguaagagaaaucaucacccccaguaauuaaguaagagaacaccuuaacaauaucuuacucucacaaaaaagcaaaaucuagauggguucuguaggaugguggaaagugguaaaucacaaaaaaaccuuaggaaguucaaaguucaguuuaaguccaaaaacugaauauaaaaaaagcuuuaaguaaaaaagaaaaaaaaagcaagguuuucuuguuuuuguuuguuuguuugagacagagucuugcucuguugcccaggcuggcacaaucacaacucacugaagccucaaccucccagguucaagcaauccucccaccucagccucccgaguaucugggacuacaggugugcaccaccaugcccagcaaauuuuuuuauuuuuuucuagagacaaggucucacuauguugccuaggcuggucuccaacuacugggcucaagcgauccuccugccucagccucccaaggugcugggaccccaggcaugagccacagcaccaggccaaaagcaagguauuuacagggaauuaaaguagauaagacaaacauuuuuggggcacuugucugguaaguacacugcugcaaacacuuuacaugcauaaucacuuaauucucacaauuaguacaauuauccucauuuugcaaauaaggaaacuggaacagaaauauuaaauaauuuagucaagguguuuaaaaauuuagacagguguuuaaaaauuaaaauaauucuguguaaugggaugaauuuaaaaaaaaaaaaauuuuuaagacacugggaucuuaacccaagcuaucuguguccagaaccaagcuccuuucuaacuauuaugcuaaauuucaugaacaaacaauagcuagggugaaggacauaucuaguaauaugaacaguauggucaagugguguguagcuuuuuuauuuuuaaaacccaaagucaggcugggugagguggcucaugccugcaaucccagcacuuugggaggccgaggcaggcagaucaugaggucaagagaucgagaccauccuggcuaacaugguaaaaccccaucucuacuaaaaauacaaaaaaaaauuagccgggucugguggggggcaccuguagucccagcuaguugggaggcugagggaggaaaauggugugaaccugguaggcggagcuugcagugagccgagaucacaccacugcacuccagccugggcgacagagcgagacucugucucaaaaaaaaaaaaaaacaaagucagcaaauaaacauauaaaaagagacaaauaagcauaugaaaagaugcucaacaucaugucauuaggaaauuacaauuuuaaaaaaggagauaccacuacacaacuacuaaaacggccaaaauauaaaacccccaaaugcuggugaggaaguagaacauucauugcugaugagaauacaaaaugguacacagccacuaagagucugucaguuucuuacaaaaguaaacauacucucacaugcaacccagcaauugagcuccuuaguauuuacccaaaugauuugaaaacuuaugucuacacaaaaaccugcacacaaauguuuacagcagguuuauucauaauugccaaaacauggaagccagcaagauguccuccgguaugugaauggauaaacugugcuacauccagacaauggaauauuauuuagcgcuaaaaaggaaugagcuaucaagccaugaaaagacaaggaagaacuguaaaugcauauagauaaagaaggcaaccugaaaagucuacaaacgguauaaauacaacuaugacauucugaauaaggcaaaacuaugaagacaguaaaaagaucagugguugccagcagggagaggggagggaacaguuggggggaaaaggaagggaaggaugaauaggcagagcaggggaucuuuaggguagugaaacuauucuuuaugauaguacaaugguggauacaugucacuauacauuguccaaacccacagccuguacaacaccaagaguaaauccuaauguaaacuaugcacuuugggagaugaugauuguuagugcuaagaucacggaugguaacauaccacucuggugcagaauacugaugggugggaggcugugugagcacagagauagagggcauaugggaacugucuguacuuucugcucaauuuuguuguuaaccuaaaacugcucuaaaaaagaaacacauauuuaaacaaaaaaaaagucaaggaauguguuuacuuagcaauuaguauauaaggaaguacuaauauacucauuguuauauaugcauccaaucaaaaauacucgaguuuauacuguauauauuagggcugggcgcgguggcccaaaccuguaaucccaacacuuugggaggccaaggugggcagaucacuugaggucaggaguucgagaccagccuggccaacauggugaaacccugucucuacuaaaaauaaaaaauaaaaauaaaaaaaauuagccaggucuggugguguguaccuguaaucccagcuauucaggaaggugaggcaggaggacugccugagccaaggaggcagaggcuacagugagccgagaucgcaucacugcacuccagccugggccacagagugacacucugucaaagaaacaauaauaauaaauaaauauauacauacacacacacauacacacacacuguauauuaggcauccuggggaagggauauauaaacaaauaaacaaaguaccuccccacaaggagcuugaaauaugagacagaccucauauauuuacaaaaagcuaaauaaaauggaauuuaaacuuaaauaguucaagacgguugaaaaaauaccacaaaauacuaaccugccagauuacuaaaauggacacuaauaggaccauaugugcuuagggcuucagucauuucuggcuaaagggaucaggaaguuaagauacgcucuaggucuugaaaaugacuaagacuuagcuaaaugacuggagcgaauuggugcauuccaagaaagaacaaaacuacuguaguuaggaaaaagaauuaaauggaccauuucacaaaacuuauaaauaaggagacaagacuagagagacuaguaaaagccagaucacgcagcucagagcuucaaaaaucuucacucuuaaauacugacagggagcaaauacuuacccagccuguguauauacugauagcucuuaauccaguuaaacuguauuuauaaacauuuuauaucagauacagauaauauaaagacauauacuaguagucauaguuaaaaauucacugucuuugccacucaauacauauacauacaaguccuguucccauccuucaacugcaaaucuacaggcaacccauaacccuauaaacugaaccccaggcguccauaagaccuauuacuguaucaccuagucuuuauccccucagacacagaugucuuuccucugugguagaaaagaaaguggcccauugcccauaaacgggaaagagggauuauguuaggaccaugaucgcuacuggcaucuucucucuacucuauuuauagggcugucacccucuauuaaucauuaaaagcaaacuuacuaaauaccugcagauucuaaguaaaacauaaaaugcagcauucccuccucaaucaucugaacuggggcaaauaggacccuauacaaccucugauaauuauuauuaauaacaaacuucuggccaggugggacagcucaugccuguaauaccagcacuuugggaggcugaggugggaggaucauuugaggccggaaguucaagaccagccugggcaacacagcaaaaccccaucucuacaaauacgaauaaauuuuacaaauaauaauaaauuucacuucucauauaugaaaauguuucagaaugcauccauuguuaacuuccaaauuuuuucuguaauccuucauuccguucacuauaaacccuucuacauauuuuaauucacauacucaaucuucaugcauggggaccugcaauuguauccaaucccgaacucuucuaaucaacagaugccccaacaaaaccuguuaucccaaaucaaugcuacauuuuacuuaucuaccuacaccuucauguuauacaucuaaaacccuccucuuuaguaaucuaccacuaaagugaauauugucuuuccuuccauguacaggcacauaaauauauguccaauuuccccaaccaacaaauccugacacacauuauuauucucaaacauggccuccagacauaaaaagcacaccauaaaauuccucuuucuauccaaaacacuugaauacuuuuguuaaugacuuucuuuagaaauccuaguacauauaccacuuauuccaaguuaaaaaucacaaaaauacuacauccucaagauagaaacauauacuagaaaguguagacauauaugaaaaggauaaaaucaaauuaaagauaacguuuaugaagagggaggauuggagaaaugcaguccaggagagauucagcugagauuuuaauccuauuuguaaaguuuuauuucuuaaccugaguuggggaugcaugguguucacuguaauuacucuucauaccuuuucauacuugaaauacuuuuaaaugacuuuuaaaaagaaagacauccaauuaccaaugagcaucucccucuuacacacagugagaagccauuauguccaaguugcaguaacuguucacugcuacaucugggccaccccaucauuuaccuaagccaagaaaagaaaaaauuacaaaccuaccucccaaaacuuucucuuagauauguuccaaguuuauauccugaaacuauacauaauccaauucuuucacaacucucacaucaacaauaauuaacaugucuaauuucacguuugcaucccuaaauugccauuuacucuuacaaaugccuuauuacucacauaguaaacuuuuccuuguucgucuacguuaaaauacaagugaauugguugaccacauaacuacuuccacuuggcuaaacgcagacaguuguauacauuacaucucuaugcaggaguccgauucacucauacacuaacuuuucaaucuaaaccuacaacauccaaauuaagccacccaucauuuaaccacaaaugaaaugucaucuccgccaaaucuaacucagccagggccauuccaaaaccacuccaguccguccacugagcauacaccucacgcaucugaaagucccgucccuggaccaagguuuacgccacccagaagugcucuccuccaauggugagacucagacacaccuucaaauccuaauuuucggcucgcugugggaaaacaaguagagacagccugaaguuacaaacccaaaggaaucuauuucauacaccacagguccugacuuucucgucacuggggcguagaaguuggaagccccgagcaaggggaccaggucuagucgucuucggcguccgcagaguccuacagucgucgaccaagcaguucaggcagcuggcccgccuacuucccuccccacccccaccacgacccaccccacccccaccccacccccacccccacgcugggcgcacagcccgcggucugucccccgcacugcgggaccugagaacagcagacugccggcuccucucccacaagggagggcuugguugccggcucagacgcuccccgccccucgccuccggccaccagccucuccgcccggggucaacccuuccagccuuucgcucucaucuaaccggacgcaggaccgacagccucuccagggccuacccgggccucgcuuccuccggugccaagcuccaaggucuccucaccucucgcggaggaccaagccagaccggacgcuccaggcccgaaaggcaacuccccucccaccacucccugacucgccggucuuuccucccaacugcagccgcugaaaaagccaaguccuaaggucccccuccaucagcuuccgggccucccuucacggcugggcccgaacccccagcccugcccucucgccaucucgcuuccccgagucgcgaggccgagccccggggcuggacggcuucuuuccccggcuucgcgcccgcccggcgugcggaagacucaccacugagcgcggaggccugcaguguggcccccgaggugccgucgaugacuuugauggucccgcggcuagugacggccaggauggcguugagcgcagggugguaggacaggcugugcagcccgucggcgucgcagugcaugcagccgucccgcagcaccagccacucugagaccccggccgcccccgcccccgccgccgaggagcagccggggcccgaggccgccgcagccgcagccgccaucuuccggccugcgcucagcacaaucacacugggaagcggcucagugacagucccgggaggugcagcaccaccaccagucaccauccggggccagggggcaagccgagcgcguuagccggaagugaagucaggcgcccgcacgcacgcggaacgucgaucgcccggccggaggggccaaacucggagggaggcugacgggagagggggagaagcaggga

SEQ ID NO: 192977 - RNA, 36887 nt, Homo sapiens
acugguucaaugguccauucuguuuauucagaacgguaacauaaauacaccuuaaauauuaacauuuuuuauauacagaaaugaccccacuccccaaaaaguuugaaaaaauauugucuccuccuccuuuauaaaacccuagaugaccuaugaaggcacagccaagcccuugaugcaucuuccucagcacaauuuggccaacgcuggagggaaggucaaagagguggaaggaaaauguuaugcugaaaaucccuuuccaacaagggugccaagcgccggucuugaacgaaguacccugccuaagcaucauuuccuaaagcgcuugaagagcggguguacauguuugcugggcgccuugcuccgcgaugagugguacuccauguacacagugucgucggccccagacauagaacucauggugccaaagcgccgagaugccugccgggaagggggaaccagcccauguuagucuccagaagaaaagauacuccuuuuauaauacuuauaaucacagcaaauuuuauaagacuuacauaaauuuaauacaucauuuuuaauaauguuuacagaucgcuuacugucucaggcauuguucuaagcauuuuacaugcauuaucuccucuaauccucaaaacuacuauaauccacaccugaaagaagaggaaacugagacacagagagauuaacuaaccuauccaagaucacauagcucuuaaggagaugggauuugaacacccagguagccuggcuucagacuguucuuaaccauaaugccacacuaccucacuuaauaacaacuucugaacaaacuuuuuuuuuuuaagagagaaacagggucucgauauguugaccaugcuggucucaaacuccuggacucaacugauccucccgccuaggccucccaaagugcugggauuacagacaugagccaccaugccuggccugaacagaauuuuuuaacaguuagggcaaaaguuccuuaaaaucuccugagacaccaccauaaggcuuugaaucaaguggaaggacagaaagcccugggcuugacucuuggcuccuccugucccugaguaacccugaggcaaguaauuaaugucugcaccucaaugaccucaucuguaaaauggggauaaccacaucagugcugacauugcuauccugugaggagaaugaaccaggcaccuccuuaaaaccagugagagcaaugagagcacucuccuggguucccauggagagugcccccugggucgggggaggaaagccuuaggcuggagggagggcagccccuucccagggacagcuguuuccuucuugccuugguccagcaguugcucaccuuccggcucuaauggcaacugaauuucaaacgcaccugacugaagugcacuucuccccuuggacaggccugcuaauucuccauaaugaugcucucacuaauuagaccauauauuuacuuggccuagagcaggcauauuuguagaauaaaugaaagguugaguauuuucacagaacucuacauuuuucaaaguuaaguaucgaagcuaccacaagaguugauccucagagcagucuuaggggcuagagggcucagcuuuaucacugaggaggaaccagaggagaacuguguggccacagccagggauggcagcccugugugugggaacuacguacccccagcccaucaugcucccuccagucaccaccaaggugagcuggggucaccugcuugccauccugggcuucaacaucaagauuuaacaaauacucgugugagcaaagcaggagaccagucacagccacugugagcucagcugugugcaacaguacaaggggcacacaccaaaagggcaacaaggauuguuucuguucaucucuuccguguuuuccaacauuuccaaaaaaaucccaugggcccauccaggcaggacuacaugucugugucugugucuacaaacgcugcccugugagagcacugacaccuggaaccuccucacccauuuacucaccuggcuggaucuggagccaaauuccccagccaccaccuccuccucggcauccaggucaguggcugccaggacuuucuguaagagcugcuguugcucuucuuuugucgaaaacgccaagucuuccuccuccaugccagcgaguuucgugaucaccugcaaagcccaagccagcagacaugccccuuucugcucucucuccccagcccuccucugccuucuccuggguccaccugcuuuggucacuucccuccccaggcccagccacccugguggccaacaauggagagcuccucccuagcauuccagagaccagcaucaggagccgccuuuaacagggagcuugacuaaugaucucaagaccagagggaugcaggaauuucagagaaaucugcccccagcacacagcaucuaaaugaucauguauggaagaucaacaggaagaaucuuagugauuuuaaaaggcuccuucggguagccuucacaucuuggagcagacaaaggaagggacaagugacuggaaggcacaggcuguggcccuuugugaaggucccuggcaucugcugugcuccgcaacuggggcuuccagcaggaaugagcacgugaaaaugaaaaugauaggauaucaggaagauuauuuauagagcuucucugagagaguaagaacagcaugguggagacuggguuuucauuucuauggggauaacuuacuacaagggcucccuaucccugcagaaaacuuggguugauucuguaaagggaauucuccuucccuccaauucucauaauguucauuaaaugaaaauuccuagaaguaaggaucugaguccuucugggccagggauccagaguacagacgaugugcacaucugcccaggcccagccacuccacgucaugacucugggaacuccaaccacugcuccucaacaggcagcaccgaagacacagcuccaaccaacacaaacuacuacggcauggcauugugccuuuuugucgaggucaccuuucaaagaauugcucuuucugaccuggugcuccucuuacccucacagcucggcaggaaucaggagguaggaaugcuauuaccaacagggauuuucauggauggauaaaaaggucaugaugcaaauccuccaaaaaacugggcucaaaacccaagcaucuuguccucuaggccagcaugagaggucugaagugucacugccucuagcuaaaagagggaaggucagacaacccuguccuccuaaggccaauaaugggaacucucaccaaugcauaaagagacacauuaaaaacguaucucaaaaggcagccuggauugcagucuuuugcaaucaagaaccugggagucuaauguucuagggauguccuuuuaguggaccauagggggaauuuaauuccccuacuucuagaacccuccaucuauccccaaaauauaaagcccucuggacaccaaauacugacauaaacguaauauuuguguaacaggaaagaaagcaaaugccucagccagugaaaguuagccaaagcuuuagaauuucccaauuauuaaaauaccugauuuguaguacaggauagcucugaugucugggaggcaaacugaggcaaacuaaggccuggagcuuaccagcugaugaaaggaagagcucuccuagcuaccuagagaggcaucccugagaaagcagcccugcggggcucagauucacacagugcuggucauagugccauggcaccucaguccugccaggacggcacacuuuccaccaacagcugcccucagagauucaugcagagauaaagggaguuugaggcaaggccucuaaucuccuaaugcuuggugccugccugcugacaguggcccucgcuucuccuggaggccaggguaucaagaaggccuugguccuagucuaaccagaagccaaauggauauguaccuugaagcuauaaccuugaucuaccaagaaucucugccgcuugguugaguaagccauuuccuguguguccugggauaccagugaguagaaaaaggcauuguacucuucugcaaccaucccugcaggaaaaaaugagaaacggcaauaaagaagacaacauuagccauuagaaugccaagagcuaagggucccaggcucaaaagcaagcacuggaguggaaaagcccugcacucgggguuaccaccugaacuuggcaugggauugcaucaaaauuuggaagucuuuugugcuuccaaggacaccaucaagugaaaaaacaauccucagaauaaaaaaauguggaaagcauauaucugauaagggauuuguaucuagguuauacaaagaacuguugaaacucaacaacaagacaaauuaauuauaaaugagagaagaauaugaacagauuacuucuccaaaaacaauauaaaaauagccaguaagcacaugaaaugaugcuccacaccauuaaucaccagggaaaugcaacucaaaagcacaaugagauuaucaccucacgccccucuccgaggauggcuacaaucaaaaaagcagauaacugccacuguugucaaggauguggaaaaacuagaacccgcaugcauugcuguugagaauguaaaugaugcggcugcuuuggaaaacagucuggcaguucaucaaaauguuaaacacacuguuauaaccacaugaccuggcaauuccacuuccaggcauaaauccaagagaaaugaaacuauauccacacaaaaauuuguacaugaauuucauagcagaauucuucuaagagccaaaaaguggaaacagcccaaauguccaucaacagauguguggauaaauaaaaugugguauguccauggaaucgaauauuauuuagcaauaaaaaagaaugaaguacugacagaugcuacaauauagauaaucuuuuugaaaacauuaugcugccggguguggugacccaguccuguaaucccagcccuuugggaggcugaggugggcguggaucacucaaggucaggaguuugagaccagccuggccaacauggugaaacuccaucucuacuaaaaauagaaaaauuagccaggcgugguggcucaugccuguaauuccagcuacgcgggaggcugaggcaggagaaucccuugaaccugcgaggcagugguugcagugagccaagaucgccccacuguacuccagccugggcgauagagcgagauuccaucuccaaaaaacaaacaaacaaaacauuaugcuaagugaaaagaaaccagucacagaaggccccaaguggucugacugcauuuacaugaaauguccagaaaaggccuacagacaucaaaguagauuaggggcugccuagagcuggggguugggaacaagaggaaauuaggaguggcugugcauggaugaggguuucuuuugggagcugaugagaauauucuaaacaugaauuguguugauaguugcacaacuuugugaauauuguauuuccuagguuuucuucgaggauccuuauaguuugaggucuuacauuuacaucuuuaauccauuaugaguugauuuuuguauguggugauaggcaggggucugguuucauccuucugcauacaguuagccaguuuccccagcaccauuuauugaauagggaguacuuuccccacugcauauuuuugccaauuuuguugaacaucaguuggcugcagguacauggcauuauuucugagcucucuauucugcuccauuggucuaugugccuguucuguaccaguaccaugcuguuuugguuacuguaagcccuguagcauaguuugaaguuggauacugugaggccuuuggcuuuguuccuuuugcuuaggauugcuuuggcuauucaggugcuuuugugguuccagaugaauuuuauaaguuuuuuuucuaauucugugaaaaaugauguuggcaauuugauagaauaguguugaaucuguagauuguuuugggcaguuuggcaauuuuaaugauauugcuucuuccaauccucaagcacagaauguuuuuccauuuguuucugucaccuaugauuuauuucaggaguguucuguaguuauuccuagguuuugucuuuuguuuuuacagcuauuauaaauuggauuguguucuugauuuggcucucagcuugaauguuacugguguauagaaaugcuacugauuuuuguacauugauuuugaauuccgaaacuuuacucaaguugccuaucaggucuaggagccuuuugguggagucuuuaggguuuucuagguauagaaucacaucauuagggaagacagauaauuuaacuuccuuuuuuccuaucuggaugccuuuuauuucuuuaucuugcuagacuggucugaguagaacuuucaguacuauguggaauagguguggugagggugggcucuuugucuuguuccaguucuuuuuuuuuuuuuuuucugggggacggagucucgcucugucgcccaggcuggagugcaguggcgugaucucggcucacugcaagcuccgccucccagguucaugccauucuccugcuucagccucccaaguagcugggacuacaggugccugccaccacgcccggcuaauuuuuuguacuuuuaguagggaugggguuucaccauguuagccagaaugaccuagaucuccugaccuuguugugauccgcccaccucggccucccaaagugcucggauuacaggcaagagccaccgugcccggcugucuuguuccaguucuuaaagggaaugcuuccagcuuuugcuuacuuaguaugauguuggcugugaguuugucauagauggcuuuuauuauugugagauauguuccuucgaugccauuuguugaggguuuuuaucaugaaggaauguugaauuuuaucaaaagcucuuucugggcugggcgcaguggcucacaccuauaaucccagcacuuugggaggccaagguggguggaucaccugaggucaggccuucaagaccagcacugccaacauggcgaaacccugucucuacuaaaaauacaaaaaaauuagcugggcaugguggugcgugccuguagucccagcuacuugggaggcugaggcaggagaauaguuugaaucugggaagcagagguugcagugagccaagauugcaccauugcacuccagccugggcaacaagagcaagacucugccucaaaaaaacaaaaaaccuuuuucugugucuauuaggauaauuauaugcuuuucauuuuuaauuauguggugaaucauauuuauugauuuccacauguugaaccaacuuugcaucccagaaguaaagccuauuugauuguggugaauuaacuuuuugauaugcugcuggauuugcuuuguccucauuuuguuacagauuuuugcgucuguguucaucaggaauacuagccuguaguuuuuucaucgugucuuugccagauuuugguaucaggaugauagugguuucguaguaugaguuaggaagaagucucuccuccucaauuuuuuugaauaguuucaguagaacugaauacaucugguccaggacuuuuuuaguugguagauuuuuuuuuuuuuuuuuggaggcggagucucacucugucacccaggcuggagugcaguggcacgaucucagcucacugcaaccuccaccuccaggguuuaagcaauucuccugccucagccuuccacguggauggaauuacaggcacacgccaccaagcccaccuaguuuuguauuuuuaguagagacgagguuucaccauguuggucaggcuggucuggaacuccugaccucaggugauccaccugccucagccuuccaaagugcugggauuagaggugugagccaccaugccuggggccauauuuuuuuuuuaaauuacugauucaauuucuccuuauugaucuguucaggguuucaauuaauuucugauucaaucuugggaaguuguauguuuccaggaauuuaucuauuuccucuagauuuacuaguuugugugcacagagguauuuuuaagucucugagaaucuuuuguauuucuggggaucagcugugaugucaccuuugucauuucugauucugcuuauuuggaucuucucuuuucuguuaaucuaacuagcaguccaucaaucuuauuuaucuuuuuuuuugagacggagucucgcucugucacccaggcuggagugcagaggugcgaucucggcucacugcagccucugccuccuggguucacgcaauucuccugccucagccuccugaguagcugggauuacaagcaugcgccaccacauucgacuaauuuuuguauuuuuaguagagacgggguuucuccauguuggucaggcuggucuugaacucuugaccuuguaauccgcccaccucggccucccaaaguuccaggauuacaggcaugagccacugcgacuggccuuaucuaucuuuucaaagaaccagcuuuuuauuucauugauccuuuguauuguuuuugagucugaauuucauuuaguucugcucugauuuuaguuauuucuuuucuucagcuaguuuugggauuagcuuguucuuauuuuucuaguuccuucaggugaaaucucaaauuguuaauuugaaaucugucuucucgauguagguguucagugcuauaaacuuuccuaacaauaccuuugcuguaccccagagauuuaguauguuguaucuguuuucauuuguuucaaauaauuuuugauuccugccuuaauuuguuuauccaaaagucauucaggagcaaguuguuuaguuucuauguaauuguguggguuuuuuuuuuucuuuuuucuuuuauuuagcgaugaggucucgcuauguugcccagaauggucuugaacuccugaguucaaaugauccucccacuuuggccucccaaagugcugcgguuacaggcaugagccacugugccuggccaauugugugguuuugagaguucuuccugguacugauuucuacuuuuauuccacugugacccaagaaaaugcuugguaugauuucgacuuuuuugaauuuauugagucuuuuuuuuuuuuuuuuuuuuuugagagagucucgcucuguugcccaggcuggagugcaguggcgcgaucucggcucacugcaagcuccgccucccagguucacgccauucuccugccucagccucccgaguagcugagacuacaggcaacugccaccacacacccggcuaauuuuuuguauuuuuaguagagacgggguuucacuguguuagccaggauggucucgaucuccugaccucgugauccacccgccuuggcuucccaaagugcugggauuaucggcguaagccaccacacccugccgaauuuauugagacuuuaauaaagucgagcauaaagucucacauugcuuuauggccaaacacaugaucaauuauuuuuuuuuuuuuuuuuuuuuuuugugacagaguccugcucuguuccccaggcuggagugcaguggcaugaucuuggcucacugcaaccucugccucccggcuucaagucaguucuccugccucaggcucccgaguagcugggacuacaggcgcaugccgccacacucagcuaauuuuuguauuuuaguagagacgggguuucaccguguugcccaggcugguugcaaacucccgagcucaggcaaucugccggccucagccucccaaagugcugggauuacaggugugagccacggcaccaggcccaugugaucaaucuuaagaguauauucugggggcagaugagaauauauauucugugguuguugcguagagaauuauguagaugccuauuagguccaauuggucaaguguugaauuuuaaguacagaauuucuuuguuaguuuucugccucuauaaucugucucaugcugucaguggggugucaaaaucuccuaccauuguuguguggcugucuaagccuuuuccuagcucuaaaaguacuugguuuaugaaucuaggugcuccaauguugggcgcauauauauuuaggauaguuaagucuucuuguugaauugaaccauuuaucaucguguaaugaccuuuuuguccuuuuuuacuguggcugguuuaaagucucuuuuaucugaugcaagaauagugacccccugccccacucuuuuuuuuuuuuuauuugugugauagauuuuuuucccuaucccuuuacuuugaaccuaugaguccuguuacaugugagagaggucucuugaagacagcagaaggcugggucuuguuuuuaauccaauuugccacuccaagucuuuuaggugggguguuuagguuguuuacauucaagguuaauauugagacaugaggcuuuauuccuaacauggugucauuagcugguugcucuguaguuuggauuguguaguugcuuuacagggucugugggcuaugugcuuauguguauuuuugugguagcaggugucaccauucuuucauuuccauguuuagaacucucaagacucucuuguagggccagucuggugauaacaaauucuuuuagcaguugcuugucugggaaagauuuuauuucuucuuugcucauguagcuuaguuuggcaggauauggaauucuugguuaggauuuuucuuuuuuauuuuuuuucuuaaagagacugggucucacuaugguuuuuugguuuuuguuuuuuuguuuugagacagagucuugcuguuguugcccaggcuggagugcaauggugcaaucucggcucacugaaaccucugccuccuggguuccagcaauacuccugccucagccuccugaguagcugagauuauaggcaccugccaccacgcccggcuaauuuuuguauuuuuaguggagaugggguuucaccauguuggccaggcuggucuggaacuccugaccucaggugauccacucaccucagccucccaaagugcuaggauuacaggugugagccaccgcgccuggccuguuuuuuuguuuguuuuuguuuuaaacaggaucuuguucuguugcccaagguggaauaccguggugagaugucagaucacugcaaccucugccucccagacuaaagcgauucucuugccucagccuccggaguggcugggacuacaggcgcacaccaccacacccagcuagcuaauuguuguauuuuuuguaggaacaggguuucaucauguugcccagacuggucucaaacuccugaguucaagcaaucugccuaccuuggccucccaaagugcugggauuacaggugugagccgccgugcccagccaggauuucuuuucuuuucuuuaagaaugcuaaaaacagucccccaaucucuucugacuuguaaaguuucugcugagaagucugcuguuagcaugaugaguuauaugacccuuucucuagcugucuuuaagauucuuucuuuuguauugaccuuggaaagucugacggcuaugugcucuggggaugaucaucuuguacagcaggaagagucauucucacccucgaucuuagcaaccuuagcauaugauuuuuauucccuugcuuaaauuaauaacuuuuaccuuuucgcuuuaagaaagcacuuuacagcuucucuggcauaucugaauugcuagcaucauuacacuugugcuuuggggccauuaguaagauaaagguuacuugaaaacaagcacugagauacagugacaguccgugacaacugagauggcuacuaagugacuaauggguggggagaauuuaagcaugaauaugccgcacaaagcaagaauucacaucauggaugcuacucagaauaguguguaauuuaaaacuuaugaauuguuuauuucuggaauuuuccauuuaauauuuuuagacuacagcugaccaugcguaauugaauguggaaaggaaaauugcagauauggggggacuacuguauuaaaaaacuaggacagaaaauucuguggccugaaagacuugauccuucaggaaaaucugaacaucuuugcuuuguaguucaaaugucaguagguuaagcauacugcccuugaauguaauuguuucucaaaucuuacaagagcucagagaugcaaagaaaggagccaagugucauguuaaacaguguuuugaguaagaaaacaauucuauucacuuuuuuuuuuuuuuuuuuuuuugagauggagucuugcucuguugcccaggcuggaaugcaguggcgcaaucucggcucacuguaagcucugccucccggguucacgccauucuccugccucagccucccgaguagcugggacuacaggcacccgccaccacgcccagcuaauuuuuuguauuuuuaguagagacgggguuucaccauguuagccaggauggucucaaucuccugaccucaugaucugccugccugggccucccaaagugcugggauuacaggcgugagccaccgcgccuggccuucuauucacauuuaagggaguuuuuaaggcuaggcacaguggcucacaccuguaaucccagcacuuugggaggccaagguggguggaucacuagagacgagccuggccaaaauggugaaaccccgucuuuacuaaaaauacaaaaaaaauuagcuggacgugguggugcacgccuguaguccggguacucgggaggcugaggcaggugaaucacacuugaccccaguagauggagguugcagugagccgagauugugccacugcacuccagccugggugacagaauaagacucuaucucaaucaaucaaucaaucaaucaaucaauaaaggaguuuucaaauuagaguaaggaauaaguaaugaauuauauucacauuugcuagcagaucauaguccugucaguuuauaaaagcuacugucucagccucccaaguagcuggaaccacagguacacaccaccacgcccagcuaguuuuauuuuuuguagagauggggucucacuacauugcccaagauggucucaaacuccugggcucaagcuauccuccugccuuggccucccaaagugcugggauuauagguguaagccacugugcccagccagccgacuacauuuuaugacuuauaagcugaauccucacagcagucuuggcaagacaggauugucacccccacuuuggaugggaaaaccaagucucagaggagaaaauaauuugccaaaggugacacagcuggcuuggugccugaguccaugcuauuucuaguccaugcuaucugccucaucuccauuuuaaauacaagcuacuagacgcuucuuaaacacaucugaacgcaguacaguuccaacagaugcccacuaaucuugucauuuucaaacauucuagcaguccagaugccuccuugaauaagcagacuccuugaggauagggcuuguguccuugucucaggaugugcccuggucccaguaagacagacacggccaucucuuagcaagagugucagucccugccauguccacaauggcagucugggcccuuuuaccgcaguaagcaagcacaggggugccacgccuccucagaaaaagccuuugcaaugaggauucucaccuccucacucacugagcuugcccugccccugcugcaagcugccaccagggcggcacucugcacagguuaugaaugacgugcccauugugugucugcccaagcugcuccuaccaaaccuuucccugccuccugaucaaguuccagaagcagcuuccagcuccuccacuuacacugguggcccagcucuguuuucucccuuccaugucuaccccauaagcacugccuugcccuggcucccucucaccaucuaccaacacagcugcacaguguacagagcacaucuguguggauuccgugacacugucauggaaaacaccugcauauucacccccaagguaugagaaauaaugaugggccauaaggaucuaggucuuugcuuugggauucucucccuccagagucuauuuagccccagggcacauggcagcucucaccccuaucgucuuccuaacuaaagugguuuaagaggagugaccuccugcaacagaagaugaaaggccacuuuaccuuuuuuagcucgaagcacccgcccuagccuuugggcuuccugacgccuggagccaccaugggaugagaucugaaugaggacauuugcuuccggcagaucaaacgaagugucaccuaccuacagaaacaaguuggaagguuuuuauauaugaggaaaaaaaaaaagucaacugauccagaauuuaaauaaguucuguagauaauuuugaaacauaaucacucuuuucuccucuuuauaccagggucuaucugaugcaggcagagagaggugaagcaauaaaccucagaaaggcaucucugggucuccaggaccuugugugaguucugcuaagagucauccugaagaauuaauaccaggcaucagugacauucagugcugggugccaggagcccagagaugagagggcccuugaacagagacugacuuugagucauucauuuuuuuggcuacagaaauaugucuccacaaaaccauccauacucuuaccuguuggccacugacaccagcagcacacgugggaugugaccugggaggaacaacugccccauauggaauucugacuguagguggauuccucagcucuggggcuccaaacaucgagguucccagccacagacaugaagguuuggugcuuauaagcgcccagccacaaucacauaaaaucucauuucuuuuuuuuuuuuuuuuuuuuuuuuuuuugagacggagucucgcucuuguugccuaggcuggagugcaacggcacaaucucagcuccacugcaaccuccaccucccggguucaagugacugaacccugcugccucagccuccugaguaguugggauuacaggcgucugccaccacacccagcuaauuuuuguauuuuuaguagagacaggguuucuccauguuggccaggcuggucucgaacuccugaccuccggugauccacccgccucagccucccaaagugcugggauuacagaugugagccaccgcgcccgguuguaaaaucucauuucuuuugggcuuugggucugucuuaaucugaaugacuauucuaaacuguggggcuacagcuucugauugcagaguaaaccaucccugagcugggccugcggaagucugugcugacauccaccacccaucaucaagggacaccaggaaccaggacaaaggcugccgcgacacacaggaucuccaacuuguaaagagaacuucaucuaaaugccuacuuuugccagaguaggaaaugaacuuuuuuuccuuuuauaaauaaggaaauacaacuuaaaacuucuacauccccaaaagaacuggaaaaaccucaaauagccuuuauagauuauccaugaugcaugcaaauccucagucugcuccuuccacuaaccccaggcagugcccccuaucccuggacaugucggaaaugaaaacaugcaggagaaguuccuucagcagacaugaauucacuguccaggaaucauaguguaccccccagguccccagagugcuaggggccucaccuccaccccauaugccacacaaaccuuggauaugaagaugguguuaauuuugggguugugcuugaaauucuggagaauuugcauccuuucccccugagacguagguccguagauauagggucuagagaagaaugaagcuguguuagaccacagaauaaugccucaguuaucuugaaaacacaucagagggaaaaaggagcucaggcuagcucuucucaaguagaaagcccucgucauguaggaauaucguuacacccaaaaaaaugacuggcuacagaugcaccucccagccuuccccacugauucuagguuuaggcccaccauucucuucgggauucccuccuuuccauuuuucguuuucuuuuuggacuaugcuuuuuccugcuucaacaucucuuacucucagcacagagucuauacaaggagcaucuccacauuucaugaagcccaaagagaggugcaaagaaaccacugcuauuuccaaaaaaaggcuggaagcaacuguuugccaagacacaggcaugcuccaagagaugagcagaaaggagaaaagugcccuucagccauuauugugcugauuucccauaacacuaaguuuuaaaaacuucucuuuaauuucuagcucccugccaggcgcggugguucacgccuguaaucccagcacuuugggaugccgaggcggguggaucaccugagguugggaauucacgaccagccugaccaacaugaagaaaccccgucucuaccaaaaauacaaaauuagccgagugugguggcgcauguguguaaucccagcuacucgggaggcugaggcaggagaaucacuugaaccggggaggcagagguuguggugagccgagaucgcgccauugcacuccacccugggaaacaagagugaaacucugucucaaaaaaaaaaaaaaaaaaaaaaaaaaauuuuccagcucccugccaaaggguacaacccuaucaaugaacucaaugguuaucaucccauagcauugggaaugucacacuccuucccucugucuuggaaugugacgguggacaguuuuuguagcuucccaagaaucauaacaacagugaugaugaugaugacaacagcaaagacaaugaagacaaacuacagguacgcaggaccuaccaacaccaggcauugagcugaguauuacauuaaaaaaaaaaaaauccagccaggcgcgguggcucacaccuguaaucccagcacuuugggaggcggagguggguggaucaccugaggccaggaguucgagaccagccuggccaacauggugagaccccaucucuacuaaaaauaaaaaaaauuagcuggguaugguggugggcaccuauaaucccagcuacucaggaggcugaagcaggagaaucacuugaaccugggaggcagagguugcagugagccaagaucacaccacuucacuccagccugggcaacagagugagacuccgucucagaaaaaaaaaaaaaagaaaaagaaaagaaaaaaauccagccagcccugccaagauuccucagcauuguaaaagacagguuucauguuccccaauuuacaugugggaaaccaagggucagaagccugagcagguggaaccugggaguggcugcuccacugccgaggcccguuagcacccagagcagugcccauuaauggauguaccucaaagagcaaaccccuugccuguggggaagcuggauagggccugggcagcugcacacccaggcugauggccucugauuagcccagucacaagcugccuugccgugauccagaaugucccggccaccacauaauuuuaucauuuucuaugcaugucaugcagugaaaaagguuagaagccccacucgucagaacagccugacucuugagacccagguuuuuaggugguuuucuccucccccaucaccaggaaaaacuacuugcacaguggggagcccucaguuucuaaagguucccccacacagaugaaauagaaggaaaagcacccuccaaguggagaaugucacauuuacuaaauacuuacaagcugccaggcacaagaauccaccccccaccaucaagggacaccaggacccaguacacauuggguggcaguagcuccaugugaccgaaguacaaaaggaguucagagguaaacaacuuucccacauccagucugucugaucccaaaaacgaugcucugcccacagccccacacugccauauaacccuaagccucucuugcaaagugcuuuggugauaccaaugccuuucuuaugaaggcugggaggagccaaaagcuuggagaauccccaccacacacgagcaaagaauggagcaaugcccgagagccacaggaucacuuuuuuuuuaaaggauggggucucacuauauugcccaagcuggacuugaacuccugggcucaagugaucuuucugccuuggccccccaaagugcugggauuauaggcaugagccacugcgccuggcccgcaggaucauuuuagaagcgagaaaaccaagaagaaaaaacacuacuucauacauuuaaaggccagagacacaaaaaaaagguaaaaaguacacauuguaaugaucauucuaguacacaggagacagccacaaucugcugcccuucacugugacagacuggcuuggaauugacagugccaggcaaauuaacgucccugcccaagcagaugcucgggaggcugcggcuaaggcacaagccucaggagugcugcaaauguaggugggggaggccccuggagugaggcuccagaagacuggaggagcauugcugugggaggaaggauggggagagaauaguucuuaaauaaggcaaaguaaauauaggaacugucucauugcccugcucaaauuggcacuaaugugacagaacacaaacccaccaagaaaacaggagaagaaauaacagcagaugagagaaguggguaacauuucagaagcugaaaagcagacagaugcaggcacaguaccugagcuaacagacuagagaaagcagaagcuggagccggcaggagggaagaccgauacaaaacccgccgccucuguguccucugcagcacgcaggagggcucaggaacuagucaccaguugccugagaagguggggaggugcacaggaggacuggcagugugugagugugaggagcaguuggguccggccggcagcaggcaggccaccuccacugguggggcacuggaggcuuauucuccagggaugcccggcagagaugagggaaaaggcaagacugaaugcaaagauuccacaagcccuccucuuccccuaacacacgguggugcccaggggacugaaaaauuccucacugaagaaaccguccagcccaagagaaaaguccuagagauacuggcauuuggcaaccuccugaagaaauagccaggcccugcccagccacucuggugagguccacaagcuggcaaacccacuaagccacacagaaaggccugccagguuuucagugacuuuaaaccaauaaaauacagucaaggauuaccaaaacucagaaagacucaaaagacagguaaaaacaauuaagacaaaaaaaugaagaaaagagacauggcaggaaacagacggaagcuucaaaaguuuucaaagccuccgagaagacacucuauucacaaacaaaacaagaacaguuaccaggaaagaacucucagaaauuaacaagucucaauacaaggguuagaagacaaagagauaaaaaaguagaaaaaagauaagcaaacuggagaagcuguucagaggaucuaacaucugaugaaucaaaauuccaagaagggacuacauagagaaagugauuaacaacaaaaaaacagaaauucucagaacugaaggacacgaguuuccagauggaaaggauauacugagugcccaucacgaugaaagaaaaacauuaagaauaucacuuucaaauuuccaaaaagagagaagauccuaccaguuuucaagggaaggaaaacgcacagccaccacagcagacaacacacugagaggaagcaaagggcaucagacugccaaacugcugcacuggaagcuccaauguuaguucuaggaccuggccaaacuacugaucaaguauaaagucgaguaaagacaucuguaaacaugugaagucuccaaagcuucuccuccuacaucccuucucucaggaaccuacuggaacaugugcuccaucaaaaugaguaaccaagaggguggagauuucagggugggaaacacaacaaagaggcccagggaagucaugggguaguguccaagggaaaccccaugguaacagcugguggugucucuaguccuagacagcaagcaggccagaacagaguaagcgaauggagugcugguggggaucccacuggggaaacagaaaaacagaacugagaaauuaccugacccuacugaguuuaugguuaugugaagacuuuggaggggaauaauuauucaaugcacagaaaaccaagcaaaaacaaugacaaggcaauuauuaacuccaaggcaaaaaaacauuuacaaaaaagaaaauguaaggccgggcaugguggcucacaccuguaaucccagcacuuuggaaggccgaggcaggcagaucacgaggucaagagaucgagaccauccuggccaauauggugaaacccuaucucuaccaaaaauacaaaaauuauccaggcugugguggcgggugccuguagucccagcuacucaggaggcugaggcaggagaaucacuugaacccacaaggcagagguugcagugagcugagauagcgccacugcacuccagccuggcaacagagcaagacuccgucucaaaaaaaaaaggaaaauguaauaguacucuacagcucugccugaacauacuuacacagucaaaauaauguaacugaauauuaaaguaacccccaacuugugcuauucccauauugggagaaugguaggagagaaaacaggaguggggagagugguguauguaagaaagcuaaacccucaacuccuacaguaggaaguuaauaggcaauuucuauaacugaucaucaagaaauuacuacauaagcuauugcuuagaaagaugaaggcuggccaggugugguggcucaugacucuaaucccagcacuuugggaggccaaggcaggaggaacugcuugagcucaggaguuugagaccagccugggcaacauagcaaaaccccaucucuacaaaaaacaaaaauuagcugggugugguggugcgugccuguagacccagcuacucgggaggcugagguggaaggauugauugagcccagggggucaaggcugccgugagccgugauuacaccacugcacuacagacugggugacacagugacacccuaacuccaaaaaaaaaaaaagaaaaaaggaagaaagaaagaaauaugaagguaaacaacaaaaaagagucaaaagcggcugucuucaaggaauagaauugugggugggaaaauagaagcagggaauugcuguuuuucacaauaaucuaaauguugacuuggauuaaaaagucuuucuaaauuaaauaaagguauaauuuuagaaacuuaagaaauuuaaucuuucuaugaguuugucuucccuucuauaaaaugggaacaacauuuuauauggcugaagugaggauuaaguaaaaccuauguauaguacccauagcacauagcuugaccugucuccauagagggccuggccuucugcaacacuuacagcaccugaaguccugugucacuguaggagcaagcgcagaccucuuccuccuuacuuggcagagcuuuacaaaagccagguuuuaagcacaaauauuuggguggagccauggguugaugaggauacugcgugggcauuucuaagcuccuuccagaugccaguccguacuugggaugccagcccagcccaucuugccuucccagccccuaggccauccagucuggccuccucuccacccacagagcucacacagcccaaagcuccaaaugccaacucccacccaccuuuggagcccagaucuuccauggggccccacccagcucaguccaagucucugcucccuguucuuugggcucaaggugacuagccccccuuuucucuaugcucuaaccucugacuccaaccaccuacuucaggucuucccugguuucugagaccagggccacagaacaagaucuuuggagcccaagaaguuccugagagaaaaacaaaaaaacaaaacaacagccaccuucugcacucucaauggggaagagaaacuggccuggaggaagcuccaaguuuucaauucuuacuuguucagucgaauggcauauuccuuuagggcaaacacauugucagcaaagacaauaaucuugucauuccuccuuucaugaaacuugaucagaaacuggcaagcucuaaauuuguugggguucaugguguacagcaagauucguuucuugguuuugauugccacauauucccgguaaaauucaggagacauagggcaccagaccuguaauacaguaagaaccaggggucauuuuacaaguuuaaacaccacacaauuuaaaacuuuugaagaccuuucucuagcagaauuagcuuuaaaacaaaaccagucaggugcaguggcucaugccuguaaugccagcaguuugggaggcugaggcaggcagaucacuugaggccaggaguucaagaccagccuggccaacacagugaaacccagucucuacuaaaaauacaaaaauuagcugggugugguagugcaugucuguaauuccagcuacgcaggaggcuaaggcaggagaaucacuugcccaggaggcggagguugcagugagccaagaucacgccacugcacuccagccugggugacagagugagacccuguuuuaaaaaaaaaaaaaugcuaugugaauuagaaaucaguacaacugaaaauaaaugcaugcacaaaacuaaacccaaccuaauaccuccuauugaacuggacguuuucacauguuaaccacuuaaaagauuuuuaaaugcaaucacauccagggaguuauuuucacaccagcugcaagugugcgaaaccagauucucaauugguagugucagcaauucuuccauuuaagccacacuuccacacacgagucagcacugcuacugaguaccgccaccucuucacacacuucccagcagggcugggagcauaucaguuaggcgcuuggggcuaucagagcaaagcccuuugcugccaggcucccaggcagcacugugguaucaggggccuucauucaucccugugcccugaaugcuaauccucacccacagaaauccaugacugguaaaccccauggcuaggaaaaagaaucaucacaaauucagggguaugugagauaugugacaagacagaagauaugcagcaagugggucuaguaccacccaaccacagggugacugaggauccuguaugaagugguagcaggugagccuaaguccugaccugugucugcccaugaggaaucgaucugaucacuccccugcccauaggaggaggcccuuucccagacgcccccagcccaggcccagcuaccucagcacacuggacuuuggcgauguagccauuauucugcagcuccauccaguuggcuucguagagcuuaggcccaaucagaaaauuuaaauccacaauuuugucaucuucgcggacgagggucgcagucaaacccagcuuacagugggccugcacgauggugagcacccuucggaacaucuuggcugaggaaacaaugggagcauucacacugucacuuuucuuucuuauuuuuuauuuauuuauuuuaaaauauuuuuuguagagauggggucucauuauauugcccaggcuggucuugaacuccuggccucaagcaaucccccugccuucgccucccaaagugcugggauuacagacgugacccacugcacccagccuacacugucacuuuuucaaaugcucauagcugugcaacuuaacacuggcuuaugacaccaccugaacuaacccuuggguuucaggaccacagaagcuggcucuagacaagaaugacuaggcaaaugcuucaccaucacuuuuagaccuguccaaaagaaaaugaaaaggagaacaagagggugaaaugagcuuaaggaaucuccaaguuaaugaaucccagcauuccccucacaacaguuaucaguagaaguacagauggcaauuugaaauacaaccugcaauacuuacuauuaauaccauuaagcucuaaauuacgcaaagaauuuuccccuaacacuuguacccagguuacugaaaagaaaguugacaaucuagggagaggaagaaaugaaagaagccagcucuucucagcuucccaucauuuucccagaaaccgagaagaaagccaagcccacgggagugaugaaacuccaggaacuguucgcccaagcccuccggcccgccuuaggaaacuccccucuccaaacuuuaccaauucaaucacuuuggucaaccagcaaccucuuuuucuuccuuucuuuugaacauuauaauucucucugguuuaucaaauaaaauaaacacauaaaggguaugaguuauucauuuuuaaaaaaccuaauuuauggauuuccacgggcucaccuuuuaaaaauucuaauacucugaagcaagguuaaaauguuugagucaugcuuaucuuacaauauaauugaaaguagggcuaaugauauuucagaaauaaauagacacaaaaaucuaaggaaaaagaggccugaaugcaccaaaacacaaagacguucacagugaaauaacauaggguugccuaacucuaaguaaauguuuaguuuuuacaucuacaugguuugcacacaacaccacaugcaaacacacacacacaaacacacacacacacacacaacacagaaaacaaaaucagcucaggguuaugucuaaggaaagacugugcuggcuccaaaauacaguagccaagaaccucagaccaagcuccccauguuagagggaaaugguagucaaggcaauggcuacaccaacccagugugggccccagagaggcaacacugggggacauacugacccaagacaaggauaaggcagguaggacucugccuggacacccgugaccccaucacaccccucuauuacacucuccuacagcccugacagcugucacaggugaauaacucacagcauacuacucaauauauuuuuacagacaugcagcuguggaaccaccuagaucaggauauagagaaccaggcacccagaggucucuccccugaccccuucugucaauaacuagcacucuuccuugagggaaacacuccucugacuucugagaggggucugccuccuuucugaacuuugcaugaaugaaaucauaguaugcacuuuuguguguggcuuguaucacucaacauuaugucaugguugucauuuggcauuuauuugugugguuacuuggcugucccuuccacuuugucuccagugccaaguacagugccuaaacuuaguagguucucaauaaauaccuguagaaauaaugaaacuggcacaguaccuagcacacaggaagcacuuaauauacacaaguaccauaauaugaaucauuaauaaaaaggcauaacagagcuccuuuugaaaaaucuguaaaacagcacagcaaucuuuauccuuugagauaaaucucaaagauugaucacuccaccuaacccaacacagcagacguuaagacagucaggagacuuacugugacuuccuagcauucccuuauuuaacauuugcucucugggacaaugagcauggccaggccacugggcuuauggggccuguacucaaaaaucccuuagaguuuguugguuucacuccgcaacucaaccaaagacuaacucauccagugaacuagacgagagacagacaaacucacagacauaugugagugugagaugcaccuuuuuguacuuguucaucagauaaccaaucccaaaucugugcuguuguccccuggaaccugggaccuggggcuuggguuaaagaaaaacaugaacguguaccaaacauauagucagacagaaugccucaagcccugaacacagcuuccaaccaaacugcuacagaacaauuccagacuccuuuguggguagugauucucuguaccaucaauuuucaauccuagcagacccaauacccacccuuccaccuuuuuucuuuugaguuuuuaaauucucacaguaaaacugacuuggggcgggggguggggggggcacuucuaugcauuuuaacauauuuacauuuuuguaaccagcaccacaaucaggguacagauaaagacagcaucccccaaaauuccccugugcucuccuuuagagucauccaucucugaccccccacuucuggcaaccacugaucugcuggccagcacuauacugucguuguauaaaugaaaucacauacuauggaagcuuuugaggcugacuucuuucacucagcaccaugcuuuugagauucauccagguugcaacaugcagcaaguuuguucuuuuucacuacugaguaguguuccaguguauggauguaccacagcuuguuuauccagacacccacugaugagcaccuggguuuuggauauuaugaacagagcugccauaaacauucguguacaggauuuuguguaaaccucuuuucauguauccaggauacacaggaaugggacugaugggucaugugguaauuucauaauaaauggacaaacuguuuuccacagugaccauacacuuugcaauccaucccuccaggaaugugugacaguucaguugcugugaccucaucagcacccgcacaucaguauuuuuuauuuuggcccuucuaacuggcauaugggagcauccugugguggguuuaaaucugcaguucccugaugacuaaugagguugaacccuuuuucaagugcuuuuuugacauauguauauccuuuuuuggugaaaugucuaucaauuucuuuggccuauuucuuaaccuuuuugccauggccugaaugccuaacaggaaacucaaauucacacaucuaaagcccaacuccugauagucaccuuccagaccagcuccuuugagaguguuccccaucucaauuaaugcccacuguauccucccuuuguucaagccaaaaaccuuagugucauucuugauuucucucugauuccacaccugaccugucaauuaaagcuucacaacauauccagagucggaucacgccuucauccuuacugggauuccacaaacucaccucaccgcuucugucuugcuuccuucagucuauuuccagcacagcagccagggcaguauuuuuacaguguaaagucaacucaugucaugcucugcucaaaucccucagauggcuucacacuaagaguacaagccaaaguucuugucguggccuacaagguccuacaagaccugccccaauaccgcuaaucuuccucagccuugacuacuguuccuaugcucuccucuggccgcauggccaccuugugcugucucacuaugccaaguacuuucccacagcagggcccacacccugggcuuccaucagaaagaccuccaaucccucccuggccagcugugaacaucucuagguaucuccagaaacccaucagggcugaagagcucucaugcacagaaagaaccagaugcuggggccauuuugacauuuugaacacuaccugugaaaaugccucagauuucauuuuguucauaguaaccucuauuagacuccuuaauuuacccuaaucuguucaucuuuauuuuuuuuuuuugagacagagucucacacucugucacccaugcuggaguacaguugcacaaucaugguucacugcagccucaaccucccagguucaagugauccucccaccucagccuccucagcagcugagaccacaggugcacaccaccacacuuggcuaauuaaaaaaauuuuuuuuuguagagacaugucucacuauguuacccaggcuaaucuuaagcuccugggcucaagcaauccuccugcccuggccucccaaagugcuaggagacuacaggugucagccaccaugcccacuccuaauuuguuaaucuuaaucccuuaaucuguuuuuaucaaaaaagauucgcccaaaaaacuauacagcaauaaaaggaacaaacuacugauaaaugcuaaggcacagaugaaucauuaugggaagugaaagaagccagacauaauauauauuguaugauuguguuuauauaaauuuuccauaaaaagcaaaucuauagugacagcaguucaguagucaucugaagcuagauagagaaacaaagauugacugcaaaugaguacaaaggaaaucuaaaacuggaucaugguggccgaaugcaguggcucacgucuauaaucccaguacuuugggaggcccaagcaggcagaucacuuaaagucuggacuucaagaccagccuggcuaacauggcgaaacccuuucucuacuaaaaauacaaaaauuuggccaggugugguacuuuacgccuguaaucccagggugaggcugaggugggcggaucaccugaagucaggaguuugagaccagccugaccaacacggagaaacccugucucuacuaaaaauauaaaauuagcugggcaugguggcgcacaccuguaauccuagcuacucgggaggcugaggcaggagaaucacuugaacccgggaggcagagcuuccagugagcugagauugcaccacugcacuccagccugggcaacaagagcgaaacugucucaaauaaaaaaaaauuagccgggugugguaguacacaccuguagucccagcuacuugggaggcugaggcaggggaaucaguugaacccuagaggcggagguugcagugggccaagaucacacgacugcacuccagccugggcaacaaagcaagaugccaucucaaaaaaaaaaagaaaagaaaacuuggaucauggucaugguugcacugguccacaaauuuacuaaaacucauuggauuauauauuuacaaggggugauuuuaugguauauaaauuaaaucaauagagcagcuuaaaaaaaaaagguuugcccaugauacuuggagaaguagggcuucuauuacauauugacuaaggaucaauauuccgggcuucaaauaaaacacaucaccaccauuuugggaagggcuuuucagugcuccuaacccaguuuuuagagggccauuaaaaaacggaugaagcugagcagcaaaaggaagauggaggaaagaaaauaucauuuucuaaaucacuacugagccagugauuaagcaaacugugaaugugaacacuccugccugcaucccacuuaagaauuacuggccgggcacgguggcucacgccuguaaucccagcacuuugggaggaugagguggguggaucacgaggucaggaguucaagaccagccuggccaagauggggaaacccugucucuacaaaaauacaaaaauuagccuagcaugguggcaggugccuguaaucccagcuacucagaggcugaggcagagaacugcuugaaccugggagguggaaguuguggugagcugagaucgugccacugcacuccagcuugggugacagagugagacucccucucaaaaaaaaaaaaaagaacuauuaaaagcuuuacccagcaagccagcaagucuuucuagccaguugggugggcuacacagcagucccuuucccaaccuaacaacuggaaauugguuugucuguucagcaaguggacagcucagcuccagccugcuuaccugguauggugugcacuucauccaggaucaugaggccccacuccugggucuugagccacuccaugacucgcucggccucccaggaccuuuuggugguguggcccagcauggaguaggugcuaauggcaacggagcagccgaugggcuuguccuuggcaucggaggugaaccggcagaucuggcugucgucaaugguggaccacaucuugaacugggcuuuccacugcuccacagaaacagcugaguugcccagcaccagacagcguuuucugacagugcaugcagcagucacaccaaccagggacuuuccagcaccuacaagaaacaagagugcaaucccacccaaggacagguugaaaugaaggacagggacaggcagaaugacucacaaguacagcaaucuaggaaaaugucuuguaacaguccacauagcugacaucugagcgacacacacugcuccagccuguuuucuucuuuauaaugaggagacaugcccacuucacauacauaugugagaaauggcaggcgcuggggccuacuguagcacuuuacacacaucucauuuaaaugucaaaaucucaaaacaaaccagugagaagagaaaugccuguuauuguuauuuuaaagauagaaaaaccuggcugagccaccaugccacgguggcucauaccuguaaucccagcacuuugggaggccgagguggguagaucacaugaggucaggaguucaagaccagccuggccaacauggugaaacccuaucuuuacuaaaaauacaaaaaauuagccgggcaugguggcgggcgccuauaaucccggucacuugggaggcugaggcaggagaauaucuugaacccaguaggcggagguuguggugagccaagauggcgccacuacacuccagcaugggcaacggagcaagacucugucucaaaaagaaaaaagaaagauugaaaaacuaaagcugaggaguacuuuaccuugcccacagccacgggacagugaagcuacugggucccagcaugccuggcccacagaaggaggcacucggcaaaagaccacuauuauuauuacacagcaaacggggcugagaauucagggaugcgcuauguguguacagagaaaaugaaauuccaggagcuucugaguuuacuaccauccaccauuugaagaucaagagaaaaaucaagcuuuuccauuaaacagagauccuuccuuuauuauaaaaauacacugugaguuaccaggaauaaacguaaauaaaaaaaauuuguaaagugaaauaaaaaaggaaaacaacaucaaaauaacccuuggaguuuuggaaaaaaagaaccuccccuucccugaagaccuugccucuguaaguccucaguggggucccaaggugagucugcuguggucucuggccaagaagcuaggcuaggaccugacacuacugggauaaguggucaaacaggugcccagggggccacuccugccuuucccuggaccugcacaccauccuagucauccaggaacaccaaaguuucugcgcuagggagucuccaaauacacaaccccuaaggcugauucaagaacaagaaccuaaccccacuaagugcaacagccccuugccaucauuacaaucucaccccucaugugcucuaauuuuucuucgcugacucuagcaccacccaagguuguacacaucugcuuaccaucugucucuuccccagaagagugagcuccaugaggucagaaguguuguucuagccaccauaauacccccaguguccaggccagggcccauacacagcaagcacucaaauauuugucaagucaugaaucagggagucaccugaucuuggcuuuucagcaaggugugauuuagggaaaugugcagagagaaagcgggaggcagcuggcagauccagacacaacagccugaccaccuucuuaacucugguaccacuuaccgcagggaagaacaaugacccccgaacgugcacgcccguuuccaaacaucuuucgcaagcucuucuccugauagggucugaggacagcugugggcuuuaggucaauguugauaucaggguugacagaaucauuccggaagucauauucugccaacagaggguacuccagguggaugcaacguuucuggaguuccucaaucauuuccuggaaagagggcacaaaagggguuuuaaaaucuuguuacugugcucaaaaacauuacaucuucuaagagguccaauggucaaaaaaguggcauucuaucuaaacuucuacaagauuuuagaucuugcucagucaacaaccgggauaaagcacagaaaagcaacccagacuaacaacacuuugaaaaugaaaucuaaucagcaggcaaaauugaccuucaggcaccauuucucacaucuccucaggaaccugugaagaccagccuaccagccugaaaaagaggacacugggacuuuaacuccaucaggagaaaugaugccauggcucacagauaauaaaaaggagaaagcaauucagggaccaacagggacuccuuccuuucacacagacuacaggcagagucgacacauggcuggacuagcuucuaacagcagcucagugaaggaaccaggaggaagguacauucacuaaccugcuugacuucaaaagacacugucugugucucuucuucuucuucuucauccuuguccauuugcucauagaagucaaacagguccauggggaugucagauuuacccuguggaucugucacucgggaaguggagggcccaccacugcuuucagcagucuuagaaaucugugagagagguaggugcugaacgugcacacaacauuuaauucugcuguuaucaagcaaugggugaaguuguaaaggguagaaccagcagggcugcuagguuguaagugcuggguuaaagacaccugagagaacugaaauccuaaaugccugcccccacccaaggguggcccaggaguccacauacggcagauuugcuugugaaagucucugugaugagcucaguggccuccccuucagaguuucuuaagcggcauucucggaucacgggguccuggagaagaugcuggauuacaucaggguggcaacuuucaacgaaguaucugcaagcaggggaggaagaaggggucuacugaccagcagguaccuccuggagauuccacugcucauucaauuagauggucuggaaauacaagccucaugacucuccccacaacccuucgccaaaucuguaccaugagcugccggccaugauuuaacauaugaggguugugacuuugaggucaaguaggcaggggccugagcccagcuccacugcuagaggaaauacaguggccaguggaugaguuuccagucugggccacaucucuuguuucucuucucuuaucugugcuucacagaaaagacagcauaaacaucagguccuucccauaucccuuuauuccugcuggugcgcagaaagugacagugccuugggacaggccugucauggaaucucuuaccuguugugcuucaagaccagcuugacuuuuccauagcugacaguacacaacugcaaauacagauaacauccaacagguaaaugugcagcuaacucagaacacauucauuacuggucacaucuuacaccuaccaaccaagugaaaaguucauuuuacuuuagggaaacccaacuugcaauccuaaaguggucagaugugccuaaacugagcuuuuuccauuggccucugcuuucugagaacaaaaucuuccucuugccuggguaauucugaugcauauccauuaaguuauaaaacgcugcuuaaaaucuugcauucugccuuuccucucuauucccacagcccccacccuagucuagagaagaccacaccaguauuacuacaacuccacagaguaugugcacaguaauugcggcuuaaauaaaaugcaaagccucuucaccaaugcuccuauuuccccaaauagaauguaagcaucuugauggcagagaauacagcuuaaauccucccagguucccaaccaccuuuaggaaggaauacaguagaggcuguguggcaacaauaaaaauuugccacucaggccaggcacgguggcucacaccuguaauccuagcacuuugggaggccgagccagguggaucaccugaggucaggaguucgagaccagccuggccaacauggugaaaccccaucucuacuaaaaauauaaaaauuagccgggcauggugacgggcgccuauaaucccagcuacuugggaggcugaggcaggagaacugcuugagccugggagguagagguugcagugagccaagaucaugccacugcuauccagccugggcgacagagcaagacuccgucucaaaaaaaaagaaaaaaaaaauuugccagucagacuuugaggggcugccuauccccgcuguugucccugauccaccacuacagugcaccaacaccuacaucccugcaggcaauucgcagccaagaccaggcagagccacaguguugguacaagguccucuccuugggcacgcuuucuuuuuuguuguuguucugaggcggagucucacucuguugcccaggcuggagugcaaugaauggugagaucucagcucacuucaaccucugccgcccggguucaagugauuguccugccucagccuccugaguagcugggauuacaggcacccaccaccaugccuggcgaauuuuuguauuuuuaguagagacaggaauuucgccauguuggccaggcuggucuugaacuccugaccccaggugguccacccaccucagccacccaaagugcugggauuacaggagugagccacugcaccuggccgggcacgcuuucacaucacaggaaaagagaguucucuccaggacuccugcagcuucucugggacuggcugcaguaccauacugaauuccuguggcacucuucugccacuccagaucccaaggucugaaucugacuccuuuuggaucagccaaaggcaaugaaagccacuguccaucucuuuuaaauggcauucacccaucucgcagaagaaaccuagcauguucaacuauuaaucacauggaacccucuuuguuuugucaaaaacaucugaaguuguuuuugacuuucccucauggaacuuguugacuauuggucuccugcagauacuuagcuuuagacagaguuuaccaccuguguuagucagcuugggcugccauaauaaaauuccagacuggguggcuucaacauuagaacuguauuuucucagagcuguggaggcugaaagucuaugaucaagguaucagccgauucaguuucuggugaaggcucuugucuauggaccaccuucccauuguguacucacaugacaagaagggcaggugagagaaagcaugcuccggugucucuucuuaggaggacacuaaucauagcggaucacgaccucauuuagucuuaacuacuuucuuacuccaaauacauuaccauuggauauuagguuuugaagacaaaauuugaggggaacacacacaauucaguccccagcacacucacuuugggcugcauuuccaaauucucccuggcuacaaugggccugaauuaguagccccucuguguuaauacccacagcugggagcggcucaugagaagcguggccucacccagaacacaaugcuggauccagaguguagcggcucaugagaagcauggccucacccagaacacaaugcuggauccagaguguagcggcugggguaaucagucguuaugcuccccacaggaaaucugaauggcacauucucauggcugccacaggcugacaacauggagcaccuaugccuauuguuacauuagcagggcagguggaauugcuggucucagcugucacuugccuuaauaaacugcauaauuccaucagggacuccagucuugcugagcuuccugagguacucggugaugucacugguuugcagcccaacgcugacagcugcauacaaggaguaggcaguuaguuuguacucaugcacauggguuggucggcacacuggcucugcaauagccaccaagaagucuugggcauauuuguaaacuggagagaaggcuuccaagaagauauggccaucgggagccugagagauaccaaauggacaaaacagacaaggaaacaugaguugcagagacuacugggcucuugcccauaucauuaucaagaaagaauaagcugcccaacaccacagauauucuugcaagcacuccuucagacaacuguggggccuguuacauuaaucagauacagaagaguaaagaaaaauagaagaaaguguuuccaaagucaacagcuguuuccuacuauucugcacagagaaagcccaucuuacuggcuauccucaaguuaccuuuuggcuagauuucaacuaaauguauaacauuaauuauuuaaaguagagcaaaagcuugcuaccgaacaugucuuccauuauuugaggaaacaaacuguuacaugauaaaugcuauuuauucggcagauaaaaggauucacuacaugggguagggcuggggaaggagugagaguaaaccgagggguuagagcuguuggaagcccagguccggccgccacacgugugcgcaacugcucgcuguugccuugggcuguuccaacguguguggaugaaaauucucucccggccaguucuaggggcaguauccugaaugucaguuuugacucugaggaugcccaagauuuagcugccgcuccgcacacuccugggcccugcccaagcuaagggcaugcuuaccacccagaggggccuggagguguggucguccuucagcggcauuugcagccuguaguccuuggcuccauauucauccacuuuggugccugacucauccaccugcuuccccgccgccgagggaaccgcuuccugagggucguuccccggggcguccucuucaucauccucuucauccucauagugccgcuuccuggauuucuucuugucugcaagauaccaacacagaaguaagcccagcaggagccuucaggguucccuccgcaccgcuuggcagcauuucaccugcgccgccgcaaacuccuagcuaagagccaccugcaucccgcaggcguugcgccccucacccgucuccccuaggccgaguucgcugggcugcgcccagguccagcaucucucccgcccaaaggccugucccaacggggugcgcgcgggagggccagcagggucggccggcgcagaggcccggagcagcuccgaggcagagcggggggcagggccggcaagggcagucguggcugagcgugcccgcgcaacgucucaccgcgguccgcucggucucuuuugcccauggcagcuacagcagcagagagaagaugaccccgcucccacaggcccgccgcggcauccgcucuggggggacuuccggcucaauccggaagcuccc

SEQ ID NO: 192978 - RNA, 147438 nt, Homo sapiens
gucagcuugggggugccuucgucgcgcagccuugcgucggcccggcccggccaggccagcgggcagaugccccgagcugccgccgccgccgccgccgacucggccgguggcggugugggaggugggcgaccagcccggggccgcugagugugacggacgcaacugggggcgccgggggcuccgcacggaccauguauuuucugagcggcuggcccaagaggcugcugugcccucuggggagcccggccgaggcgccuuuccacguucaguccgacccgcagagggcuuucuucgccgugcuggccgcggcccgccucagcaucugguacagccgaguaaguagagccgcccgccgccuuucgccgcugccuccccggccucccggcgccgucccacccccaacuuccacccagagccuaggacuccugccccuucgugccagacccaccugccuucgcaguccgcguccucguuccaccgaauuggccgcagguacccgccggcugcaggcacguccuccagccggcgguccgggguggaugaagucgcugcugccgaaaaucccugagccuccccgcguuggaccgacggccgcggcgugcagacuccgcacgcuccccggccgagcccagacuuguucuucucucccuucccccauuccccgagggacaaauuuguuuaaacuuuccacaauuagaaauccggccgcuguggugccccaacccucccuuacuuuaaaggucgccguuuuggaguuagggaaagccucuugggcuuuacccagcgccagacuuuacaggccuguaauaacuuauuucuacaaacuacagccugaauucuuuauucuucacuaaaggucugguuauuuaacuccccucuuuaaccccaacaucccuuccccacuuucgaguuggucuuuuucuuugcugcugcucuuggacucuucggaauaggggguuaaaggagcggaaguagaacucaaaucuguccgcggaacucccaguuauaacaccuggaaauaauaaggcuugggaggagcauggaacugaauucuguuuuugcuuuaaguccugguuaucuuuuucuuucuuguauugaauuacugaguagauaugagaaagaaauaagugguggaugggauacucccuacucucugcaaacacugcuauaacuuugucuaugagaacgacagaguucagaguauaaaaaugcuuuuuuuccuccccaaagaaggcaguaccaaucgaugucagagugaaguuuuucuccuuuccaaguuaauuugaccauguggggauagguugugaucuuguccuuauuagguguucgugaaauacugguuuuaguuuguuaaaauccccaaaucuuuguguguugcuguuccauuaccuguaaugcccuugacaguccucacccacuucccugguaauacuggugaugggauuuagugacggguaauucuggugucuccuuugacugucauaguugggcuguaaaucagacuauuugccaucaaguuuuggcugaucuaauuuucaaaugcaaaucagaacaaaacaaacuuauaaaaucguaauaccaacaauaugacuauuuugucuagugccugauuguauuuugaauauauauguauguauguguguguguauauauauaaacauauguguaaauauauauaaaguaucaucugguuccuaaaugagauauucguuuacaauguauaugccaguugaauaauuuuuaauuuguuuagguguauauaacucaacuuuaaagcacaugcagaaaaaaauagaacuugaauuuaaauugucuuuugaauuuaauacauaauuccuuuugaauguaacaaauuuagacuuucgucuaaaauuuaacuuuucuuaccuuuaaaaaggcagaccuaacuuaauuuuaaauaaaaguaaacaauaugaccuaugaauugaccagaagccuguaaaccacuuuauucccccauaagagaagcauaaacauaugcuuuaauuuagggacauugugaauauucuuaagcaugucuauuguuugguuuuggaguuacauacgacaucuagaaauccaaggcaguucuggaauuuaaacuauucauacucuucuuucaaauucccaccucacaugcaacuuccuuuuuccacagaaguccagggaccccuacuauuaaguucuguugugcaaaaguuaggcuguagggaacccauggguuuagaggucuggagugaaaugaaaugcaggaauaccuuagaggaggcuguauaguacuguaguaugagugguuaaccuuggucucugggcaccagcuuuguugucacugaaaaaaaucagauauucacgaggucaagagaucgagaccauccuggccaacauggugaaaucccgucucuacuaaaaauacaaaaaaauagcugggcgugguggugcacgccuauagccccagcuacucgggaggcugaggcaggagaaucgcuugaacccaagaggcagagguugcagugagccaagaucccaccacugcacuccagccuggcgacagagcaagacucugucucaaaaaaaaaaaaaaaaaaaaaucaaauauugaaccaagugauuauaagguguaugauuacaugccuaggugagugggauacauaugcuagacuccagcuuccaaucuucucuuccugggauaugcccuuucuuacucuguaugaaaguuuucauuuugauuuucuaauuuguaaacuuccugaaaguauguaaguuaauuagguuaacaaacuucauuuaaaagugaaaaugccuuuagguaaauuaaagggcuaucaguuauacuuccauaauuuagagugaauugguuuaaaaaguucucauggagcugcuaaaagcuuugauuuuugagaggcuguagauacaaguaguuuuauaauaauaugugaagaucuacaggauuuuacagaguugaagucuuacagcugcuugagggcauuugaaggcagggagacaugcucguagagaugauaaaacaagauuugcuuaccugaaauuuuguuagggcucacuuaguaaaucaggcucucuuaggagugauauauuuuaaaaagagacaacuagccuuguggaagggacagucguuuaguagucuaagcugguuguuucaauguucaaaagaauuguggaaauuguauguguacagugauaauucauaagacugaaucucuauuaaaaucucuaacuguacauuauaugggucuucuaaugaacuuuuauguacuacuuauaccuacuguccucuauucuaaguagguauucggaauuccacuguuuagacucauaucucuucagaauuauuuccuaccccaaauuugagaaauacaguauaguguuguuuaugaacaaaagagccucuagauaguuacuuagcuuuuuuauauuggagccccaauauuauauuuuggagccccccaaaugguguuaaaaaaaggcucaguauguguaggcuagauuggggugguagagguagaacuugacugggggcaguugguacauuucugcuaagguuauuguaaaaggacuaguuucagcuuugaggaugaaacuguugcauaagguagguuaugauuuaugauugacguagguguagugugagaugaauuacauuuuguacuguacugagggcccagaauuauuccuuuaauauacuaacugugacuaugaaagucuauauaugugaacaucagaaugguaucuuugaauuuagccauucuaaauuagauguauagacauucucguuuuucaggucaccgacuuuaaacauuuaaauuagcuucagaaguauuuuugaacaucaacuguaaaagacagauguguauaaaagggaugaagagacauguuauauguuaguguguuagauguuaguguguuaauauaaaucuugugagauaucacuguuguagguagcuaauaaaaagcugaaaugggcaaauaauuacuaggcuuauaaaauaaauuauaugucguuuaguaauccugagcaaaaacuuaguucccauugguaugugcuaaucauggaaaaaaacaaugauaugucaaaagaaccaagcuuuggaucagguaugugauuaacuguguugaccucaggaagaccauuuuauuuguauuuucccagcauucccauuucucacccuuuuaacucuauuacuuucuccagagagccuucuuuauaaauucacugcucugaagucuucuaggguucacuguugaugaaagaauggaguucaaacuccuuaguuugauaucacagacacucccuucuuggaaugcucucuugccucauuucugccugucagaguauuaucuauccuuuaacugcuguugaaauccuuucuuuaugagucauucuuuaccuaccguaaccauaaguguucauuuuucugaugaacuacugcuuccccacuacugccagcuuuguugagguauaauugacaaauaaaaauuguauauauuuaaggugugcugugcgauacuuagaucuacccugugaguugauaaucacaaucagucuaauuaacagauccaccaucucacacagcucccucuuuuuuuguaugugggaugagaacacuuaagaccuacucucuuagcaaauuucaaguauacaauauauguuaauuauggaaauaaaugucauuauuaacgauaguuacugggccaugcauuagguccccagaacguauucaucuuauaccugaaaauuuguaccuuugacugaaauacucccauuucacccaccucccagccccugguaaucaucguucuauucucuguuccuaugaauuugacgucuuuauauuccauauaugagaucaugaaguuguuuuuugucuugcuuacuuaguauacuguccuuaaguuuuguccauguuguugcagauggcaggauuuccuuguuuuuuaaaggcugaauaauauuuuauguguguauguguguguguuacauuuucuuuauccauucaucuauugacagacacuuagguuguuucuguaucuuggcuacuuugaauaaugcugcaaugaauaugaaagugcagauaucucuuugagauacugauuucaauuccuuuggauauauaccuagaaguaggauuguuggaucaugugguaguccuguuuuuaguuugaggaacuucuguuuuccaucaugacuguaccauuuugcagucccgucaauaguguacagggaggggaucccuuuucuccacgucuuugccgaccuuguuaugauuuaacuucuugauaauagauauccuaacaggugugagguaucuuaugguuuugauuugcaucucccugaugauuaguguauugagcaccuauuggccauuggcuguuuuuugguaaaacaucuguucagaucucuuguccauuuuuaaauuagguuaucuguuuuguuuuuuucucgguacugaguuguaugaguuccuuacauaucuugaauauuagcccccuuuuagauguaugguuugcagauauuuucuccuauuccauagguugcuuuuuuaucuuguugauuguuuucuuuacuguacaauaacuuaauuucauguaauccuacuuguuuauuuuugcuuuugucaccugugcuuuccaugucauccaaaauaccaucgugaaaacagaugucaggguguuuuuccccuguuuucuucuaggauuugcaugguuucagguuuuacauuuaagucuuugauccuucuucuuauuuuaauuuuuguggguacauaguagaucuguguauuugugggguauaugggauauuuugauacaggacuauagucacccuguuguacuaucaaauacuagauuuuauucaucaucaucaccauuauuauuuugagacagggucucacucugucacucuggaguacagagucaugaucauggcuuacugcagccucgaccucuugggcucaagcaauucucccaccuuagcauccugaguagcugggaguacagaugcaugccaccaugccuaguuaauuuuuugaagagauguggucuugcuguguugcccaggccggucucagacuccuggacacaagugaucugcccaucucagccuccuaaagugcuaggauuacaagcaugggccaccacacccaguccuuauucauuuuuucuauuuuuuguacccauuaaccauccuuccuucccccuccgucuuuaauccuucuugaguugauaguguaagauaaggguccaguuuccuuccuuagcauguggauauccaguuuuucuaacacuaugguguugaaaagucaguguugcaagauguguuuucuccauucuuagcacuuugugaaagauugacuauauaugcaugcgugguuuuauuucuggacuccauucuguugcauuggucuauguaucucuuuuuaugucaguaccauacuauuuugauuacuauagcuuuguaauauacuuugaaaucagguugauaugguuuggcucuauuuccccacccaaauuucaucucuaaucguaauccucauaauccccauguauggagggcaggaccugguagggggucauuagaucauagcgggaguuuuccucaugcuguucuugugauaguaaguucucacgagaucugaugguuuuauaaguguuugacuguuccuucuacacgcucugucucucucuugccugccagcauguaacaagugccugcuuccccuucugccaugauuguaaguuuccugaggccucaccagccauuauggaacugaaucuauucaaccuuucuuuauaaauuaccaaaucucagggaaguuuguuauagcagugugaaaauggacuaacacacagguaaugugacacuuccagcuuuguuguucuuucucaagauggccuuggcuauucaugggcuauugugguuuuguauaaauuuuaggauuguuuuucuguuuaugugaaaauaucauugaaauucugauagagauugcauugaauccauagauugguuuggauaguagggacauuuuaacaauauuaauucuuccaauccaugaacauaagauauccagccauuuauuuguaccuucuucaguuuauuucaucagcauuuuaugguguuuaguggcgguuaaauguauucuaaguauuuaguuuuuuggagcuaccauaaaugguauuguuuucuuuuucuuuuucuguuuuuuuuagacaaagucucgcucuugucaccgaggcuggagugcaauggagcgaucucaacucacugcagccucugccuccuggguucaagcaauucuccugccccagccuccugaguagcugggauuacaggugccugccaccauacccggcuaauuuuuguauuuuuaguagagacaggguuucaccauguuggccaggcugguaucgauuccugaccucaguugaucugccugccucagccucccaaagugcugggauuauaggugugagccaccacucccagccauguuuucuuaauuuauuuuuuagauacucauuguucuuguguagaaacacaacuuauucuuguauauugauuuuauaucuugcaacuuuacuaaauucauuucuuaguucuaaauuuuuuggugguuuuuagguuuuucuaaauauaagauuaugucaucuucagagacaauuuugcuuuuuccuuugaacuacugcuuuauaucguaaguuuugcacuuaugcuuuauuucuccagcuagauuauaaguuucuggagcacagaaacuaucuuaauuuguauuaucuauagugccuuguacaaggaagauguuuaauaaacauuuuuaauauuaaugaauuuaagguauuugucauacguguggcacagcaauuuuuuuuuaaguuuuaguguuuugauuuuugugagaacacaguagguauauauuuaugauuuuuuuguuuguuuguuuguuuuugagacaggguuucacuucaguugcccagguuggagugcaguggcacaaucucagcucacugcaaucucugccuacugggcucaagcagcuguccugcuucagccucccaaguagcugggacuacaggugugccccacugcacuuggcuaauuuuuuuuuuucuguaauuuuuuauagagaugggauuucaccauguugcccacgcuggucuugaacuccugagcucaagugauccauccaccucgggcucccaaagugcugggauuacaggcaugagccacuauacccagccaugagauauuuugauacuagcgugcaauuuguaacaaucaguucaugaaaaauaggguauucauccccucaagcauuuaaccuucauguuccaaacaauccauauguacucauaguuauuuuaaaauauacaauuaaauuauuuugacuguagucacccuguugugcuaucaaauacuaggucauacucauucucuuuuuuuguacccauuagccguucccaccucccuuccuauccccccaguuaccuuucucagccucugguaaucaucuuuccacucuuuaucaccauuaguucaauuguuuugauuuguagaucccacaaauaagugagaacaugcgauguuugucucucuaugccuugcuuauugcacuuaacauaaugaccucuaguuccauccauguuguuguaaaugaccggaucucauuuuuuuuguaacugaauaguacuccauuaugugcaaguaccauguuuucuuuauccauccaucuguugauggacacuuccaguacuguguugaauaacaauagugaaggugggcaucuuugucguguuccagaucuuagaggaaaggcuuucgguuuuuacauacucaguaugauacuagcuaugggucuguuauauauggcuuuuauuauguugagguauguuccuucuauacccaguuuuuuuaggguuuuuaugaagggauguugaauuuuuaugaaaugcuuuuucagcaucaguugaaaugaucauauaguuuugguccuucauucuguugauaugauguaucacauugauugauuugcauauguugaaccauccuugcaucccuggaauaaauaccacuuguucaugaugaaugaucuuuuuaauauauuguugaaucucauuagcuuguauuuuguugaggguuuucacaucaguguucaucagaaauauugaccuguaguuuucuuuauugaugugucuuugucuggguuugguaugaggguaauccuggccucauagaaugaguuuagaaguacucccuccuccuguauuuuucagaacaguuucaguaguauugguguucuucuuuaaauguuuguuggaauugagcagugaaaccacuaggucuugggcuuuucuuuacugggagacuuuuuauuacagguucaaucucacuguuguuagucuguucagguuuugaauuucuucaugauucaaucuugguagguuguaugugcuagggauuuauccauuuccucuagauuuuccaguuuauuggcauauaguugcucauaguaguuugugaugaucguuugaauuuuugcgguaucaauuguaauaucuccuuucuuaucucugauuuuauuuauuuugguuuucucuuuuaagguuugucaauuuuguuuaucuuuucuaaaaagcaacuuuauguuucuuuggucuuuugcauuauuuucuucauuucaaguuaauuuauuucugcuccaucuuuauuauuucuguuacuaauuuuggguuguuugcucuugcuuuucuuguuguuuaagaggcaucauuagguuauuuauuugaaguuuuucuucuuguuuucugagacagggucucucuuuauucuccaggcuagagugcaguggugcaaucucgucucacuguagccucaaccucccaaguucaugugauccucccaccucagcccccuaaauaguugggacuacaguugcaugccaccgugcccagcuaauuuuuguagagacaggauuucaccauguuucccaggcuguucucaaauuccugagcucaagcaaucugcccaccucggcucccaaagugcuaggauucaggcaugagccacuauacccggccauuuuucuucuuuuaugguguaauacuuauagcuauaaauuucucuguuaauacugcuuuugcugucucccauaacuuuugauauguuguguuuccauuaucauuuguuucaauaaaguuuucaguuugcuucuuaauuucugcacugacccauuggucauucaggaacauauuguuuaauuuccaaguguuuauaugauuuccagaauuguucuuauugauuucuaguuuaacucuauuaugagagaagaugcuugauauuauuucaguuuuuuugaauauuuuaagauuugugaccuaucauaugagcaauccuuaagugauccauguacugagggaaagaauguguguucugcacccuuuggaugaaauguucuauaaauaucuguuagguccauuuguuguauagugcagauuaaguccgauguuucuuuguugaguuucugucugggaguuggguucagugcugaaagugagguguugaagucuccagcuaucauauugaggucuagcucucucuuuagcccuaauaauguuugcuuuguauaucuggguguguugggugcauauguacauaugauuguuauauucuauugcuggauugacucuuuucucaguauauaaugacauucuuugucucacaauuuuugucuugaaaucuauuuugucaguauuuauauaauuacuccugcucuuuugguuuccauuggcauguaauaucuuuuucauccccuuauuuucagucuaugcauaccuuuguaugugaaguguguuucuugugggcaacagaucaguggaucuuguuuuuucauccauucacccacucucugucuuuugauuggagaguuugguccauuuguauucaaugcuauuauugauaaguagggacuucugccauuuugauauauauuuucugguuguuuuguggucuucguucuuucuuuacuugcuguguuccuuuuagugaaggugguuuucucuggugcuaugauuuaauuucuugcuuuuuauguuuuguguaucuguuguguuuuuugauuugaguuuacugugagacuugcaaguacugucuuauaacccauuauuuuaaacucacgacaacuuaacacugauuguauaagcagucaaacacacacaaaguguuuaaaguguaauuaaaaguguaauuaaaacucuacacuuuaacuucaucccucuacacuuuaacuucaucccucugcuuuuuaacuuuuuuguuuguuguuucuccuuaugucuuacuguacuaugucuugaaaaguugucguuauucuuuauugguucguuucaucagucuuucuacuuaagaguaguuuacacacuacaauaacacuuauaaaauaagaaucauuguuagguuauuuauuugaaguuacagaauaagaguguaauugugcuguguaaacuacucaaguagaaggaguuauacucuucuguguuuuucugugugcuuacuauuaccagcgaguuguaccuucugaugguuucuucuuggucauuaaauacucuuuucuuucagauugaacaacucccuuuagcauuucuugagggcagauccaguguugaugaacucucucagcauuuuuugucugugaaggucuuuguuucuccuucaugcuugaaggauauuuucacuggauauacuguucuaagguaaaugcuuuuguuuguuuuuuuugucagcacuuucaacauauugugccacucucuccuggccuguaagauuuuuacugaagagucugcugucagagauauuggagcucuauuguauguuauuuguuucuuuucucuugccguuuuuaggaucuuucuuuauccuugauaaagaaacuauccuuugagaguuuguuuauagaugccauaagguagucuucuuuuuuuuuuuuuuggacggggucuugcucugucacccaggcuggagugcaguggugccaucucagcucacugcaagcucugccuccuggguucacgccauucuccagccucagccuccugaguaccugggacuacaggcgcccaccaccacacccggcuaauuuuuuguauuuuuaguagagaugggguuucacuguguuagccaggauggucucgaucuccugaccucaugaucugcccgccucggccucccaaagugcugggauuacaggcaugagccaccgcgcccggccgccaugagguacucuucuuuagguuaaaucugcuuggcguucuguaaccuucucauacuugaaugcagauaucuuucucuagguuugggaaguucucucuuaucccuuugaaugaacuuucuacuccggucucuuucucuacuuccucuuuaaggccaauaccucuuauauuugcccuuuucaugcuauuuuuuaggcaugcuucacuguuuucuauucuuuuuucuuuuguggucuccucugacuauauugucaaguagccugucuccaagcccacuaauucuuucuucugcuugaucaauucugcuuuucagagacucugaugcauucuucaguuuguugguugcauuuuucaacuuuagaauugcugcuugauuuuuaaaaauuuaaauuucuuuguuuaaaaugugauagaauucugagguccuucucuguguuaucuucaauuucuuugacuuuccucaacauagcuauuuugaauuccugccugaaaggucacauaucuaucucuguuuuuccaggauuggucccugccuuacuuaguucauuugguggggucauguuuuccuggaugaucuugauuugaugcuuguagauguucauugguguguaggcaucaaagagguagguauuuauuguagucuuugcagucugggcuuguuuguaucuguccuuuuugagaagucuuuccaguuauucgaagggacuugggccccaagcccaauaaugcugagguuuuugcagacucagagguacugccuugguggucuuggauaaaaucuggaagaauuauuuggauuaccacguagagacucuuguucuuuucuguuacuuucuuccaaacaaauggagucucucucugugcugagucuccuggaacuagggauguguucaugcguugaugcaagcaccccuguugccaccaccacugaaacuaagcuggguuagaccugaagccagcagagcacugggucucauccaaggccugcugucaccaccaccuggcuaccaccuauguucacucaaggcccuaaggcucuaccaucagcagguggugaagccagccagguuuauguccuucccuucagagugucucauuccccaaaccccaggccaguccagaaaugcugucuggaagccagggauuagagucaaaauucuuagcaauuuguuugauauucuguucuguuguggcuaagcaggcacucaaaccguaacacaaaauucuucccacuuuuuccccuguccacaggcagaggagaaucugccucuguggccaccacuaccacagggccauaguggguucugccuggccacugccgggcagucaucuucagguguuuaugaaucauuaacauaauccauauuauaguuaaauauuuauuuggaguuuacuguggacuagguauuuuacaucauaguaagcaaaguuucccaaauuuaaguucuuuuuauuucucauucaugacuuuuggccuguucucauacuaccuauucauuguaacuuuuaaacuugaaagucucuuucaaaauaaaugaauuuauacuuuuaccauaaauggaaaucuaguaccauuuuuaugaauagaagauauuaugaaggaauacaauaaaaacaauuuuauaagucugggcaugguggcucacaccuguaaccucagcacuuuugggggccuaggugggaggaucacuugagcccaggaguucaagaccagucuggacaguauagggagacccccaucucuauaaaaaauaaaaauaaaaaaaucagcuggccaugguggugcaugccuguggucucagcuaaucugguggcugaggugggaggauuguuugagccugggaugucuugauucauaaacacaugaagaugacuaaaaucuccuuuuaaauuuguuuauacugcuuuuucuucuauggcuuucuuuuuuucauagaucaugucaauauaaacacauacugagaaccaggaguuugagugauucuauaugaaugacuguauacuauuuaaauuuugaugaacuacagaguaguuugagccuaggagguugaggcugcagugagccaugauugcacuauggcaacccagccaggaugacagggugaaacccuuucucaaaaaaaaaguuaugaaaaauaugguuuccugccaaacucauaauuacuccuuuauuaaaaagggcaauuagcccuuuuuaugcaaggugcuuaaaaauaaacuagcaccucauuuagauacucuccuuacguaaauaaaaaagauugaagaggaguugaaaaaagauuuuuuuccuaugugauuguuuacuucaguauuuguaugucaucuaaaauggugauauaggaccugcauuaaaguguuccaccuguauuaguuuguuaggcaauuuauuuaaucagaaaaaauaaaauaaauuuacaauuuaaaaauauuuuggaauuuacaccugccacaaaaugagacaguuucuucguucagauuucuuacucaugagcaggcaucaauugguuggaaucagagagguuucuuaccuuuaaguuacaauugcuuuccuuugaguugcugucacaaaucuacugucccccaaguaguuuaccuuauuucaaccauaaaucauacaaaaauuuaccuaugaaaauuuggauauuauuguagauaauacuguagaauuugcuaugguuuaaauuuuuaagagcuuugaggugcauaaaaauacaucuaaguguacauugauuuuuaguaaauuuauaguguugugcauccauaaucacagucuaguuuuagaacauuuauaucagccuuaaaaaguacuaugcccauuugucaucaaccucuucucccauuccagccuuagaaaaccuuggccuacuuuuuguccauuugauuuagcuuuccuagaauuuucauaucauuggaaucauaugguauauggucauuuguguuugguuuuuauuuagcauaauguuuuugaggugcauccaggucauaauauuucuuuuuucaaaauguguguaaacuaagggauacaagugcaguuuuuuuacagggacauauugcacagugguaaagucugggcuuuuaguguaaucaucagcuaaagaaugugcauuguacacauaaguaacuucuuauccuuuauccccuucucauccuucugagucugguaucuguuauuccacacucuauguccaugugguaguauuccuuuuuguugcugaauauuuuuccauuauuugcauaugccgcauuucuaucuccauucaccaguugacagguauuugagucauugugaauaauacucucauuuugaaugauugugaguaauacugcuguaaacauuuguauacaugucuguguguggauaaauguuacucuucuagagagauaccuaggagugcaacuacuaagucauauggcaaguuuaacuuauugguaaagugcaaaacuuuguuccaaagugacuguagcauuuuacaaccccaccaauaauguauggaaguuucuguuucuccacacccguucuagaggguuuguaguggugucuuauuuguggcuuuaauuugguguuuuucuaaugacuaaaaaauguuuggcaugauuucauuugcuuauuagcuauuuauauaucuuauuccauuuauauaucuuauuagccauuucgcuauaccuauguaguuaauuaucuauucaaauccuuuguccauuuaaaaaaaaaacagugaucugaucuugggucacugcagccuugaacucuugggcucaagugauccuuccaccccagccucccuaguagcugggacuacagaugcccaacagcaugccucacuuauuuaaaaauuuuguagagacagggucuccauaaguugcccaggcuggucuuaaacucccaucgucaggcuauccuccgaaaguguuggaauuacaaguauuagccaugaugcccagaccauuuuuguuuaaguggaauauuucucuuauuauucaguuguaagaguucuuuauaugucuugauacaaauuauuuagcagauauauacuucgcaaaguucugcagcauuaaguacauucacauuaucauguaaccauuaccaccaucaguauccagaacuuucauuuucauuuucccaaacugaagcuucguacccuguaaaugguaauuccugguuuucucaucccaucagucccuggaaacuacuauuguauuuucugucuuuaugaauuugauuuguguggguaccucagacaaguggaaccacacacuauuugucuuuuugugauugacuuauugcacucagcaugucuuaaguuuuauccaugcuguagcauguaccaaaauuuccuuccuucuuaaggcugaaugauacuccauuguauauguacauacugcauuuuguuuuauucauucaucuguugauggacacaugggcugcuuuuaccucuuggauauugugaauaaugcugcugugaacauggguagacaaauauccagaucccugcuuuacuucuuuuggguacauacccagaaguggaccugcuguuucauuugguuauucuauagguuuuuuuuuuuuuugagaaauuuugcuuuuuuuuuuaauguuaagaaauugccacauacuguguuuccacaguguacaucauuuuacauucuuaccagcaauacagugguuccaguuucuucacauccuugcuaguacuuguuuucuguuguuuugaugauugccauuccauuggguccaaugugguaugucaugguuuugguuugcauuuuccuaaugguuauuaaugucgagcaucuuuuauguacuuguaagucauguguaugccuucuuugaaaguguccguugaaguucuuugcccauuguuuuucuuggguuauuuuuuguugaguuguaacgcuucauguauucuggguauaauccuuuaucagauaugugguuucuaauacaguuaugcuccauguaauggcaguuugagauguuccugucaacagacugcauuauaugaugguggcccuauaaaauucuaauggagcugaaaaauucuucuugccuagugacaauagaaauuuuauauaguguaaugcauuacuuuuucuauguuuagaaguauuuagauauagaaauauuuaccauuauggcacaauugcuuauguauucaguauaguaauaugcuauauaggcuuguauccuaggagcaauaggguauaccuuauagccaagguguguaguaggccauaacgucuagguuuguguuaaguacccacugugauguucacaugaugacaaaauugccuagugaugcauuucuuggaacuuauccccucuuguuaaagugacacgugacuguauuuucuucuguuucaaggguuacauuuuuacucucuuuguaguagccauugaugcacagcauuuucaauuuugaugaagucugucuuaccuauuuuuuuuuguugccugugcuuucaguaucauauccaagaaauuguuuucaaauccaaagucaugaaguuuuuggcuuguguuuucuucuaagaguuuuauagggugaggucuucuguuuagaguuuugaucacuuugagacaauuuuuguauauaguauaagauaaggguccagcuuuauuuuuuuacauguggauauccaguuuucccagcacuguuuguugaaaagacuuucuuuccuuuuccccuuugaauggucuagguagccuuguggaaaauaauuugacuauuuaugcaagaguguauuucuggacucuguguuuuauucuguuggucuauauguguauccuugugccaguacgacaguauuuugauugcuguagucuucuaguaaguuuugaugucaggaaaugugagacguccaacuuuguuauuuucaaguuuguuuugucuauucgaggucucuugggaauccauaugaauuuuaggauggauuuuucuguuucugcuaaaaaugcuguuaggauuuugaaaggacuuacauugacuauguagauugcuuuggguaguauugacaucuuaacaauauuaaauuuucuaauccaugaacagaggauaucuuuucauuuauuugugucuaauuucuuucagugauauuuugcaguuuucacuguagaagucuuuugccugcuugguuagguuuaguccuaaguacuuuauucuuuuugauguuacgguuugcugauuuuucuguguugauuuuguauucugcaguuuuccugaauucauucauucuaacagguuuguuguuguuguggaaucuuuagagucuuuacauauaagaucaugucaucuucaaacauauaauuuuacuuauucauuuccaaguuagauuuauuuuauuucauuuccuugcugauugcucuggcuagggcuuuagguauuacguugaauggaagugguaagaaugggcaucuuugucuuaauucugaccuuugaggaaaagcuuuccaucuuuucaccauugaguuugaugcugguuacaaguuguuguuuuguuuuuuguuuuuguuuguuuguuuuuuguuuguguguguggggguggguggugguggugguggugguggugguggugguggugauggugguggugguggugguagugguagugguuuuuucuugcucuguugcccaggccggagugcaauggugugaucucggcuuacugcaaccgccaccucccgaguucaagcaauucuucugccucagccucccaaguagcugggauuacaggcgcccgccaccauacccgacuaauuucuuguauuuuuaguagagacaggguuuugccauguuguucagacuggucucgagcuccugaccucaggugauccaccugucucggccuccugaagugcugagauuacagcugugagccaucaugccuagccagguauagguuuuuuauauauggccuuuuuauuaucuugagauaguuugcuucuauucauaguuuuuugaguauuuuuagcaugaaaggauauugaguuuuaucagauguuuuuucugacucaauugaaaugauuaucuguugguggacacuuagguugauuccauaucuuugcuaauguuaacaguguggcuaugaacuugggggugcaaauaucccuuugauguauuuauuuuguuucuuuuggauaaauaccuaacagugggauugcuggaucauaugguaguucuauuuuuacuuuucgagaaaucuucauacuguuuuugguaauggcuguacuaauuuauauuuccaccacaggaguucccuuuucucugcauucucaucaacaucuguuauguuuucuuuuuaauaauugcuauucuaacuggguuaagaugauaucuugugguuuugauuuucauuuuccugaugauuagugauguugagccucuuuugauguaccuguuggccauccauaugucuuuugaaaaaauguuuaugucuuuugcccacuuuuuaaugggaauguuuuguuuuaacuguugaguuguuugaguuccuuguauauucugguuuuuaguuucuugucagaugcauaguuugcaacuauugucuaccauucaaaaggaagguuauuucuuuacucuguuggauuguuuccuuugcuaugcacaaaacaagucucaaaacauuuuaaaacucugggaggcugaagugggagaaucauuugagccagggagguaaaggcugcaaugagcuaugauugugccacuucacuccagccuggcaacagagauagacccuaucuuaaaaaagaaaaaaaaaauuaaacucaaaacuauaucaagugucuucuuagaccacaguagaauccucaaacuagaaauuaauaccaagaggaacuuagaaaacugucuaaauaaaugguaauuacauagaauacuccugaauguccauugguucuuuuucugcuccuuugaucuugucuuugccuucuguaacaccaaaaauucaaauagaucacuuuauggugucccauaugucauguaggcuuuguucauucuuauuuauucuuguuuuguuuucugaguuauuucaaaaaucugaaauucauucuucugcuugauaucauccauugcugaagcacuugaauguauuuuuuauuccacuuagugaauucuucgguuugaggauuucuguuugguuccuuuuuuaugauaucuaucuuuuuggugaauuuuucauucauaucuugaauuguuuuucugauuucuuuguauuuuuguguucucuaucucacugagugucuuuaguauuauuuugaauccuguugcuggcauuucauaaauuucuuuuuuauuagaaucuguugcuggggaauuauuguguuccuuuggagaugucauaauuucuuguuuuuuuuuuuucacauuacuuguauacuuacaaguugaugucuguaccucugguguaacaguugcuucuuccaguuuuuuagauuggcuuucagagagguagacuuuuuccugaagaucuauccgugguguugguuggguagggcaccuugucuuugauucugggugugugcaguaguguauuuuucauaugaccuuuuuagccauauauagcauuaguggugucugugauuuccucagugguuuagggugcaauuguuagcagaggcugaggugaaguucuccugggcagugggaugcuagguaggccaguccuugggcaccagugguggcagcagcagacugugugccuguccuucggccccaggguacacaggcaugguguuagcagguuuaauuggguugauucuuaggccuccauauggcuugcuuaggugcuggugguugcaguggaugaccaggugaguggguagguccuuggaucccugggcagugcaugugguaugggcuauggcaguaguugugaugguagcaucaggcugggugggcugacucucaggcuucccuguaggagugcguaugugugaguggcagacagggugaggcaaucucuaugcuccaaucucuaugcuugggcccuuggggguauguggugccaggccaggugggccugucuucaggcccccugguagagugcucagguagcaacaguggauagagagagccuugccucagggcaugugcauguccacuguggcccugcuacuagaggggauaggguuggugucggugucaguagccucacaccagaggcugggguggggcagguaugguaugcuuugcuccaagcagugucaggaacauugacacuggcaugcugggagauucuguccucaggacauguucaagugugcugcagucuugcuguuaguggagaugggguuacugucaguggcagcaaccccaggcuagcaggguuuaggcucucagaaguguacgcuuuggcucuuuuuguccuugugauagccuccccaguauacccuccccagugcauugcacuugccuguucuccacaguguaggauuuuauauaugcuuuaauaccagggacucugccacucugcuggguccaaguggcauugcaucacuguaggcccccagguggaugcagggaauguuaguagggcuuuacuaauguggaaaugcagggacucuugugcucaagggcaggaugcagccuguuaagagcuggacugaaaaugacaccaugcuguaacuguuuaggucucaugcaggugguacaggacccagugugagcucucucucuggagcagugucaucacauggucucuaagaaguucucuaugcuagucucuggacccccucucuguaagcuaggguugcaggaguccguggugggagugugagcugcuggguaucucucauuuaccuuucccccacacuggagaucugcucugugcuccaggucgauaaaggccaagcaaacaaccuugcuucccucuucuuccuugcuuuagguguuuccugucacuucucugcuaaauuccaguguugugucuuagauguucuguugaaagugugacuccucccuguuuggguuuuuuuuuugugaaggaggcaagggcugaugucucuagucagcuaucuugaagccccuccucuauuuuugcuguuguugccugugcuuuucaggucuuauccaaaaaauuccuugcucagaccaauauaaugaaucauuuccuuuauguuuuucuuccaguaguuucauaguuuugggucuuacauuuaagucuuuaaucuuuuuuuuuuuuuuuuuuuuuuauugagacagucucacccuguccuucauucuugagugcaguggugugaucucagcucacuucaaccuccaccuccuggguucaagugauucuccugccucagccucccgaguagcugagauuacaggugcaugccaccaugcccagcuaauuuuuguauuuuuuuuuauuagagaugggguuuugccauguuggccagguuggucucgaacuccugaucucaagugaucugcccaccucggccucccaaagugcugggauuacaggcaugagccaccgcaccuagccucuuuaaucuauuuugaaaugaguuuuguguauaguaagauaagggucuaauuucauucuuuugcauguggcuauccagguuucccagcaccauuuauuagauuauccuuucuccaaugugugcucuuggcaccuguuuuuugaaaaucaguuggcuguaaaagcauggauuuauuucugggcuauuuuguuccauuguuuuauuugcuuuuauugccaguaccaugguguuuugguuaauacagcuuuguaguauauuuugaagucagguaguguaauuccacuaacuuuguuauuuuuguucaagauugcuuuggcuauuugagguccucugugguucaguaugaauuuuaggcuuguguuuuccacugcugugaggcauaucauugguauuuugguagggauuacauuggaucuguagaucacuuugggucauauggacaauuuaacaguauuaauuuuuccaaucuauaaacaugggauaucuuuccauguauuuguguuuucuucauuuuauuacuguuucauaguuuucauuguagugaucuuuuacuucuucaauuaaauuuuuuguucuuuggguuuuuuuauagcuauuaauaagugggauuguuuuguugauuucuuuuuucagcuaauucacuauuaguguauagaggcauuacugguuuuuguauauugauuuuguauucuacaacuuuacugaauuauuuuguucuaccacuuuuuugguggcaucuuuaggguuucuauauguaagauuguguuaccugcaaauaguguuaauuugacuucuccuuuccaauuaauuuggauacuuuuuauucuuuuuuuuuucuugccuaauugcucuggcuaggauuuccaguacugcguugaauaaaaguggugaaagauaguauccuugucuuauuccagauuagaggaaaagauuucaacuuuuccuuauucaguaguguuagcuauggguuugucauauauggcuuuuauuguguugaguuacauucuuucuauucuuaauuuguuaagaguuguugucaagaauagauguugaguuuugucaaaugcuuuuucugccucuccugaaaugaucaugggguuuuugccuuuuauucuguuaauguaauauaucacauuuauugauuugucugugcugaaccauccuugcauuccugggaucaguccuacuugaucaugaugaauuguugaauuugguuugcuaccauuuuguugaggacuuuugcaucuguguucaucagguauuuauuuuugugaauguugacgucuaguuguuugaauacuauucauugcaaagacugucuuuucucuguuguacuuccuuuccuuguuuguuaaagaucaguuggcauauauuugugugugucuauuucugggcucucuauucuguuccauugauugauuuguuuauuauuuuguuaauaccacacuuucuugacuacuuuagcuuuauaguaagucuugaagucagguaaugccggucuuccaacauugucuucuccaguauuaaguugcuagucuuggucuuuugccucucuguaucaacuuuagagugacuuuguugauagccagaaaauaaauugcugggaauuugauugagauuguauuaaaucuguauaucaaguugggaagaacugacauauugugacaguauugagucuuuguauucauuaacaugguauaugucuccauuuauuuuuuucuuucuuucuuucuuucuuucuuuuuuugagacggaguuucacucugucacccaagcuggagugcaauggcgcagucuuggcucacugcagccuccgucuccuggguucaagugauucuccugccucagccucccgaguagcugugacuacaggugcacaccacuacgcccggcuaauuuuuguauuuuuaguagagaugggguuucacuguguuggccagguuggucucaaacuuuugaccuggugaucugccugccucagccucccaaagugcugggauuacaggcaugcacaaccacacccagccugucuccauuuauuuagcucuucuuugguaucuuucauuaguguuuuguaacuuuuuucuauagauaaacguauuguguuacauaguuuuuuaaaaaugcuuuuuacauuuuuuauguuuuugagacagcaucuuacucuaucacuuaggcuggagugcagugacaugaucucagcucacugcaaccucugccucccaggcucgagcaaucucccacuucagccuccugaguagcugggacuacaggugugugccaccaugcccagcuaauuuuuguauuguuuuguuuguagagacaagguuucaccauguugcccaggcugcaaguguguauuuuuuguuuuuguuuguuugguuucuuuuuuuuggagguagagucucacucuugcuacccaggcuggagugcaaugguguggucuugacucacugcagccucugccucccggguucaagcgauucuccugccacauucucccgaguagcugggauuacaggugacugccaccauguccagcuaauuuuuguaauuuuuuaguagagacgggguuucaccauguuggcgggcuggucucgaacuccugaccucaggugauuugucuaucuuggccucccaaaguguugggauuacaggcgugagccacugugcccagcuuuguuuuuguuuuugagauucaguuucuguugccuaggguggagugcaguagcgcagucucagcucacugcaaccuguaccucccagguuuaagcaguucuucugccucagccuccugaguagcugggauuaauuuuuguauuuuuaguagagauguaaccacaccuggcuaauuuuuguauuuuuaguagagauggguuucaccauguuggccaggcuggucuugaacuccugaccuuaagugaucugccugccuuggccuuucaaaguguagggauuacaggcaugagcuacugcgccuggccugcaaauguguuuauaaugacaaauuccacuuuuuuauugcugguauauagaaaauuuauugacuuuuguauauuaaucuuggauccuguaaccuugcuauaguuacuuauucuaggaggauuuuugggucaauucugucaaauuuucuacauagaugaucacauuaucuaugaguaaagacaguuuuauuuauuccuucccaaucucuuuaccuuuuauuccuuuuuguggucuuauugaauuagcugggacuuccacuauucuguugaaaagcugcugugaguggagacauccuucccuuguuccugaucuuagcaggaaagcguugagcuguagguuucucauagaucuucuuuaucacguugaaaaaauuucuuucuauucccgagagguuuuuuuaaaaucaugaaugaguguuguucuguaguuugcucaguguuuuuuguuuauuuguuuuguuuuauggagacagagucucgcucuuuugcccaggcuggagugcagucucacaaucucagcucacugcaaccuccaccucucagguucaagugauucuccugccucagccucccaaauagcuggcauuauaggcgccugccaccacaccgggcuaauuuuuguauuuuuaguagagaugggguuucaccauauuggccaggcuggucgcaaacuccugaccucaggugaucugccaaccucagccucccaaagugcugggauuacaggcaugagccguggcgcccggccuugcucagcguuuuuaucuugguuguuagauuuguuaagugcuuuuucuguguuuauugaaauaaucaugugauuuuucuguagccuguugaugugauggauuauauuaauugaguuuugaaugccgaaccaggcuuguauuucugggguauaucguauuugguuaugguguuuaauuuuuuuuaauaccuuguuggauuugauuugcuaauauuuuguugagagguuuuauaucuauguucauaagagauguugaucuguaguguuuuuuuguuuuuguuuuugagacagagucucgcuuugucaccuaggcuggagugcaguguuguugugaucucggcucacugcaagcucugccucccagguucacgcuauucuccugccucagccuccugaguagcugggacuacaggcgccugccaccacgcccagcuaauuuuuuuguauuuuuaguagaaacgggguuucacuguguuagccaggauggucuccaucuccuaaccuugugauccgcccaccauggccucccaaagugcugggauuacaggcaugagccaccgcgccuggccuguaguuuucuuuucauguaauauccuuuucugauuuugguauuaagggaaugcuggacucaaaauuaggaaguacuccugcuucuaucuuguggaaggcuuuguaaagaauugguguaauuucucccuuaaacguuugguagacuucaccuaugaacacauuuaguccugguucuuucuguuuuggaugauuauuaauuauuaauucaguuucuuuaauaauacaggcguagguuuaggucuuuguuuugguugauaugcuugcaauguugaaagccgauaguuuaauaucaauauugucuuuuauuuuacuguaaaaauacuuugaauacucuguuaucuuaaauuuuauuuguguauuuuuaugagauauugauaaaaaauacaacuuuuuuuuuuuuuuaaucacacagccuaguguguuaauuguaaccuacaaggagccugcaaaaucaucuacucaguuuggauccuacaagcaagcugaauggaggccagauaguaccaugauagcuguaucaguaaguagauuuuaccgcuaaauaguguuuucuuaugaaaucauuacaucgcauuuaaauuugauucucuuagaugacuuucuuucagucuuuugcacucauaaguauuuauuuuauucugauaggaauugcuuuacugauuauucuauguggauuacuccuacuauagcuuuucuucugacucugcuacuuccuuaacaaagcaccuauaucccuaaacauagcaccuguauccuuuucuguuuguuguucucacuuuacuguuuugcccuugaagucuaacugcuuuacuaauuauucugugcguguuacuccuacuauagcuucuguuuugacucugcugcuuccuuccaucccuaaacauagcaccuauauccuuuucuguuuguuguucucacuuuacuguuuuguccuugaagucuuaucuaguuuuuuaaaacauauucacaugauauucuugaauuuauauuuaaauuccucccuuccauuccaaaagauauuccagaaaauaauaagcuuuaugugcauauguuauacuaaaauuuccauauccauuuggaucuguuucuccuuuuuuucuucuguucuauuaaacgugccuagauauguuuaauuuuaccuuuucaguucauguuucaucacugucuaaggcugucauuaugacuuaauaugcauuagcaguaauauaugugguuaauuaacauuauugagcaccuccuauccgaugaguacaauuguaaucaguuuacauggaucaucccauuuaaucuuuagauaagugcuuugaaguagauauuauuauccuucauaauggauguguaaauugaggaucugaaaaauugucuuauccaagguuacaugcguaguguauauuagagagauaagguauaaacuuagcuacucagcuuccauuuacuauauccuuauaucuaauuuaucucuuugcguuggucccuuucuaguccauacuguauauaacacugacuagguuaauagucugaaauguucauaugaugaaaaauacugaguaguucuacgcuuccuauagcaggaguuugcagaugacugaccauguaccaaauaugcccuggugccuguuuguacacagaccauaauguaagaauaguuuuuacauauuuaaauaaucaaaacaagucaaagaagaauauuugcuacaguugaaaauuaugugauacuuaaauuucaguguccauaacuaaaauuuuacuggggcacgaaaauccucacugauuuauguauugucuguaacuucuuucaagcuacaauagcagauugaauugaaguucuuacagcaaguguauguggugcucucauugcuuugcucuucuguucaaugcacuguguaguaacacaguuguaacuucauaacauuucaaguguacacauauugccauucugugacauuuuauauuauuuuuauucuaguacauacucaugucaaaagaaccaaagaagacaaaaagacuuuguuuuguuuuuaaagcacacuguagugugguuucuuuuauuauugaauuagauggcaaaauauuguauuuauuauucaauggcacuauagcuaugccaaaagaauauaagcugacaucacuagacuaagcacuuaucagaauguacugaagguuaaguuagaagaauuaaaaaauuuagcacagaacagcucaccacaaaauuccuucacaaaaauaaaauaugaaaaugaaagugcaguaaaaguaaguuugcuuaguuuuugauaaauugacagauguuauaauacugcucaguuguaaauuucagugguccaugugaaguaugaauugacuaagaauuacugugaaugaccugcagaacaauuccagaugaaaaaaauucucaaaggaguugagaaaauacuaauucaguacaacccgaaguagaaucuaagaaguuguauuaauugauaguaguaaaaauccacauggagcagcaaaagacuuaguuggacagauuuacaaaguuugugaaaauauaagacuuuuaaaaccuaugguuaguguaaguuuuuucagagauggaagcaggaauaucuugaauugcccuccuccacagcuguuauggcuuggguagugauaaaaguuuauuggaaaguuuuuuuguuuuuuuuuuuaccgagacugacuuuuuuuuuuuucuuuacuugaaggaccaccaucuaccacuuaacagacacuaaauaacuuuggaaaauagcuuuugcuguauuagaaaauguuuucaaauaugaauuauguaaaaugucauuaaggaccagcauuaauagaugaaaauuugcacucaauuuugaugauagggaaaaguacuuuaaaccccaauuuaccaaaaagguuauuuccacaaaaagaaucuaauucucauuaguggauguauauuaccaaaaaaaguuguacuuuauguuaaauguuacaguacaauauguuaaagaacuauucuuuucccauugaacggucuugguagucuuguugaaaaucaauuggccauugguauuugggguuauuucuggaugcuccauucuguuucauuguuauauaugucuguccuuauuccaguaccacaguuuuuaaauuacuguggcuuuguaguaacuuuugaaaucaggaaguggaauccuccaauuuuauuguuguauuucaggauauaagucaugucaacccauugucaacccauuguaaguugaaaauaccauaaguaaaaaauuuaacagccccaaacauccaucauaaugucguaaguugaaccaucauaaguucaguaucaucuauaguuuugacuauucugagccagucccuaagaugcuauaugacuguuugaacugguuuucuauuucuguaaaaaauaccauugggaauuugguagagacugcauugaaucuguaguucucuuugggaagcauuaauuuaagucuuccagccuaugaacaugcaaugucuuaucaauuauuuagaccuucaauuucuguaaggaguguuuucugguguucaguaugcaagucuuuuuccugcuucauuaaauuuauuuuuaaguuuuaaauuucuuuuugaugcuauuguaaauggaauuguuuuuaaguuuccuuuucaguuguucauuccaaguguguagacauauaucugauuuuuuccaacuuaacuucaggguacauguguaggauguguggguuuguugcauagguaaacaugugcuauggugguuuccuugcacagauuaugccaucaccuagguauuaagcccagcauccauuagcuauucuuccagaugcucucccucauccugcgcccugccccuccauccucuaacagaccccaguguauguuguuucccccauguguccauauguucucaucauucagcucccacuuauaagugaaaacaugugguauuugauuuucuguuccuguguuaguuugcugaggauaaugguuuccagcuccaaccaugucccugcaaaggauaugaucuuguuccuuuuuguggcugcauaguauuccaucguguauauguaccacauuucuuuuauucagucuaucaucgggggacauucagguugauuccaugucuuugcuauugugaauagugcugcagugaauauaugcaugcaugaauguuuguaauagaaugauuuauauuuugggggguauacccaguaaugagauuauugggucaaacgguauuucugccucuaggucuuugaggaauugccuacugucuuccauaaugguugaacuaauuuccacuccuaccaacaguguaaaagcauuccuuuuucuccacaaccuaaccagcaccuguuguuuuuugacuuuuuaguaauagccauucuggcuugugugagacgguaucucauugugguuuugacuugaauuucucuaauaaucagugauguugagcuuuuuaaaauguauuuguuggccacauuuaugucuucuuuugagaagugucuguucauguccuuugcccacuucuuaaugggauuuuuuuuuucuuguaaguuauuaaguucauuguagaugcuggauauuagaccuuucuuugucagauuaauagauuccaaaaauuugcuaccauucuguuguuuaucugcucacuccaaugauaguuucuguugcugugcagaagcucuucaguucgauuagaucccauuugucaauuuuugcuuuuguugcaauugcuuuugucauccuugucgugaaaucucugccugugccugugucccaaaugguauugucuagauuuucuuccuggguuuuacauuuaaaucuuuaaucaaucuugaguucauuuuccuuuaggguguaaggaagggguccaguuucaauuuucugcauacagcuagccaguacucccagcaccauauauuacauggggaauccuuuccccauugcuuguguuugucagguuugcuaagaucagaugguguagguggguguucuuguuucuggguucucuauucuguuacguuggucuauguguuuauucuugugccaguaccaugcuguuuugguuacuguagcccuguguuacaguuuuaagucagguagcaugaugccucuggccuuguucuuuuugcuuugauugccuuggcuauucggacucuuuguugguuccauaugaauuuuaaaauagcuuuuuucuaauuccgugaagaaugucagugguaguuuaauggggauagcauugaaucuauaaauuacuuuggguaguauaaccauuuucacaauauugacucuuccuagccaugaacauggaauguuuuuccauuuguucgugucaucugucauuuguuugaaaguugguuuguaguuccccuugaagagguucuucaccucccuuguuagcuguauugcuagguauuuuauucauuugugaccaacugugaaugggaguucauucaugauuuggcugucugcuugccuguugauguauaagaaugcuaaugauuuuugcacauuaauuuucuauccuuagacuuugcugaaguugcuuaucagcuuacaaagcuuuugggcugaggcaaugggguuuucuaauauaggaucaugucaucugcaaacaaagauaguuuaauuuucucucuuccuauuugaauacccuuuauuucuuucucuugccugauugccccagccagaacugccaauacuauguugaauaggacuggugagagagggcauccuugucuugugccuuuuuucaaggggaaugcuuccagcuuuuguccauucauuaugauauuggcuguggguuugucauauaugacucuuauuauuuugaaguauguuccuucaauaucugguuuauugagaguuuuuaaccuaaagcgauguugaauuuuauuaaagaccuuuuccgcaucuauugagauaaucaugugguuuuuguguucaguucuguuuaugugaugaaucacauuuauugaauuguguauguugaaccagucuugcauuccggggaugaagucuacuuggacaugauggauaaacuuuuugaugggcuacuggauauuugccaguauuuuguugagaauuuuugcauugauguucaucaagcauauuggccugagguuuucuuuuuuuuuguuuugucucugccagguuuugguaucaagaugaugcuggccucauagaaugaauuaaggaggaaucccuaauuuucaauuguuuuggaauaguuucaguagaaauaauaccagcucuucuuuguaccucugguagaauucagcugugaaucugucuguccugggcugguuuuuuuuuuuggguugcuaggcucuuuauuacuucucaauuucaggacucauuauuggucuauucagagauucaguuucuuccugguucagucuuagggaggguguauguguccagaaaaguauccauuucuucuagauuuucuauuuaaugugcauugaugcauuuauaguauucucugaugauuguuuguauuucuuuggggucaggaugauauccccuuuaucauuucugauuguguuuauuuaaaucuucucuuuucuucuuuauuaaucuagcuagcagucuauguauucuauuaauuuuuuuaaauaaccagcucuuggauucauugaucguuugaauggucuuucaugucucuaucuccuucaguucugcucugaucuugguuauaucuugucuucugcuagcuuuuggguuuguucuuguuucucuaguucucuuaguugugguguuagguuguuaacuugagaucuuuguagcuuuuugaugugggcauguagugcuauaaauuucccucaacacugcuuuagcugcaucccagagauucugguacauugucucuuuguucucauuaguuucaaaggacuucuugauuucugccuuaauuucauuauuuacucaagucacucaggagcaggcuguucaauuuccauguaguugugugguuuugagugaauuucuuaauucuucugagugaauuuuuuugaguguuguggucugagagacuguuaucauuucaguucuuuugcauuugcugaagaguguuuuacuuccgauuaugugaucaaauuuagaguaagugccuugugaugaugagaacaauuaguuucuguuguuuuaggauggagaguucuguagauaucugucagguccacuugaucuagagcuaaguucagaucaugaauaucuguuaauuuucugucuuggugaucugccuaauauugucaaugguguguuaagucugcuacuauuauugugugggagucuaagucuuuuugaaggucucuaagaacuugcuuuaggaaucuggguguuccuauacugugugugcauauauggaggauauuuggcgcuuauuaaauugaacccuuuauguaacgcccuuugccuuuuuuaucuuuuuucauuuaaagucuguuuugugagaaacuaggaucgcaguccgugguucuuucuguuuuccauuugcuugguaaauuuuccuccaucccuuuauuuugggaugugugucuuugcacaugauaugggucuuuugaagacagcauaccgcugggucuugguucuuuauuuagcuugccauucugugucuuuuaauuggagcauuuagcccauuuacauuuaagguuaguauuguuauguguggauuugauccugucaucaagauacuaguugguuauuuugcagacuuaugugguuccuucauagugucacugaucuguuuacuucaguguguuuuuguaguggcugguaaugguuuuuccuuuccauauuuagugcuuccuucaggagcucuugcaaagcaggucugaugguuacgaauucccucagcguuugcuugucugaacaggaucuuguuucuccuuugcuuauaaagcuuaguuucgccagauaugaaauucuggguuggaaauucuuuacuuuaagaauguuuaauauuggccaggugugguggcucacaccuguaaucccagcacuuugggaggccaaggcgggcggauaacgaggucaagagaucgacaccauccuggccaacauugugaaaaaccccaucucuacuaaaaauacaaaaauaauuagcugagugucguggcgcauaccuguagucccagcuacucaggaggcugaggcaggagaauugcuugaacccagaaggcagagguugcagugagcugagauugcaccacugcacuccagccuggcaacggagcgagacucugucaaaaaaaaaaaagaauguuuaauauuggccccaaucucuucuggcuuuuaggguuuucacugagaggucuauuguuagucucaugggccuccccuucguaggugaccuggucuuucugucugacugcccuuaacauuuuucuuucauuuugaccuugcagaaucugaugauuauaugucuugggguugaucuucucagggaauaucuuacugagguuuucugcauuuccugaauuugaauguuggccugucuuccuagguuggggaaguucuccuggaugauauccugaaauauguuuuccaacuucguuccauucuccccaucucuuucagguaccccagucagucuuagguucaguuuauuuacauaaucccacauuucucagagguuuuauucauuuucauucuuuuuucucuauucuuguccgcuuaucuuauuucagcaagauagucuucaagcucugagauucuuuucuccacuuggucuauucugcuauuaauaguugugauugcauugugaaguucuuguaguauguuucugagcucuaacaggucgguuauguugcucucuaaacuggcuccuccuaguauugucagugguguguuccagucucccacuauuauugugugggaguuuaagucucuuucaaggucccuaagaacuugcuuugugaaucuggguguuccuacauugggagcguauauauugaggacauuuagcucuucuuguugaauugaacccuuuauuguuauguaaugcccuuugucuuuuuugaucuuguaguguguuucucagcucuaauaggucaguuaacuuccucucuaaacuggcugcuuaucucucacauugucagugguguguuaaagucucccacuauuauugugugggagucuaagucucuuugaaggucucuaagaacuuggcacguccuguauuguuuugucauguuucuuacuuugcauuggguuaaaacuugcuccuuuagcucagugaaguucguuguuacccaccuuccaaagccuacuucugucauucagcuuucucagccucagcccaguugugagcccuugcuggagagguguuguggucauuuggaggagaauaggcacucugguuuuuugaguuuuuagcauuuuugcauugauuaauuucuuaucuuugugggcuuaucugccuuugaucuuugagguugcugaccuuugaaugggguuuuuuguagggucuuuuuuguugauauuguuguuuucuguuuguuuuucuuuuaacaggccacucuuccauagaacugcugccauuugugggggucuacuccagacccuaguugccucgauuuuuccuguaccuggagguaucaccagggagggcugcaaaacagcaaagauggcagccuccuucuucuuuggaagcuccuucacagggggguacugaccuguuguuagcucagaugugccuggaggagguggcuggagaccucuguugggagaugucacccagucaggaggaacgggaucagggacccacuuaaagaagcagucuggcugcagcaggugugcuguguuggggauuccuucagccccccaauugguaugggcucuccaggacccacaggcuggacugauugagaagccugaaugccaguguggcagccuaccccaccacucagguauacuccguccuggggggaaauuagagcucugucuaauuggggguggcucaagaccccagcugggaagacccacuaccccaugaggaggaguggauugaggucucacguaaagaagcagucuggccaugaucuggcaguguggcugugcuacacugcaggaaaccuuucucuuccaugcuguauggauauaugugauuuuuguguauugauuuuauauccuacgacuuugcuaacuuuauuagcucuaauaauuuuugugugcauuauuuauacaucucuguggucugauuuggaugccuuuaucucguuuucuuguuuaauugcucuugguggaacuuucaauacuauguugaauuaagugguaaaaguggguauccuuaucuuguucuuguucuagcgggaaggcuuucagucugucaccauugaguauaauguuggcuuuagguuuuucauauauggucuuuauuauguugagguuauuuacuucuguucuuaguuucuggcaugcuuuuauuguuaaagguguuaaauuuugucaaaugcucucuuugcgucaauugagaaacguggauuuuuucuucauccuguuaauguaguguauuucauugauugauuuuccuacauugaaucauccuugcauucagugaaugaaucccacuuugucacgauguaugaaguauuugcugaggacuuuugcaucuguauucacacaauauauugauuuauauugauuaccaaaacucaagucaguuuugguagauuguauguuuuuagaacuuugucaguuucaucuggcuugucugauuuguuggaauacaacucuuuauuguauucucauaaucucuguuauuuaugcaaaauuacugguaauguucuuucugauuuuugugauuugaaucaucucccuuuuuucuuaacuuaccuagagguuuaucaguuuuguugauuuuucaaagagucaacuuuuggcuggaugugauggcucaugucuguaaucccagcacuuugggaagcugaggcgggaggauugcuugaggcagggaguuacaggggagccugggggacauagcauaaugccaucgcuacaaaaaauaaacuuagccaggugaguuggcacaugauuguaguccuagcugcucaggagggugagucaggaggaucaccugugcccaggaguucaagguuaccaugaguuuugaucuugucacagcacuccagccugggcaauagagcaagacuccguaucaggaaaaaaacaauuuuuguuaaaguguauuuucuuuauuguuuuuccauucucuuuuuauuuugcucuaacuuuuauuauuuccuuucuucugcuagcuucgggauuacuuugcucuuuguuauuuaguuauuuuaugugcacauuuagguuauuuauuugaaaugucccuccaccgccaccuuuuuuuuuuuuuuuuuugagacagcuuccuguuuuguugcccaggcugaaaugcaguggcaugaucauagcucacugcagucuugauuuccugggcuuaaguaauccucucccucagccucccuaguagcugggaccauaggcacgcaccaccacgccuggcugauuuuguuuaauuuuuguagagaugugaucucacuacguuggccaggcuggucucaaacuccuaggcucaagcgaucauccugccuuggccugucaagugcugggauuacaggcaugagccaccgcacugggccugagaugugccuuuuuaaguguggaugucuacuguuccaaccucugccaguuacccagcuccaaaguugcuuccacauuuuuggguaucuuuauagcagcaccccacucucugcaguaccaauuuacuguauuaguucuuucucaugcugcuauaaagaacugcccaagacuggguaauuuauaaaggaaagagguuuaauugacuuacaguucuacauggcuggggaggccucaggaaaauuacaaucauggcagcaggggaaacaaacaugucccucuucacgugguggcaggagagaagugcugagcagagggagaaaagccaccuauuaaaguaccaucagaucucguaagaacucacucauuaucacgagaacaccgugaggguaccaccucugugauucaauuaccucccgccaggucccucccaugacacaggggauuaugggaacuacaauucaagaugaaauuugguuggggacacagccaaaccauaucacugaggaacccuuauauuugauaagcugcuucucuguuaauguuuucaaaauucugucuuuugguuucagcaguuugauucuagugugucucagugugggucucugaguuuauccuuuuuggaauuucuuggauuuguauauucacggauuucauuaaggcuccugacauuuucaaccauuucucuuuccuccauacuucuauuccuauauuauguauguuguugugauuaauggugccccacaggucccccagacucugcuuauuuuucuuuauucuucuuuuugcuccuuagauugcauaauuucaaaugucuuauuuucaaguacauuuaucuuuuccgucugcucaaauuugcuauugaauuucuguagugaauuuuucauuuuaguuacuguacuuuuuaucuucagaauuuuuucaguuccuuuaaaaaaaauuuucccuuuuaucgauauucucauuuuguuuagacauuguuuucuugauuuucuuuaguuuuuugcccauggucuccuuuagcucauugaacauauuuaagaguguugauuuaaugucucagauuaauaauucaaaugucugggcuuccuuagggaugguuucugccauauucuuuauuuucuaugacugggccauacuuuucuguuucuuuuuauguguuguaauuuuucauugagaacuggacugaguauuauguuguggugacuuuggaaaucuaauucuccuagcccucagagauugcugggguucugcuccuugauuacugaagaguuccuuuuaugauuuuuugaaacucuuuuugcauaguauguauuucuucugauggguggucucugaaguuucucuuuuguuuucucuguugccagccagucauguaagauuuccuuauccuacucccaagagaggggagauuuuggugcacccaucacccaagcaguguacacuguguacccaauuuguagucuuuuaucccucacccgccucccacccuuuucccugaguccccaaaguccauuguaucauuauuaugucuuuguguucucacagcuuagcucccaauuaugagugagaacguaggauguuugguuuuccauuccugaauuacuucacuuagaauaauagucuucaauuccauccagguugcugcaaaugccauuauuuugcuccuuuuugugacugaguaguauucgaugguguauauauauaccacauuuucuuuauccacuuguugauugaugggcauuugauugucaucuugcccauaugacaucaaaauucagcagaugucuugaggguaaaauugguguuaaagaaaaaauuaucgaauaauacuuguugaaacacaguaaggaaaacuuuuuuggggacuaucgcaguauauauagggaacacugcaguggguucuugcaguggcaaagagagauugggcucacuucuucagcaugggcaagugggaauuuauagccaaggagcagugugggagucaauggauagaaaauuaauaagaggaaacaucagggguaauggggauucuggcuaaaacaacaggauucuugcugaagacagaccagggugaucagacaucacuuaggggagauuggaggaugagccaccuaaucagauaucaagugugggggucuugcuaaacuggauuuuauaaggaaaugcacagauggaccuaagagaagaagguucaggagccugacuaaaguuugacuaagcacagaaucuuugucacugguuauguguuugaggcacaucaggucuccaguuaguauggauaccugugcaucucacaaauacaggaaauuuuacuuugccuguaugaaguuugcuuucgagcccuugagccccuucugcagcuucuaaguucagcagaugucuugugggaaaaauuggcuguggaguugaggcauuucaagucugauuauuucuucaacccuauguaacugccaagagcuuugcugauuuuucuuugcuccagcaggcgucugccugaacuaagucugcugcuuucuuagccugugcccagaauuggugaaugcucuuaggggaaaaaaaaucagcuuacuucugaacagcccuccuacuaugaauuuuaaucagucuaggccuuauugauuccauagcuugccugaugccuuuaaaaauauaauuuuuuauguuuucugccuuuuucuagcuguugggagaguuggucugccaugaccuacuuauuguauauuacugugcaguagaauucuuaaccauguaauauaaaauugccuuaauacuccuuuuaugauuuuuugagucauuucauuuuuauauauaaaauccaaagcauuauauaaagauggaaugagcccagauauauccauuaaaacuauuguaacugcccaacaguuucguuuugccugcugccugaauacaauugauuuaucaagacagaggaauugcaauagagaaaguuuaauucaugaagagcuggcugaacagaagcgccauaguuuuauuauucaaauaagucuuccccaauauuuggaggcuaggguuuuucaaggauaguuugguggggcagggaaugggugcugcugauugguuagggaggcagucagagguguggaaaauggucuucaugucgaguccacuucugaguaggaccacaggaccaggaccaguugguggguccacguggagcccuccgccgucagaaaugcaaaaaccugagaagguaucugaaaaggccaaucuuagguucuacaguagugauguuaccugcaggaguaauuggggaaguugcaaaucuugugaccucuggaauaaugacugguaauuguuuacauuuacacuuuagcagaauucaggcuccucuccuccuccuaaugucuugcuaaacagaugauacaaaaauaucagugaccuuucuaaacuauuaccaaauaauacagagauggcucucuguauuauuuauuuuauuauuauuauuauuauuuuuuuuuuuuugagacggcaucuugcucugucacccagacuggaguggaguggcgcagcgcaaucucugcucacugcaaccuccgccucccagguucaagcaguucucccugccuuacccucccaaguaguugggauuacaggugcucgccaccaggcccaacuaauuuuuguauucuuaguagcgacaggguuuugccauguuggccaggcuggucucuaacuccugaccucaggugacccgccugccccggccucccgaaguguugggauuaugggcaugagucacugcacccagccuguauuauuuuauaucauaaugaaagaaaugaaaauaaaaaagaaccuguuuugcaggcagaggcuacaaaaacuuugaacaacuaguagaaaugguuuaaguuaauuucuaaauucugagaagauagaaggacuaagcccccauuccuaacuccucuccucuucucaggaguauaaacaugagccuaaagucagaaucaucaagauaucaaguucuuuagggaaagaauaggugcugaaggaccaggcagagggaaagguuugcuuugccacuccuuaaggcacugagacaggaucugagauuucacaguucucuaagugagcuuaaaaaaguggaauccugugguuucccuucagaaaagggaggacugugucugcuccuggaaguggacauuagcagggcuucccauaaaacucuguuaacugcugcggacuuagaguagagguugcacaggugaacucaguugcugccacaccucauggucugaggaagccggcccuucuacucagagacagugccugagaggagacugcugaagccucagcucagcaguaugugagcuugucugccucugcaaacugucacuuuauccagcaucuguagguuugcauugccagauacccacaucaaagccuaaccucuacagguggcuaauggaacacagcaaagaaaaaaaccacuaagggagcucauuaacuuuacgauguaagaccaaacuaaacaaguaaaauauguggcuccuauugaugagccacagggaugagacagaagaauguaguaaauuaagaaaaaaauuacuaagaacuuucagaaaauguaauuagaacauaaucaggauuuuucagagcuaaaaauuuccuaagagaaaaauucaacagaugaacugauaaauaaccccuugugagagcugaaucuuuuguuccagaagaucaaauagaaacaauuucaugauguaaggcauauagaaauaaaauuauuuuugaaaagauaagagaccugcaggagcaaauucaagagguuugggaaugaguguuauagaaagaaaacaagacagaacaaguauuaguuuaggaaauaauagaagaaacuuaccuaguuuagaaacauugaagguugucagauugaaaaggcugagacuuagauacauuugauugcggguggggcuauguggaaaaaguuuaaugaaaaaacguacauaucuagagauaaugugcagaaauaacugaauuucagucaugagaaaaaucauucagagaaaagggaaagagaaucacauugacaauagacuucucacuacuaacccuggaaacuuaagggaacauuagaacaacaucucauagccaugaaaaaagaaucucuaacaauccuguaccuagacaggauguccuuuaucucgguuaaguaacgguauguucggauaauuuauuucguuuaauaagggaaugccuugguauuggagcuacagugaacaggacaagcaaguggacauguaacuaauuccuagguuagugagagauaggugauaaacaaguuuagacaagaaaaugaaacgugaugaccauaccauccauguuagguauaugcaaugcuuagggacaauuauuaucuguauuaauauucauauuaauaaaaacuuccuauggaagaccauccuauugaaaaauggacgaacaaggcaacuugcagaaggagaaguaugaagagccaauaaaaaugaaaagauaagcaucacuagcaaggaaacaaauggaaauuaaaauaagaccauuuuucaccaaucuaaugcaggcauaaacaggaauucuaggaacaaguagaguguuacugggaauuaauguaauuuuuuggauaaauuuggcaauacauauuaaaaugaauguacauacauacacuuugacuuggcaauccuacuuaagggaagguaccccacaaaauauauaugcaccaaaacauaaggagauauauauauauauauauauauaaauaaauguugauugcagcauugucuguaguugccaaagguccaucaagaaaagaauagcaaaguaaauaagaaacuuccauacuuuggaauaucacacaaauacuaaaaauaguaguaaguguaucuaugaauguggaagaacagucagaaaacacuaagugaaaaaaaucaaauugcaugguaauguguaaauuaagauuccaauuuugugugaaaaugauaaaaguuccuguauauauuuaucaguuuaaaaauuuacucauuucugaguuagaauccaaugcagacauuuaaaaucaaguuacagaagaauguuaaguuuauacaacauuugugauaaaauaaugucauaaaagcagauuauaaaacuguaugauagcuuuauauaaagaaaaaaauuguauuuuagauaacccucuacuuaagaaacuaacagauuuaucaacugugcucgucauaaccaguuacauuagcaggcauuuacaguaucaucaguuuggauuuaaaaacagacuucagcagaagucuaauaugcuguaaaauauaagaguuugugcaaaugucccuggaaaagacauaaggacuacauaaaaauugauaaugauuaucugugaauggugaaacuauuggcaguuuauuuuuguuacuuucuguguuucuuggguuuucuucauugaacauggagaaauuugucauucauaaaaaaaaaauuuaacaaaaauucauuuaugauccuguaugaauuuuaaaauucauauaagcuaaaauguuaauucauguuuuaaauagcccaaguaaggaugaauuaaauuacuagaagcaggucagcauuuacucaauauauuuaauauaagccagauuacuaugacuaauauuauauuuaucuuaacaucuccacaaaguucuagaaauaagacgguggugaaaggauaauaaaaacucaggaccccaauucaccacuccaaaagggaaaaaauaagcugaaagcccagucaugcaagaaacugccuuuccuuuuguuccugagcugauaacuacagauaaaagguuagguuaccuacuccacaaguagcuacuuauguucaccauaucuuauguaaagugccuguuuaaugaugccagacgaauacauaauugacuauuccccuaccugcucuuuucucuuggaacuuguggauuaccauacccuccuucucuccccuccagcccacuuuuccccuuuaaagauugaagcccucaaauucaucuuuggagaaaggcacagaucacagacugucacugugauucuguuuuuuuguuccgggcauaugcuuaaccuuggcaaaauaaacuucuaaauugauugagaccugucucagauacuucuugguuuacaacuauguucuaaauaaaguguuggugccacaaaagaaauagcacucaaauauaaaauuuucuuuuuaauucucagcaaggcaguguacuucuauagaggggugcgcccuuacagauggagcaauggugagcgcacacuuggacaagggaggggaagggguucuuaucccugacgcacguggccccugcugcugugucguuccccucuuggcuaggguuagaccgcacaggcuaaacuaauuccgauuggcuaauuuaaagagagugacugggcgagugguuuggcgggaaaaaugguuauggcagagcaggaaauuggaaugagucaggguggagaaugagcagguaaugggaacgagucaggguggaguagguaaucggaaugagucaggguggaggagguaaucuaaaaagauugcuuuaugaggaaguuaaguuuaaaaguagaaggcaaagaauugaacuuacugacauaucgauucuuugaagagaaacuuagaacuccuaucuaacaacuauaaguaauaaauaagugaaauaaaaauuagauuuucaguggccaaaaauauuaaauuauuuuguuacucuuuauguacuuuauuucuucaacuuacgacaaguauaauuucuucuaacuucuuuguugucuuaauauuuagcguaauauaaaagguagucacuuaauaaauuaaugugaaauuauuucugauauaaaaauaaagcuaucagacuguucccucuguacugucuagugggaauuuuaggggggaaaaauguacauacaaaauggccuacaaauaacauggaggaaucauauguaaaaacuaauguaccaguugcuuaaacuuucacuaaacucuucuuccuuugaaagaugaggaagaguuuuaauuauauacugaauauaaaaauuaugcuauucauaauaugcauacagcacauuugcagucagugguaaauuauugaucuugaaaccaccuuugcaaaaauaacaaugagaaaauuaugacaguaaaagaaaucuaaucuaacccccaucuugccuuuaaccucccaacugcccuuggucauuccugggccuaggccaugcuaacuuuaggagaaauuuauaguuuaaaugauaauggcccuuccccaaaacuaaaccaccuuuguaaagcuaacgaaagacgaggucuugcuguguugcccaggcuggucucaaucuccuggacuuaagugauacgcccaccucagacucccaaagugcugggauuacagaugugagccacugcaccuggccuggauaagcaaacuuucuagguaaccaaagcuuuaucagauucugaaacguuacuaauuuaaugauucuuuuccucaaauguauucuauaguuuuuuauccuuguaugaaauauauugaauaugaauuaacgguguacuugaagauuaaauuguauaauuauaauaguaaauuuugggaggugucuauguucuaggcacuguuguagugcuuuauguguauuaaaauuaauuuguuauucauaacaauccucucaagguagauacuuuuauauucccaucauacaguugagcaaacuaggguacagagagguuaaguaaccugcucaagaauacauggcuaauaaugaaauguuaguaauauuuugaaagcucuauuucugcaucauuauuagagccauaggcaucuccuuaucaauuuguaucuuaaaaagaaaucucacuggcacuuuuuuaaugggguuuaaagaaaaaaauugcucuacuguuuuaagaauccccaccucucucaaaaccaacgacugaucugcuuuuugucacugccaauuacuuuguguuuucugguuuuauauaaauuaagucauacacuguauacuuauuuuuucuaguuucucucagcauauuuugagauucauccauuuugucgugaaucaguaauucauuaugaguauuaguuuacggauuucucacaguugguuuauccauucaucuguugauggacaguuugacuuguuucccguuuggggcuguaacaaacaaaacuacaugaacauugauguacaagucuuuguauggaugcguauuuccuuuucuguuggguaaauauccaugaguggaacagcuacauuauaugguagaaguauauuugacuuuuaaaggaaaugugaaacuuuucugaaguaguuauaccauuuuacauucccgcuagcaguguaugagaauuucuauuuuccucuaucuuugccaacaugugguaggguaugccuuuuuaauuuuagucauucugguagugguguagugauaucucauuauaauuuuaacuugcauuuuucuaauaacuaaugauguugaacauuuuucucauuuguuuauuuguuaugugugugucuuauuugguaaaauguguguucaaaucuuuugcccauuuuuuuagaugggauccuugauuucuuguuguuaaguucauauuuugcaucuugauaucuguuccaguacaauugguugaaaagauuaucccuucuacacagcauaucuuuugcaccuuugucaaaaaucaguugucuacauauguguggguuuacuucuauauacuucauucuguuccaugaucuauuuguauauauuuaacaucauuuugauuacucuagauauauaauaauuuuugaaaucacacaguguuaggucuccaacuuuguucauuuucaaaguugcuuuugcuauuguaggccuuuguauuuccauauuuuauguucaucucaauuuuuuuuuguaaacauuaaaacacaggaaaagaauuagagcauagauauaaggguuauuuuuacuuauagcauuauauguaaauuaaaacuacauuguuuugaaaaaacuuccacugaacaaacauuuuucucaccauguuuacucuuuuuuuuuaaauuuuauuauuauuauacuuuaaguuuuaggguacaugugcacaauguguagguuuguuacauauguauacaugugccauguuagugugaugcacccauuaacucauuuagcauuagguauaucuccuaaugcuaucccuccccccugcccccaccccacaacaguccccagugugugauguuccccuuccuguguccauguguucucauuguucaauucccaccuaugagugagaacaugcgguguuuguuuuuuuguccuugggauaguuugcugagaaugaugguuuccagcuucauccaugucccuacaaaggacaugaacucauccuuuuuuauggcugcauaguauuccaugguauauaugugccacauuuucuuaauccagucuaucauuguuggacauuuggcuugguuucaaguguuugcuauugugaauagugccgcaguaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaacuguuccuauuucuccacauccucuccagcaccuguuguuuccugacuuuuuaaugauugccauucuaacuggugugagaugauaucucauaguggcuuugauuugcauuucucugauggccagugaugaugagcauuuuuucauguguuuuuuggcugcauaaaugucuucuuuugagaagugucuguuuguaucuuucgcccacuuuuugaugggguuguuuuuuucuuguaaauuuguuugaguucauuguagauucuggauauuagcccuuugucagaugaguagguugcaaaaauuuuuucccauucuguagguugccuguucacucugaugguaguuucuuuugcugugcagaagcucuuuaguugaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguauaaggaagggauccaguuucagcuuucuacauauggcuagccaguuuucccagcaccauuuauuaaauagggaauccuuuccccauuucuuguuuuugucagguuuguccaagaucagauaguuguagauauguggcauuauuucugagggcucuguucuguuccauuggucuauaucucuguuuugguaccaguacuguuuugguuacuauagccuuauaguauaguuugaagucagguagugugaugccuccagcuuuguucuuuugacuuaggauugucuuggcaaugcaggcucuuuuuugguuccauaugaacuuuaaaguaguuuuuuccaauucugugaagaaagucauugguagcuugauggggauggcauugaaucuauaaauuaccuugagcaguauggcuauuuucacgauauugauucuuccuauccaugagcauggaaaguucuuccauuuguuuguauccucuuuuauuucauugggcagugcuuuguaguucuccuugaagagguccuucacaucccuuguaaguuggauuccuagguauuuuauucucuuugaagcaauugugaaugggaguucacucaugauuuggcucuguguuugucuguuauugguguauaagaaugcuugugauuuuugcacauugauuuuguauccugagacuuugcugaaguugcuuaucagcuuaaggagauuuugggcugauacgaugggguuuucuagauauacaaucaugucaucugcagacagggacaauuugacuuccucuuuuccuaauugaaugcccuuuauuuccuucuccugccugauugcccuggccagaacuuccaacacuauguugaauaggaguggugagagagggcaucccugucuugugccaguuuucaaagggaaugcuuccaguuuuuguccauccaguauaauauuggcuguggguuugucauagauagcucuuacuauuuugagauacaucccaucaauaccuaauuuauugagaguuuuuagcaugaaggguuguugaauuuugucaaaggccuuuucugcaucuauugagauaaucaugugguuuuugucuuuggcucuguuuauaugcuggauuacauuuauugauuuucguauguugaaccagccuugcaucccagggaugaagcccacuugaucaugguggauaagcuuuuugaugugcugcuggauucaguuugccaguauuuuauugaggauuuuugcuucaauguucaucaaggauauuggucuaaaauuuucuuuuuuuguugugucucugccaggcuuugauaucagggugaugcuggcgucaucaaaugaguuagggaggauucccucuuuuucuauugauuggaauaguuucagaaggaaugguaccaucucuuccuuguaccucugguagaauucagcugugaauccaucugguucuggacuuuuuuugguugguaagcuauuaauuauugccucaauuucagagccuguuauuggucuauucagagauucugcuucuuccugguuuagucuugggaagguguaggguguauguguccaggaacuuauccauuucuucuagauuuucuaguuuauuuguguagagguguuuaugguauucucugaugguaguuuguauuucugugggauugguggugauauccccuuugucauuuuuuauugcgucuguuugauucuucuccguuuucuucuuuauuagucuugcuagcggucuaucaauuuuguugaucuuuccagaacaccagcuccugcagucauugauuuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccuuguuagccaggauggucucgaucuccugaccucgugauccgcccgccucggccucccaaagugcugggauuacaggcgugagccaccgcgcccggccgauuuuuuuuaagguuuuuuugugucucuauuuccuucaguucugcucugaucuuaguuauuucuuaccuucugcuagcuuuugaauguguuugcucuugcuucucuaguuauuuuaauugugauguuagggugucaauuuuagaucuuuccugcuuucucuugugggcauuuagugcuauaaaauucccucuacgcacugcuuugaaugugucccagagauucugguuauguugugucuuuguucucguugguuucaaagaacaucuuuauuucugccuucauuucgcaggagcagguuguucaguguccauguaguugagugguuuugagugaguuucuuaauccugaguucuaguuugauugcacuauggucugacagacaguuuguuauaauuucuguucuuuuacauuugcugaggagugccuuacuucaaacuauguggucaauuuuggaauaggugugguguguugcugaaaagaauguauauucuguugauuugggguggagaguucuguagaugucuauuaggucugcuuggugcagugcugaguucaauuccuggauauccuuguuaacuuucugucucuuugaucugucuaauggugacagugggguguuaaagucucccauuauuauugugugggagucuaagucucuuuguaggucagcaaggacuugcuuuaugaaucuaggugcuccuguauugcgugcuccuguauugggugcauauauauuuaggauaguuagcucuucuuguugaauugaucccuuuaccauuauguaauggccuucuuugucucuuuugaucuuuguugguuuaaagucuguuuuauccgagaguaggauugcaaccccugccuuuuuuuguuuuccauuuguuugguagaucuuccuccaucccuuuauuuugagccuaugugugucucugcaccugagaugaguuuccugaauacagcacacugaugggucuugagucuuuauccaauuugccagucugugucuuuuaauuggagcauuuagcccauuuacauuuaagguuaauauuguuaugugugaauuugauccugucauuaugauguuagcugguuauuuugcuuguuaguugaugcaguuucuuccuagccuugauggucuuuacaauuuggcauguuuuugcaguggcugguaccaguuuuuccuuuccacguuuagugcuucuuucaggagcucuuuuaaggcaggccugguggggacaaaaucucucagcauuugccugucuguaaaggauuuuauuucucuuucacuuaugaagcuuaguuuggcuggauaugaaauucuggguugaaaauucuuuucuuuaagaauguugaauauuggcccucacucucuucuggcuugucgaguuucugccaagagaucggcuguuagucugaugggcuucucuuuguggguaacccgaccuuucucuguggcugcccuuaacauuuuuuccuucauuucaacuuugcugaaucugacaauuaugugucuuggaguugcucuucucaaggaguaucuuuguggcguucucuguauuuccugaauuugaauguuggccugccuugcuagauuggggaaguucuccuggauaauauccugcagaguguuuuccaacuugguuccauucuccccgucacuuucaggucagguacaccaaucagacauagauuuugucuuuucacauaguccuauauuucuuggaggcuuuguucguuucuuuuuauucuuuuuucucuacacuucucuucucgcuucauuucauucauuucaucuuccaucgcugauacccuuucuuccaguugaucgcaucggcuacugaggcuugcgcauucgucacguaguucucgugccauggguuucagcuccaucagguccuuuaaggacuucucuccauugguuauucuaguuagccauucgucuaauuuuuuuucaagguuuuuaacuucuuugccauugguucgcacagaguaauuugauuuucugaagccuucuuucaacucgucaaagucauuuuccaucaagcuuuguuacauuguuugugaggagcugcguuccuuuggaggagaagaggcacucugauuuuuagaguuuccgguuuuucugcucuguuuuuuccccgucuuugugguuuuaucuaccuuuggucuuugaugauggugacguacagguggguuuuugguguggauguccuuucugauuguuaguuuucccucuaacagucaggacccucagcugcaggucuguuggaguuugcuggagguccacuccagacgcuguuugccuggguaucagcagcaguggcugcagaacaguggauauuggugaaccucaaaugcugcugccugaucguugcucuggaaguuuugucucagaggaguacccggccgugugaagugucagucugucccuacuggggggugccccucaguuaugcuacucaggggucagggacccacuugaggaggcagucugccgguucucagaucucaagcugugugcugggagagccacuacccucuucaaagcugucagacagggacauuuaagucugcagagguuacugcugccuuuuguuugucugugcccugcccccagagguggagacugcugaggaaggcgggccuccuugagcuguggugggcuccacccaguucaacuucccggcugcuuuguuuaccuacucaagccucgggaauggcgggcgccccucccccagccucgcugccaccuugcaguuugaucucagacugcugugcuagcaaugagcgaggcuccgugggcauaggacccuccgagccaggugcgggauauaaucuccugguaugccauuuguuaacccuguuggaagagcacaguauuagggugggagugacucgauuuuccuggugccgucugucaccccuuucuuugacuaggaaagggaauucccugaccccuugcgcuucccaggugaggugaugccuugcccugcuucagcucacgcacagugcgcugcacccacuguccggcacaccccggugagaugaacccggcaucucaguuguaaaugcagaaaucacccgucuucuguguugcucaugcugggagcuguagacuggagcuguuccuauuuggccaucuuggcuccacccccccccccccccccccccccccccgccaucucaucaauuuauacagaaaugucugcugggaguuugauugggauuacauugaaucuuuggauccauuuggggagaguugcuaucuuagcaauauaaacaagauguauuucuccauugaaguauuuuuacuuucagcacuguuuucuaguuaucaguguacaaguauuucaucucuuuugccagauuuauccauaucucacaacuuuaauguuacugauuuuuuucauuuucuaauuguucuuauuaguauguaaaaaugcaguugauuuuucuauauuugucuuguguccagcagucauacuaaacucacuuauuauaguuaauuccauuaggaguccuaugcaaaugaccauaucaaaaacaguuuuacuuuuucuccccaauuuauauaccuuuucuuuuucuugucugaauuuacugccuagagucuagacaguguugaauaugaugaaggcauucagucuuuuaccauuaagaaugauguuauaaauauuuuauaaaucucuuucauccagauauggaaguuucccauuucuuccuaauuuacugagaauuuuuaaucaggaauggauguugaauuuugucuaaugcuuuuaaugcaauguauucagacugucaugguuuuccuuuuuuaguuuguuaauaagguaaauuacauguauuuaauuuuguuaaaccccaacccugcauucuuggauaaaccucauuugguugugauguuuuuuuuuuauaagguugaauuuaauuugcuauaauuuuguuuagaauauguuaaugagggaaggagaacuacaaaccacugcucaaggaaauaaaagaggauacaaacaaauggaagaacauuccaugcucauggguaggaagaaucaauaucgugaaaauggccauacugcccaaggugauuuacagauucaaugccauccccaucaagcuaccaaugaguuucuucacagaauuggaaaaaacuacuuuaaaguucauauggaaccaaaaaagagcccgcaucgccaagucaauccuaagccaaaagaacaaagcuggaggcaucacacuaccugacuucaacuauacuacaaggcuacaguaaccaaaacagcaugguacugguaccaaaacagagauauagaucaauggaacagaacagagcccucagaaauaacgccacauaccuacaacuaucugaucuuugacaaaccugagaaaaacaagcaauggggaaaggauucccuauuuaauaaauggugcugggaaaacuggcuagccauauguagaaagcugaaacuggaugccuuccuuacaccuuauacaaaaaucaauucaagauggauuaaagauuuaaauguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggauguaauucaacuaaagagcuucugcacagcaaaagaaacuaccaucagagugaacaggcaaccuacaacaugggagaaaauuuuugcaaccuacucaucugacaaagggcuaauauccagaaucuacaaugaacucaaacaaauuuacaagaaaaaaacaaacaaacccaucaaaaagugggcgaaggacaugaacagacacuucugaaaagaagacauuuaugcagccaaaaaacacaugaaaaaaugcucaucaucacuggccaucagagaaaugcaaaucaaagccacuaugagauaucaucucacaccaguuagaauggcaaucauuaaaaagucaggaaacaacaggugcuggagaggauguggagaaauaggaacaguuuuacacuguuggugggacuguaaacuaguucaaccauuguggaagucaguguggcgauuccucagggaucuagaacuagaaauaccauuugacccagccaucccauuacuggguauauacccaaaugacuauaaaucaugccgcuauaaagacacaugcacacguauguuuauuguggcacuauucacaauagcaaagacuugaaaccaacccaaauguccaacaaugauagacuggauuaagaaaauguggcacauauacaccauggaauaguaugcagccauaaaaaaugaugaguucauguccuuuguagagacauggaugaaauuggaaaucaucauucucaguaaacuaucacaagaacaaaaaaccaaacaccgcauauucucacucauaggugggaauugaacaaugagaucacagggagacaugaaggggaauaucacacucuggggacuguggugggguggggggaggggggagggauagcacugggagauauaccuaaggcuagaugacgaguuagugggugcagcgcaccaguauggcacauguauacauauguaacuaaccugcacaaugugcacauguacccuaaaacuuaaaguauaauaauaaaaaaaaagaauauguuaaugagggaucuuggccuguaguuauaaugucuuugucugguuuuguuaugaggccucauaaaaugagauaggaagugguuccuucucuuugguguucuggaagagucuguauucaacugauauuauuuauuucuuaaagaguugguagaauuuaccagugaugcugucucagccuagaauuuucuuuguggaaaggauuugaauuggaauuauaauuucuuuaacagacauuggcuuuucaggguacagauuucuuuucagugaacuuuggugguuuguguuuaucaaggaauuuguccaucucauccaaguuguuaaaauuauugucauauuaauaaugugaccucauuauucuuuuaauaccucuagaauuuguagugauaucaccucuuugauuucuguuaguggcucuuuuuugccugaucagugugaccagaaauaugucaguuuuagugaucuucuaaaacaauaacaaaagaaccccagauuuuuauucauugauuuuauuuuucuguuuucuauuucauugauuaccacucugaucucuguuauuugcaugcuuccccacccuccaccacuugcuuuggauuucguuugcucuaguuuaauuuguuucuaguuuaagguagaagcuugucauugauuugagauuuuccuuuuuuucuaauauaaguauuuuaaggcuguaaauuuccucuuuaguacugcuuuagcagcaucccacaaauuuugggaugauguauuuuuaaaauuucccuuuuucuccuuugauucauggguuauuuagaaguaugcaguuaagcuucaaaauauuugugggcuuuccagaauuuuuuuuauuuguuucuaguuuuguucuauugggaucaggaaacauauauuauacacauuuuauuuuuacacacgguauaaaccccagcauacacugcuauuauucuuguuuuaaagccuguuaucuuuuaaagaaauuuaagugaagcaaaugaaauuugaauuuaauuaaauauuuuuuuucugacucuuaccccugucaugcggagacucuguuuauauguauauugggcuacaugaaguuguuccucaauucacugauuuuguuucuguuuuauuuuggguuuuuuuguguguguguguguuucauuauggauaauuuuuauugcugugcuuuucugaucauugucuaaccugucauucauccagccaaugucuuuuucaucucagauauuuuaguauuucuguuucuagaguuuuguuugaguuuucuauauugccuaaccuuuggaacauacagaauauaguucacauuuggaacauuaugaaauauagcaaaagguuuuaauguccuuuugugcuaauuuuaacaucugauugaguuaugcauuguuuugauugguugauuuuucauuaugucucauguuugucuuacucuuccuggacucuucagcuucuucucaacucuggaagucugccaggcuuugucuuagugcgccuucuaagugugcugacccagaaauucucacaaggcaguaagcuggguaagaguaggagggucacuucaguuguuucuuaucucucaaggaugacuggccuucauugcuugaugccaguguuuugaaaaguauuucauagauuuugucuguuuuuguuguuguuguuguucuuguuuuuuuaugugugaaaccuuuguuaugauuugauuugaagccauuuuccuuuugcuuccauacucuccauauugcaagaacauaaaauugcacauaaagaauuagaaagaugaucuuaucugaagaauuuucacccuuuuguuuuuguaucuuacaguguugaaacucuaguuucaaauacauuauaaaauaguaaaguuaauggucaaaaagaaagcaaaccaccugguuuugcugaagaaacuaaguauuuucuuggucauuccuuugaaaaacaggaagccagaauuagaaaguaauuugaaaccuuggauaauuucuugguuuucuuugguucuacuuugaguacaugcccaccucccucuaaaaugauaggaauucaguauuacuguaaaguaguuugggcaaaacacugccacuucacucuguuaggcguaaaaauguuuggcuggaaacagcuaaauauaauauuuuguacuuacagaaauguaaaaugguuguuugaacuucacaaauguauguaugucaugacgcagauguaugucaugaucauguaauagcacuguuuuuaauacaauuucuuuuuuuuuuuuuuuuuuuuuugagacggagucucgcucugucgcccagcggggagugcaguggcgcgaucuuagcucacugcaagcuccgccuucuggguucacgccauucuccugccucagccuccugaguagcugggauuacaggcgccugccaccacgcccggcuaauuuuuuuguauuuuuuuaguagagacaggguuucaccacguuagccagaauggucuugaucuccugaccucgugaucugcccgccuuggccucccaaaauacugggauuacaggugugagccaccgcgcccggccuacaauuuguuguuaaaaaauauuuuguuaacuuagaaaaaugaacuagcugauacucaaauuuuggaaauuaaagguuugcucuguuuuaugucuguaucuggggcuauauuuuguaguaaaucagagaccaaaagauuguuuuugaaauauauaaauaugcuguucugaaguuaauacuguguaaauuuugaguagaguaagcguuuugucuuaaagguguaauaaagccauaaaguggcauuguugcuuuauaaacuuagaauaauaauuugccauauuagugcagaguucaaaaaguacuauauauuuugcaaaauagucacuuacucauuauugaauaaugcaguuacuugagaguaugcaugucuagaauacuuuaugaaguacugauuucacugaaagauuuugaaaucuguaaaaacccuuuuuuucaacauggguuauauuaaaaagucgcuucuauuugcauaauuaggcuauaauucuccaagggaggguauuggagaauaaauuuuuuuucgaaguaagaauuuauaaaauuaaaauucaggguuacaguuauagccuuacucuuuaauucaugauuaauaaaauuucucuuucagacggcaaauggauacaucuuguuuuuucauauuacaucuacaagaggggacaaguaccuuuaugaaccaguguaucccaaguaaguuuguugccuuucauucuuuuaauaugugauuugcauacuuuauauucagaaaaacauuacaguuuugaguugucuguagugauuagaauaaaacuaaaccagcauuucccaaauaguauuuaaaaaauuaccaggucuuugaacugucauuucuugaauaaagaauucuuuaagucugggaaucuugaugauaaacuauaucaagacuauuuucuuggguauucagaaugacuguuaauauauuccaggucuagcauuucucauuccuuauuagggaagagcuaagagaucaugagaggaagaguugaaauguugguaaguuacagguacuuuugcaugugcuuuuguauaugcauagaaaaaaaagaaccucagacaguuauuaccucuugguuuaaauuugggaaaaacguggacuuuugcccuuuacacuguguaguuauguauauuuugcauucuuuuccuuauagcaggccuuaacuuuugaaauaaaagaacauacaauuguaaagcauuccaucuuuuuuuuuuuuuaaucaagccauaaagccagauaaaaauauaagagcauuuaucacauuucuagaugguggaagauauccaaaguuuaauagguauauaagaaauuagaaagacagauuuuacugugugaaaaguuuaaauuuuugaauauuaacagaaaaaaagaaaaacauuaacagcaaauaacuugggaaaaauauuugugguaaauagggccaagucuuacuacuuuuauauaaaagagauauauaaauugccaauaagcacacagagauuccaguagauaaauagggaaaguagucucauuaaaggaaauacuguaacuaacaaacucaagagaaaguauuuagacccaguaguaacccaaauaaaauaaacguuaaauaaaauaaacccaaauaaaauaaacauuaaauauaaccauuuuuauuuuuuaauaauuaaagaauuauuacugcucgcagagguauaauaaaaguuguguugcacacuucugauacacaaaggugugauaauagggagcugguuaacaaguuaacugugguacauccuucucuuauagugauauguagucauuaugucucagaaaaauguauaaacuuaagaacuugaccauauuauaaugccaagugaagaaacaagucacacaaaauuauauauguaauaugaccaugacuguauaaaacaaaacaacgcaagucaucuaaagacaaaaucuagagcaauacaguacaaauauuuauaguaauuguuccugaaugguagaacuguagugauucuucugcuuuucaacucuuaaauuuucaacuaguuagauuuucuugaugcuauagccacuuguuuuuguaacaaguauagugcuaacugagguauucgguuuuggaaaucuuuaaaguacagacuuuuuugaugaugggauucaauuuaacuuguuuauuuuucaauaaaaauauuuagugcaaaaauuuuugacacauaaauauagugcaaaaugauaggaacaucaugauguauuuagaaauuuuaaauucaguuuuauggguaaaacugaaaaaagaauuuuuuugcauucuaagugauaauuuugugauucuuuugaagaacuguuguaaucaaugacuaaaauuagauuuacuggugcauuuuaaacuacuauguuuguuuuauugcuuaauuuagacauguuccuauaaauaaaaagcaguaaucagaaacaacaauuuaacuccauuaauuuauguuccugugggcaugguagagaaauaacuucucuugaaacagugaaaauucuauuuucuuuauuucaguucacuaauaccauuacauguuuauaguguuuuggaauaguauuuugagacccacuuuuuguguuccagaaaaguuuuaagaaacaguuucuuucuuuucugauucuaaaacugcaagagacaccaguuaacuaaguaguccugacaaugcgugaacuuugcuguguuugacucuauguguuaaggcagagaacuaaauaaaaaacauacucucuuucuuaauuugggcauucuuuuacuauauugaaaguuuuagguuucaguggcuggccucaauaaaaugugcauugcuuuagagcaguucgaauaauaguuaaagauacaggcuuuggugucagauagaccugaaauuaaauguuggcugugccacuuuucagcuauaugacuucuuucaaguuauuuaauaccaccaaaaacuuuccucaucuguagaguaggauaacaguaguaaucaucucauaagauuaaaugagaucauucauauuuaaugcuuagguaagcaccuagcuuaugggauaauuaauaaaggacaacuguuauuaucaguaauuuuuuucaccaaguguuuacuucauuucuaagcuuuuaaguaauuuuuaaauauauacauauauaucuacuugauauuuuacuucuuugccagagucuaacuucuaguaacugcuaccuaaaaucucuuauaugaaaauaguucugcagauuaaagucagccuguuguguauuugugugcuugacuguucuaguuauguuacuuagucuagugaguuucuugguuuuucugcagaacccauuuguacaaugggaauaaaaauaacuucuuucauuguuaagaggauuaugugaauucauauucuuaaaaccugaaaaauagugguuauauaagguuuugaggaaaguaaaguuugguuuugacagugguaucuucauugucaucugugccauuauaaacccuucuguaguuugagacacuguucuaagcauuuuuuaauacguauuuaaucccuuuagcaacccuaugagguaguuagguauaacuguuuuacaaacugcugcacagagaggcagaguaacucacccauagucacacgcgaauaaguuguacagcuaggauucagacauaaguguuguagcucuaaagucugugcuauuaaucaguaauauacugucucaacccuguuuaugcuccauccagcuacuacuuugggguuuaucugggaguagagaauggaaaaaggagaaaugaucuggagugguuucuaauaguccugaagaauagaggcaguauaauuacugaggccagugguuaaucauccucuucucacuuaguuauagaaauacuauugucucucguuucucuucuguaaaucuuacaaguucaucacaggaguuuuucuagaguaucuuaacuucccuguauuaugugacagcaucuuaaccucagacugcauauccuuuuccacuaugcuccaucugagaacacaguucagaugccucaugaucuuuccuaguuuccaccuaguguuguuucuagcauccuucuauagauguugggagucagucuauaacaaugguggcagucuuauuaagugacucuguaccucaaagaucauuuauucuuuggugaaugaauuuuccauuuuagaaaucuuagauuccauuguauauuacauuaucucuucauauuaguuacacagaccaguggaccagacuaguugaagguugucuggacauuuuauuuuauggcuuggaaauuuuagugaaauuaaugaaggaaacuuccagggauaagucagaaauaauuuguguuuagcuuuaaaauguguucauaugcuuauguuuaaauagaaguuuaguagauuucuaaauugcacaucauguuuaauuucagcauaaugaaaaaaauuuaaacaaauaugucaucaucauguauacuuuguugagagcagagauuuuuuucccccuucuuccugucuuuucacugcuacuauuacccucuuuuuuguuagagacuagcauuuuugaggcugaguuucuuuaaaaaaaaaaaaaguuucuguacugaaauucaguacauuuaauuauuauauaguaaagauacuggucuuuuucacugaagaaaaaaagucacuccaaaauauaaucaaaucuccuucuccucuucccccuccacccuccccauauaauuucaucagauggcaauacuucuuaccagcucacugcuaaugaauuagugccagcuggaaaggaagaagagcauagcuaccugagguuagcaauuuuuaacuucaacacaacuugccccuucuaaaauccagcuucuuugcagaagaaaccuacaguaagggacagaagcaucuaaaucguaucaaauuuaaaggugacaagagaucugaauuaguuacagacucaugaaaguuucccucaauauauguuucuuuuugcuaauauguugugaguguucuuuuucuagagaggaacuuuagccacuuuuuccccguauuucuaauaauaaaccuuguucuacauucaguuuauaaacuugacaaaguauguuagugaucuugauguuuuuuguucugcuugagccucugaaaacaucccgugucuaauuugauuucaguguguuuauauucuguaaauguacaugggugaccuuuuacuacugaacuuugcauauuacaugcauccauuacuucacauuauaguugcaugagcacuuauuaauaggauuggcaacaguguuauuauauaaguucuggauagugaaaacucccuuauuggccacacuuccaaggauggcaccugaauccaaagaaugguaggacugcccaaaucagagagcccugcacauuguuucugucagacuggaggcugucucaaugugugauaauauaaacgauaagcaguuuugguuuuugguggcuuuuuuuuuuuugguucuaugaaaagucuggugaaaggguacuacgucuuucaaaaaacucuucugaaaauuauuuucauccaucugucuauccauuuaaaaaguauugaauuuuguccagcucuaggcacuguuguagauacuagagaucuaacaguggaaaaaaacaacaaaacaaaaagcccugcugauagaucuuguuauucuucuaguagagggugauaaguaaaauacauuaugaguuaggugauccacucuauggagaaaaauuaagcaggguaagggaauagagaguggaauaugacuuaaaauaguggucagugucuucacugagaagaugacauauaaaaggaucucaaagaugaugagguaacaaaacauauauccaggggaagacaauucuggauuggugagauuuagcagguaugaaaauucauaagaagauaccgugaauaaauuuuagguccuauaauaauuuauaguuaguaagaaaugaugaacuuuuuuuauuagcuguaaaaaugaaaauacagucugauuuuuagguaacugaauccugggaaagucaagagcgcacccgcuuuuuucuuccaguaaauggcaccaccguguauuugaguuuauucacucuuccugcccacuaacaucaauagccagucuauauccagucuaguauauucuaccuuguaugucauuucuuuucccuccucguaauucccaaugacacuaguucaguuuaggucuugucacuuuucuccuggauuauuauuauaucuuuuuuuuuuuuuuuuuuugagacagagucucgcucugucgccugugcuggagugcaguggcgugaucuuggcucccugcaaucuccgccuucuggguucaagcgauucucaugucucaauccugaguagcugggacuacaggcaugcaccaccacaccuagcuaauuuuuguauuuuuaguagagacgggguuucacuauguuggccaggauggucuugaacuccugaccucaagugaucugccugccucggccucccaaagugcugggauuucaggcgugagccacugcacccggccuauuaugucuucuuaaugucagauucaugucuaaaccucacucacuuacccccugccaagccaaacaugcuauugcuuugcuaaacuuuuuugcaguuaccaucaucuuuuguacguuguaugagguagaaaaccuuuaauucuuuguuucuuccucuggauuguuucuucacuuuacauauuuguucagucaucaaauuuuacugauugauuagaguuuuccagugccucuggaauucauuuaacucuauuuuacucucauuggucuuuuuaggggcccucauguccuccuccuugucuauuaaaaaagcuuauucacuaacucauuucucuuccccuagucucuuucaccuacauaaugaaguuuaucauuugcauugauaacaauuuuuuuuuuuuuccaaaacgaaguccaagcucucuggccuggcauuuagaaccuacuuucuccauaucuugaacacaucgaacccacaauuccuauuuaaugccucuauuccuuuguuauuugcucuauucaguaugacuccccugcuaucuuuuuuuauguaagaaauuuaucugaguugguuuucaagcucaggucagacaucuguuguacucuauaaaccuucugcccucaacucuccuauauccgccccuguacccaauaaauaacugaucuggcaugugcauucccauaguauguuuuaaaaauuuacacuacuaauucaucaauaccuucuuacuuaaaaaaaaauccaacaaugagagaucuauaaagauaaaaaguaaaaaaaugugaacuuugcuuuuuuagauucuaaucucauuucacucuccaguuguccuguaucucuugaguaaauaaauaccuaggaauagaauugcugggucauaucacaugucuaguaauuucagauuggauguuagauacuguauuacauuauccauugucugauuuuuguccuuuuccuuuaaagaguauugaagguuguuuuggguggcagguaagcugcuuggagaucuuacugaucuuuugaggcuuuuuguaugucuuuuaggauggauuuaacuguuaagcuagcuuagcccuucugaaguccacugaauguccuaggucuuuaagaaggucucuccauucuggcuagucagaaccgaaaugucucccaguccuauaugaacuggguagccaaaaacccuaguagucauucuuugccuguauuuguggagugucacuauguauuuggauaguauucaguaagacucgggaaaccccugcagguuucuagagcuuuucucuguguggcucccacaucacuggugcucugcuucacaaauagcugcuucugcuucucugaacuuuaaucuuuuucuccucaacuuaacaaggcugccauacuaugcuugguuucucucacucuacaugauggacaaaaccuuaagagguuagauggugacuucugccagaaaaccuguuuguuuuccuucccucaugauaucaguccugugcugccugcugucucaugucugaauaugguugguugaucuauuuuguccaguucucuuguuucugggcacuaguuugguaccagguacucuauuaguagaauaauaaaaugaccaucuguguguccaucagucaguuugaacaauuuucagucuuuuuccacuggaguauauuuaagcacauccaagauaucauuauuucauuucauccaaaaauacuuuuuauuauuguaagcauuccaguaaacaaugaugaaugcaaaugaugaaauaugaggccuggaguuuuaggaaaagaaaucguucugagccuuuccagaauuaugguuggagaacuaaagccucuuagucccagaauuuacauaggacugccagaacuuucuagaucaagccuugcacauuucagaaucaucucaaauggauucauccucauuuauuguaugccugcuaucuguaaaacacuugcuauacacugcuacugaagaugcuaaugaauaauuguuuaaaguuaauggcaauauaaaauaacagauugccagguaaauaucuugaaaagucauaauagcauuucaggguaaagugauuaguugucaagggaaguuuuguagauaaggagacuugaguucuauacuugggagagaagucaggacuuagguaaguuauguugcaaggaaaaacacuauaauuaauugcauucuugaaguuucuguucccccacaccccaaaucuauuagguuauuugccacauuauucuuuucuuuagcuggcacuuaaagcauuugguaucuccugcacagaagaauuugcucaaagaaauggcuguugaauuugugaaucaguuuucuguaucaccugaucuagcccucaaagcauacuugacaugcuuuaaaagcagucuucuuuucuuuuaagacuucuguguaguuuuuaugcuacacuugguauugugguuugauuuuugguuuuuaccaauuugaugagaaauuacuccccgcucaguguccugggaaguuugacuagugguugacccaucccauagaaacauuuuauuuuuuucauggcccuuuaagggccacucauuaacaugaaugccuuaucauucauuggaauagaaaacugggaggcuuuacuuuuaguuacaaaaguuaauguauggaaaauacauuaauaaaaccggcuuagcuucauuuuuccuacuuucuugugauauuuuucuuagacuugcuauugauaccucagauaaauauccagcaguuuagagauguggaaaaaaauauggcaguuggaaucagagaggcccagguuccaguucagauucugcuuuuucccaagacuuuggaaaagccauuuucuaaaguugcuuucugugcugugugucuauaaaaugagaaaaaugagugauuagauucuuaauaaguugcaacugguauuguugucuagguugccuucugaauuauguaaauauaaugugccuccauugcauauuuaugacaauuuauaaguguuuaaaaaagaaggggauucuaguucauuaacugcgagguuuuagagugaacuagaauuugaagaaugacaaaacuuuaagagguugccaaaaaauacagguguacuuguucaaaagcaagucucagauugagucauguaucaaauguaagcaauaacagacuugacuccucuggggaacuuaggcagaguauucauuuauacaauacuugaaaauuccaaguauuaacaaagauagcuucuuuaauauagcgagaaacuccuuacaucauauccuugaauaaugucauaacaucgaugagggaaaaaaauugaucccuggccagggccacugucaauauggaauuuucauauucucccuaugucuguguaguacuguaguuuccucccacaucccaaagauguacgcuuugggugaaucagcaucugcauggccccagucugagcgagugugggguaugugugugagugcgcccuccaauggaaugacaucugguccaaggugggcuucagcuuuggccccaagcugcugggaugggccguggccaccugcaauucugaacuggaauuaguggguaaauguuuuuauucaucuuucuuaaauguauguauagcuuacauuuauuucaaugucuuuuuuuuuuuuucaaaaaacuguuuguauauugcauauauaacuaaaauauaaaagcaacauuuuauaaaacuuucuagagagacaaauuccacacaagugguaagggcaaccuagugucucuagauuuguucuguuucauaaauuggauuuuaacaaauccuauguaaaucaauuuuuguaaauaaaauguaauuguuggauuuuucacauguuagauuuuugcaauaaucugagauuuacaacacuuucugauguauguucacucugauucugaaacuaaauuauauuauuggauuucauauacaguauuaaaauuaguggugguuuaccaagauuaaacuuuaaagcauaucugaaaguuaucuaucuguaaauaagacaaauugucuacagaauuaguuuuauauagucagugauguguaaaccucuuggcuuuaagaaccacaacaacuuugaaugcauuaagaaaacugucacacaauugauccgaaacugcauuaagaaaaaaauuccuacuuuuuuuuuuuuuuuuccuuucacugguuucuugucucucagggucaucguuccaugggcuguccccacccaaccccaccaaguuuccuucauugacauuucuguucuuuccuucacaaauucugccauggcuuguagggagagcaccugauuaaccaauacugagcugggaaugaccgacacuucuuagcuaguucuauaaauuuuguuaguuuguuuuuguuagccccaguuaaucucaaauagauagaaauuuagaacauuauugaggggauuauaaugggauuaaucccuuuugccuaucccauaauguauucagcuguuucauuucuuuuuguucauuugugauuuuguguuuucaaaguaaaaaaucugaauauuuauuuagaguuuacuuuggauuaaaaauauucaauuuauuagagcuucaaaauaauaacuguagcucaaacuuuuaaguuccaucuacaaaucuuaaaaaucuauucguaaaucuagcaaauuucaacacuuuuagaggggaaucuuacaaauuaaauucucuuacguauauuaauguauauuuauaaauaugccuuauaaauauauaauaaauuauauauuuuguuucuucuuaaaauacuugaauugucuaacaagcuuuguaccauuucaugagcagguauuuuugccaaagcaugauauaugcauuguguaaacaccuucauucugcacaagugcacacuaaaaacaaagcuugugggaaaaucguuggaacagaucacuuaaaacuuccuauaacuuugaacuagaggagucacaaauaauaaucuuaauaaaaguuagaaaauaauuaaauuuuuucuuuuccauguaguuucacaaagacaacugcaaguuauaaauauuuuuuuucaaauaaguauaauuuccuacugcuucccuacucuucacauucuuuuccccaguuagcuuaccuagcuuuuaguucagauucuucucagaaucguauggucaaagucugguguuuaauuucccuucauguuucuucucaaaauuuaucaaaacuaucacuaugacuuaaguuggcuggguucuauuucauuagugcaaguaaacaauaacuuguuaucacccauuugugguaaaacugugguauagcuggcucuucuguuugagaccuauagaaaagcucugaauguuuuuuuucuuucaugaguggauguguacauagcacuccugauggagauauuuaucuuuuuuaugggcaucuauauugaauccuuuggaguauaucgauuuaaaugcaaaguguagcuuagaaauaaauguuugggcugggugagguggcucacgccugcaaucucagcacuuugggaggcccaaggcggguggaucacuugaggucgggaguucaagaccagccugaccaacauagcagaacccccgucucuacuaacaauacaaaaauuagcuggugugguaaucccggcuacucaggaggcugaagcaaauugcuugaacugggagguggacauugcaguuugccgagauugcaccacugcacuccagccugggugacagagcaagacuccauuuaaaaaaaaaaaaaaagaaaaguucaguuacauuuucucuugaaaauucagguuuuuguuuucuauccaucuuccuuaccuuguauaguuuaacuuaacuuuugcucuguauaauucguacuauaacauuaguaugaauaugguagguagugcaugucaaaucuauuaucuguucuuccaaacaauuuugcuuuuagugagaaaaccaucauaauuaaaauauugaagcugguuaguuucucaagcacaugacugggaucaaaagcaaaggaguaacuguuaacauuuaauacacucaaaaugucaaaaaacauacgugcauacaucccacuuaugcagggauccacguauuaaacaucaucaauugccuggaauagcuaagacucaggaaauaaggccuccaaggggacacucaucuuuacucauuuaagacauuuguugguuuugggcuauauacaaggcaauggugugaauuagaguugauuuuuucccagucugaagcucauaguuuauuaaggggacaaaagcuaaauucagauaauaucaaauauacuguaaaagugauguguacucuaaaggagcuacagauaaauagcuuugggaggcaguuuagaaagggaauauacuuucaguguauuauugaggaauucuuuguaaagagaguagcaucugagcugagucaugagguauauuagucuauucucacacugccauaaauaaacaccuaagacuggguaauuuauaaagaaaagagguuuaauugguucacaguuccgcaggcuauacaggaagaauggcuggggaggccucaggaaacuuacagucaugacagaaggagaaggggaagcaggcaccucuuacacggccagagcaggaagccggggagaggugcuacacacuuacacacuuuuuuuuuguuuuguuuuguuuuuguuuuuguuuuuguuuuuguuuguuuguuuguuugagacagagucucacucuguugccaggcuggagugcaguggcaccaucucggcucacugcaaccuccgccucccggguugaagcaauucuccugcuucagccuccugaguagcugggacuacaggcacacgccgccaugcccggcuaauuuuuuuuguguguguauuuuaguggagacaggcuuucacccuguugcccaggcuggucucgaacuccugagcucaggcauucugcccgacuuggccucccaaagugcuaggauuacaggcgugagccacugcaugcaacugagcuacacacuuuuaaacaaccagaucucacgauaacuuacuaucacaagaacagcaccaaaggggaaauugcccucaugauccagucaccucccaccaggccccaccuccaacguuggggauuacaauuugacauaagauuuguguagggacagagacccaaaccauguaauuccacccuuguccccugccaaaucucaugucuuucucacauuuaaaauacaaucaugccuucacaagagucccccaaagucugaacccauuccagcauuaacucaaaaguccgaagucucaucugagacaaaacuagucucuucugccuaugagccuguaaaaucaaaaacaaguuaauaacuuccaagauacaaugggaauacagacauugguuaauacucccguuccgaaagggaagaaucagccaaaagaaagggacuauaagccccgugcagaucugaaacacaguagggcagucauuaauucuuaaagcuccaaaauaaccuccuuugacuccaugucucacauagcauuaaguacauuuacaguguuuuguacaacuaucacaauuaccuaguuccagaacuuuuacaucacuccaggcagaaaccauggauucauuaagcagucauucccuguucucuucugcucucagccccuagaaccauacauuuguuucuugucugugucucucuggauuugccuauucuggauacacuauauaaauauaauacagcauguaccuuuugugucuuauuuaauugcuggauacuuuguauaaauggaaucacacacuauguaccuuuugugucuucuuaauguaauguuuucaagguuaauucguguuuuagcauguaucaguacuucguuucuuuuauggcugaauaauauuuuguuauauggauuuaccacaggguguuuauccaugaaucaggugauggccauugagguuguuuucacuuuuuggcuauuggaacaguccugcuaugacuaggaguguucauagcaguuguucauguacaauuuguauuugaacaccuguuuucaauuauuuuuggguauauaccuggaaguagaauugcuagguuacaugguaauucuauguuuaacuuuuugagaaacugccagacuguuuucccacaagccauaugugaagguucugguuucuccauauccucaucaacauuuguuauuuucuggguuuuuuuuuuuauuauauuagggucaucccaaugaaugugaaauaguaucucauuaugguuuugauguguauuucccuaaugauuaaugacauugaacauacuuucauuugcucuuuggccauuuguguaucuucucuagauaaauaucuauucaagucuucuucccacugucuuuuuuuuuuuuauuuuuuuaaagaaagcuucuugcucugucuuccaggcagugucacaaucauagcucacugcauccuugauuucuugggcucaagcaauccucucaccucagucaccagaguagcugggacuacaggcaugcaccaccacaccuggcuaauuuuuugauuuuuuugugaaguugggaucucacuacauuguucaagcuagucucaaacuccugggcucaagcaauccuccugucuuggccccccaaagugcuggaauuacaagcaugagccaccaugcccugccucucccuucuuuuuaauugguuuguuuaucuuugaguuauaagaauuauuuauauauucuggauacuacauccuuuuaagauacaugauuuucauauuuuuuuucucauugucugggcuuuucacuuucuugguaguguauuuugcacaaaaaaguuuaauuuugaugaaguccaauuuauauauauauuuuguuccuuacaguuuuuuuauaucuagaaaacaauugccaaaugcaaggccaugacaauuuacgccuauauuuucuucuauuuuuuuaagaauaguuuuagcucuuauauuuagaguuuuuauucauuuugaauuauuuuuuacuuaugaugugagauaaggauccaacuuaauucuuucguaaaugguuauucaguugucuuaguacagagaauguuguuuccccuguugagugcacuuggcaccuuugccaauaaucaauugaccauagguauacagguuuauuauuaggcucuuaauuccauuccauugaucuguaugucugcccuuguaucauuaccacacuguguugguuacuguagcuuugcaguagguuuugugaucaggaaaugugaauucuccaacuuuguucuucuuuucaagauuauuuuggcucuucgggguuccuugccuuucuguaugaauuuuaggaucagcuuucccauuucuguuuuuuuuuuuuuuuuuuuuaaaagaacauugggauuuugguagaaauugcauuuaaucuauagcuguuugggaaguauuaucguaacaauauuaaauauuccauucaugaacauaauauaccuuuccaauuucuuaguucucccuuaauuuauuuacgcauacaacucuuacucauccuugggucaguuuauucccaaguauuuuauuccuuuuugaugcuauuguaaauggaguuguuuucugaaauuuuuauugcuagcguagagaaauauauacgauuucuguguugaucauguacuacagcuuugaugaauuuauuagcucuaauaacucuucuguggauucuuuagaauuuucuauauauacuauacuauuaugacaucuuugaauaaagagagucccauuuuuuccguuucuguuggaugacuuuucuuuuucuuacuugauugcugucuagaauguccaguauuaugcugaacggaaguagugagagcagcauucuugucucaugcaugaucguagcgggaaaacuuucagucaguaaacagucauuuacuguugaguaagauguuagcugugcgcuuuaucauauauguccuuuaucauuuugaagaaguucccuuccuuuccucauuuguugaguguuuuuaucuuaaaagauuauuacuauuuuuucagaugcuuuuucugcaugaauugaaaucauucugggauuuuuccccuucauucuauuaauaugauuacauuguauuacauugauuuucauguguugaaccaccauuguauucuuaggcuaaagcccacuugguagugguggauaauccuuuuaauaugcuacuggauccaguuugcuaauauuuuguucaggauuuuuuuuacaucuauauucauaagguauauugagccaugguuuccuuuucuugcagugucuuugucugacuuugguaucaggguaauucuggccucauagaaugaauuagaaguccggggaugguggcuuaacgccuguaaucccagcauuuugggaggccaaggugggcagaucacgaggucaggagaucuagaccauccugaccaacauggugaaacugcaucuaaaauaaaaaaauuagcugggcaugguggcacaugccuguaaucccagguacucgggaggcuaaggcaggagaauugcuugaaccagggagucggagguugcggugagcugagaucgcaccacugcacuccagccuagcgacagagcaagacucugucucaaaaaaaaggaaugaauuagaaaguguucccuccucuuaccuauuuuuuuuuaauaacaucuugagaaggaugaauguucauucuuauuuaaauauuguauaggucacuaauuaagccaucuuguuuuggguucuucuuuauugggagguuuuuugauuagugacucaauuucauuacuuauuauaggucuauucauauguuuuauuuccucgagucaguugggaaauuuguguguuucuaggaauuuguccauuuaacauagguuaucuaacuuguuagcauucaguuguuuacaauauucucuuauaacccauacuauuuuuuuguaugaucaguaauaauauucccacuuucauuucagacuuauaaagucuucuuuuuccuuagguuuuucaauuguauugauguuuucaaacaaccaacuugcuuuaauugauuuuucucuguuuuucuauucucgauuucauguauagccacucuaauuuuuaucacauccauccuucugccagcucuuuuacuaguuccauaagguauaaaguuagguuacugauuugaaaucuuuuucuuaauauaggcauuuuaccuauaaauuucucucugaggacuucauucacuguaucccauaacguugcauguuuguuuucauuaguuucagagcauuuccugauuucccuuuugguucuucuuugagucauugauuguuuuacaguguauuuugaauuuccacauauuugaauuuucuaguuuuucuuuuacugauuuuuaguuauauuccauuugguuagagaagauacuuuaugugcuuucagucuuuuaaaauuuauuaagacuuuuuugugguuuaauauccauucugucuuggagaauguuccaugugcauuugagaauaauauguauucugcuguuggguggcauauucaguaugugucuuaggucuaagugguuuauauaguguuauuuaacuucucuauuuccuuauuuucuguccaguucuauccauuauugaaagugggguauugaagucuccaacauuauuacacaucuauuuuucccuucaguuuuguguucuuucuucauauauuaauauuuuguggcucugaugcuauauuugaaucucuuuauaggugugguaucuucuugcuagauugacuguuugaucauuauaaaaauccuucuuugucucuugugauaguuccuaaagucuuuuguuuuuuuguuuguuuguuuguuuguuucugauuuuaccacagccacccuacuauuugcauggaauauauuuuuccuuccuuccaccuucaacuuguuuccuuggaucuaaaguaauuuucuuguagacagcuuauaaauggacucauuugguuuauucgaauccauucugauaaugcuugccuuuuaaugaaugcauuuaauccauuuacauuaaaguacuuacugauaaagaaggauuucugccauuuugcuauuuguuuucuauuaugucuguaucuuuuuuguccuggguuccuccacugcugccuuuuuguuguuguuguuguuguuuuuauuguuguuguugguuugauuuuuuugcauuguaccauuucaacuccuuucucauuuccuuuuuuguacauguuuuaguuauuaaugguuaccuuggggauuaaauuaacaucuugcauguacaacagccuaguuugaaguaauaccaacuuagcuucaauaauaucucaaaacuauguucccguacaucucccucucucccuuuuuauguuguuguuaugacaaauuacaucuuuauacauuguguaacuguuaacauagauauauaauuacuguuuuaugcacuugucuuuugagucauauagggaaaaaaaggcagauuucugaaccaaaaauacugcuggcuuuuauauuuaccuauguaauuacuuuuaucaguguucuuuauuuucuuacauggguuugaguuauugccucuuguuuuuucaggcugaagaacuuccuuuagcauuucugguaguucaggucuacuugugacaaauucccucaacuuuuuguuuaucuggaaauucauuaauuucuuuuuuguuuuugaaggauaauuuuucuagauauuucagcacuugaaauaugucaucccacuguucucuggccuccaugguuuccuaugaaaaguuggcugucagucuuacuugggaucucuuguaugugaggagucacauacaucucuugcugcuuucaagauucucuucguuuuuuugacaguuugaacaugaugugucucugugugcaucuuuuaaaauuuauccuacuuggaguuucuuggaagaaagacucuuggcuuucucagauuuggaaaguuuguaaccaugauuucuucauauauucucuuuucucucuccuugccuuuggacuuccaucauacagacaggcguugguauuuaugauguuguucccauaagucuuuaaacugggucuauuuuuuuuucauucuuuuuuccuauuucuuggauuccauaguuaaugaaaucacucaugucgaauagucacaaacuguuaauuuguugaguuuuacaggacaaaaaucuaacaauuguuaguuacuugauuuuguacacuauauuagucagcauagcuuaaaucaucacaguagaggauuaaaaacaaaacauguaccaaguguuggcucuuaaaucuucuguucagaaaugacacaaaucacuuccccucauauuuuauaggccaaaguaaaucauguggccacaccuaauuuuaagaaggcaggaaacugcaguucugccgucuguccagauacgaaaaacauuaacauuuacaguguguguucccuucccuacuccauccccaauccauuccuuagcauucauuccauuauuucuacgugcagacagagguuacuguguuagucucuuuaacucuaauuuucaguugcuuagagccuuaaauauuagaguuugauuaucagcucccuuacuuucuuagcuuugugaucaagagcaaaguucucaauauuuguacguuucaguuuucucucugaaaaaguggagauaauuccugucucaaaagauuacaaaugauugguugagaggauguguauagaacguuuuguacacuguuucauacauaguaaaugcucuauuccuauucuccuggcauucagugcuuucauaaucuggcuucaacuuauucuucuagccucaucuucugugacucucuuccagucaucugaugcuguaccuuaucaaauuauaguugaauucuaaguaauaauauuuuuuaugagaaagucagaauuuuuuuguuacuguaauuuuuuaaaguuugcucuauuuuaguauguuuggaagacaggauggaaacuuuccugcgagauguaucucuaauuuuauaauggaagucaugaagaaauuagaauuuacuuaaauuugcuuuaaaguucuuguaauacuuuaguuguaauaaaugagaauauucauauaaagaaaaacacgguuuccaguuuuaagauagguaaugugguuucaauucuuucucuugauaaucaccaacagaaaaaaagcugaaauaaaauucccaucuuuaauuuaaacuagagguaucuccaacccuugagcuaaaaauccaaagagaaagauaaauaacuaaggaagagcaucaaacuugagcgcuuaagaaccuacaggauacugauaaaaagcaccuuguuuuaccugcaaacucagaaaggcuuagagcuuagaaggacugguacuacagaauauaggagugaggcaggggccaucaacauagagauugcuugaaaacacugaauaaggauuccuauguucccaccucacaggaaauauacugucugguuuaacaauauguauuauauuuaacagaagagugagaugcuaaaguugucauagugccucuuuacccugcuuggcuccagacuucugucuuucacgcuuugauaucccaggcagguuugagggauccuuccuggagaaauggaaccacugaagaaaaacugcucaacagguacuaguauuugaagaccucaaaaaagugcuggcuggccacuacccugcugaaguccaccaguugacagccugcagacacguagucaccuuuuuauuguuaaccucuaaaauaagaacaaaggacuaaacauuguuagccauuuuaggaaaguuuccaguguaacuuagaaacacauaccagaaaaaaggaacuuaaaguaaacagauacuugaaggaaugaaaacaguuugaggaaauaauuaacaaccuuagacagauuuuggcuaaucaaacaagguaggaugguuuaagaaaacggggggaguggaugagaaaauucucagaaugaaaaguacaauaguagaaauauauucaguaaaagcauugaaagaaacaguugaggaacuuucccuggauauagaauaaaagacaagaauaagagagaaaagagaaaauuagaguuuaauaugagguuuaauaucuaacugacuaggaguuguagaaagagagaacagggaauggagaagcuuauuauuauauuaaggaaacaaaacauguaaauuuccuagaguuuaaacuaaauacaucaguagauugaacaggucuaccaggugcucagugcaaugauaaacauucacauacuuguagaaaaauuaauuauuuugaaauuucagaacccaucggauauauaaaaagaagauccuagguacuucagaggaaaaagagcuagucugugaauaggaaugucauugaacuccacagccacacuugagaaucuaaaaggacauguccccaguguacuuaucucccagauucaaaaguugucaacaucccccucuccccaugcaugcauacuuuuuaauuauuaaagcaacuuucauauacuauaucauucaacccuaaaugcuucuguuuugucuguaacagguagacauuuuaaggaaaccaaaccacaauauuauuacccaacagaauuaauaguuuauuagugucaucaaauacucagucuguguucaguuuucccauuuuaacucagagcuguuauuuuaggaguuggucuguucaaaucaggacauacgucuuuuuuguuuguuuuccuuuuuaucuuuauuuuauauauauauauauuuuuauuauacuuuaaguucuaggguacaugugcacaaugugcagguuuguuacauauguauacaugugcuguguugguguucugcacccauuaacucgucauuuacauuagguauaucuccuaaugcuaucccucccugcugcccccaccccacaacaggaccugaugugugauggucccuuuccuguguccaaguguucucauuguucaauucccaccuaugagugagaacaugcgguguuugguuuuuuguccuugcgacaguuugcugagaaugaugguuuccagcuucaucuaugucccuacaaaggacaugaacucauccuuuuauauggcugcauaguauuccaugguguauaugugccacauuuucuuaauccagucuaucauuguugaacauuuggguugguuccaagucuuugcuauugugaguagugccgcaauaaacauacaugcgcaugugucuuuauagcagcaugauuuauauuccuuuggguauauaccuaguaaugggauugcugggucaaaugguauuucuaguucuagaucccuaaggaaucgccacacugucuuccacaauaguugaacuaguuugcagucccaccaacaauguaaaaguguuccuauuucuucacauccucuccagcaccuguuguuuccugacuuuuuaaugaucaccauucuaacuggugugagaugguaucucauugugguuuugauuugcauuucucugauggccagugaugaugagcauuuuuucaugugucuguuaaagagcuucugcgcagcaaaagaaacuaccaucagagugaagaggcaaccuacagaaugggagaacauuuuugcaaucuacucaucugacaaagggcuaauauccagcaucuacaaaggacucaaacaaauuuacaagaaaaaaacaaccccaucaaaaagugggcaaaggauaugaacagacacuucucaaaagaagacauaugucuuuuuaaguuuccacugaaaggagucuaccucuguguuguuuucugucuuaagcuuucuagcccuauuugaauuuuaacuucuguauauauauuacuuuggaaaauaaaauuuaacuuuaaaaccagauauauuaauacaucgaagacaucucaguaaaucaucacagacuguguguucagcaguuuaaaugugacuccuauaaacuaauuacuuucauguccuuuuuacaggcugucacaucagucagacauguuaguugaacacgaaccuguaugguuaaacauuagcuaguuuagucauuuagacuuagaaggaauuaaguaaguacuccaguucauaguaguagcaggauagaaugguaauaaaucaccacaaaacuuuauaagaaaaauagucuguaacaaaaaaauaagcaaaaauaaguaagaaagaaaacuaaaaaaaugagcaucaaaauauauuucccaaagccaggaacuuugaaagcuauuggacuuguuugccucuuugugcauauuuuaauaguaucgacaaauuauaggaauguacuugacuggaaagggagagaugacaucagcaggcuaauuguugccacaagugauagcugauggugagagacagauaacuguuaaauuccagcacaggcacugaagaagauacuggucuaccaugccauguggagauaaagaauacaaaacaaccuguaguccuuugaagggucgugugugacaguucaguuaaguuggcauugacccagcacucuacugcagcuauuugaugccagggauuuaaaauuuuagguauuuagcuacuuauuacuaaguaacuugugaaacaucuccuaauugcacccuugaauuucaccuuaauucugauucacacccaaagaauaggaaugaaggauaagguguggaguaaguaaagaugaagccacacgauuuggaucacugggacagauacuguauagaaugauacuuuuuuccauaguuguccaccuuagaaagggcccucaggaauuuuaaacaaaaugccuguugguucucuuuagaguuaguucacuuuuauuucaaguggguuuuuuucucagauucucugcucuucuucccacccuccuaacacaaauuacauuggucaaacauuuauuuccaauugauaaguagauaaugucugcuauaauagaauuuaagucuguuuuucauuugagaaucugaaggaugaauaccugauuuguaaguuuuauuucauuuacuuuauuugauuguauguguauuagccacagaauggaggcaaauucagcaucuuucuuuaacucuaugcuguuuguuuuagaggaaguccacaaaugaaggggacaccccauuuuaaggaagaacagugugcuccagcauuaaauuuggagaugaggaaaauacuggauuuacaagcacccaucaugagguacaguacuuugguuaaauuugacauugugugaugacaguagacaauguaguucguaaaucccaugaccaacaggaaaguuaguuuaauuucuuuuaauucaagauaacuucuuaguucuggaaaugcuugauuaacccuuauaagacaauggaaguuuuacagauggcacuuaauacuuaaauuauuauaauaaaauugaauauaccaacuauaaucuuauuuugaaauuuauauuuuauaaggucuagaauuguuugauugagugauaacaguccauauuucccaaaacaauacugaugaaagcacacaaguugaggaaaagagaaagugccuuuguuuccaaaguugccauaagcuucugggaaguuuauauacacuuggaagaaaguuacacuuuuucauccaaguaugaauaaagguuuuaugacaaaguggccagaaauaccagaauaccaaaaaucuauuuuauacccauugguagaaaaaaucuuaccuacaauuuggcuuuauuucuuuaauuguuguuccacuauugauguuuuaguugucacuuaguuuagcugcauaucuuuuccauuguguagauauaagaaaauuuauuuaaacgauacgcagcuguaaaaacauugaggacauucuuuauggaaaaaaaucuuuccaaauauguuguugggugaaaaaagcaaaaugcuuauguugcuaauguuuguuuuuaaaagggagaugagguaucuccaucuuguuuaaaagagagagcauguauuuuucuggaagaauacauaagaaacuggggaugagaacugaguagcuaugggacagguuugggggaaaagcuuuuuauuguguacucuuuuuuaauauugaacuauguaaauguauugaauuauaugaaugucaugcuacuuuuaaaaaaaucccucugacucacaguucuaaguaaagguuuauuucaccauuucucuuguuagaguacuguacagaaugauacugaaacauuaaaacuaugcaaguggcuggguauugucuugccuuguuugguccauccccuucauaucuuauucucauagaaaagaacacaauuauuauuugcuuaaauguaaucaguguuacagaagauugaguucaaaguuacucaucgccuuggucacaagguuauucaucacuucacauuuuauuuauuucagcaugggaaucguuuucaagaaaguaacuugauacauaaggaauucugagugucuguagguaccaagaaaagguggaauuguacaggcuuggcuuucuaccuccaccuggugggaaaccuuguauggugcauggaaauagaauagaaaaagagccaaaaagaaaaaaaaacaauucugccaucuuguccaaguuuaaccugucaggugcuagguuuuaaucuaugaauuuaggugguuggaaaucuguaagguuucucucaaaacuccagugaaauaacugcauuucagaacaaaguuaucagcaccugaaacacauaacugcuggaaauuugaaauuugcuauagauuuuaaaucgagugagaagacaugaaacuuagauuuuuauaaccaauuauuuucccuccugucaccacaaauauaagucagauaaggcuaggauauugguuaugcuguugcuuauagggguaagaguacuaucucaucuuuuauuuuugauuugaagaaaaaauauuaauguuaagcaucuaacuuuuguuauuaauugaggauagagaauguuuagaagguaaaaacauaauuuuaaugagaguuuccccuccccucccuuccccuccccucccauccccuucccuaccucucuccccacuccuccgacagggucucaccuugucacccaggcugaagugcaguggcacaaucacagcuaauugcagcggcaugaucacagcucacugcagccucagccuccugggcuccagugaucucaccucagccuaucaaguagcugggacuacaggcacacgucacagcacgcuaauuuuuuguacuuuauuguagagacaagguuucaccauguuguugaggcuggucucaaacuccuaagcucaagcgaucuccccuccuuggccucucaaagugcugggauugcagguguugagccaccacacccagccaagauccuaaauuuaaacauacauuuaacacacacgcacaccugggauaccacauagcucucauaaaauuaaugaagucaaugauugaagaggcucucuaaggauauaacuuagaguguauuuaccuaaauuuuuaaauguacucauuaacaguugugauauuaaaaauauuucagaaccaggcugggcacgguggcucaugccuauaaucccagcacuuugggaggccaaggggacagaagggcagaucaugaggucaggaguuugagaccagccuagccaacauagugaaacccugucucuacuaaaaauauaaaaauuagcugggugugguggcacacgccuguacucccagcuacucaggaggcugaggcacaauaauugcuugaacccgggaggcagagguugcagugagcugagauugugccacugcacuccagccagggcaacagagacugugucucaaaagaaacaaaaauuuaagaaccaauacagcaugaaaagacauggguuauuaguuaucgaacaggguucugacaucgcccuacuacgccaauaaugaauccuucaguuggccagauuuuucugagggaggggagucaguuguagcaaacacuuaggugacuuggggcaaggucuauuuaccaacauuuauagaauuauuaguauuuuaacaacugacaccagcuuuuuuauuucuaaauuuuuuuagaggugguagucucacugugcugcucaguuggucucgagcuccugggcucaagcauuccuccugccucagccuccuaguagcugggauuauaggcacaagccaccacgccuggcucagccuuuguuuuaacaaguuuguccacuuucaauuaaaugagaaggauauaucuaucucuuccuguagauuauuuauuaugucugucacaguuuuuaaaaagccuaucugcuaauuccaauaucaagauuaucuauaagucuauuuauauugauggauuuuucucuugacucuagguuacauuuuccuguuuauucacacaucuggccagucauuuguuuguugcagcaucacugauuaucauguuauagagauuaugaacucuuaauuuugucagacgauuguugaguuuugucuagcagguagucagauuacuggaggauaacucuguuguauacagugauuuucuagggagauaggguuaggggagagggagaauguaguuuggaauaaacgaugcugacuccuuccaaggaaaaucacugguaaaccagugacuacucugcuaaauugccucucuugacauugucaacuugaaguaaucaaaaggaucagauucuggaauuaaugcaagcagaaagcugaccaauccgggagaacagacuucagaaaauggggucaguguuccaaaguuaaaaguucaguucuugcaggccaggcacaguagcucacaccuauaaucccagcacacugggaggccgaggcggguggaucaccugaggucaggaguucaaaaccagccuggccaacauggugaaaccuugucucuaccacaaacagaaaaauuagcugggcgugguggcgcaugccugucaucgcagcuacucaggaggcugaggcaggagaaucccgggaggcggagguuucagugagcugagaucgcgccacugcacucuagccugggcagcagaguaagagacuguuuaaaaauaaaaaaaaaaaaaguucagccaggcgcaguggcucacgccuguaaucccagcacuuuggaggccaaggugggucgaucaccugaggucaggaguucaagacgagccuggccaacacggcgaaaccuugucucuacuaaaaauacaaaaauuagcugggcaugguggcgugcgccuguaaucccagcuacuagggaggcugaggcaggagaaucacuugaaccugggaggcagagguugcagugagcugagaugguaccacugcacuccagcuugggcaacagagcaagacuccgucucaaaaaaaaaaaaaaaaaaaaaaaaaaaguucaguucuugcuuauauagguggaaaauaaaguuuaguaggauuauaauguuuucuauacaaggcugguuuaugaguuacaauuuaguuacaguuuguuuucuuuauggcuugucuuuacagcuaguuuucauuuccaauuuaaaaagaguguauuuaacauuccauuuuaagacaaugugauagccaugaagucuuuguguaagaaagauaagagggaaguuaaucuaccaugaagaucaacagugaagagggaaggggucuucccuggagcccuuuagucauuuacagcauuuauaaaacaauacaguaaggaagaaagcuaaucuauaaucagagaaagaaagaugacagcugccuagauuauagcugccuauugugugacucaggccccauaauuacauuucuuuaaggcucaaaaguaauucagauuuccaacagcuuagauuuugaauuacauauuuucauagcauauaguagugcaucuaaaacauaaacuuuuuauacucuacccaccaaaugauacacauagauuuuaucacugaaauauaaauuugaaauuaauauauaaugcuuuaaaaagugaaaugucuaaaaacugggaauuuuaauugauuacaaauggcugugaaguucaagaaauagagcuggguaaagaaacaucuguuucugaucuuuuucaguauuuuuauaguuggggaaaaaacagcaaauucuacauuagcugaaaucuuuggaguaugaguaauugaagucaacuuuccaaagaauuaaagguuuaguuuaagaauuaaaauacuaaaagacauuuuuuucaucauuauggauuaaaauauuucagaaauaugcucuuaaguaugaaaaggaauuuaauaguauuuaauaggguauauauaauauacacauaacauuuuuuguuuuuccuuauauaguauuugauacuuugaacacucuuucuuaaauucaucuuacuuccuuggcuuucuugauaucaguuucuacugguuucccugguugucuuuuucuuugugccaguaccuuugcggucucauuuauggguuccucuuuccucuaacccuuucccucuucuugccuccuuugcacaaauauuuagugacagauuuaacuaacacugcccuuggggcugugcauacagaggugagcaaaacaggcuauuuccccauuaaagaaguaaaugcugaauaucuucauaaauauugauaagugaugagaucaugcuauguaacuauuuuugauuucuugccugagaaguccucugaagacggagaauauuuuauucauccucgaauauccagcacacaguauagcaccugucacagaggauaggcucaguaaauguuuguagaaggaaugaacaaugugagacuugcuaauaccuaagaaauauauuggccuggaacuauacuccaauacaguagccacuagucacacaugaauuuauuuaaauuuacauuaaugaaaaguaaauaaaauuucaguuauuuuauugcacuagccauauuucaaguguauagucaccacauacagcucauagcuacuguuuacagauagcacagauauagaacauuuccaucauuauucaaaguuuuauuggacaagugccagagcauuguuaccucuacacuuaauggcucuagauugucauacuguuauuaguuggguuuauucauuuuaugguuucucuaccucuuuuucuuucuuucugcuaucacuucuguuuccaucuucuaauuugcuguuucaauauuuguaguuuuuaacuaguuuuaucaguuaucaaguuugugacugugagugcccauagucuuucauuucuuucaggauuucugauucuagauugaaauauacauagauaaaguugcagauaaauggagauguuuuguaaaugguuucaugaucauuuuugcaugaguauucucuaaagcaguuuuaauauucauacacauugcuuucccaguaugcucucuuaaaaauuaauugauucuaccuacaguuugcagucuguguuggaagaucuccugguugcuacuucugauggacuucuucaucuuauucacugggaaggaaugacaaauggaaggaaagccauuaaucuuugcacaguacccuuuucaguagaccugcagucaucuagagguagcuauacuuucuacaugagguugaaccaguuguuuaauguuugaugucuaguuagguaucuucuauggaugaacacuucuuuggaauuacuuaugcaaggggagaggugggcagaguaugagaggcggggugagagaggcauuuaauaggaaaggacaguuuaauuauuuaggguuguuaggucauuauuuuuacccuuuuaaacuuacagguuuuucuggcaaaaagugagagaguaauuuauuauauucuuaauccuauuucaugugcuuauuuuuuucaucaguagguucauuccugggcuucacagacguacacaucagagacauggaauacugugccacacuugauggguuugcuguuguauuuaaugaugguaaaguuggauuuauuacaccagugucaaguagauuuacugcagagguaugacuuauuuacuuugaaggguuuuuuguuauuguguacuuauuuuauucuuuguuaucaaauucuucucuauuuucaucauucauguaagauuuuaaggguuguuaauuuuuuaaucaaaccaaacauauaaauaguauaaguagacaaaauucucuuggacauguuaaagaaaaauaaugauuccuguucuccucccugcucuccucaugccuaauuuuccacuuuuggaggcaacuacuuguuauuccuuuacugguuauuuugauuuuuaaucuccacuacucugaauauuuccuuuaauuuuuaguucuuaggcuguguuuauugacuucuuacuguugaaagugaccauuuacuucccucuucccugcuuccaccauacuuauauucuucucauguucccauuauaguuauugugauuuugauuagguuacuauuaauuguuuauauuuuuaucaauauguaagccccauuaguaccgaaaccaugugguacugacgcagaaguuuuugcuccuuaguuuagcuaaaagcagguucuugucacacagccaggaaagauuaggcaugcagacauacugaaaggugaggagagcagaauuuauuaaaagcaagcucucagcaaauaaagaugauguccugcuaacaggcucccacuucacagauugauuaccaaaccccagcacacacgcgcgugcacacacacacgcugaagagccccaggguccuacccgcugaacaaggcgugaacuuaaccccauucuccuagugcgcuugugggcauuauucagaaagaaucacucaggaaacggcaaacgggcaguuauuuaucccucuggaucaccaguuucaucugggacaaggagucccaucuuucagccuucaggcacuuuuugggcuugaaaguggguuuucacuggggacccuuggccaacuccugucucugucaguauaauuauuuuuccuuuacugcagauuuuuccuccugcuaggaauuaaugauugccuuguucuuuacauuugcuuaauuuuuguguacuuaucucuuacucaacccaaacugucaguuguguaaauauccucccagcuuuuucaaacauauuagcuguucuguucauuucaucuuuuuuguuuucuuuuuuuuuuuuuugagauggaauuuugcucuuguuguccagacuggagugcaguggcacgaucucggcucaccacaaccuccgccucucggguucaagcgauucuccugcuucagccucccgaguugcugggauuacaggcaugcaccaccacgcccgccuaauuuugugucuuuaguagagacgggguuucucccuguuggucaggcuggucuugaccuaccaaccucaggugauccacccaccucagccucccaaugugcugggauuacaggcgucagccauggugcccagcccauuucaucuucuucuucuuuuuuuuuuuuuuuccacaguaccacaaaacaauuuaauggaggaagagauuuuuuuuuuuuuuuuuuuaccccgaggaacuauaucacuuaaggauggcuuacagaaggaaugagcuugcaaaaacuauaagagagagagaguguguguguguguguguguguguguguguguguaccuaugcaguguaugugugggucuauagguauguaucacacguccacaugcauguucauagccuccaugcacauguaaauauuucuucacauaaacuuuucugacuuuaauacuagaaagaacuuacacugguuuucugaagcccacugugauaucagagaucccuuucuaaaucuaucuuuuuauuuacuuuuuuaaguucuaggguacaugugcacagcgugcagguuuguuacauauguacacaugugccauguugguguucugcacccauuaacucgucauuuacauuagguauaucuccuaaugcuaucccucccccccucgccccaccccacgacaggcccuggugugugauguuccccaccuuguguccaaguguucucauuguucaauucccaccuaugaaucagaacauacgguguuugguuuuuuguccuugcaauaguuugcucagaaugaugguuuccaacuucacccaugugccuacaaaggacaugaacucauccuuuuuuauggcugcauaguauuccaugguguauaugugccacauuuucuuaauccagucugucauugauggacacugggcuugguaccaagucuuugcuauuugaauagugccacaauaaacauacaugugcgugugucuuuauagcagcaugauuuauaauccuuuggguauauacccaguaaugggauggcuggaucaaaugauauuucuaguuuuagauccuugaagaaucgccacacugucuuccacaaugguugaacuaguuuacagucccaccaacaguguaaaaguauuccuauuucuccacauccucuccaggaccuauuguuuccuaaguuuuuaaugaucaccauuuuaacuggugugagaugguaucucauugugguuuugauuugcauuucuuugauggccagugauaaugagcauuuuuucaugugucuguuggcugcauaaaugucuucuuuugagaagugucuguucauagccuucgcccacuuuuugauggggugguuugauuuuuuucuuguaaauuuguuuaaguucuuuguaguuucuggauauuagcccuuugucagauggguagaugguaaaaauuuuuucccauucuguagguugccuguucacucugaugguaguuucuuuugcugugcagaagcucuuuaguugaauuagaucccauuugucaauuuuggcuuuuguugccauugcuuuugguguuuuagucaugaaguccuugcccaugccuauggccugaaugguauugucuagguuuucuucuaggguuuuuaugguuuuagguccaacauuuaagucuuuaauccaucuugaauuaauuuuuguauaagguguaaggaaaggauccaguuucagcuuucuacauauggcuagcccguuuuaccagcaccauuuauuaaauagagaauccuuuccccguuucuuguuuuugucagguuugucaaagaucagaugguuguagaugugugguauuauuucugagggcucuguucuguuccauuggucuagaucucuguuuugguaccaguaccaugcuguuuugguuacuguagccuuguaguauaguuugaagucagguagcgugaugccuccagcuuuguucuuuuggcuuaggauugucuucgcaaugcaggcuguuuuuugguuccauaugaacuuuaaaguaguuuuuuccaacucugugaagaaagucauugguaacuugauggggauggcauugaaucuauaaaugaccuugggcaguauggccauuuucacaauauugauucuuccuauccaugagcauggaaaguucuuucauuuguuuguguccucuuuuauuucguugagcagugguuuguaguucuccuugaagagguccuucacaucccuuguaaguuggauuccuagguauuuuauucucuuugaagcaauugugaaugggaguucacucaugauuugguucuguguuugucuguuauugguguauaggaaugcuugugauuuuugcacauucauuuuguauccugagacuuugcugaaguugccuaucagcuuaaggagauuuugcgcugagacuauggaguuuucuagauauacaaucaugucaucugcaaacagggacaauuugacuuccucuuuuccuaauugaauacccuuuauuucuuucuucugccugauugcucuggccagaacuuccaacacuguguugaauaggaguggugagagaggacaucccugucuugugccaguuuucaaagggaaugcuuccaguuuuugcccauucaguaugauauuuguggguuugucauaaguagcucuuauuauuuugagauacgucccaucaauaccuaguuuauugagacuuuuuagcaggaaggacuguugaauuuugucaaaggccuuuucugcaucuauugagauaaucaugugguuuuugucuuugguucuguuuauaugcuguauuaccguuauugauuuucguaucuugaaccagccuugcaucccagggaugaagccaacuugauagugguggauaagcuuuuugaugugcugcuggauucgguuugccaguauuuuauugaggauuuuugcaucauuguucauaagggauauuggucuaauauucucuuuuuuuguugugucucugccaggcuuugauaucaggaugaugcaggccucauaaaaugaguuagggaggguucccucuuuuucuauugauuggaauaguuucagaaggaaugguaccaguuccucuuuguaccucugauagaauuuggcugugaaucugucucguccuggacuuuuuuugguuaguaggcuauuaauuauugccucaauuucagagccuguuauuggucuauucagggauucagcuucuuccugguuuagucuugggaggguguauuuguccaggaauuuauccauuucuucuagaguuucuaguuuauuugcuuagagguguuuauaguauucucugaugguaguuuguauuucugugggaucgguggugauauccccuuuaucauuuuuuauugcgucuacuugauucuucucucuuuacuucuucauuagucuugcuaguggucuaucaauuucgucagucuuuucaaaaaaccagcuccugcauucauugauuuuuuugaugguuuuuuuaugucucuaucuccuucaguucugcucugaucuuaguuauuucuuaccuucugcuagcuuuugaaugugucugcuccugcuucucuaguucuuuuaauugugauguuagggugucaauuuuagaucuuucgugcuuucuguugugggcauuuaauccuauaaauuucccucuacacacugcuuuaaauaugucccagagauucugguauguugugucuuuguucucguugguuucaaagaacaucuuuauuucugccuucauuucguuauguacccaguagucauucaggagcagguuguucaguuucauguaguugagugguuuugagugaguuucuuaauccugaguucuaguuugauugcacuguggucugagagacaguugguuauaauuucugguuuuuuacauuugcugagggguacuuccaacuauguggucaauuuuggaauaagugugauguggugcugagaagaauguauauucuguugauuugggguggagaguucuguagaugucuauuaggaccacuuggugcagagcugaguucaauuccuggauacccuuguuaacuuucugucucuuugaucugucuaauguuuacggugggguguuaaagucucccauuauuauugugugggagucuaagucucuuuguaggucucuaaggacuugcuuuaugaaucugggugcuccuguauugggugcauauauauuuaggauaguuagcucuucuuguugaauugaucccuuuagcauuaugcaauggccuucuuugucucuauugaucuuuguugguuuaaagucuguuuuaucagauacuaggauugcaaccccugcuuuuuuuuguuuuccauuugcuugguugaucuuccuccaucccuuuauuuugagccuaugugugucucugcacguaagguaggucuccagaauacagcacaaugaugggucuugacacuuuauccaauuugccagucugugucuuuuaaucggagcauuuaguccauuuacauuuaagguuacuauuguuaugugugaauuugauccugucauuaugauguuagcugguuauuuugcacauuaguugaugcaguuucuuccuagcaucgauggucuuuacaauuuggcauguuuuugcaguggcugguaccaguuguuccuuuccauauuuagugcuuccuucaggagcucuuguaaggcaggcuugguggugacaaaaucucucagcauuugcuugucuguaaaggauuuuauuucuccuucacuuacgaagcuuaguuuggcuggauaugaaauucuggguugaaaauucuuuucuauaagaauguugaauauuggcccccacuaucuucuggcuuguagaguuucugcuuagagaucugcuguuagucugauaggcuucccuuuguggguaacccgaccuuucucucuggcugcccuuaacauuuuuuccuucauuucaacuuuggugagucugacaauuaugugucuuggaguugcucuucucgaggaguaucuuuguggcguucccuguauuuccugaauuugaauguuggucugccuugcuagguuggggaaguucuccuggauaacauccugcagaguguuuuccaacuugguuccauucuccccgucacuuucagguacagcagucagacguagauuucaucuuuucacacagucccauuuuucugggaggcuuuguucauuucuuuuuacucuuuuuuucucuaaacuucucuucucacuucauuucauucauuugaucuucaaucauucgaucaaaucggcuacugaagcuugugcaggcaucacauaguucucgugcgaugguuuucagcuccaucacgucauuuuagguccuugcuacgcuguuuauucuaguuagccauuugucuaaucuuuuuucaagauuuuuugcuucuuugcaauggguucgagcauccuucuuuagcuuggagaaguuuguuauuacugaucgucugaagccuucuucucucaacucaucaaagucauucuccaucgagcuuuguuccauugcuggcaaggagcugcguuccuuuggaggugaagaggugcucugauuuuuagaauuuuagcuuuucugcucugguuucuccccaucuuugguuuuaucugccuuuagucuuugaugaugcugacauacauaugggguuuugguguggauguccuuucuguuuguuaguuuuccuucuaacagucaggacccucagcuguaggucuguuggaguuugcuggagguccacuccagacccuguuugccuggguaucacuagcggaggcugcagaacagcacauauugcagaacggcaaauguugcugccugauccuucuucuggaagguucaucuuagaggggcacccagcuggauugaggugucaguuggccccuaaugggaggugucucccaguuaggcuacuuaugggucagggacccacuugaggaggcagucugucuguucucagaccucagacuccgugcugggcaaaccacuacucucuucaaagcuguuagacagggacauuuacgucugcagaacugucugcugccuuuuguucagcuauacccugcccccagagguggagucuacagaggcaggcaggccuccuugagcugcggugggcuccacccacuuggagcuucccugccacuuuguuuaccuauucaagccuuagcaaugguagacaccccucccccagcuucgcugccaucuugcaguucaaucugaguugcugugcuagcagugagcaaggcuccaugggcaugggacccuccaagccaggcgcaggauauaaucuccuggugugcuguuugcuaagaccauuggaaaagcgcaguauuagggugggagugucccgauuuuccauguaccaucugucauggcuuccuuuggcuaugaaaaggaauuccccgaccccuugcacuucccgggugaggugaugcccuguccuccuugggcucacacuccaugggcugcacccacugucugacaagcccuagugagaugaaccugguacuucaguuggaaaugcagaaaucacccauccucugcaucacucaugcugggagcuguacacuggagcuguuccuauuuggccaucuuggaaccucccauuucaucuucuuaaagaaauuucucugggagccuucuggccugcuccaaauuagacugcuugcuuacuauaaucuuuaacacagcuguuuuuuggccuucugucauaauuauccugagauucccuuuacucuuauuugugucggaucuuuuaauagcuaauagcuaauuaauauauggauuuggcugcugugacagagaccuaaaauuaaaauaauuuauugaaaacugugaauuuugguucguuugguuuacuauguccuuuaccauaggaugagcugacugaguuauuuacuuggggguccuccuaccuuuagagccauacccuucccucugucccucccuucugcuccccucuccccucucugucuccaguguuccuuggaaaagaguccugcaguccuuucuagaggauauauacuuggcuaccccaguauucugggauuugaguuacagaagaguuaagcuagcggguccaaauucaagaugugaaccuuuauuuucuaucccuguuuucagugugguccauaggccucugguggaggugguagggguggggguguuuuguuuuguuuuucuccaaagaaaaauauccaguuuuccguaggaguggagguaggguauuuauuggcugcucagcuuuggggaagugcucugggaggaccugguugcuucuuuaaguagguuuugaaccacuucuacuacauuuaauuuagccuuucaaagaccccugaauucccaagccuuucguguacccuacaacuuaaauuuagacguuucucagcauucuucccugucaguuaaggauucuacucauugauaugcuuuccagcuucuaaaauuuucuaaugccgccuccuauuauuuuugucuuugcugcuuuauguuuuuuuaaacaaaaacucuuuucucuucuagaaguuacaguuuuaggaguccaagaagcuaaauauuuauauucagucaucucucuuuaacuggaaaggaauuuaaguuuuuaauggccuuuuuuaauuguugucauucuguuugguaucaacuuuaauauuccuaucuacuaucuuccguuaucaacuuuauucagauaguaagguacuaaauaauguauuugugaucaccugugucagaacauaaauaagaauaaaaauaaacuuuugaugaauuagaaaaaacucuuuuuuuuuuccuauaaggugcauauauauuuguaauuaucuuugggacuuaaauguuuagacuggaaauaaaaauauuagagcugaaaaagugauugacucuuuuccaaguacuuuagaguuaguacaaaauauauucucaguguuuauuaguauguaauuaaauaauuuuuucuaauaaguuaaggauuuaaaaacuaaugaaaagcagaugggcauuacuaaauaagguauagauagaaaauacaaauuacaagaaaacaguaccuauguauuaaugguaauagggaaauaacuaaaugacauuuaacagauguguuaaaaugugauuaugucaguccucuguggagacucauucaguaggacuagauuauuaggacagaaccuccugaggacuaaaagagcuggagaaaaaauauauuuuuuaauaugcuugaagcccuuagagagcaaacaagacaguaaagaguugccagacuaagggaggccagcaauccagugagcuaagcccaauauuuaagccuacaaugaacaugaacaaauuaggcuauaugcaacaacacagauagaucuuacagacaugguaagcaaaaaacagcuagacacaaaggaauacaugcuaugauuccauuuuagguaaaaauuaaagggcaaauaauguaggcauuucuaaauuagaguauauaugggugcauguuuaagugguaaugauuuaaaagaaagaaggaggugauuaccauguaaaucuggauauuuuuuguuguaggggugugaggauacagugauugggaagggcacuauugggagacuuuuggguacucaugauucuuggccugaguagcaauuccacaaguguuugcuuugugauauugagauguacauuucauuuucauguauucuuuauuauaauucaugacagaaaaguuuaaaaaauuugaauauucuucuucuauauaacuugaagaaaaagccaaaauucuuaugguggccuucaaagcccuaauuaucugaccuccuguuacaucucuuaccacauauacuacuuuccuuucacaacccauccacuucacucuauccacacaggcuucuuugcuggucuuugagcaugccagaaaugcuccuacauuagggcuuuuacacuuguuuuauuucuuugaggacuuuccucaaaaggcauccuuauagggaaaccuguuuaauauuacauccuuccccuguacucccucuucaccagcauugcuuaauuuuuuuuguauaguauuuuuuaaccuccaguauucaauauacuuuuuuaacuugucugucucuugacucaaauguaaagcaagcauacaaguagagauuuuggugugcuaguauagccucagcaccuagagcagugccuggugaaugguaaccaccuagaaaauacuuauuguaggacugaauuucagucuaagcagcaguucagagaaauaaugcucacugcugucuuuaccauuugugacauaaaauguccaguuuuauuauuaaaauuaaaagauacaauuccuacuaaagcaaagauuccguguuuagauaguagauuauauagcugauuguggaauuaaaugaaaucuguaggauucuaguucauauaguugugauuauauuguaucuuuaauguuuacuauuaggaucauccaaaaauaaagugcuauauuauagugugccacuuuuucugcuaacugaacuaaugauuaugaccuuugccuuggaauuuaucaucuaaaaugucugugauuugacagauaggagcaaacaacugagcugaaucuauucucuauauauggagauggcauauggaaauagcauauaugcuuacuaauaaugucauuuauuuauugaaugcuuguugaaugguaggcauuguccuaaauaguuuacauguguaucuucauuuaaucuuugaaacacccugagagguaaauacgauaagaaaacugaagcuuaaaaaagaucaaauacuuauuuugaggagugaaagcaguccugagcugucaggcuuccagauaccaugcuauuaaccauuacacuauaaagaagggaauuguagagaauaguaagcaauuuugcuucuaaagaauaaaccaaacagaauguacuacuuuucacugacugagaaguuaaauacuaugugcuaggugaugagaauaauuacagugagcaaguuagaugcuguuuccgcugucaaaauguuuacauucuaacaagaaagucaucuuuauuugaauuuggagaugaauuuccauauuuuaguguuuuuuaaauaaauuaacuagcacuggacugagcugaguauuuaucagaccaauucaugagaaguuugagguuuuaagggagacuauuugguaguauuuuaagggagacuauugugguaguccuggugggauauuuuccucugcagaugaaaccaaauaaagcauuaugaaauuguauguuuauugaaggagaauuauauugacuacgguaaauuuggagaaacacuuuuuaagccuuaacuauuuuucuuuauuauagcagcuucauggaguuuggccacaagauguuguugacggaacguguguagcaguaaauaacaaguaucgacuaauggcauuuggcugugugagguauaauugauguaggcuuuugcauuuuuaagaguuguugcaaaaaauacugguuuuuuuuuuuguaaacauaagauguuccuaacauacuuauaaacugcaucaugcuaucauaauuuaucagucaaccuuaauaugaaauguaaaaguauuuuauuagauugaaacaaacaaaaguaaagggcagauuuuggagguugagcauguuaauuuguaaaaguuagcguuuucuucagugguggaaaauugaguuacaaguuaaacagaauaaaucaguuaaaguuuagguucuuuauuguuuaaaagaggauuuggaagauuuuuuuaaaucuuaauuuuuaagacaucagcauucaugacgccuucaaauuagugagugugcuuuaguuaacaagcaaauuuaaagugcacauauaaaaccaguuucuugccuuaguuuauuaaauagagauuuuagaaaaaaauugaauaaaauuauuuauucaacaaguaucuguaugccuaucacauaccagccauaguucuaagcacuugauacauuagaaaacaaagauacugaacuugguugagcuuaaauuuuagcucauaaauuuuagcuaaaauaaaacgauuauauuaguuguuauaaugccuugcaauguauauagugcuuuuuaguuuucuaaacucuuucuuaaauaaaaaauccuauguugcccucaaaaugagacuugguuguucuauagaacauauaucuaguauagucuccagccauaucaucaccacccaauuuaaguaucaaagauuuuuuuuuuuuuuuuuugagauggagucucgcucuguugcccaggcuggagugcaguggagcgaucucagcucacugcaagcuccgucuccuggguucacgccauucuccugccucagccucccgaguagcugggacugcaggcgcccaccaccaugcccagcuaauuuuuuuuguauuuuuuuaguagagcaggcauuucaccguguuuggccaggauggucuugaucuccugaccuugugauccgccuuggccucccacagugcuggauuacaggcgugagccaccgugcccggccagauuuuuuuauuaguauaaauaauucacauaaaucacuuucauuacacucuuaauaaacucuuuguaaaguagggaauccucauccucaacuuuuucucaauacauugauccucauugagcaguuaaauguagaaauacgaguaaguuuaacuuaguacaagagagaaggaaaagcuuuuuuuuaauguuuguggauuggauucagucauauuuuguuuagaauuuuaaaauguauguucaugaauacauuucaccuauaauuuuccucuuuacucuucugaguaagguuauggcugucucauaaagcaaguuaugagaaucccucccuucuuugucuucucuauucaucuuugaauguuugguagaauuugccaaugagaagccaucuagaccuagaauuuucuuauuguggauuuuuuuggacuacugauucaauucaguuuuuaaaaauauacauauauauaauguauauauuuuagauauauauauuuaaauauuauaaauauauauaauauauauuuuaaauauauauauauauuuauuuuauuuuauuuuauuuuuugagacagucucgcucugucgcccuggcuagagugcaagagcgugaucuuggcucaccgcaaccucugccuccuggguucaagugauucuccugucuuagcauccugaguagcucggauugcaggcaugcaccaccaugcccggcuaauuuuuguauuuuuaguagaacggaguuucacuguguuggucagucuggucucaaacuccugaccucgugauccauccaccucggccucccaaagugcugugauuacaggugugagccacugggcccggcccaguuuuaaaaauagauuuaagaagauucagauuuuguaucucuuccuaugucauuuuggcaaguugcauuuuuuccaggaauugguuucuuucuuauacaccuucaaacuuacuggcauaaaguuuauaauacccuuuuuauuucacauugugaaacaaaaauaugcauacaaaguaguacauaauccagauauucauaguuuuaacguuguaguagaaacacccaucucuucacaacuggaucaguaaauagaacauuacuggucuccagucacaaacugccucugcuacuuccuagucacaacucuuauucccuccuugacucacuuaguaacuggucaacauugugagauucauccaugucauuuaccaguaguuguaaucauuuuuuaaauugguuuauaaauaacguuccauugucugaauauagcauaauuuauccacuuugcuguugacauacuuuugccuuauuucuugguuucuaaaaaaggagacauucucuuguauaauuggaauaucuuuaucacaugagauaauuaaugauaaaucccuaauaggaucuaauacccaauuuauaugcaaauuaacccaguugccaccagcuaaauuucuucuauagcuccuuuguuccaaacagaaucgaucaagauucauuaauaauauuugguuauuauuucucuuuaguuaccuuuuaacuacaauaguccuuaugccacuuauuuucaugacauugacuuuuuuugagucugagucgauucuuuauagaauauccugcauccuagauuugccuuauuguuuccucaugauggcauuuaccuuguuuaucugacaccugucgugacuaaccuggaagcuaguucuuguugagcaauacagucaagugacuagaaagcccacacaucaggcauggaaaaguauuuagagaaaauacacagagacagaagcaguggcaagugugcaguuccauuuacugcauuuggggccagcacaaggguggguguuagaauccagaagaaguacuccucccuaggcuaugggcuuauaagcuacaugauugggaaguacuagcccuucccaggauaauguagguagacucuuggccuauagcuuuucagucaccucaguuuucaucagcuacgagacuacaaguucucuucuagcaugcccauggguuaggguuaaaguuuugugauucuagcuguugacauaacaaaccagugucugcuaguccagaucugccaacacuuaucaggacuaauuaccuugaacacuaggugauagcugguguccuuagaguuguguaagaagccagcuuccuuuuaggaugccaguuugcagcagaucaguauuuuaacaaccuuccuguuaaccuaaauauuuaaagguauuacuagauucugguuacacauuuugucaugggugaugauauauauuuccuaugguaucauuuaguaauaaugucaaguuguuucaguauuaaugacacuaaauuugaucacuuauggugauaauagucauaucucucuuauagagauuugcuuuggaguuaguaaguccugucuuuuuaaugaaaauauauuuuucuguuacauugggcuggugagaaauggaaggaaaaguaguuuaaagaauacaagcacuauagaauaccuaaaagauugucagacuuuuauaaguaguaacuuagcaccuacuucuuauauuuaaaacauggacuccucacuaacauuuuagagcucagcaacccaggguuagcaguugacaguugucagaugcaaagcaaaaacaaacaccugcuacccacuuagugcugucucucagcaagaguugaucuauuugggcagguagucuggaaagaaaucuuuuucagauauuuggcuucuggguaugauugaaugacagaugacauuuucccucccaccugauacagccaagaaaacggacaaaaauaugaaagagcuguuuugaauucagaacacaaacauaagguaacaagggacagugauuucugaaagaugagaaacaaaauuaucucucuguaacugcccuuaguuuuuauuauuuugaguguuuguaggcugcagcacaggauuggggagauacauccugagcugagauaagcacauggaaaucagagaaucugggaaaaccaaggcagcuagaguucauaauauagacaccaaagagguggcacaaagagagaacuucagagagcuguagagggucucucuugaauauuaaacugagacauggaagauauuagaaaaagacugaaauuaaacuucuagaggugaaaacuaugaugucugagaugaaaaacauacuguauggaacuaacaacagauuagacauugcagaagagaagauuaaugaacuugaaaaacagaaauuauccaaaauggaacacagaaaaaaaagaaaacaaaaacagaguaucaguaagcugugggacaacuuuaaggaggcuacuauugcaggucuuuuaguuagucccaguucuaauccuugagaagagguaggaccuggaugggaauggaucaaagcugcugugaagaaaccaucugauuucuccuaccaccaaaaaaaaaaaaaacaaucugguagucauaaaccagugucauccuauuaugugcaaaagcauucuuauauuaaaaagugucuuuaagaacauuuguuucucuuucucacuauaaauguugcauaaguaaucuaaaacaggagccucauuuucaaaugcugaaugugcauuaaauuuuugaacugagaauauaccaugagcagaaaugagacuuuucuguuauccucguaguucaauuuugaaauguggcuuagacguauuauagagauuuuacuucuggcuucaggcccuucagaaauuugacccuuguaaagauguuuuaaauuaaguaauuauauauaccauauacacaaaaaagcauauagauuuuaaaaauaaaauguuuauaaauuaccauccaacauaagaaauaauacaucaccagugcugaugaagccuccuguuuaccccucuucuuugauacucccuucuccaccagaguaucacuaaucugaaauuuguauacauuaacucuuuguuguauuuuuaccacaaauauauuuacuauuaauacuguauaucuacuauauauauaucaaauauguauguuuauauuuacuaugcuuuuacacacacacauguuuuauaucuuaaacguauauacuguugaccguugaacagcccagggguuagagguaccaaccccccaacacaguugaaaaauuuacauauaacuuuugacucgcccaagacuuuuaacuacuaauagcauacuguugacuggaaaccuuacugacaauauagucaauuaacacauacuuuuuauuuuauauauauuaauauuauauauuguauucuuacaauaaaguaagagaaaagauuauuaagaaaauuauaaggaagaaauaauguacuuacuauugauuaaguggaaguggaucaucuuaaaggucuucauugucaccguguucauguugaguaggcuugaggaagaggcaaaggagguaugucagguguggcagaggcagaagaaaauacauguauaagugggcccaugcaguucagauccauguuguucaaggguuaacuguauucgcuauccauguggcuaaaguucauucauuuucagugcuguaagguauaguauuauauugcuauaccauauguacuauagccaaauaaaaguucauuuuuuuccucauguugcuagauaggcuauuuccuuuuuuaaaaauuaucacaauaguacaauggacauuguacauaucucuaguaaacauuagacaauaauuucugggauauaucuggaagugaaauugcuagauuagaauaugccuuuguucaaauuuaugagaugacugcaacuuauugacaaagugguuuuguucuaguuuacacucccaccagcaaaacauaagaguucuauaaugcuuuuucuauuuguauuugucuuuuuucacuaaaaguuuuucguuguuguuuucacagugguucugugcaggucuauacaauagauaacagcacuggagccaugcugcuaucucauaaauuagagcuaacagcaaaacaguauccuggugagucuuuuuuuuuuuuuuuuuuuuuaacauuuuuaauguacugguauugccauuuguagcagaugcugauuuuaaguuaaacaauacaugucaugcuauaggucaaauauuggggcucuggguguguaaacuggcucaagucuggaaauugauugaggggccgugauucuguuuuaauaauucaaauuaguauuuuguccauuugaccuagaaguuuucugcuuguauaaauuaagugggaaugcaguaggcuuccuaucaguuucacuuccaggaacaccauaauuaauuagccaaugcccaaguucuacacaagucagacuauucugauugcugcuuugcuucugcuguccauuacaguagcuacgcccaccuuaccuuugauaguugagugccgucacuuggccccugcuaccuccggauccaguuauucccauuuuguauuuaaauuuuguaguugagugacugagguucccacuguuagaucugacauacagagaagugcaauuauaggguucuucaaagauguagcugcugcccuuguaaaucuguuuugcaaggcaucagucaaggguauaucuucuggacccucccagcugggaugaguaggucuaaagugacuaauccacuccaccuucugaaucucccuaagccuuuggaucccuuccucuacauuaaaccaagggagaucaggcauuuccagcucacucacagugggccaucuuuuaauccauauuucagcuaaccacgcaaaucaacuauuagaaccuuuuuuaacuccccgagcugcagcuuuaaaugcagaaucccuacuuagugggcccaaaucaauaaauucagccugauccaacucuguguaccuuccaucauuaucccacacccuuaauauccauucccaugccuacucuccagauuucuauuuauguaaauuagaaaacucaagcaguucccauagugcaccuccucaugggucauacucucaaccucaccucuagaggccugccaggacuuuauugauaggucuagaagcaaacagagguguugggaguggcuccugaggagaaucaacauuaucuugccuggcgacugccucaggggagggcaucacuguugccucaggcagcacaggguuuauaauccucagacaaagguggaagggcuaauggcagcauggguccaggaggggauguugccacuauuggggauggggaaagcuguuucuucuggcaaaaaaaaagguucaccagaguuuacaaacucagugaaucuagcuucaucaggguccucccacacauccccuuuccaaguugcagggucccauuuuuuuccaaucagugccuucacuuuaacaguagacaccuggugaggcugugcaugcaccuuuuguugcagaucagccacucaaaugauaagaguuugucucuguguuuccacaauuuuagcucuuucucuauaggagauaagacccucacucagggcaaucuuagcaguuuugaggcucaguaucugcuucugggagauggaaucccugaguucaucauuuucuuucaucaccuuguucacugaacuuaggagcaaccaacuagcuucauuauguuccuugauucuccacauauggucaaagguguuauguauagagucacuaaacuccuugcgucucacaagcaaugaaucaggagugccaaaugcauuuauuuugcauaacucuauauaaacaguucacgucaaggacugucagugcguacuauuagaaauagaguccuuagcauuuuggggucuaaugauauuaggcagccaacucuagaaaccccaaaaccaaugaaggaacuccauccuuaauauucuguaccucuagaaucacuccugguaccaauaucuguauuaguaagguucucuaggggacagaacuaauagaauagauacauacauauuuauaaaggggaguuuauuaaguauuaauaaaugaucacaugaucacaaggucccacaauaggccaucugcaggcugaggaggaaggagagccaguccgaguuccaaaacugaagaacuuggagucugauguuugagggcaggaagcauccagcacacgagauguaggcuggggggcuaggcccgucucuauuuucacauuuuucugccugcuuauauucuagccgcacuggcagcugauuagauugugcccacccagauuaagggugggucugccuuucccagcccacugacucaaauguuaaucuccuuuggcagcacccucacagacacacccgggauuaauacuuuguauccuucaauucagucaaguugacacucaguguuaaccaucacaauuaggauauuuaacuauucauguugacuuaguguuacccacauuuauaccaguauuuuugcccaccauaucuuugaccaacucauaccuucuucuugagaccauuuucugccugaaaaaccucccauacaucccuuggaauuucuuuuaaugaaguuuuuugaagguaaacucuacuuugggagagucugaaauguacuuauuuugcugcugugauuuaauuauaguuuaacuuggugugcuguuuuggauuggcaguuauuuucuuuuuauacauugaagaauuuguuccagugccauuggauuuccauugcagcuauugagagguccucugucaaguugucuucucuuuucaauagauuggucuuuauagcuaccuuucagaucuugucuuuguuuuuggcuuucugcaguucaacugugauguggaagggaagaauuuuguuuguuuuucaaauccugcuugagacuuaggcuugcuggaugaagauuuacaucuuugaacuauuucuggaaaauucucaaccaguauuucuaaauauuccucuccccuaaucuauuuucuggaacucagauauacauuacacuuuuuuccauguuucuuaaccuaacuuuaaauuuuuuaaaauuuuguuucucuagacugcauucuagaaauuuuuucuccaucuagguuugcugauccucuccaguuaugccuaauaauguuguuugaucuguccaucaaguucuuaauuucaguuauuguauuuuuuauuauuuaaaggcuuauuuagcucuuuuuccaaucuguaugcauccugcuccuuguuugagucuucuccuuuauuuucauuggcuauaaaaagcaguuauuuuauauucugugucuguuaaucccaaaaucugaagccuuucugagucuguuucugccaugucuugauucuuuguguucuugcucguuuguguguguauuuuaggauuuuugacugagagccgauuguuuuccuugaagcauauuuuuuguguguguagcgcuuugagaacuggauaacauuugaguuuuuccagagaggauuuaaauuucuuugcuuccgcuggucacuugggagcacuacaucagucugugacccuuugcauuguauucucuguuugaaccacauuaaauugcacaaauuacaaaucagagugaggguuuguggcuucagauuaucaagggaguauuauuuuccauucacuuccacugaugaaacaugaaaguguuccuugcuaauucuuuuccuacauggcagaggcuuuuuucucauucucucuuauaccauggauauaguccauuguagucccagcuuuacauggguaucuuuuguuagauuaccugucuugggcaagcucugagcuuuaucuccuguuccuaacaugcugugagucaucagagguagaaguaaaggucuccaggguuuggcagaaaaauucagggaacaagcacuuugucucaguauuuuuuauuguuuugaggauuuaaguauucuauucaccaucuuaguuuuuucaguguggaagucauucagggugucauuugcuguacuuccagaaauagaaauuugcuccuuacguuuuuuuaaucauucuuacuguguagcuuuuuuuaaggccugcauauguuuuuuucuaaagacagcuuuuacuguaaccuuauccuuguuuuacagaaacugauuuauacaaagccaaagacuuuuaagauuacgcaguuauaaguuaaucaagcuaauagugacuagaaacagcuuucacuucuuacaaaucaccugugcacugaguuuguucugcuuagaucaggacaaaacuaauggccuuacuaacuuuaaguaguccuaaaugaccaggauuuauuuuuggaagcagucauaccuuucuacucauuuagauuugaaaauacagauuguauuugaaaaaaaaaaaaaaacaaguauuucugaagcaacuauuuauuuuuaacucuucucacuauuuccuaacagacauuuggaauaaaacaggagcuguuaaauugaugagauggucuccugacaauaguguuguaauagugaccugggaauacggaggccuuucuuuauggaguguuuuuggagcacagcugauuuguacacuuggaggagauuuugcguaagucaaaaaagacaauuuuuagauaaaauaacuccauuauuucucacaaugcaugcauacaaaaaccuugugucagaacuucccuuuuugccuugacucuuaccuuaaaacaauuugcaaaguucauaaucuguucgaauauacugauucucugaacauucauuuuuuaaaaaauguacaucucauuccacaaaaauguauuuauuuauugaaccccugcuguauauaugacagcauguuagacacaaagcagaaucaggcaugguucugcuuuuagguaguuuauaaucuaaugagggugguaaggcauguacauaaauaguagaaaguuacguuaucucauuagguuaauguagguuagcccagugauugauaggaguagguugguaucucugcccacuucauauacuacccugaaccucaguucugaugaaaugagcacaccuuuaaaagcugcauaucucuggcaagaagucacuuggaccucggaaaauguggcugagagauauauacaccuagguguauuaacccacaguuuuguauuucaugcauuauuauguauuucuauuuuaaaggagcaaaauccguuugauuuuuuaaaaaacacuaaauuuuauguguauuauauguaauuggaaggcuguauuauauuuaguuucuguucuguuucaguuauaggucugauggcaccaaaaaagauccccuuaagaucaacucuaugguaaguacuuucuauaaaaaauuggcaugguauuaaaaaaacuuggauuuuucuucccuuuuuucacucauuuuuauuuauuuaauuuuuugagacagggucuuacacugucacccagguuggagagcaguggcagaucauagcucacugcagccucucuaagcgauccuccugccucaagcuuccaaguagcugagacucuaggcacaccacuauccacacacgguuaauuuuuuugauuuuuaguagagacguggucuugccauguugcccaggcuggcccccuuuuuucacucauguugaucugauaaaaucacaaaacuauuuuagucucagcagacucuucauuauacaguucuugcuugaugaaagucuuuuguuuuuuuuuaauuggaaggcugccugguuuucaguauuugcauuuuguuuagauguggccagcaaaccccugucaucuuuaugaugauaaugacuguucagaugaggccuuuuuuguaugugucuucucauggccugcuugcuuuuaacaugaggugaaaugcucauugggcauuuuuccuggaggacaugcacuugugcauuacuugaggauaucuguaucuauauaucuauauauauguauacaguaccuugagcauauuuuuuaaaauuuacauagauguaugucaaagagaauuauggucacuguuguaaacaauacagguugaguaccccuuaaccaaagugcuuggaaccagaaguauuucagauuuuggaacuuuuuggauuuuggaauauuugcaaauacauucuuggggaugggacucaagucuaaacacagaauucccuuauguuuuauauauaccuuaugcacauagacugaagcuaauguaaugaauuuguaauaauuuuguacauaaaacaaaauuuugacugcagcucaucacaugaagucaggugugggauuuuuuuacuguggugucauaucagcccucaaaaaguugcagcuauuggagcauuucagauuuuuggauuagggaggcuuaaccuguauuuuuauuuuuuaccuauuuucaagaguuucuguagaaaacagagauauaaaaccccugucuuuacauaacaaguuuuucuugcuauagccccucugcauaccauccuuuuuaaauuagugacuaugaggcuugucgcuucucuucucucuugcuccacagaggaagacauucuucugaucuugaguuucuuguagaauuaaaaccgccaugguugccuaaaauagugguucccaaacuuucaccaccaaggaccccuucugaugucuuugcccaccuccauaguuuaaaauaaguuuucaccacacauuucuauaaauaccaaucagugcuucugaauggcaugcaagaaccaguguuguccgucucacuaaguugauauuuuaaccacaaacuaagaaucuaagcauuauuaguuaaaacuuaggcagcuuuaucauaggaaaacauaaaaguucuauuaaacuuuugaaauuuugcaacaauucaugggcuaccccugccccuucaccauuuucuuggcuugaagauugagaaucacuaaucuuuaaaaauacuaucauggagucuaguuacagaauauuaaaacugaaugguucuggaggaauuuauuugaaccuucucauuuuacagaggaagaaacuuauaucccgagaaacgagacagcuuggccaagguaauauauacaaaaagccaagcuauaaugaagacucuagucucacagcuuccaauccaauguuuuuugcuccauacaaaacugcaucuguuguaggggcuucuuugccaggcuucuacuggguaaccuggggugucuucuguaaggaauuucuuuguauuugagaggcagcuaaauuaaagcaauagagaaguuacagagcacaguagguauuuuuaggauuaagacccugaaauuggcauuaagaaugguagguaauguuuucacuuuugcagauagagagcagugauggugauuuccucuggaguuaguuaagagguaacugaaggugugauucuugucuguguuaucacgguuucuccaaccuucacaaaucauuaauaaugcuaucauuggcuauuucagaauuugaauaauugaagcuagaaagggauacaaaagccuuuuauugcucugacuuuuuuucucccuccucuucucucuaagagcuggggugcagaaggcuaucaccuauggguaaucagcggauuugguucucaaaacacugaaauugagucugaccucaggaguguaguuaaacagcccagcauccuguuauuucaguuuauuaagaguguacucacuguaaacccuuguaugguaaguauauuuaaagcucugauuuuuuagugucuuuuguguuagaagcucagacccuucuuuaugacauauguauggcguauacuucuaaaauuggcauauuaucuucuuuucuaugauucuuguguuucuuuuuaauuuauauuaaauuuauaccaaaauuuuauuucucaacggguuguguuucuuuggucuuauuuuuuuaaaagggucauaagcaauuugacggaaagcaauguuuauauauuuauuuaaauaauuugaguaauuuagucuuuaucugaauagcauuucccaaaguguguuccuccaggcacuacuuaugagagauauuaguagcaguuccacaggauuuuuuaaaaguuuuguuuccauauaagugucaaauaaagguaaaacaaaauuguagagauugauuguagggcuccagaggcuuaaauaugccauugugcaucaugaaaauccaggaggugguauauuaaaaacaguguuccccaugcuuauuuaacugugaauuuuuaagaaauagcuuaaagaaaguaugucugaggacuugcuuuuagaaacaccgccccaaacacugccucuuguauuucuaucugaaauaguguauacuaauauuauuauauaucgcuaauauacaguaaugguauauguuacauguuagaaauguguaucuuaauaccuaccaucaauggcuuuuuaauggauauuugguacaacaaauuucuaauuaaaauuuacgaacauccauaaaaaaugugaaaauagccugaauuucagauccauuauuccacuugaagacuaaggauccccagaaaagaagagagcauuucucccuccccuuccccaucccaaauaauaauuuaaaagcacccuugaguuuuaugucaagccagcauuuggacuaaaauggaaaaaugacaaggguagggugcuacuuugucugauuucaauaguuaaugagucuacucaccuuugagaacacuggcuuucuagcugaaaucucauagucacuaagagcacuauucuuucuaauuauaacagugcaugagauuauuguguagucuuuguccucugugaagaaaaucaacaucgagauacauguacauuuccuauaauaaaacuaaaucgauguguuauuuuugccugcguaauauugaguuguuuuuauuuguuuuccuccuuugcccuuuuguuccucuuucccucauuuagaguaaccaagagcagguguugcuucagggugaggaucgcuuguacuugaacuguggagaggcuucacaaacccagaaucccaggaguucuucaacacacucugagcauaagcccagucgagaaaagagcccauuugcagauggagguuuagagucucagggauuaagcacuuuacuuggacaucggcauuggcauguuguacagguaaaucuuuaguuacugauuacuagagacuuauucuuugauaggauaucaccuggaacagauuauuaaauauuucaucuguuaacuucaggcaacugagaauccuuuuaaccauuuugucaugucccucuucugcuuuucuguguucuuguccucuagucuucucccuccuuucuuuccacuuggcguagaguguauccccaccuguuucaagucuauuaauaaugucaagaacuagaaguuuauguuuugccuucucauugagaacuauuuauuuuacuuucagccucuuuuuuuguauaaauuuagcucuacggauuugcacaggcaaaacaaaguguaauaaucucauggaaaguggcaacaucagcuaguacucuguacagcugaccuuacagucuuaaggggccacguugagguuaaucaugugacuuuggacccaaauugcagacuugugaucaguagagagcuuuauuguuaauacuuuuauuagcuaaucuuauuccaaauuauuuauucauucugauaucacuuuuaaauuaacagugucucacaguaauucugauaaacugacauuuaacauggaaauuaauucucaauuuugauaccaaguaaaauuauuuuggggaaaccaguaaguugaaguuucuuaaaagaaacuugcauacauaauuucagucuuccgacuguuuucuuucccuuuuugauagcaaaauauuuuagguacaucaaagcccacucuuaguuucuuuuagucaguuucuguuuccauaauucuuugccuuacuuugacucucuauauguuuacccuacuagccuacuucagcucccauguuauuuucaguugacuuugagugaagauaaugagagacaaaaaaauggucaugugaaagguugaaggauuaucuccuacauugacaucugguauacacuaaaagaaaaugaacuuaacuuacauuaauaaauucauagaaucaaacaauguacauaccauuuuauaauuaguaacaauuuuuaaauaaaacugcacuagcuacuuccuugacuaaaauuuuccacugcucccuucucuccuauagccauuucucugcuauuuucauuuccccauacuuugaacuauucauucuacacugaccuagcaucaaugccaguucugccuagccaggucuguguuaccagagagccaaguagagcagaggaucaaagaagguaggucuggaacuaaaaaaucgaucaggcaauaacaaaaauugaauuuccuuccagcucaaaaacucagugauucugugauucuuaagcaucuaugaaguaccccauauaagagaaacauuuuaacacugauuuuaggacuuuggguacuagcaagauuccacuguuauucuguucuuuagauagcuaaagauauuuagacagaugaacuuuuaaaacuugaguuuaccuaguuuaucaguuuccuuaaaaauaacauaaauaaugccacauugauuguuuuguacugcugaaacaaugaaaaugggcucauagaauuuuucaagcuggaaggaccuaagagaucauaaaguccaacuggauuugauacaugaggaaacugaggaucagagaaguuauaugacuuguccaguucacccagcagaguaguggcagacuuaucuuuaucaucacucuacguuaaaguaaaaaucuaauguauuuuaaaaccgagguacugagcauuaaaucacauaauacaccacugaccuugagcuaaaacuuagaauucgccuauuuggcaguuuguacuuggaguugcccuguauuucgcuggcacuccagcuacaugauucagugcaguuaugguggcgguguauagggcaguauacagugucuauauaaugcuaaacuuuuacguucuaggcuuuuuagccauuuaugaugacucccugaagaaacauaguugccugguuuaauuugccccacaauaguauccuuuuuucuaagauaagugaccacauccucugucaaaguugauuuuguuugcgugauuuauucguuguauguaugcuucuuguauagcuuagaugaacuccaacuaauucugcugcuuguucuguuucucauuuagaguacuagcuuuuuguuuguuugcuuaaaccugcuaccuuauacuccuuagcuuccagauuggaagauucuauguuacuuaugauuuuucuuuaacuaaaacaaaacaaauacauacuugucagaagcaggauugguaacuggcaguaaaggcggugcuuuuuuuuuuuuuuuuuuuuuuuuuuuuuugagauugaauuuuguucuuuguugcccaggcuggagugcaguggcgugaucucagcucacugcaaccuccaccuccaggguucaagcgauucugcugucucagccucccaaguagcugggauuacaggcaccugccaccaugcccggcuaauuuuuguauuuuuaguagagacgggguuucaccauguuggccaggcuggucucaaacuccugaccuugugauccaccugccucagccucccaaaguacugggauuacaggcgugagccaccgcacccagccaaagcaagcaccagcaagcaccagccaaggugcuuuuuaaaaaguuuuuucuuaccuauaaguuuuaaaacuuuugaagucauuuguugacauauggggcacaaacuauugaaauuuuacagaacacaaaguuucuaguuuuaggccauguuccuucuaagacugccauuuauuuuaaugcucaguauuuuguaugauguaagcauuuacuucugaaagguacauaaaucuauuauccauuguucugaggguguugguuugaugguuagcuuggcuauuuagaaagaauaagcuucacaaaauguggaagauaagcaccuacaggguaucaggcacuauguuagggauuucaacagagaguauuuaaaggcucuuucauucauaaauuauuuacugucuuccuacaguauguaucaaguguaccagguauuuggcacagaacaaaucugcuaggaggauggcucccacagucucacuaguuauagacaaaacuaaucuaggcaggagacagaguuuuagcagaguuacuuuaaaauuuaaaaaucauaauaacaaaugagggcggauucaguuucuuuaagagaaacugaaacauucuaagauaaggguagaguuucuguaccuuagcacucaguuuuccagugauguggcaugacuucagugcccugagugugcuuucaugaccuguuuuuuuugucacugaucagcugccucuuccuuacuucugccauucccuuuuaucaaguauuagagguagagcucagaguucagaugacacauagaucaauaaaguugaccuacuggagaaaauacauaguaucuuuagacacaaacugcaugaaaaauaaagcuucauucuaaacuuaacaccuuaaguuuuuaaaauacaucauuuguggcacuucauagauuuuuguagaauaaagaauaaauuguuuuauagauauugaucauagugugaucauuugauaagauuuaacuuugguucccauuauuagaaacucuuuguguuagaauccacuuuugcaguaagaucccagcuccuccauuacccacccacacguuucauaaguacucaugaaacaccaagguuugagggagguaaggauuccuuuuagugcaauggaugauugacacaguuauacucagguacauccuccugcugugagugacugcugaaaaaaguugaaaaugcuuucaaguuuuauuucaccacccaaucauuaccuuaaguguaccauuauucugaacuaauuuuacccaucauagugaucuuuuugggggucuggggggcagggagacagagucucacucuguugcccaggcuggagugcaguggugcaaucucggcucacugcaaccuccgccuccaggguucaggugauucuccugcgucagcuucccgaguagcugggauugccggcaccugccaucacgccuggcuaauuuuuguauuuuuaguagagacggguuucaccaugcuggccgggcuggucucaaacuccugaccucaggcaaucugccugccucagccucccaaagugcugggauuacaggcaugagccacggugccuggcccauagugaauuuuauuaauuuauuaagcuauugauuuaguuggauuuuaaguugacuuaagucaacuuaauaaguauaacaaauaauuaguaaguaaagcacuugauaauaagugaaguauaacaaacaguuuuaucaaauuuuaucaagguuaauacagauguuuagagcauauugcuuuuacuuaauuuucugucuucacauuacauacacaaucuuacuggguuugauugcuguugacuuagcuuuuuaauuuggcauuuaguuuuucaauaugugacaacuuuucuuagaguaaaaugaaaaauaaauuugaacagaucgaagcuuuucuuauuccaagaacagaagacucuuuguucaguucuguuaauucucgccccacuccaacaugugcucaugaaaacuaaucagcaggcuagagagaucaaucucauuaaaacgaaaauuuacuuuaucuacauugauaucccaugucaauuauuuaaauugaaagguguuguuagggugauacaaagacaccauguucaaagauguaagacagacaacguggaaaaaugaacgccuuuucuugcagauagaguuaauauuuguaauauauuaaaaguucuuguagauaaguaagucaaauaccccaauagaaaaauaauagcuuacauacacucuuucauguacauauauauauguuuguuuagagauagaauaaaagcuaaccagugguuguaccuaaguaacagagaauuucauuuugucaauuuuuauauugcauaauuucauaaguuuuuuuuuguuuuuuuuuuuuggagacggaguuucgcucuuauuccccaggcuggagugcaguggcgcgauccuggcucacugcaaccucugccucccggguucaagcgauuguccugccucagucucccauguaguugggacuacaggcaugcaccaucaugcacgguuucguauuuuuaauagagacgagauuucgccauguuggucaggcuggucacaaacuccugaccucaggugauccaccugccucggccucccaaagugcugggauuacaggcgugagcaaccacaccuggccuaagcauugcuguuuuaaucagaaaaguguaaaaguaauaaaaauauuuccauuaaaaaccagaacuuuuucugaggcuguaauuguauuagauuagguuguuuuggaaugguuuauaucagcaaacccaaacuguucaucugcacaauucauagcugcccucacaggugccuucucugaaaaucucuugucagucuguauuuauugaauucaauauuuaaaacaaacagaaacauaaggggcaaggggcagggagaggaaagccuggugccuagaaacaugaaauaacguaagauguaaaacauugauucauauacaaaugguaaauuccaagugcucugcuacuaacuagggggcaccuuaaacauuguucggcaagaugaaucucauagugugauaacuuaaugcuuuaaguuuaaauauauuucauaaguuuuaccaaucugauguguuauuuucuauagauuuccagcaccuaucuagagagcaauuggccuauacgggugaguuguuauuuuguugguguuaacuuuuguugacuagcauuugcugcaagaggcauucugggaagagcccuucaguggguguacugagaaaaauaaaacucuugaucuauuguaacauugcuaguauauuaacaucuauaauuuugucagauauaacugaauauuuggacuuuaaaauauuuaauuagcaaacauuuauuaauugucuguuugccugacacaauacuaagcucuuuaugccuaauaaaguauauagguuugcaaggaaaaguucuuauuuuuuuuuuuaaacaguuuucagcuauugauaagcuuggacagaauauugcugugguuggcaaguuugguuuugcacauuacucuuuacucaccaaaaaauggaaacuuuuuggaaacauuacccagguuagucuuuuuugagauuaaaaaccuauuucucaaaguauaagagaacuacaauaugaaauagcuauaaaguuuaucacuaaguaauuuugguuacuuauuaaaaauaaggaaaaucagauauaaaaaagugauauugaauaauauguaagauuugauucugauaaaauacuugauauuugauaaaggaucuuguguugaaauaguugguuuauuuuuaauucuuuuuaagaucgguaacuauaauuccuuagccugaggauuuauucuuacauuccagcuugaguuuaucugaugugaucagaauagauuuccacagaauuugagaucauuccaugccuauucugugugugauguauaugggauagugagugugcguguguguauguguauguguguguacauauacgcaugcaguuggaagagaaggaaaucaguacuuauuaggugccuauuguguguuaggcauuuuaaggcacuuucauauauguuaucuuacucaucugcacagcaacccagugaaggcacuacuguuacugaucuuuugauguaaacacacacacacacacaaacuaggauucaguuacucaucugauaagugauuaagccagaauuuacacuaagcccuaauggguguuagaaugaugaugcuauauagcacccaguuauuuuuaaugguauacuugccuucuuaaagaaauauuuauuuuuauaaauaggauauggaucauuauuaauaaaggcucuagaguuaucauuggagagagggggaguaagagcagaaauaauuugaucuuuggcugggcgugugguggcucacgccuguaaucccagcacuuugggaggccgaagcaggcggaucacuugaggcugggaguccaagaccagccuggccaacaugacgaaaccccgucccuacaaaauauacaaaauuagcuagguguguuggagcaugcuuguaaucccagcuacuugggaggcggcugagacaugagaauuccuugaacccaggaggcggagguugcagggagcugagaucgagccacugcacuccagcaugggugacagagugagacugucucaaaaaauaauaauaauuugagcuuugucuggguaagaauuuuuauaaauauauuacuuuguuauaauuucugguagcauaagguaaauuuuuuaaaaaauuuuuauuuuaaggagcaaaauaugaucgugacagguggcuuagccugguggaaugauuuuaugguccuugcguguuauaacauaaaugaccgucaagaagagguaaguuuuuucucucagaaauaacagauuuuuauauuuuaaagcuauuaagcaugaauuaauuuuauauagaaaauagucgauugaaaacugaacaaaacauuuuauuuuuuaaucaagaauguagcuucuuuuagguagugggauuuucuuuucagguuauuacuuuaaaaaauuauuaagugacaauugagacuuuuaagauaaccuuuucuaaggauuuuagcugucggacauucccuauggaguuugaaaauaaagaguuaaaagcaaaaaauuucaugauauaagaauggcuguccucagagauagauuuauuuaguuacugauuuacaguaaccccuccuuaauuaugggggauacauuccaagaccaucaguggaugccugaaacuguuaauaguacugaacccuauauagcacuaucuuuuuuccuauacauacauaccuaugauaaaguuuaauuuguaagagauuaauaaugacuaauaauaaaacaauuaugacaguauauuguaauaaaaguuguaugaauguggucucucagaauaucuuaguauacuguacucaccuauuuucagaccaugguugacuguagauaacugaaacugugaagagcaaagccauggauaagagagacuacuguaucugguuuuuuguuuugagaaacagcuggucuuauuauguaucaggucuaaaucugcaggucuaggccaggugcaguggcucaugccuguaauccaagcacuuugggaggcuaaggcggguggaucaccugaggucaggaguucaagaccagccaggccaacauggugaaaccccaucucuauuaaaaaugcaaaaauuauccagguaugguggcacaccccuguaaucccagcuacuugggaagcugagguggcagaauugcuugaacccggaaggcggagggugcagugagccgagaucaugccacugcacuccagccugggcaacagagugagaccccgucuuuaaauaaauaaauaaauaaauaaauaaauaaagcaggucuaaaaggaauauuuuauaauaguacauucaguuuugaucacuucauuuuuugcuuacucauagaaugagccuagucugcaaaaauauguaaacauaauccauuuacuguuaaagcuuagauaguucuuuuaacuccuguuacuaaaaaaaaaaaaaaaagucggaaguuaaaaacagcauguuuaaaguauuuggucaucccuaguaguuaucuuguuuuuauaauuuucuucauuuuuguuuucuucagcuuagaguauacuugcgaacaucaaaucuggacaaugccuuugcucaugucaccaaagcacaagcagaaacauuacugcuuagugucuuccaggacaugguaauaguauuuagagcagacuguucaauaugccuuuacaguauugaaagaaaaucugauggguaaguaucuggcauaugagaagucacuuuuugcuccuauuuaccacguuucucuuuuguaguuuuuguuuucucaaaacaguuauuccacuuuuauauucaaucuuguuuuuguuagagguaaaaaaagcaaggaguuuuaauuagugauauugauauaauagcuaaaaaaaaaagaaauaucguacacuaacuucuuuagcuuaucuuccuggagucauuugaaaaaaaucuaguuugggaugagguaaacccuuagauacuaaauuuuuuuucacaaccuugaaaauaaaugguuacugacucuccuggugcucucgauacuuggugggaauuugaaggaguucuacaacuuuaagacuguaggaagcauguccuuagcaaacugacuuauauuuccacugagcuagauggcuguagucuggggcaguaaaaaaucagcaguguuguugcugcugcacguugccuuauauuugucuuggcaucuggucuacuugcaacguauuuagaccacaccucuugaguuuuauuuuuguucucagagguuaauugaaguauguauuuacugaaacagcacagugauugagaaguaaugcaagauaaaaauuaagacaucucacuagccucaaugauugaaccaucauucuuucucaacccacuaguuuuuuccacuuaaauauuuguauucuuauagcuucuucccuaguuuucgucuucccuccuauuuguuacucccuuucuuucucucucauccccauauacucugguuccccucaaccuugccaacuuccugaucgaaggauauauggggagaagaugauagguaguaagacaucugagucuuccauaagcaugaaaucuaauacuauuacuaguggaaaagaaagaaaaucuuauuagcauuguuguugagguauguggguuucuuuuguuuuuacaguccaaauacuacugcugguauucaaguucuucaggagguuuccaugucacgcuacauuccucacccuuuccuggugguaucugucacucugacaucagugaguacagagaauggaaucaccuugaaaaugccacagcagguaccacuccauuaucaaaggucuuuggaguuuacauuucuguuuuuaguauuugaguccauauuaggaaguauuuguuuggcaaauaaauacuaagugucuaaaauguaccuuauaugagaaugcuggguugcaguggcaaauuaaaaagacaugguuucugcucaggcauuaaauaaauaauuacauacauaaugaauuguuccuguuacguguaccaaaaaguaguacacauuacugugagagcauuuaacaaaaaccuguuauagucugaacagucagagauuucuguaucauuuaaauuaaaacuaggagaauaaguagaaauuauccaaguuaagaggggauggauuuucagguggaaggaacaguagugcaaaggcccauagacaaggcagaacaugacacacucagggaauuggaagaauuuuagagugacugggacauggaaagugaaagaggauaugagucuuguagauaauauugauaauuuuagacuuuaagucuaaaguguuuuaagguagguauuauuagaucuaagcuuuauaauguuuacuguaaggaggaaaaugaacugaaguaagacaaaacuacuguagggagagcaacugggaggucauuguaaugaucuaggucagugguguucacagucugaacuugggcagugaaaaaggauauggaaagaaguagaaugaguauagaauagcaagggcuuuauaauuaguuaauuaugaggaaagagaaaguauaaucccguaguuucuggguaaaguaacaggguaagaaguagggcgaccaggacccacguugcauaacuuucuauuucagugguuucuaaacuucaugucaacugggaaccuacugucagaggaaaauucuauguggauuuauuugucaucccugucugggcagucugucuuuuacuuccuaucgaggcacuucgaucaaaccucaacacuccauaaaauaauuagaaaacagacuagacuagacuauccaguuauggggaauuuaauauuacuuauaugaaucuaaaaucaauuuuguuaccuucuaucccaguucucuauucuuuguagaagacauuguaaaagcuagucccucuuccacaugaugacccguaaaauaucugcagacaguuaacauuccuuggcuucuccuucucuccucaaaccucucugucaucuuaucugcaugcuaaauacuuccauauguccaacuauuucauuggauguuuauucuagaccccuuaagcaucuuggucucccuucuuuuuuuuuuuuuuuuuuuguccuuuuuucuuuuuuuuuuugagauggagucucacucuaucgccaggcuggagugcaguggugcaaucuuggcucagugcaaccucugccucccaggcucaagcaauucucccgccucagccucccaacuagcugggacugcaggugcacgccaccacgcccagcuaauuuuuguauauuuaguagagacaggguuucaccauguuggccaggauggucucaaucucuugaccucaugaucugcccaccucggccucccaaagugcugggauuaagggcgugagccaucgugcucggccuuggucucccuucuauagguaaaauugguuuucuccuuuaaaauauaguucccauuuccucugcaaaccuuauuuaaugguaaccaguuaguccuaauugauaagggaauauacuguuuuacagaaguuuagauaaaaggugugaaaaaaagugacaauuuaaaaaucauuuugcaguccugaggaacuaaucagucuuaucacuaaaaaugggaaaaccagauaugguaugcuucuugaggugauauaacaugaaguucacaagaauuauugccaaaaaucuugaacccaaaucaaaucaaguauagagagucaucuucccuaccacaagggagcagaauacaagacauucuguuggacagcuacaagucacuaacaugggggaagaaggagugaaucuucuagauuaaauaagacuuugaagccauaaaaaccaaaugcagugguuaaaagucauuugugaggcaaaugugauaaucacuacccugcagaaccaagucaguaagcucauuuguaucuucauucaaaucagcuaugaaaagacacuguugaaacaauuagggauauuuaaauacuaauggagagagaaaguagggaauaauuguaaauuuuauuggaugugauacuagcauuguagcuauguuagcagaugcccauauauuuuaggaaugcauauuaaacauguagaaguaaaauggguagcaugucuuaauugaaaauauucugacaaaacugaaaaaaaaauaagggauggauggagcacauaaggcaaaaucuugauaauugugaaucuggauaauggcagugugaaaguucauuauacuauucuccauacuuuuaaucauguuuaaaguuuucauauuuaaaaaaggacucuuauauaucccagauagaguaggcaaccaguggcaucaguaguccuggauaccauauuuugagagggccuuucacaaagagaaggugcuuaauuuggcuagagcagauuaagaaguuaaaauugacugauuaccauagagggaagacaaagaaugcuggagcaaaguaaguuuucauuuaauacuaaaguuuucaaaaaaaauaguaguaacagugaaaacucuucaacagcaagauagucucuccaugagagugagcuccuuguuacugaaacucucauagagaaucaucugccagggguuuuuuuaggguaagagauugaguuugggguuccuucaaauuuaggauuuugggcauacauguagcccuugcuuuuucugaaagcuuuauuaaaguugcuugagagugcuguugcagucaucuuuaacguuaucagaaaguguugaauacuaagauaggauacugauaauacccacucacugaagaaaagagaaguguacuuuuuuaaugaauuaguaugaaauguggugaaaucuaccaucuuaaaacuuaagguagucauuauaaacauuacucauauuguggugaauuacaguaaaugccuuuaaggucuuuugaaguguuuuaguguaugcaguucccagucaugcuguuuugcugcagguguuugucuuuuucuuuuuccucugccaucuagcuacauuuuacuguuauccaggugucugacucuucuaguugccacacaccuaaauuccauguucacuucucauaccuccaaauuacuuucuggauagauaaccaauuuuuuuauuuagucauuucuuuauacauaauccccuguagaaucugaaagcaguaagcaagaguaguuuguauagccaaguauuuugcaacuagaauauauaggguggcugcuguuuucuugaugaacccuaaaugaucauugguagcuuaaauucagccagccagcaugcagcaaagccugggacacaaucccacaaguuuugaauacucacucuuuccucccugaaauucuuuccuucuguuuauauagcauguauagcauugugcuucccuauuucucuuuugucuuccaaaagcucaggugauggcccgcugcucuuuuuacccuggcuagugugccugagaaacaucugucugucuccuucaguuuaccagccucaccuuuuuuuuuuuuuuuuuuuuuuuuuuugagacggagucuugcucugucacccaggcuagagugcaauggugcaaucuuggcucacugcagccuccgucucccggguucaagugauucuccugccucagccucccaaguagcugggauuacaggcaccugccaccacgcccggcuuauuuuuguguuuuuaguagagacgggguuucaccauuuuggccagguuggucuugaacuccugaccucgugauccacccaccucagccucccaccaaaugcugggauuacaggugugagccacugcgcccagccuggcccagccucaccuuuaagcuucugaugcugguacagucgucucugauuuagugauugcucacauuuuuacuuggaauucuuaagaauuuuuuuuuauuuuuucaaauuaaaugagccaaaaagaaaaagggaaacucuuugguuuucccuucccuaauuucucuuccugucuucuaucagugauaauaacuucaacuucucuagcaccucagcuaaccuggaaaucaucuuugguucaucucuuuuucuaccuuucaugucuaggauagcaguaaguucuguuuuuuaaccaaaauguuccuuccucuuuacagauagaaaugacuugauaucugagguuccuuuuaaaacagggcugcucaaaguuuaaugugcauaaugguuuaaguugcgugauagggcucaauuggaaaucauuauacuaggcucucugagguuugauugaaauuuuucauuauaaaaaggcagacuauuuccucauuucugaagucaacacccaugaaaucugccucuccucaguaaccuauccugauuaacucugauuuuuuaaauaacugucuuauucaagaaccauaaguaguggcuucuuuccugcugcucuuuuaccuggcuuucugaauccuccuugaaggucuguuaccauccagcuuuguucucauaaugucccuagucuagccagacuguucucacuuucccaauaguuccaugucuucguuuuccauuagauuaccaacccuuacucucccacacguguaugucuuccucaucugucagguucacugcauccuuuuaaacuuucuguuguuaugacagcuagaucacugaagugaucucucauuuuuauaaacuucuaaaguugucuuagcuuuuucaggauaauucaacucugcccucaaucuuaugucacuggugguguucauuaauugcauuauguguuaggcuuuguaccauccuagccagaaagcuccuuauauucccacagagccuagcagaauggcuguacauaguacaaccucaauaaauaauguagauuguuugaccuauaaaccuuauggauuggggggagaugcggaaagcauaccgauacagaaguaugaauuuagcugcuuuuucuuaaauuucaggcucguggugcagagagcauuauguuaaaccuggcaggacagcucaucaugaugcagagggacaggucaggcccacagauccgggagaaggacaguaacccuaauaaccaaaggaaacuugugaguaaaguacuagucauuucuuuucaaacauuaagaagguaugggaugaggaugaaggaaugaaacaauuuaagagaagaguauuuuaugauuuggaaaggagaaauuaaguccauaaaaucagucuuaagccucuggguguaagacugacugacuggaggauaaggucccaaaaugaucaugaaauguuccauacuccauauguuaacugcuuaggcaucauucauugcaaauucuaauggaaaaaauagggauagacuggugaaguucaugggguguuuuguuuucagauuuaaguguauauacuuuaaaaggccaggauacuuuuauuaacucuaauucuaauuagaucccuuugcuuuucccaaaaaaauauuauacuaucauuugaaagacuuaguaaacuaguaccuaggaacuuaagaaccugcagauuuaauaggaaaacaacuugauucuugucucuccuucuccagcugccauucuguccuccuguuguacuagcccagucuguugaaaaugucuggacaacgugucgagcaaauaaacagaaacgucaccuucuggaggcccucuggcugagcugugguggugcagggaugaaaguuuggcucccucucuucccuagggaucaccgcaagccccauuccuucuugucccagcggaucaugcugccuuuccacaucaacauuuacccgcuagcuguucuguuugaagaugcuuuaguccuuggugcugucaaugacacuuugcucuaugauucuuuauauacucggaacaaugcuagagaacagcuggaggugcucuucccuuucuguguuguggagagaaccucucagaucuaccuccaccacauucuacgucaacuucuggucagaaaccuuggggagcaagccuugcucuuggcccaguccugugccacauuaccuuacuucccucaugugcuggagcucaugcuccaugaaguacuggaagaagaagcuaccucacgggagcccauucccgacccucugcuucccacuguggcaaaauuuaucacugaguucccccucuuccugcagacaguuguccauugugccaggaagaccgaauaugcccuguggaauuaccuuuuugcagcuguuggaaacccuaaggacuuguuugaggaguguuugauggcucaggauuuggacacagcugccucuuaccuuauuaucuuacagguaacaauucucuucuuauaaaggggcaagaauuaaugagcuuaaacuuagaaaaauagaaauguccuguuuugacaccaugauuguguuuaaggaauucauagucaaauuuucuguuuauaucuuuaauuuggaagaauucagacagauuccuuugaauaucauaaaguaacauugcagagauauuuuuuccauuguccauaaauaggccuaaaacagauuaaugaguucagaguaguguuuugaaauuuuaauauauugaagaaauuuaauauguauauuagaauacauguaauaggaacauggaagaaauauuacauaagauuauugaaauauuacauaagaaacauagcaaagaaaguauuauuugagauauuagugaguuugagcuucucacaacaguagauuuguuuccuuucaguguggguuacugaggggacacuuauuagagcauggucauaacagagcaccuugagcuagucuuccccaaagcaagcugagaaggcucaggccugccacagcaaagacccucauagcacacaguuuuucucaaaauaauggcuucuuugcaacuccugaaaauuuauuucauuagcuauuugacaaaagggcuugacaguugguuauuugauaggcuacacuuaaagauucuuuccaguuacugcaaaguuguuuccauugauguaagaagcuaaccauaaaccugguuucaaucucugccugaagcagauuuccugucagcuucuuugcuucaugacaaugaacugaaaccagaggagacacucaagcagaggccagguggccuugaaguaugauuccauggcuaacccuaaagaaaaagacauaggguuuuaaaaauagaaucaaaauaaaugcagcuguuuuuugguuccgggucacucccugcaacuucacuguaucucccugacaauguaauuuuuuucugcaacagaauuccuaaguugcuauggauuggcagauaauaauuacaauuacaguugucuauuaggcaccuuuccauaaagaccaagauaggcagguuaaauuugugaaagaaaaauggaggauucugaaugugcagcagaacuuuacuacuugcuauugcccaaagcaaagauucuagucacauccucagaaaacucugcaacaggagacagaccugaccuauuuuggagucaggcaaaccucccuuuuuuuucuuccuuuucugcugaucuucaacaauuuacuuaacucaguuuccucacuuguaaaauacaaaugauaugccuaucugcagagucacugggagaaauaaaugaaaugacuuaaaguauauguaugcuaucuggcauguaguaggaguuuaauaaauuauaguuuacauacaccagaagaguacuugccucgcuuuuccuuguaugguacuuuuuaaucuuauuauuaaacuaaccccuguggugguguggcuacauucuuugaguuuagaaaacgagauaaagaauugcucauaucuucccaaauuguguaguauaaaaagaaugcuguccugguuguuuuuuguagaauauggaagucccugcaguaaguaggcaacaugcuacccuucuauucaacacagcacuagaacaaggcaagugggaccuuugucgacacaugauucgauuucuuaaagccauuggcucuggagaaucugagacaccuccauccacacccacagcucagguuaguugcaaaaguuacacaucuucucuaggccauacacccacguagcaucuuucucuaaugguacugcauaugguguguaauccuaggaacccaguucaagugguggauuugaguucuucaggaaucgaagcaucaguuuaucccagucagcugaaaauguuccugccaguaaauucaguuuacagaaaacacuaaguaugccaucuggucccucuggaaaaagguaaaauaauaaagagccauuacugcuuuuugggcauucaugacacauugcauuucaagacauuuacaaaauuaggucuuaauggaaacaacuauuuaauccaauugcaguuucuuuuuccauucccaaaaagcagaggccacacagaaggcuucccuuuuuccuuccucccaaguucacuucagcacccucugaauaguuucugccccuuuuucuggaauagaucuucauguaccuguucugaauguaacaaacuuguuuaagacagagucucacucugucacccaggcuggaaugcaguggcaccaucucagcucacugcaaccuccgccuuacagguucaagcgauuauccugccucagccacccaaguagcugggauuacaggcauaugccaccacacucggcuaauuuucauauuuuuaguagagacgggguuucaacauguugcccaggcuagucucgaacuccuggccucaaggauccaccugccucugcuucccaaagggccgggauuacaagcgugagccacccuaccuggccaaaugcuacaaacuuuuuuuucccauaaguuacugggguccaggugguauuugguuacauuaauaaguuauuuaguggugauuugugagauuuuggugcacccaucacccaagcaguauacacugcaccauauuuguugucuuuuaucccucacccccucccagccuuucccccaaguccccaaaguccauuguaucauucuuaugccuuugcguccucaugguuuagcucccacauaucagugagaacauacuacauuugguuuuccauuccugaguuacuucacuuagaauaauacucuccaaucucaucaggucacugcaaaugcuguuaauucauuccuuuuuauggcugaguaguauuccaucauauauacguauauacaaguuucuuuauccacucguugacugaugggcauuuggguugguuccacgauuuugcaguugugaacugugcugcuauaaacgugugugcaaguaucuuuuuugaaugacuucuuuuccucuggguagaaccccaguagugagauugcuggaucaaaugguaguucuacuuuugguuauugagggaaucuccacccuguuuuccauagcagcuguacuaguuuacauucccaccggcaguguagaaguguucccugauggccacauccaugccaacaucuacuguuuuuugauuauggucauucuugcaggaguaagguggcauugcguugugguuuugauuugaaaaugcaacaaacuuuuaaauuaccucugaugauagaggaccaaaaggaagauagauaaaucuguagguaauccaaaagccuucuuaaagucguaauuuuaccuuuccuucuaauuauacuuuuugauauaaauuuagugcuaaugcauuugacacucuugugaccuauugauuagagaaguuauuacacagucggggagccaaaugaauuguaugcuggagacugaaacugcuaucacccauagaugggauauugucuucugagagaugacuaugaauucacacuaacauuauaaaaucaugagaauuuccucugguuugugaggccuguguauuccuuccuauguucuucuguuguugucucauuuuuuuccuuaccuaauccuuuguuuuauauuguucauauucucuuuuuuuuuuuuuccccaggacaacaugaacauauguuuauauucuuacuaccgugcuugggcacauagugagagcuuauugaacguuuguuauugucauguuuuacuggguuuuuuuguuuuuugagauggaguuucgcucuuguugcccaggcuggagugcaauggcuugaucucggcucaucgcaaucuccgccucccagguucaagugauucuucugccucagccucccaaguagcugggauuacaggcaugcaccaccacgccuggcucauuuuguauuuuuaguagagacgggguuucuccguauuggucaggcuagucucaaacucccgaccucaggugauccgccugccucugccucccaaagugcugggauuacaggcaugagccaccaugcccagccuguuuuacuguuuuuuaacaagugcuuacuacaugccaggccuuauucuaagcauuuacauacauagguccuauuuuaaacaacucuaugaggguuauccacauuguauaggugaagaaacagaggccuaggaaaauaaacuuaguuauguucacacaacaaaugaguggcagagccaagauccgaauccaggcaguacugcaccagagacuaggcucuuuaccccaccacuaaacugccucucacuuaaagcaccacauuauccaguuaccaaaccaguucccccacauuagcucauguaagucaggaaugagagacuauacuuaggcaaguuguaauuuuuaaaaauugguuucaggacuggcaagguggcuaacaccuguaauuccagcacuuugggaggccaaggugggaggauugcuugaggccaggaguucaagaugagucugggcaacacagcaagaucccauccuugcaaaaauaaaaauacauuggcuaggcaugguggcaaguaccuguagucccagcuacuugggaggcugagguggggaagauagcuugagcccaggaguuugagguugcagugagcuaugaucacaccacugcacuccagacugggugacauugugaaaccuugucauuuaagaaaaaaaaaguugguauucuuuucauaugucugcaugacucacacugagaaauuuaauuucacuuugccucucuauccuuaguuucuuugaugugcucuccuucccucuuuucauugggcuuuucaaauauagcauagagguuugcugccuuucuuucugucagccacccaucaccugcuuccuggucugacuucuucugucccccuuuuccuguucccuguauucauucuacaaaugugucuuaagagccuucuguguuccgaggguugugguguaacacggaggagaagcguugauacuuuaucuucauugucaaucagaauuagaucuuggaucucuuaucuccuugucagcuuuaucaguaccucugcguaauaaggaugugaaauccuccaguaaagauuauucuguagcuuucuuguguuuccacuuacagauggagcaaagacagugacugugcugagaacauguauauugacaugaugcucuggagacaugcucggcgccucuuagaagaugugagguuaaaggaccuuggcugcuuugcagcccagcugggcuuugaacuaauuaguuggcuaugcaaggaacguacccgagccgcccggguagacaacuuuguaauagcccugaagagacuccacaaagauuuccuguggccacuuccaaucaucccagccucuucuaucaguucuccuuucaaaaauggaaaauaccgaacugguaauguagacuucaugucacuuguacaaggagaauuguauuuuacuccguguauuuacacauuuugcuauuaguugauauucaaggaauuauuuucauuccaaacuuaggaauggauaaaagccaacuuuuuguacaugaguuggaaugcccacuguuugaccaaagauguaaauaaaguagaaccuaugucucuaagucuugugaccuugaagucuaauucaaaaaucuaaucauacuuggauuauaaagaaguugagaacugccugaauauaaaagcuaccaugcuuauguuauugugggaaggaguucuggaaucagauagacauggaccucaaaguaagcugacagaacucauuccaggggaacaguaaggccaccuucuaaacuaggagaggacaaacugaaaguguauauuuuggugaaauaaaaauuuaaaguuuuuuaauucaggacuuuuuaugaagacuguucuaauuauuauuauuugugaauauugaaaccaaaacuuuuaacuuuggcauuuggaaacuucauguuaucuuaagagccaaagcaaaucacuuagaagaucaacauaauaaaguuuugccuagcuccaguaagaaauaggaugauauaacuuuuaggugguauuguggucaguccauuguuacacaaucccaugucucuaguuuugggguggcugauacaguacaggacaguaauugccuuugaacuguucuuauuggguaggcagguaggggaagcuaaaagagcugaauugaaaaugucagugugugcaucuucaauuucuuccuccauuuuuuguuuucggacccacucugcagugggagagcagcuguuaaagucucaaucagcugacccauuuuugaaccuugagauggaugcuggcaucuccaacauccagcgaagucagagcuggcucagcaacauuggccccacccaucaugagauagacacagcuucaucccauggaccacaaaugcaagaugccuucuugucaccuuuaucuaauaaagguaaauguaauuuuaaauccuagcucuucaguuccuuugaagaaaauuuaugugcuauagcacuucagagauagaccuucauucuuuuucuaucgugauggaggauuaaccauuuguauccacuggagagguagaaaguuuguagaacaaggccaaacuggccuugacuguacuuugccauauuuauuuuaugugaacaaaauaaauaguacagaucaacauuaauagaugaaucuuuguaaaucaauuuugaugauaaggaaacacuaacuuugagccccaaguaagcaaaauguuauccucauauaaagaauuccauuuuuaucauaauuagauguggaucauaacaaauuuuacugcauuaucauuuuuauguuuuuuauuuauuuuucuuuuggaauaugugaggagguaauguuuuuuauuucaucaauaaaaauuguggacauuugcuuuuucucuugcuauauaaguuccuacauaauauccuugauuuugccucuuggccuuaaaagcuuguaguauuuacuaucuggugcuuuuacaaaaaaauguacaccaaccucugcucuguaguaauggguaaaucacaaacugaagagguuuugaagcaauuuguguuggcauaggguuauauaguauaggagcuuaaacaacaauuugucugaguuugcaguuuuuuuaguggccaggcauuugucuaauguuugauuaucagucugucaucacuauuaccugagcuucugcuaugugaggaggcuuacagaucucauuaguuuuguuuuaaauugugguagaauacacaauuuaacagcuuaaccguuuuuaagcagaguuuguaguguuaauuaugcccacauuguucugcaaucagccuccagaaugcucuucaucuucaaaacgaaaacucuguauauguuacuuaauaacagcagcuccucauaccuucuucccccagccaguggcaaccaccauuuuauuuuuucucucugaauuugacuauucuagguacuucauauaaggaaaucauauaguguuugucuuuuucugaccagcuuauuucacuuagcauaauguccucauguucauccuuuuuggagcauguuuuauuccuuuguaugcagauaccacguuuuguguauucuucugaugauggacacuuggguugcuuuuacuuuuggcuauugugaauuaugcugcugugaauguggguauauaauauuucugugagacucuguuuucaguuauuuuggguauauauauccagaaaugggacugcugggucauaauucuacuugcauuuuuuuugaggaaucgccauguuucccauagcaacugcaccauuuuaaauuaucagcaguggacaaggguucuauuuucuccacaucucaccaacacucacuuucaguuuuuugauaguagucauccuaaugggugugagauggugccaucacuuuagaaaacuuuuuucaagagauaauuucaaauauauuaaaaaguacaguuaauaauauaguggguucuccucccucccccauguggccgucacucagcuuacaucacuaauggccacauauguuuguuguaccuccccacucuuguauuaacugaagaaaauccaugacauauuaucuauaaauauuucaguuuuuuuccuacaaggacucuuuaagaauuaugaccaaaauaccauuaucaucccuauaaaaauuugauaauuccuugguaccaucaaauauccauuaaguauucagauuucuaauuguuucauagacaucauaauuuuguauagguuaagauuuaaauaagguucacauauugugauuguguucuuaauucucuuuuuaaguggauguucccccacccucuccuuuucccuuccuugcaguuuauucauggaagaaauuugguuuuguggauuuucucacaauaaugauuuugcuuauuacaucuccaugguuuaguuuaacaguuuccucuauuuccuguaguagcugaauguaaagacuuggucaaacucuagcuagauuuuauugagggaguuggggaagacugcuucauagguggugguaguauauuuuuccaucuaaagguacauaaugucgguuaucuaauucuuucuuuaaauguuuucuauguucacaugguaauuuuagccauggauuucauguuuuaguuucaagauccugagaaaucaacaucugaggaacagcuaauauuuaaaauuaaaggaaaauauauuuucuccacgaaguugguuguaacuuuuggcaauucuucaucaggugaugaaugcaguauugguucagccacagacuugacugaaaguagcuccaugguggauggcgacuggacaaugguggaugaaaauuucucuacacucaguuuaacucagucagagcuggagcacauuuccauggaguuggccaguaaagggccucauaaaucccagguccagcuucggugaguuucuuggcuauuugaaaucacagaaugccuacucagaguauuugggcaaauagguauggggcuacucuccuaauaaucauugcacuucuguacaucuuauagaucuuucuuagcauaaaucauuuuguuucugcuuauauuuagguauuugcuacacauuuucauggaggcagggugccuagacuggugcaucguuauaggccugauucuuagagaauccucaauaaucaaucagauuuugguuauuacacagucuucagagguagauggagagauguuacagaacauaaagacagggcuccaugcaguggaccgaugggccucuacagacugguaagugcugcuuuccuuaggcuugguguccuuccaugucuuuuggugaauccuguccuuucacauuaaggccuaguuaugguucauguguuacauuuuauuuauuuauuauauauuauuuauuauauguucauuuuuaagcuacuuucuuuaguaaucauucuauacccagcuauuuaaauggauaauuccaucgaguaagguuacacuguuggucaguguauaauuuauagugugaauguauaucacugacuuaagauugaugcagugcaaaugagcuuagaauuagacuggaacuucagauuugcaucccugugaaauugaaagcaauggucuacaaauaucuacuugaaaagauucaaacuuaagguccaugugaauuuaacauuccauggcaguuacaagcaaauccaaauuagaguugugguugcaguuaagagccuuggacucuagcccugucuuuauuaccaguuaauguguguauuuggagcuaguuacuucccuuacuuggaucugguuuuccuuaauuggcaaaugcauuuagguuaaauguugucugaagguccuuuuucaagucuaagcuccuguuggccuuucaauuguaaaauauaauuuuuaguuguaauacugguucuaaaacaucagccuuugccccuaaugcuuagaaacuuaagccucaggcuuaugcaaugugcagcccccucugcugggcaggacagccaagaagccuuuccucccuaccuucuuugccuccucucuccccuccuaaucuaucgucgucuuuaccauaucaauguucaguagaaguucacccguaauguucuaccaaaccuuuugaauuauggcagaugagcuaauguuuuuuuucucuacauaguccuggauauaagccauuuuuaaacaucauuaagccacaacugcagaagcucagugagauaacagaagagcagguccagccagaugccuuccaaccaauaacuauggguaagacuccagaacagacuagcccccgggcagaggagagcaggggcuccuccagccauggaagcaucccccagggugaaguuggaagcagcaauauggucagccggaaagaggaggacacagcccaagcagaggaggaagaaccuuuucaggaugggacuuacgacuguucuguguccuaacagugagguuccaucacaaaggggcaguauuaauuagcagcagcgugcagcucaguacguuguaacauaguuggaugauuuaacaggagaacucaguucagagacucuucgguaaguauuaguagauuuuaacuaauucuuucuugucuaagaaaucuuuuugacuccauaaaaaugugauauaaagcaucuuucauaaaaaaauuuuaagcugcagugaaaaguaaauauuguacagauguacaugagaauauuuugguuuuacucaaagguugguagcucuuaaaccacaggaauuguuuugccccaggugagcuuacuuuuucacuacuuacaucuucucacauuucccgguucugcauuauguccagauugcuuuuuaaaaaauaaaugcuaaggugcuugcuauagucugucagguacuugagcuaccuguuugcucccuuggauacagcuggacucuuuaaucaguccuccugaauagauugcuacccuggggcacaauaugugccagugugauggaaacauucuccuuggcuuuacuagccagucaaaucccaguccagaauugauggaagcuauuuaccugugaguuaaugugcuuguuuuagcaagcuugauucccauuagaccaaugugggcagaggucugaggggguucuucucaauuuugcuguuagauaccacuaaacuauuuuguauuaaagaacaguaucuuuuugugaauacucuuguguaaauauauucaaaggcacuguucauauuuuagggcuuguauuauaauuugcaagguuuuaaugcuggauucugcaugucuacacauacaaagacagggcuugcuccucugcaaaacugaggaagacagguuuauuggcuuggucaugaaguaacagaaauggucacacugaucaugaaaugcagcaaguuuugugcaaauuaacauagucucuuauuuauugcuuuuguaaauugaauaaagauggacuucuauguaaauagacugcugaauccuguauuaccacggcuacuaaaaauuaguguguaaagaaugcauucuucauuguaaacuuaaaguauuuuauguacuucuagaaaugacuuaaauuuguuuucauacauuaugaaaacaacugcauacuccuuaauugcuuuaaacacccauccacuguauguaauucuaauuaccuuauaacaguauuaagacagcuuguuuguacugugcaauuugaacaaggaaugcaauguuauuuuuuacaaaaaacaaacuuguuuauuuuuauaauaacgauguauuugauguggaccaaauucguaccacuaucuaaaauagccucuuuucucauagugcaguuguaguuuagaaacaaaacuugguccucucuccuugcuuuuuaaaguaaauggcuagauuuaguugucuuagccagguuuccuuugaagagaaacucaaaaccauuuugaaacugcuuaguucagaauacaucgaaguauuuaaaauuacugaguuggguaauuuacuaucauuuacuuuuuacauuacaagugcaauaauauuucacaaaaugaaacucccgaauggguggaguaugugauuauugguaccugguccuucuggugcuauuuuuauuuaagucuuuguuucaaaccaccuuucccugaaucuuaaagauaauguuuugcaugugaguacaugcagcccagcaagaaacuaaacugaacucucuucuccuauccuaguccauuaaggagaagaaccagcauugcuuuuguguuuggugugaauauucagucaauaaaaaugauuuaccauuauaaagagcugugaucuuuucaaguaucugaaauaaaacacugugcugcugaguucaucucaaacauucuugaaagcagggcaccaguauaaguuaacuguauuccuguggguuaggccgugaaugaaucauuucuuuuauacaauauucuuuuacaacuaauagagauaggaggcccccaggcaagaaguuuggcagguuuacagaaaauuugguaauuuauuuguuauauaccuuaauuuuuaaaaacccauuuuuauugugguguuugguucacauaucaacuguuuaagccauaauuuuagccaaugaauuuaaauauucaguauaacuauuugagguuuacuagaugcauuuauuaauaaauuauuugcugaaaccaaaacaagucauugggggugugggaauaaaaucaaccuuugcuuguaauuaaaguugcugcuauuucuguaauguguauuuuucuccccuugguaaagggcaauaaaaccauuacacaa

SEQ ID NO: 192979 - RNA, 147438 nt, Homo sapiens
uuguguaaugguuuuauugcccuuuaccaaggggagaaaaauacacauuacagaaauagcagcaacuuuaauuacaagcaaagguugauuuuauucccacacccccaaugacuuguuuugguuucagcaaauaauuuauuaauaaaugcaucuaguaaaccucaaauaguuauacugaauauuuaaauucauuggcuaaaauuauggcuuaaacaguugauaugugaaccaaacaccacaauaaaaauggguuuuuaaaaauuaagguauauaacaaauaaauuaccaaauuuucuguaaaccugccaaacuucuugccugggggccuccuaucucuauuaguuguaaaagaauauuguauaaaagaaaugauucauucacggccuaacccacaggaauacaguuaacuuauacuggugcccugcuuucaagaauguuugagaugaacucagcagcacaguguuuuauuucagauacuugaaaagaucacagcucuuuauaaugguaaaucauuuuuauugacugaauauucacaccaaacacaaaagcaaugcugguucuucuccuuaauggacuaggauaggagaagagaguucaguuuaguuucuugcugggcugcauguacucacaugcaaaacauuaucuuuaagauucagggaaaggugguuugaaacaaagacuuaaauaaaaauagcaccagaaggaccagguaccaauaaucacauacuccacccauucgggaguuucauuuugugaaauauuauugcacuuguaauguaaaaaguaaaugauaguaaauuacccaacucaguaauuuuaaauacuucgauguauucugaacuaagcaguuucaaaaugguuuugaguuucucuucaaaggaaaccuggcuaagacaacuaaaucuagccauuuacuuuaaaaagcaaggagagaggaccaaguuuuguuucuaaacuacaacugcacuaugagaaaagaggcuauuuuagauagugguacgaauuugguccacaucaaauacaucguuauuauaaaaauaaacaaguuuguuuuuuguaaaaaauaacauugcauuccuuguucaaauugcacaguacaaacaagcugucuuaauacuguuauaagguaauuagaauuacauacaguggauggguguuuaaagcaauuaaggaguaugcaguuguuuucauaauguaugaaaacaaauuuaagucauuucuagaaguacauaaaauacuuuaaguuuacaaugaagaaugcauucuuuacacacuaauuuuuaguagccgugguaauacaggauucagcagucuauuuacauagaaguccaucuuuauucaauuuacaaaagcaauaaauaagagacuauguuaauuugcacaaaacuugcugcauuucaugaucagugugaccauuucuguuacuucaugaccaagccaauaaaccugucuuccucaguuuugcagaggagcaagcccugucuuuguauguguagacaugcagaauccagcauuaaaaccuugcaaauuauaauacaagcccuaaaauaugaacagugccuuugaauauauuuacacaagaguauucacaaaaagauacuguucuuuaauacaaaauaguuuagugguaucuaacagcaaaauugagaagaacccccucagaccucugcccacauuggucuaaugggaaucaagcuugcuaaaacaagcacauuaacucacagguaaauagcuuccaucaauucuggacugggauuugacuggcuaguaaagccaaggagaauguuuccaucacacuggcacauauugugccccaggguagcaaucuauucaggaggacugauuaaagaguccagcuguauccaagggagcaaacagguagcucaaguaccugacagacuauagcaagcaccuuagcauuuauuuuuuaaaaagcaaucuggacauaaugcagaaccgggaaaugugagaagauguaaguagugaaaaaguaagcucaccuggggcaaaacaauuccugugguuuaagagcuaccaaccuuugaguaaaaccaaaauauucucauguacaucuguacaauauuuacuuuucacugcagcuuaaaauuuuuuuaugaaagaugcuuuauaucacauuuuuauggagucaaaaagauuucuuagacaagaaagaauuaguuaaaaucuacuaauacuuaccgaagagucucugaacugaguucuccuguuaaaucauccaacuauguuacaacguacugagcugcacgcugcugcuaauuaauacugccccuuugugauggaaccucacuguuaggacacagaacagucguaagucccauccugaaaagguucuuccuccucugcuugggcuguguccuccucuuuccggcugaccauauugcugcuuccaacuucacccugggggaugcuuccauggcuggaggagccccugcucuccucugcccgggggcuagucuguucuggagucuuacccauaguuauugguuggaaggcaucuggcuggaccugcucuucuguuaucucacugagcuucugcaguuguggcuuaaugauguuuaaaaauggcuuauauccaggacuauguagagaaaaaaaacauuagcucaucugccauaauucaaaagguuugguagaacauuacgggugaacuucuacugaacauugauaugguaaagacgacgauagauuaggaggggagagaggaggcaaagaagguagggaggaaaggcuucuuggcuguccugcccagcagagggggcugcacauugcauaagccugaggcuuaaguuucuaagcauuaggggcaaaggcugauguuuuagaaccaguauuacaacuaaaaauuauauuuuacaauugaaaggccaacaggagcuuagacuugaaaaaggaccuucagacaacauuuaaccuaaaugcauuugccaauuaaggaaaaccagauccaaguaagggaaguaacuagcuccaaauacacacauuaacugguaauaaagacagggcuagaguccaaggcucuuaacugcaaccacaacucuaauuuggauuugcuuguaacugccauggaauguuaaauucacauggaccuuaaguuugaaucuuuucaaguagauauuuguagaccauugcuuucaauuucacagggaugcaaaucugaaguuccagucuaauucuaagcucauuugcacugcaucaaucuuaagucagugauauacauucacacuauaaauuauacacugaccaacaguguaaccuuacucgauggaauuauccauuuaaauagcuggguauagaaugauuacuaaagaaaguagcuuaaaaaugaacauauaauaaauaauauauaauaaauaaauaaaauguaacacaugaaccauaacuaggccuuaaugugaaaggacaggauucaccaaaagacauggaaggacaccaagccuaaggaaagcagcacuuaccagucuguagaggcccaucgguccacugcauggagcccugucuuuauguucuguaacaucucuccaucuaccucugaagacuguguaauaaccaaaaucugauugauuauugaggauucucuaagaaucaggccuauaacgaugcaccagucuaggcacccugccuccaugaaaauguguagcaaauaccuaaauauaagcagaaacaaaaugauuuaugcuaagaaagaucuauaagauguacagaagugcaaugauuauuaggagaguagccccauaccuauuugcccaaauacucugaguaggcauucugugauuucaaauagccaagaaacucaccgaagcuggaccugggauuuaugaggcccuuuacuggccaacuccauggaaaugugcuccagcucugacugaguuaaacugaguguagagaaauuuucauccaccauuguccagucgccauccaccauggagcuacuuucagucaagucuguggcugaaccaauacugcauucaucaccugaugaagaauugccaaaaguuacaaccaacuucguggagaaaauauauuuuccuuuaauuuuaaauauuagcuguuccucagauguugauuucucaggaucuugaaacuaaaacaugaaauccauggcuaaaauuaccaugugaacauagaaaacauuuaaagaaagaauuagauaaccgacauuauguaccuuuagauggaaaaauauacuaccaccaccuaugaagcagucuuccccaacucccucaauaaaaucuagcuagaguuugaccaagucuuuacauucagcuacuacaggaaauagaggaaacuguuaaacuaaaccauggagauguaauaagcaaaaucauuauugugagaaaauccacaaaaccaaauuucuuccaugaauaaacugcaaggaagggaaaaggagagggugggggaacauccacuuaaaaagagaauuaagaacacaaucacaauaugugaaccuuauuuaaaucuuaaccuauacaaaauuaugaugucuaugaaacaauuagaaaucugaauacuuaauggauauuugaugguaccaaggaauuaucaaauuuuuauagggaugauaaugguauuuuggucauaauucuuaaagaguccuuguaggaaaaaaacugaaauauuuauagauaauaugucauggauuuucuucaguuaauacaagaguggggagguacaacaaacauauguggccauuagugauguaagcugagugacggccacaugggggagggaggagaacccacuauauuauuaacuguacuuuuuaauauauuugaaauuaucucuugaaaaaaguuuucuaaagugauggcaccaucucacacccauuaggaugacuacuaucaaaaaacugaaagugaguguuggugagauguggagaaaauagaacccuuguccacugcugauaauuuaaaauggugcaguugcuaugggaaacauggcgauuccucaaaaaaaaugcaaguagaauuaugacccagcagucccauuucuggauauauauacccaaaauaacugaaaacagagucucacagaaauauuauauacccacauucacagcagcauaauucacaauagccaaaaguaaaagcaacccaaguguccaucaucagaagaauacacaaaacgugguaucugcauacaaaggaauaaaacaugcuccaaaaaggaugaacaugaggacauuaugcuaagugaaauaagcuggucagaaaaagacaaacacuauaugauuuccuuauaugaaguaccuagaauagucaaauucagagagaaaaaauaaaauggugguugccacuggcugggggaagaagguaugaggagcugcuguuauuaaguaacauauacagaguuuucguuuugaagaugaagagcauucuggaggcugauugcagaacaaugugggcauaauuaacacuacaaacucugcuuaaaaacgguuaagcuguuaaauuguguauucuaccacaauuuaaaacaaaacuaaugagaucuguaagccuccucacauagcagaagcucagguaauagugaugacagacugauaaucaaacauuagacaaaugccuggccacuaaaaaaacugcaaacucagacaaauuguuguuuaagcuccuauacuauauaacccuaugccaacacaaauugcuucaaaaccucuucaguuugugauuuacccauuacuacagagcagagguugguguacauuuuuuuguaaaagcaccagauaguaaauacuacaagcuuuuaaggccaagaggcaaaaucaaggauauuauguaggaacuuauauagcaagagaaaaagcaaauguccacaauuuuuauugaugaaauaaaaaacauuaccuccucacauauuccaaaagaaaaauaaauaaaaaacauaaaaaugauaaugcaguaaaauuuguuaugauccacaucuaauuaugauaaaaauggaauucuuuauaugaggauaacauuuugcuuacuuggggcucaaaguuaguguuuccuuaucaucaaaauugauuuacaaagauucaucuauuaauguugaucuguacuauuuauuuuguucacauaaaauaaauauggcaaaguacagucaaggccaguuuggccuuguucuacaaacuuucuaccucuccaguggauacaaaugguuaauccuccaucacgauagaaaaagaaugaaggucuaucucugaagugcuauagcacauaaauuuucuucaaaggaacugaagagcuaggauuuaaaauuacauuuaccuuuauuagauaaaggugacaagaaggcaucuugcauuugugguccaugggaugaagcugugucuaucucaugauggguggggccaauguugcugagccagcucugacuucgcuggauguuggagaugccagcauccaucucaagguucaaaaaugggucagcugauugagacuuuaacagcugcucucccacugcagaguggguccgaaaacaaaaaauggaggaagaaauugaagaugcacacacugacauuuucaauucagcucuuuuagcuuccccuaccugccuacccaauaagaacaguucaaaggcaauuacuguccuguacuguaucagccaccccaaaacuagagacaugggauuguguaacaauggacugaccacaauaccaccuaaaaguuauaucauccuauuucuuacuggagcuaggcaaaacuuuauuauguugaucuucuaagugauuugcuuuggcucuuaagauaacaugaaguuuccaaaugccaaaguuaaaaguuuugguuucaauauucacaaauaauaauaauuagaacagucuucauaaaaaguccugaauuaaaaaacuuuaaauuuuuauuucaccaaaauauacacuuucaguuuguccucuccuaguuuagaagguggccuuacuguuccccuggaaugaguucugucagcuuacuuugagguccaugucuaucugauuccagaacuccuucccacaauaacauaagcaugguagcuuuuauauucaggcaguucucaacuucuuuauaauccaaguaugauuagauuuuugaauuagacuucaaggucacaagacuuagagacauagguucuacuuuauuuacaucuuuggucaaacagugggcauuccaacucauguacaaaaaguuggcuuuuauccauuccuaaguuuggaaugaaaauaauuccuugaauaucaacuaauagcaaaauguguaaauacacggaguaaaauacaauucuccuuguacaagugacaugaagucuacauuaccaguucgguauuuuccauuuuugaaaggagaacugauagaagaggcugggaugauuggaaguggccacaggaaaucuuuguggagucucuucagggcuauuacaaaguugucuacccgggcggcucggguacguuccuugcauagccaacuaauuaguucaaagcccagcugggcugcaaagcagccaagguccuuuaaccucacaucuucuaagaggcgccgagcaugucuccagagcaucaugucaauauacauguucucagcacagucacugucuuugcuccaucuguaaguggaaacacaagaaagcuacagaauaaucuuuacuggaggauuucacauccuuauuacgcagagguacugauaaagcugacaaggagauaagagauccaagaucuaauucugauugacaaugaagauaaaguaucaacgcuucuccuccguguuacaccacaacccucggaacacagaaggcucuuaagacacauuuguagaaugaauacagggaacaggaaaagggggacagaagaagucagaccaggaagcaggugauggguggcugacagaaagaaaggcagcaaaccucuaugcuauauuugaaaagcccaaugaaaagagggaaggagagcacaucaaagaaacuaaggauagagaggcaaagugaaauuaaauuucucagugugagucaugcagacauaugaaaagaauaccaacuuuuuuuuucuuaaaugacaagguuucacaaugucacccagucuggagugcaguggugugaucauagcucacugcaaccucaaacuccugggcucaagcuaucuuccccaccucagccucccaaguagcugggacuacagguacuugccaccaugccuagccaauguauuuuuauuuuugcaaggaugggaucuugcuguguugcccagacucaucuugaacuccuggccucaagcaauccucccaccuuggccucccaaagugcuggaauuacagguguuagccaccuugccaguccugaaaccaauuuuuaaaaauuacaacuugccuaaguauagucucucauuccugacuuacaugagcuaaugugggggaacugguuugguaacuggauaauguggugcuuuaagugagaggcaguuuaguggugggguaaagagccuagucucuggugcaguacugccuggauucggaucuuggcucugccacucauuuguugugugaacauaacuaaguuuauuuuccuaggccucuguuucuucaccuauacaauguggauaacccucauagaguuguuuaaaauaggaccuauguauguaaaugcuuagaauaaggccuggcauguaguaagcacuuguuaaaaaacaguaaaacaggcugggcaugguggcucaugccuguaaucccagcacuuugggaggcagaggcaggcggaucaccugaggucgggaguuugagacuagccugaccaauacggagaaaccccgucucuacuaaaaauacaaaaugagccaggcgugguggugcaugccuguaaucccagcuacuugggaggcugaggcagaagaaucacuugaaccugggaggcggagauugcgaugagccgagaucaagccauugcacuccagccugggcaacaagagcgaaacuccaucucaaaaaacaaaaaaacccaguaaaacaugacaauaacaaacguucaauaagcucucacuaugugcccaagcacgguaguaagaauauaaacauauguucauguuguccuggggaaaaaaaaaaaaagagaauaugaacaauauaaaacaaaggauuagguaaggaaaaaaaugagacaacaacagaagaacauaggaaggaauacacaggccucacaaaccagaggaaauucucaugauuuuauaauguuagugugaauucauagucaucucucagaagacaauaucccaucuaugggugauagcaguuucagucuccagcauacaauucauuuggcuccccgacuguguaauaacuucucuaaucaauaggucacaagagugucaaaugcauuagcacuaaauuuauaucaaaaaguauaauuagaaggaaagguaaaauuacgacuuuaagaaggcuuuuggauuaccuacagauuuaucuaucuuccuuuugguccucuaucaucagagguaauuuaaaaguuuguugcauuuucaaaucaaaaccacaacgcaaugccaccuuacuccugcaagaaugaccauaaucaaaaaacaguagauguuggcauggauguggccaucagggaacacuucuacacugccggugggaauguaaacuaguacagcugcuauggaaaacaggguggagauucccucaauaaccaaaaguagaacuaccauuugauccagcaaucucacuacugggguucuacccagaggaaaagaagucauucaaaaaagauacuugcacacacguuuauagcagcacaguucacaacugcaaaaucguggaaccaacccaaaugcccaucagucaacgaguggauaaagaaacuuguauauacguauauaugauggaauacuacucagccauaaaaaggaaugaauuaacagcauuugcagugaccugaugagauuggagaguauuauucuaagugaaguaacucaggaauggaaaaccaaauguaguauguucucacugauaugugggagcuaaaccaugaggacgcaaaggcauaagaaugauacaauggacuuuggggacuugggggaaaggcugggagggggugagggauaaaagacaacaaauauggugcaguguauacugcuugggugaugggugcaccaaaaucucacaaaucaccacuaaauaacuuauuaauguaaccaaauaccaccuggaccccaguaacuuaugggaaaaaaaaguuuguagcauuuggccagguaggguggcucacgcuuguaaucccggcccuuugggaagcagaggcagguggauccuugaggccaggaguucgagacuagccugggcaacauguugaaaccccgucucuacuaaaaauaugaaaauuagccgagugugguggcauaugccuguaaucccagcuacuuggguggcugaggcaggauaaucgcuugaaccuguaaggcggagguugcagugagcugagauggugccacugcauuccagccugggugacagagugagacucugucuuaaacaaguuuguuacauucagaacagguacaugaagaucuauuccagaaaaaggggcagaaacuauucagagggugcugaagugaacuugggaggaaggaaaaagggaagccuucuguguggccucugcuuuuugggaauggaaaaagaaacugcaauuggauuaaauaguuguuuccauuaagaccuaauuuuguaaaugucuugaaaugcaaugugucaugaaugcccaaaaagcaguaauggcucuuuauuauuuuaccuuuuuccagagggaccagauggcauacuuaguguuuucuguaaacugaauuuacuggcaggaacauuuucagcugacugggauaaacugaugcuucgauuccugaagaacucaaauccaccacuugaacuggguuccuaggauuacacaccauaugcaguaccauuagagaaagaugcuacguggguguauggccuagagaagauguguaacuuuugcaacuaaccugagcuguggguguggauggaggugucucagauucuccagagccaauggcuuuaagaaaucgaaucaugugucgacaaaggucccacuugccuuguucuagugcuguguugaauagaaggguagcauguugccuacuuacugcagggacuuccauauucuacaaaaaacaaccaggacagcauucuuuuuauacuacacaauuugggaagauaugagcaauucuuuaucucguuuucuaaacucaaagaauguagccacaccaccacagggguuaguuuaauaauaagauuaaaaaguaccauacaaggaaaagcgaggcaaguacucuucugguguauguaaacuauaauuuauuaaacuccuacuacaugccagauagcauacauauacuuuaagucauuucauuuauuucucccagugacucugcagauaggcauaucauuuguauuuuacaagugaggaaacugaguuaaguaaauuguugaagaucagcagaaaaggaagaaaaaaaagggagguuugccugacuccaaaauaggucaggucugucuccuguugcagaguuuucugaggaugugacuagaaucuuugcuuugggcaauagcaaguaguaaaguucugcugcacauucagaauccuccauuuuucuuucacaaauuuaaccugccuaucuuggucuuuauggaaaggugccuaauagacaacuguaauuguaauuauuaucugccaauccauagcaacuuaggaauucuguugcagaaaaaaauuacauugucagggagauacagugaaguugcagggagugacccggaaccaaaaaacagcugcauuuauuuugauucuauuuuuaaaacccuaugucuuuuucuuuaggguuagccauggaaucauacuucaaggccaccuggccucugcuugagugucuccucugguuucaguucauugucaugaagcaaagaagcugacaggaaaucugcuucaggcagagauugaaaccagguuuaugguuagcuucuuacaucaauggaaacaacuuugcaguaacuggaaagaaucuuuaaguguagccuaucaaauaaccaacugucaagcccuuuugucaaauagcuaaugaaauaaauuuucaggaguugcaaagaagccauuauuuugagaaaaacugugugcuaugagggucuuugcuguggcaggccugagccuucucagcuugcuuuggggaagacuagcucaaggugcucuguuaugaccaugcucuaauaaguguccccucaguaacccacacugaaaggaaacaaaucuacuguugugagaagcucaaacucacuaauaucucaaauaauacuuucuuugcuauguuucuuauguaauauuucaauaaucuuauguaauauuucuuccauguuccuauuacauguauucuaauauacauauuaaauuucuucaauauauuaaaauuucaaaacacuacucugaacucauuaaucuguuuuaggccuauuuauggacaauggaaaaaauaucucugcaauguuacuuuaugauauucaaaggaaucugucugaauucuuccaaauuaaagauauaaacagaaaauuugacuaugaauuccuuaaacacaaucauggugucaaaacaggacauuucuauuuuucuaaguuuaagcucauuaauucuugccccuuuauaagaagagaauuguuaccuguaagauaauaagguaagaggcagcuguguccaaauccugagccaucaaacacuccucaaacaaguccuuaggguuuccaacagcugcaaaaagguaauuccacagggcauauucggucuuccuggcacaauggacaacugucugcaggaagagggggaacucagugauaaauuuugccacagugggaagcagagggucgggaaugggcucccgugagguagcuucuucuuccaguacuucauggagcaugagcuccagcacaugagggaaguaagguaauguggcacaggacugggccaagagcaaggcuugcuccccaagguuucugaccagaaguugacguagaaugugguggagguagaucugagagguucucuccacaacacagaaagggaagagcaccuccagcuguucucuagcauuguuccgaguauauaaagaaucauagagcaaagugucauugacagcaccaaggacuaaagcaucuucaaacagaacagcuagcggguaaauguugauguggaaaggcagcaugauccgcugggacaagaaggaauggggcuugcggugaucccuagggaagagagggagccaaacuuucaucccugcaccaccacagcucagccagagggccuccagaaggugacguuucuguuuauuugcucgacacguuguccagacauuuucaacagacugggcuaguacaacaggaggacagaauggcagcuggagaaggagagacaagaaucaaguuguuuuccuauuaaaucugcagguucuuaaguuccuagguacuaguuuacuaagucuuucaaaugauaguauaauauuuuuuugggaaaagcaaagggaucuaauuagaauuagaguuaauaaaaguauccuggccuuuuaaaguauauacacuuaaaucugaaaacaaaacaccccaugaacuucaccagucuaucccuauuuuuuccauuagaauuugcaaugaaugaugccuaagcaguuaacauauggaguauggaacauuucaugaucauuuugggaccuuauccuccagucagucagucuuacacccagaggcuuaagacugauuuuauggacuuaauuucuccuuuccaaaucauaaaauacucuucucuuaaauuguuucauuccuucauccucaucccauaccuucuuaauguuugaaaagaaaugacuaguacuuuacucacaaguuuccuuugguuauuaggguuacuguccuucucccggaucugugggccugaccugucccucugcaucaugaugagcuguccugccagguuuaacauaaugcucucugcaccacgagccugaaauuuaagaaaaagcagcuaaauucauacuucuguaucgguaugcuuuccgcaucuccccccaauccauaagguuuauaggucaaacaaucuacauuauuuauugagguuguacuauguacagccauucugcuaggcucugugggaauauaaggagcuuucuggcuaggaugguacaaagccuaacacauaaugcaauuaaugaacaccaccagugacauaagauugagggcagaguugaauuauccugaaaaagcuaagacaacuuuagaaguuuauaaaaaugagagaucacuucagugaucuagcugucauaacaacagaaaguuuaaaaggaugcagugaaccugacagaugaggaagacauacacgugugggagaguaaggguugguaaucuaauggaaaacgaagacauggaacuauugggaaagugagaacagucuggcuagacuagggacauuaugagaacaaagcuggaugguaacagaccuucaaggaggauucagaaagccagguaaaagagcagcaggaaagaagccacuacuuaugguucuugaauaagacaguuauuuaaaaaaucagaguuaaucaggauagguuacugaggagaggcagauuucauggguguugacuucagaaaugaggaaauagucugccuuuuuauaaugaaaaauuucaaucaaaccucagagagccuaguauaaugauuuccaauugagcccuaucacgcaacuuaaaccauuaugcacauuaaacuuugagcagcccuguuuuaaaaggaaccucagauaucaagucauuucuaucuguaaagaggaaggaacauuuugguuaaaaaacagaacuuacugcuauccuagacaugaaagguagaaaaagagaugaaccaaagaugauuuccagguuagcugaggugcuagagaaguugaaguuauuaucacugauagaagacaggaagagaaauuagggaagggaaaaccaaagaguuucccuuuuucuuuuuggcucauuuaauuugaaaaaauaaaaaaaaauucuuaagaauuccaaguaaaaaugugagcaaucacuaaaucagagacgacuguaccagcaucagaagcuuaaaggugaggcugggccaggcugggcgcaguggcucacaccuguaaucccagcauuuggugggaggcugagguggguggaucacgaggucaggaguucaagaccaaccuggccaaaauggugaaaccccgucucuacuaaaaacacaaaaauaagccgggcgugguggcaggugccuguaaucccagcuacuugggaggcugaggcaggagaaucacuugaacccgggagacggaggcugcagugagccaagauugcaccauugcacucuagccugggugacagagcaagacuccgucucaaaaaaaaaaaaaaaaaaaaaaaaaaaggugaggcugguaaacugaaggagacagacagauguuucucaggcacacuagccaggguaaaaagagcagcgggccaucaccugagcuuuuggaagacaaaagagaaauagggaagcacaaugcuauacaugcuauauaaacagaaggaaagaauuucagggaggaaagagugaguauucaaaacuugugggauugugucccaggcuuugcugcaugcuggcuggcugaauuuaagcuaccaaugaucauuuaggguucaucaagaaaacagcagccacccuauauauucuaguugcaaaauacuuggcuauacaaacuacucuugcuuacugcuuucagauucuacaggggauuauguauaaagaaaugacuaaauaaaaaaauugguuaucuauccagaaaguaauuuggagguaugagaagugaacauggaauuuagguguguggcaacuagaagagucagacaccuggauaacaguaaaauguagcuagauggcagaggaaaaagaaaaagacaaacaccugcagcaaaacagcaugacugggaacugcauacacuaaaacacuucaaaagaccuuaaaggcauuuacuguaauucaccacaauaugaguaauguuuauaaugacuaccuuaaguuuuaagaugguagauuucaccacauuucauacuaauucauuaaaaaaguacacuucucuuuucuucagugaguggguauuaucaguauccuaucuuaguauucaacacuuucugauaacguuaaagaugacugcaacagcacucucaagcaacuuuaauaaagcuuucagaaaaagcaagggcuacauguaugcccaaaauccuaaauuugaaggaaccccaaacucaaucucuuacccuaaaaaaaccccuggcagaugauucucuaugagaguuucaguaacaaggagcucacucucauggagagacuaucuugcuguugaagaguuuucacuguuacuacuauuuuuuuugaaaacuuuaguauuaaaugaaaacuuacuuugcuccagcauucuuugucuucccucuaugguaaucagucaauuuuaacuucuuaaucugcucuagccaaauuaagcaccuucucuuugugaaaggcccucucaaaauaugguauccaggacuacugaugccacugguugccuacucuaucugggauauauaagaguccuuuuuuaaauaugaaaacuuuaaacaugauuaaaaguauggagaauaguauaaugaacuuucacacugccauuauccagauucacaauuaucaagauuuugccuuaugugcuccauccaucccuuauuuuuuuuucaguuuugucagaauauuuucaauuaagacaugcuacccauuuuacuucuacauguuuaauaugcauuccuaaaauauaugggcaucugcuaacauagcuacaaugcuaguaucacauccaauaaaauuuacaauuauucccuacuuucucucuccauuaguauuuaaauaucccuaauuguuucaacagugucuuuucauagcugauuugaaugaagauacaaaugagcuuacugacuugguucugcaggguagugauuaucacauuugccucacaaaugacuuuuaaccacugcauuugguuuuuauggcuucaaagucuuauuuaaucuagaagauucacuccuucuucccccauguuagugacuuguagcuguccaacagaaugucuuguauucugcucccuugugguagggaagaugacucucuauacuugauuugauuuggguucaagauuuuuggcaauaauucuugugaacuucauguuauaucaccucaagaagcauaccauaucugguuuucccauuuuuagugauaagacugauuaguuccucaggacugcaaaaugauuuuuaaauugucacuuuuuuucacaccuuuuaucuaaacuucuguaaaacaguauauucccuuaucaauuaggacuaacugguuaccauuaaauaagguuugcagaggaaaugggaacuauauuuuaaaggagaaaaccaauuuuaccuauagaagggagaccaaggccgagcacgauggcucacgcccuuaaucccagcacuuugggaggccgaggugggcagaucaugaggucaagagauugagaccauccuggccaacauggugaaacccugucucuacuaaauauacaaaaauuagcugggcgugguggcgugcaccugcagucccagcuaguugggaggcugaggcgggagaauugcuugagccugggaggcagagguugcacugagccaagauugcaccacugcacuccagccuggcgauagagugagacuccaucucaaaaaaaaaaagaaaaaaggacaaaaaaaaaaaaaaaaaaagaagggagaccaagaugcuuaaggggucuagaauaaacauccaaugaaauaguuggacauauggaaguauuuagcaugcagauaagaugacagagagguuugaggagagaaggagaagccaaggaauguuaacugucugcagauauuuuacgggucaucauguggaagagggacuagcuuuuacaaugucuucuacaaagaauagagaacugggauagaagguaacaaaauugauuuuagauucauauaaguaauauuaaauuccccauaacuggauagucuagucuagucuguuuucuaauuauuuuauggaguguugagguuugaucgaagugccucgauaggaaguaaaagacagacugcccagacagggaugacaaauaaauccacauagaauuuuccucugacaguagguucccaguugacaugaaguuuagaaaccacugaaauagaaaguuaugcaacguggguccuggucgcccuacuucuuacccuguuacuuuacccagaaacuacgggauuauacuuucucuuuccucauaauuaacuaauuauaaagcccuugcuauucuauacucauucuacuucuuuccauauccuuuuucacugcccaaguucagacugugaacaccacugaccuagaucauuacaaugaccucccaguugcucucccuacaguaguuuugucuuacuucaguucauuuuccuccuuacaguaaacauuauaaagcuuagaucuaauaauaccuaccuuaaaacacuuuagacuuaaagucuaaaauuaucaauauuaucuacaagacucauauccucuuucacuuuccaugucccagucacucuaaaauucuuccaauucccugagugugucauguucugccuugucuaugggccuuugcacuacuguuccuuccaccugaaaauccauccccucuuaacuuggauaauuucuacuuauucuccuaguuuuaauuuaaaugauacagaaaucucugacuguucagacuauaacagguuuuuguuaaaugcucucacaguaauguguacuacuuuuugguacacguaacaggaacaauucauuauguauguaauuauuuauuuaaugccugagcagaaaccaugucuuuuuaauuugccacugcaacccagcauucucauauaagguacauuuuagacacuuaguauuuauuugccaaacaaauacuuccuaauauggacucaaauacuaaaaacagaaauguaaacuccaaagaccuuugauaauggagugguaccugcuguggcauuuucaaggugauuccauucucuguacucacugaugucagagugacagauaccaccaggaaagggugaggaauguagcgugacauggaaaccuccugaagaacuugaauaccagcaguaguauuuggacuguaaaaacaaaagaaacccacauaccucaacaacaaugcuaauaagauuuucuuucuuuuccacuaguaauaguauuagauuucaugcuuauggaagacucagaugucuuacuaccuaucaucuucuccccauauauccuucgaucaggaaguuggcaagguugaggggaaccagaguauauggggaugagagagaaagaaagggaguaacaaauaggagggaagacgaaaacuagggaagaagcuauaagaauacaaauauuuaaguggaaaaaacuaguggguugagaaagaaugaugguucaaucauugaggcuagugagaugucuuaauuuuuaucuugcauuacuucucaaucacugugcuguuucaguaaauacauacuucaauuaaccucugagaacaaaaauaaaacucaagagguguggucuaaauacguugcaaguagaccagaugccaagacaaauauaaggcaacgugcagcagcaacaacacugcugauuuuuuacugccccagacuacagccaucuagcucaguggaaauauaagucaguuugcuaaggacaugcuuccuacagucuuaaaguuguagaacuccuucaaauucccaccaaguaucgagagcaccaggagagucaguaaccauuuauuuucaagguugugaaaaaaaauuuaguaucuaaggguuuaccucaucccaaacuagauuuuuuucaaaugacuccaggaagauaagcuaaagaaguuaguguacgauauuucuuuuuuuuuuagcuauuauaucaauaucacuaauuaaaacuccuugcuuuuuuuaccucuaacaaaaacaagauugaauauaaaaguggaauaacuguuuugagaaaacaaaaacuacaaaagagaaacgugguaaauaggagcaaaaagugacuucucauaugccagauacuuacccaucagauuuucuuucaauacuguaaaggcauauugaacagucugcucuaaauacuauuaccauguccuggaagacacuaagcaguaauguuucugcuugugcuuuggugacaugagcaaaggcauuguccagauuugauguucgcaaguauacucuaagcugaagaaaacaaaaaugaagaaaauuauaaaaacaagauaacuacuagggaugaccaaauacuuuaaacaugcuguuuuuaacuuccgacuuuuuuuuuuuuuuuuaguaacaggaguuaaaagaacuaucuaagcuuuaacaguaaauggauuauguuuacauauuuuugcagacuaggcucauucuaugaguaagcaaaaaaugaagugaucaaaacugaauguacuauuauaaaauauuccuuuuagaccugcuuuauuuauuuauuuauuuauuuauuuauuuaaagacggggucucacucuguugcccaggcuggagugcaguggcaugaucucggcucacugcacccuccgccuuccggguucaagcaauucugccaccucagcuucccaaguagcugggauuacaggggugugccaccauaccuggauaauuuuugcauuuuuaauagagaugggguuucaccauguuggccuggcuggucuugaacuccugaccucaggugauccacccgccuuagccucccaaagugcuuggauuacaggcaugagccacugcaccuggccuagaccugcagauuuagaccugauacauaauaagaccagcuguuucucaaaacaaaaaaccagauacaguagucucucuuauccauggcuuugcucuucacaguuucaguuaucuacagucaaccauggucugaaaauaggugaguacaguauacuaagauauucugagagaccacauucauacaacuuuuauuacaauauacugucauaauuguuuuauuauuagucauuauuaaucucuuacaaauuaaacuuuaucauagguauguauguauaggaaaaaagauagugcuauauaggguucaguacuauuaacaguuucaggcauccacugauggucuuggaauguaucccccauaauuaaggagggguuacuguaaaucaguaacuaaauaaaucuaucucugaggacagccauucuuauaucaugaaauuuuuugcuuuuaacucuuuauuuucaaacuccauagggaauguccgacagcuaaaauccuuagaaaagguuaucuuaaaagucucaauugucacuuaauaauuuuuuaaaguaauaaccugaaaagaaaaucccacuaccuaaaagaagcuacauucuugauuaaaaaauaaaauguuuuguucaguuuucaaucgacuauuuucuauauaaaauuaauucaugcuuaauagcuuuaaaauauaaaaaucuguuauuucugagagaaaaaacuuaccucuucuugacggucauuuauguuauaacacgcaaggaccauaaaaucauuccaccaggcuaagccaccugucacgaucauauuuugcuccuuaaaauaaaaauuuuuuaaaaaauuuaccuuaugcuaccagaaauuauaacaaaguaauauauuuauaaaaauucuuacccagacaaagcucaaauuauuauuauuuuuugagacagucucacucugucacccaugcuggagugcaguggcucgaucucagcucccugcaaccuccgccuccuggguucaaggaauucucaugucucagccgccucccaaguagcugggauuacaagcaugcuccaacacaccuagcuaauuuuguauauuuuguagggacgggguuucgucauguuggccaggcuggucuuggacucccagccucaagugauccgccugcuucggccucccaaagugcugggauuacaggcgugagccaccacacgcccagccaaagaucaaauuauuucugcucuuacucccccucucuccaaugauaacucuagagccuuuauuaauaaugauccauauccuauuuauaaaaauaaauauuucuuuaagaaggcaaguauaccauuaaaaauaacugggugcuauauagcaucaucauucuaacacccauuagggcuuaguguaaauucuggcuuaaucacuuaucagaugaguaacugaauccuaguuuguguguguguguguguuuacaucaaaagaucaguaacaguagugccuucacuggguugcugugcagaugaguaagauaacauauaugaaagugccuuaaaaugccuaacacacaauaggcaccuaauaaguacugauuuccuucucuuccaacugcaugcguauauguacacacacauacacauacacacacgcacacucacuaucccauauacaucacacacagaauaggcauggaaugaucucaaauucuguggaaaucuauucugaucacaucagauaaacucaagcuggaauguaagaauaaauccucaggcuaaggaauuauaguuaccgaucuuaaaaagaauuaaaaauaaaccaacuauuucaacacaagauccuuuaucaaauaucaaguauuuuaucagaaucaaaucuuacauauuauucaauaucacuuuuuuauaucugauuuuccuuauuuuuaauaaguaaccaaaauuacuuagugauaaacuuuauagcuauuucauauuguaguucucuuauacuuugagaaauagguuuuuaaucucaaaaaagacuaaccuggguaauguuuccaaaaaguuuccauuuuuuggugaguaaagaguaaugugcaaaaccaaacuugccaaccacagcaauauucuguccaagcuuaucaauagcugaaaacuguuuaaaaaaaaaaauaagaacuuuuccuugcaaaccuauauacuuuauuaggcauaaagagcuuaguauugugucaggcaaacagacaauuaauaaauguuugcuaauuaaauauuuuaaaguccaaauauucaguuauaucugacaaaauuauagauguuaauauacuagcaauguuacaauagaucaagaguuuuauuuuucucaguacacccacugaagggcucuucccagaaugccucuugcagcaaaugcuagucaacaaaaguuaacaccaacaaaauaacaacucacccguauaggccaauugcucucuagauaggugcuggaaaucuauagaaaauaacacaucagauugguaaaacuuaugaaauauauuuaaacuuaaagcauuaaguuaucacacuaugagauucaucuugccgaacaauguuuaaggugcccccuaguuaguagcagagcacuuggaauuuaccauuuguauaugaaucaauguuuuacaucuuacguuauuucauguuucuaggcaccaggcuuuccucucccugccccuugccccuuauguuucuguuuguuuuaaauauugaauucaauaaauacagacugacaagagauuuucagagaaggcaccugugagggcagcuaugaauugugcagaugaacaguuuggguuugcugauauaaaccauuccaaaacaaccuaaucuaauacaauuacagccucagaaaaaguucugguuuuuaauggaaauauuuuuauuacuuuuacacuuuucugauuaaaacagcaaugcuuaggccaggugugguugcucacgccuguaaucccagcacuuugggaggccgaggcagguggaucaccugaggucaggaguuugugaccagccugaccaacauggcgaaaucucgucucuauuaaaaauacgaaaccgugcaugauggugcaugccuguagucccaacuacaugggagacugaggcaggacaaucgcuugaacccgggaggcagagguugcagugagccaggaucgcgccacugcacuccagccuggggaauaagagcgaaacuccgucuccaaaaaaaaaaaacaaaaaaaaacuuaugaaauuaugcaauauaaaaauugacaaaaugaaauucucuguuacuuagguacaaccacugguuagcuuuuauucuaucucuaaacaaacauauauauauguacaugaaagaguguauguaagcuauuauuuuucuauugggguauuugacuuacuuaucuacaagaacuuuuaauauauuacaaauauuaacucuaucugcaagaaaaggcguucauuuuuccacguugucugucuuacaucuuugaacauggugucuuuguaucacccuaacaacaccuuucaauuuaaauaauugacaugggauaucaauguagauaaaguaaauuuucguuuuaaugagauugaucucucuagccugcugauuaguuuucaugagcacauguuggaguggggcgagaauuaacagaacugaacaaagagucuucuguucuuggaauaagaaaagcuucgaucuguucaaauuuauuuuucauuuuacucuaagaaaaguugucacauauugaaaaacuaaaugccaaauuaaaaagcuaagucaacagcaaucaaacccaguaagauuguguauguaaugugaagacagaaaauuaaguaaaagcaauaugcucuaaacaucuguauuaaccuugauaaaauuugauaaaacuguuuguuauacuucacuuauuaucaagugcuuuacuuacuaauuauuuguuauacuuauuaaguugacuuaagucaacuuaaaauccaacuaaaucaauagcuuaauaaauuaauaaaauucacuaugggccaggcaccguggcucaugccuguaaucccagcacuuugggaggcugaggcaggcagauugccugaggucaggaguuugagaccagcccggccagcauggugaaacccgucucuacuaaaaauacaaaaauuagccaggcgugauggcaggugccggcaaucccagcuacucgggaagcugacgcaggagaaucaccugaacccuggaggcggagguugcagugagccgagauugcaccacugcacuccagccugggcaacagagugagacucugucucccugccccccagacccccaaaaagaucacuaugauggguaaaauuaguucagaauaaugguacacuuaagguaaugauuggguggugaaauaaaacuugaaagcauuuucaacuuuuuucagcagucacucacagcaggaggauguaccugaguauaacugugucaaucauccauugcacuaaaaggaauccuuaccucccucaaaccuugguguuucaugaguacuuaugaaacguguggguggguaauggaggagcugggaucuuacugcaaaaguggauucuaacacaaagaguuucuaauaaugggaaccaaaguuaaaucuuaucaaaugaucacacuaugaucaauaucuauaaaacaauuuauucuuuauucuacaaaaaucuaugaagugccacaaaugauguauuuuaaaaacuuaagguguuaaguuuagaaugaagcuuuauuuuucaugcaguuugugucuaaagauacuauguauuuucuccaguaggucaacuuuauugaucuaugugucaucugaacucugagcucuaccucuaauacuugauaaaagggaauggcagaaguaaggaagaggcagcugaucagugacaaaaaaaacaggucaugaaagcacacucagggcacugaagucaugccacaucacuggaaaacugagugcuaagguacagaaacucuacccuuaucuuagaauguuucaguuucucuuaaagaaacugaauccgcccucauuuguuauuaugauuuuuaaauuuuaaaguaacucugcuaaaacucugucuccugccuagauuaguuuugucuauaacuagugagacugugggagccauccuccuagcagauuuguucugugccaaauaccugguacacuugauacauacuguaggaagacaguaaauaauuuaugaaugaaagagccuuuaaauacucucuguugaaaucccuaacauagugccugauacccuguaggugcuuaucuuccacauuuugugaagcuuauucuuucuaaauagccaagcuaaccaucaaaccaacacccucagaacaauggauaauagauuuauguaccuuucagaaguaaaugcuuacaucauacaaaauacugagcauuaaaauaaauggcagucuuagaaggaacauggccuaaaacuagaaacuuuguguucuguaaaauuucaauaguuugugccccauaugucaacaaaugacuucaaaaguuuuaaaacuuauagguaagaaaaaacuuuuuaaaaagcaccuuggcuggugcuugcuggugcuugcuuuggcugggugcgguggcucacgccuguaaucccaguacuuugggaggcugaggcagguggaucacaaggucaggaguuugagaccagccuggccaacauggugaaaccccgucucuacuaaaaauacaaaaauuagccgggcaugguggcaggugccuguaaucccagcuacuugggaggcugagacagcagaaucgcuugaacccuggagguggagguugcagugagcugagaucacgccacugcacuccagccugggcaacaaagaacaaaauucaaucucaaaaaaaaaaaaaaaaaaaaaaaaaaaaaagcaccgccuuuacugccaguuaccaauccugcuucugacaaguauguauuuguuuuguuuuaguuaaagaaaaaucauaaguaacauagaaucuuccaaucuggaagcuaaggaguauaagguagcagguuuaagcaaacaaacaaaaagcuaguacucuaaaugagaaacagaacaagcagcagaauuaguuggaguucaucuaagcuauacaagaagcauacauacaacgaauaaaucacgcaaacaaaaucaacuuugacagaggauguggucacuuaucuuagaaaaaaggauacuauuguggggcaaauuaaaccaggcaacuauguuucuucagggagucaucauaaauggcuaaaaagccuagaacguaaaaguuuagcauuauauagacacuguauacugcccuauacaccgccaccauaacugcacugaaucauguagcuggagugccagcgaaauacagggcaacuccaaguacaaacugccaaauaggcgaauucuaaguuuuagcucaaggucagugguguauuaugugauuuaaugcucaguaccucgguuuuaaaauacauuagauuuuuacuuuaacguagagugaugauaaagauaagucugccacuacucugcugggugaacuggacaagucauauaacuucucugauccucaguuuccucauguaucaaauccaguuggacuuuaugaucucuuagguccuuccagcuugaaaaauucuaugagcccauuuucauuguuucagcaguacaaaacaaucaauguggcauuauuuauguuauuuuuaaggaaacugauaaacuagguaaacucaaguuuuaaaaguucaucugucuaaauaucuuuagcuaucuaaagaacagaauaacaguggaaucuugcuaguacccaaaguccuaaaaucaguguuaaaauguuucucuuauaugggguacuucauagaugcuuaagaaucacagaaucacugaguuuuugagcuggaaggaaauucaauuuuuguuauugccugaucgauuuuuuaguuccagaccuaccuucuuugauccucugcucuacuuggcucucugguaacacagaccuggcuaggcagaacuggcauugaugcuaggucaguguagaaugaauaguucaaaguauggggaaaugaaaauagcagagaaauggcuauaggagagaagggagcaguggaaaauuuuagucaaggaaguagcuagugcaguuuuauuuaaaaauuguuacuaauuauaaaaugguauguacauuguuugauucuaugaauuuauuaauguaaguuaaguucauuuucuuuuaguguauaccagaugucaauguaggagauaauccuucaaccuuucacaugaccauuuuuuugucucucauuaucuucacucaaagucaacugaaaauaacaugggagcugaaguaggcuaguaggguaaacauauagagagucaaaguaaggcaaagaauuauggaaacagaaacugacuaaaagaaacuaagagugggcuuugauguaccuaaaauauuuugcuaucaaaaagggaaagaaaacagucggaagacugaaauuauguaugcaaguuucuuuuaagaaacuucaacuuacugguuuccccaaaauaauuuuacuugguaucaaaauugagaauuaauuuccauguuaaaugucaguuuaucagaauuacugugagacacuguuaauuuaaaagugauaucagaaugaauaaauaauuuggaauaagauuagcuaauaaaaguauuaacaauaaagcucucuacugaucacaagucugcaauuuggguccaaagucacaugauuaaccucaacguggccccuuaagacuguaaggucagcuguacagaguacuagcugauguugccacuuuccaugagauuauuacacuuuguuuugccugugcaaauccguagagcuaaauuuauacaaaaaaagaggcugaaaguaaaauaaauaguucucaaugagaaggcaaaacauaaacuucuaguucuugacauuauuaauagacuugaaacagguggggauacacucuacgccaaguggaaagaaaggagggagaagacuagaggacaagaacacagaaaagcagaagagggacaugacaaaaugguuaaaaggauucucaguugccugaaguuaacagaugaaauauuuaauaaucuguuccaggugauauccuaucaaagaauaagucucuaguaaucaguaacuaaagauuuaccuguacaacaugccaaugccgauguccaaguaaagugcuuaaucccugagacucuaaaccuccaucugcaaaugggcucuuuucucgacugggcuuaugcucagaguguguugaagaacuccugggauucuggguuugugaagccucuccacaguucaaguacaagcgauccucacccugaagcaacaccugcucuugguuacucuaaaugagggaaagaggaacaaaagggcaaaggaggaaaacaaauaaaaacaacucaauauuacgcaggcaaaaauaacacaucgauuuaguuuuauuauaggaaauguacauguaucucgauguugauuuucuucacagaggacaaagacuacacaauaaucucaugcacuguuauaauuagaaagaauagugcucuuagugacuaugagauuucagcuagaaagccaguguucucaaaggugaguagacucauuaacuauugaaaucagacaaaguagcacccuacccuugucauuuuuccauuuuaguccaaaugcuggcuugacauaaaacucaagggugcuuuuaaauuauuauuugggauggggaaggggagggagaaaugcucucuucuuuucuggggauccuuagucuucaaguggaauaauggaucugaaauucaggcuauuuucacauuuuuuauggauguucguaaauuuuaauuagaaauuuguuguaccaaauauccauuaaaaagccauugaugguagguauuaagauacacauuucuaacauguaacauauaccauuacuguauauuagcgauauauaauaauauuaguauacacuauuucagauagaaauacaagaggcaguguuuggggcgguguuucuaaaagcaaguccucagacauacuuucuuuaagcuauuucuuaaaaauucacaguuaaauaagcauggggaacacuguuuuuaauauaccaccuccuggauuuucaugaugcacaauggcauauuuaagccucuggagcccuacaaucaaucucuacaauuuuguuuuaccuuuauuugacacuuauauggaaacaaaacuuuuaaaaaauccuguggaacugcuacuaauaucucucauaaguagugccuggaggaacacacuuugggaaaugcuauucagauaaagacuaaauuacucaaauuauuuaaauaaauauauaaacauugcuuuccgucaaauugcuuaugacccuuuuaaaaaaauaagaccaaagaaacacaacccguugagaaauaaaauuuugguauaaauuuaauauaaauuaaaaagaaacacaagaaucauagaaaagaagauaauaugccaauuuuagaaguauacgccauacauaugucauaaagaagggucugagcuucuaacacaaaagacacuaaaaaaucagagcuuuaaauauacuuaccauacaaggguuuacagugaguacacucuuaauaaacugaaauaacaggaugcugggcuguuuaacuacacuccugaggucagacucaauuucaguguuuugagaaccaaauccgcugauuacccauaggugauagccuucugcaccccagcucuuagagagaagaggagggagaaaaaaagucagagcaauaaaaggcuuuuguaucccuuucuagcuucaauuauucaaauucugaaauagccaaugauagcauuauuaaugauuugugaagguuggagaaaccgugauaacacagacaagaaucacaccuucaguuaccucuuaacuaacuccagaggaaaucaccaucacugcucucuaucugcaaaagugaaaacauuaccuaccauucuuaaugccaauuucagggucuuaauccuaaaaauaccuacugugcucuguaacuucucuauugcuuuaauuuagcugccucucaaauacaaagaaauuccuuacagaagacaccccagguuacccaguagaagccuggcaaagaagccccuacaacagaugcaguuuuguauggagcaaaaaacauuggauuggaagcugugagacuagagucuucauuauagcuuggcuuuuuguauauauuaccuuggccaagcugucucguuucucgggauauaaguuucuuccucuguaaaaugagaagguucaaauaaauuccuccagaaccauucaguuuuaauauucuguaacuagacuccaugauaguauuuuuaaagauuagugauucucaaucuucaagccaagaaaauggugaaggggcagggguagcccaugaauuguugcaaaauuucaaaaguuuaauagaacuuuuauguuuuccuaugauaaagcugccuaaguuuuaacuaauaaugcuuagauucuuaguuugugguuaaaauaucaacuuagugagacggacaacacugguucuugcaugccauucagaagcacugauugguauuuauagaaauguguggugaaaacuuauuuuaaacuauggaggugggcaaagacaucagaagggguccuugguggugaaaguuugggaaccacuauuuuaggcaaccauggcgguuuuaauucuacaagaaacucaagaucagaagaaugucuuccucuguggagcaagagagaagagaagcgacaagccucauagucacuaauuuaaaaaggaugguaugcagaggggcuauagcaagaaaaacuuguuauguaaagacagggguuuuauaucucuguuuucuacagaaacucuugaaaauagguaaaaaauaaaaauacagguuaagccucccuaauccaaaaaucugaaaugcuccaauagcugcaacuuuuugagggcugauaugacaccacaguaaaaaaaucccacaccugacuucaugugaugagcugcagucaaaauuuuguuuuauguacaaaauuauuacaaauucauuacauuagcuucagucuaugugcauaagguauauauaaaacauaagggaauucuguguuuagacuugagucccauccccaagaauguauuugcaaauauuccaaaauccaaaaaguuccaaaaucugaaauacuucugguuccaagcacuuugguuaagggguacucaaccuguauuguuuacaacagugaccauaauucucuuugacauacaucuauguaaauuuuaaaaaauaugcucaagguacuguauacauauauauagauauauagauacagauauccucaaguaaugcacaagugcauguccuccaggaaaaaugcccaaugagcauuucaccucauguuaaaagcaagcaggccaugagaagacacauacaaaaaaggccucaucugaacagucauuaucaucauaaagaugacagggguuugcuggccacaucuaaacaaaaugcaaauacugaaaaccaggcagccuuccaauuaaaaaaaaacaaaagacuuucaucaagcaagaacuguauaaugaagagucugcugagacuaaaauaguuuugugauuuuaucagaucaacaugagugaaaaaagggggccagccugggcaacauggcaagaccacgucucuacuaaaaaucaaaaaaauuaaccguguguggauaguggugugccuagagucucagcuacuuggaagcuugaggcaggaggaucgcuuagagaggcugcagugagcuaugaucugccacugcucuccaaccugggugacaguguaagacccugucucaaaaaauuaaauaaauaaaaaugagugaaaaaagggaagaaaaauccaaguuuuuuuaauaccaugccaauuuuuuauagaaaguacuuaccauagaguugaucuuaaggggaucuuuuuuggugccaucagaccuauaacugaaacagaacagaaacuaaauauaauacagccuuccaauuacauauaauacacauaaaauuuaguguuuuuuaaaaaaucaaacggauuuugcuccuuuaaaauagaaauacauaauaaugcaugaaauacaaaacuguggguuaauacaccuagguguauauaucucucagccacauuuuccgagguccaagugacuucuugccagagauaugcagcuuuuaaaggugugcucauuucaucagaacugagguucaggguaguauaugaagugggcagagauaccaaccuacuccuaucaaucacugggcuaaccuacauuaaccuaaugagauaacguaacuuucuacuauuuauguacaugccuuaccacccucauuagauuauaaacuaccuaaaagcagaaccaugccugauucugcuuugugucuaacaugcugucauauauacagcagggguucaauaaauaaauacauuuuuguggaaugagauguacauuuuuuaaaaaaugaauguucagagaaucaguauauucgaacagauuaugaacuuugcaaauuguuuuaagguaagagucaaggcaaaaagggaaguucugacacaagguuuuuguaugcaugcauugugagaaauaauggaguuauuuuaucuaaaaauugucuuuuuugacuuacgcaaaaucuccuccaaguguacaaaucagcugugcuccaaaaacacuccauaaagaaaggccuccguauucccaggucacuauuacaacacuauugucaggagaccaucucaucaauuuaacagcuccuguuuuauuccaaaugucuguuaggaaauagugagaagaguuaaaaauaaauaguugcuucagaaauacuuguuuuuuuuuuuuuuucaaauacaaucuguauuuucaaaucuaaaugaguagaaagguaugacugcuuccaaaaauaaauccuggucauuuaggacuacuuaaaguuaguaaggccauuaguuuuguccugaucuaagcagaacaaacucagugcacaggugauuuguaagaagugaaagcuguuucuagucacuauuagcuugauuaacuuauaacugcguaaucuuaaaagucuuuggcuuuguauaaaucaguuucuguaaaacaaggauaagguuacaguaaaagcugucuuuagaaaaaaacauaugcaggccuuaaaaaaagcuacacaguaagaaugauuaaaaaaacguaaggagcaaauuucuauuucuggaaguacagcaaaugacacccugaaugacuuccacacugaaaaaacuaagauggugaauagaauacuuaaauccucaaaacaauaaaaaauacugagacaaagugcuuguucccugaauuuuucugccaaacccuggagaccuuuacuucuaccucugaugacucacagcauguuaggaacaggagauaaagcucagagcuugcccaagacagguaaucuaacaaaagauacccauguaaagcugggacuacaauggacuauauccaugguauaagagagaaugagaaaaaagccucugccauguaggaaaagaauuagcaaggaacacuuucauguuucaucaguggaagugaauggaaaauaauacucccuugauaaucugaagccacaaacccucacucugauuuguaauuugugcaauuuaaugugguucaaacagagaauacaaugcaaagggucacagacugauguagugcucccaagugaccagcggaagcaaagaaauuuaaauccucucuggaaaaacucaaauguuauccaguucucaaagcgcuacacacacaaaaaauaugcuucaaggaaaacaaucggcucucagucaaaaauccuaaaauacacacacaaacgagcaagaacacaaagaaucaagacauggcagaaacagacucagaaaggcuucagauuuugggauuaacagacacagaauauaaaauaacugcuuuuuauagccaaugaaaauaaaggagaagacucaaacaaggagcaggaugcauacagauuggaaaaagagcuaaauaagccuuuaaauaauaaaaaauacaauaacugaaauuaagaacuugauggacagaucaaacaacauuauuaggcauaacuggagaggaucagcaaaccuagauggagaaaaaauuucuagaaugcagucuagagaaacaaaauuuuaaaaaauuuaaaguuagguuaagaaacauggaaaaaaguguaauguauaucugaguuccagaaaauagauuaggggagaggaauauuuagaaauacugguugagaauuuuccagaaauaguucaaagauguaaaucuucauccagcaagccuaagucucaagcaggauuugaaaaacaaacaaaauucuucccuuccacaucacaguugaacugcagaaagccaaaaacaaagacaagaucugaaagguagcuauaaagaccaaucuauugaaaagagaagacaacuugacagaggaccucucaauagcugcaauggaaauccaauggcacuggaacaaauucuucaauguauaaaaagaaaauaacugccaauccaaaacagcacaccaaguuaaacuauaauuaaaucacagcagcaaaauaaguacauuucagacucucccaaaguagaguuuaccuucaaaaaacuucauuaaaagaaauuccaagggauguaugggagguuuuucaggcagaaaauggucucaagaagaagguaugaguuggucaaagauauggugggcaaaaauacugguauaaauguggguaacacuaagucaacaugaauaguuaaauauccuaauugugaugguuaacacugagugucaacuugacugaauugaaggauacaaaguauuaaucccgggugugucugugagggugcugccaaaggagauuaacauuugagucagugggcugggaaaggcagacccacccuuaaucugggugggcacaaucuaaucagcugccagugcggcuagaauauaagcaggcagaaaaaugugaaaauagagacgggccuagccccccagccuacaucucgugugcuggaugcuuccugcccucaaacaucagacuccaaguucuucaguuuuggaacucggacuggcucuccuuccuccucagccugcagauggccuauugugggaccuugugaucaugugaucauuuauuaauacuuaauaaacuccccuuuauaaauauguauguaucuauucuauuaguucuguccccuagagaaccuuacuaauacagauauugguaccaggagugauucuagagguacagaauauuaaggauggaguuccuucauugguuuugggguuucuagaguuggcugccuaauaucauuagaccccaaaaugcuaaggacucuauuucuaauaguacgcacugacaguccuugacgugaacuguuuauauagaguuaugcaaaauaaaugcauuuggcacuccugauucauugcuugugagacgcaaggaguuuagugacucuauacauaacaccuuugaccauauguggagaaucaaggaacauaaugaagcuaguugguugcuccuaaguucagugaacaaggugaugaaagaaaaugaugaacucagggauuccaucucccagaagcagauacugagccucaaaacugcuaagauugcccugagugagggucuuaucuccuauagagaaagagcuaaaauuguggaaacacagagacaaacucuuaucauuugaguggcugaucugcaacaaaaggugcaugcacagccucaccaggugucuacuguuaaagugaaggcacugauuggaaaaaaaugggacccugcaacuuggaaaggggaugugugggaggacccugaugaagcuagauucacugaguuuguaaacucuggugaaccuuuuuuuuugccagaagaaacagcuuuccccauccccaauaguggcaacauccccuccuggacccaugcugccauuagcccuuccaccuuugucugaggauuauaaacccugugcugccugaggcaacagugaugcccuccccugaggcagucgccaggcaagauaauguugauucuccucaggagccacucccaacaccucuguuugcuucuagaccuaucaauaaaguccuggcaggccucuagaggugagguugagaguaugacccaugaggaggugcacuaugggaacugcuugaguuuucuaauuuacauaaauagaaaucuggagaguaggcaugggaauggauauuaagggugugggauaaugauggaagguacacagaguuggaucaggcugaauuuauugauuugggcccacuaaguagggauucugcauuuaaagcugcagcucggggaguuaaaaaagguucuaauaguugauuugcgugguuagcugaaauauggauuaaaagauggcccacugugagugagcuggaaaugccugaucucccuugguuuaauguagaggaagggauccaaaggcuuagggagauucagaagguggaguggauuagucacuuuagaccuacucaucccagcugggaggguccagaagauauacccuugacugaugccuugcaaaacagauuuacaagggcagcagcuacaucuuugaagaacccuauaauugcacuucucuguaugucagaucuaacagugggaaccucagucacucaacuacaaaauuuaaauacaaaaugggaauaacuggauccggagguagcaggggccaagugacggcacucaacuaucaaagguaaggugggcguagcuacuguaauggacagcagaagcaaagcagcaaucagaauagucugacuuguguagaacuugggcauuggcuaauuaauuaugguguuccuggaagugaaacugauaggaagccuacugcauucccacuuaauuuauacaagcagaaaacuucuaggucaaauggacaaaauacuaauuugaauuauuaaaacagaaucacggccccucaaucaauuuccagacuugagccaguuuacacacccagagccccaauauuugaccuauagcaugacauguauuguuuaacuuaaaaucagcaucugcuacaaauggcaauaccaguacauuaaaaauguuaaaaaaaaaaaaaaaaaaaaagacucaccaggauacuguuuugcuguuagcucuaauuuaugagauagcagcauggcuccagugcuguuaucuauuguauagaccugcacagaaccacugugaaaacaacaacgaaaaacuuuuagugaaaaaagacaaauacaaauagaaaaagcauuauagaacucuuauguuuugcuggugggaguguaaacuagaacaaaaccacuuugucaauaaguugcagucaucucauaaauuugaacaaaggcauauucuaaucuagcaauuucacuuccagauauaucccagaaauuauugucuaauguuuacuagagauauguacaauguccauuguacuauugugauaauuuuuaaaaaaggaaauagccuaucuagcaacaugaggaaaaaaaugaacuuuuauuuggcuauaguacauaugguauagcaauauaauacuauaccuuacagcacugaaaaugaaugaacuuuagccacauggauagcgaauacaguuaacccuugaacaacauggaucugaacugcaugggcccacuuauacauguauuuucuucugccucugccacaccugacauaccuccuuugccucuuccucaagccuacucaacaugaacacggugacaaugaagaccuuuaagaugauccacuuccacuuaaucaauaguaaguacauuauuucuuccuuauaauuuucuuaauaaucuuuucucuuacuuuauuguaagaauacaauauauaauauuaauauauauaaaauaaaaaguauguguuaauugacuauauugucaguaagguuuccagucaacaguaugcuauuaguaguuaaaagucuugggcgagucaaaaguuauauguaaauuuuucaacuguguugggggguugguaccucuaaccccugggcuguucaacggucaacaguauauacguuuaagauauaaaacauguguguguguaaaagcauaguaaauauaaacauacauauuugauauauauauaguagauauacaguauuaauaguaaauauauuugugguaaaaauacaacaaagaguuaauguauacaaauuucagauuagugauacucugguggagaagggaguaucaaagaagagggguaaacaggaggcuucaucagcacuggugauguauuauuucuuauguuggaugguaauuuauaaacauuuuauuuuuaaaaucuauaugcuuuuuuguguauaugguauauauaauuacuuaauuuaaaacaucuuuacaagggucaaauuucugaagggccugaagccagaaguaaaaucucuauaauacgucuaagccacauuucaaaauugaacuacgaggauaacagaaaagucucauuucugcucaugguauauucucaguucaaaaauuuaaugcacauucagcauuugaaaaugaggcuccuguuuuagauuacuuaugcaacauuuauagugagaaagagaaacaaauguucuuaaagacacuuuuuaauauaagaaugcuuuugcacauaauaggaugacacugguuuaugacuaccagauuguuuuuuuuuuuuuuggugguaggagaaaucagaugguuucuucacagcagcuuugauccauucccauccagguccuaccucuucucaaggauuagaacugggacuaacuaaaagaccugcaauaguagccuccuuaaaguugucccacagcuuacugauacucuguuuuuguuuucuuuuuuuucuguguuccauuuuggauaauuucuguuuuucaaguucauuaaucuucucuucugcaaugucuaaucuguuguuaguuccauacaguauguuuuucaucucagacaucauaguuuucaccucuagaaguuuaauuucagucuuuuucuaauaucuuccaugucucaguuuaauauucaagagagacccucuacagcucucugaaguucucucuuugugccaccucuuuggugucuauauuaugaacucuagcugccuugguuuucccagauucucugauuuccaugugcuuaucucagcucaggauguaucuccccaauccugugcugcagccuacaaacacucaaaauaauaaaaacuaagggcaguuacagagagauaauuuuguuucucaucuuucagaaaucacugucccuuguuaccuuauguuuguguucugaauucaaaacagcucuuucauauuuuuguccguuuucuuggcuguaucaggugggagggaaaaugucaucugucauucaaucauacccagaagccaaauaucugaaaaagauuucuuuccagacuaccugcccaaauagaucaacucuugcugagagacagcacuaaguggguagcagguguuuguuuuugcuuugcaucugacaacugucaacugcuaacccuggguugcugagcucuaaaauguuagugaggaguccauguuuuaaauauaagaaguaggugcuaaguuacuacuuauaaaagucugacaaucuuuuagguauucuauagugcuuguauucuuuaaacuacuuuuccuuccauuucucaccagcccaauguaacagaaaaauauauuuucauuaaaaagacaggacuuacuaacuccaaagcaaaucucuauaagagagauaugacuauuaucaccauaagugaucaaauuuagugucauuaauacugaaacaacuugacauuauuacuaaaugauaccauaggaaauauauaucaucacccaugacaaaauguguaaccagaaucuaguaauaccuuuaaauauuuagguuaacaggaagguuguuaaaauacugaucugcugcaaacuggcauccuaaaaggaagcuggcuucuuacacaacucuaaggacaccagcuaucaccuaguguucaagguaauuaguccugauaaguguuggcagaucuggacuagcagacacugguuuguuaugucaacagcuagaaucacaaaacuuuaacccuaacccaugggcaugcuagaagagaacuuguagucucguagcugaugaaaacugaggugacugaaaagcuauaggccaagagucuaccuacauuauccugggaagggcuaguacuucccaaucauguagcuuauaagcccauagccuagggaggaguacuucuucuggauucuaacacccacccuugugcuggccccaaaugcaguaaauggaacugcacacuugccacugcuucugucucuguguauuuucucuaaauacuuuuccaugccugaugugugggcuuucuagucacuugacuguauugcucaacaagaacuagcuuccagguuagucacgacaggugucagauaaacaagguaaaugccaucaugaggaaacaauaaggcaaaucuaggaugcaggauauucuauaaagaaucgacucagacucaaaaaaagucaaugucaugaaaauaaguggcauaaggacuauuguaguuaaaagguaacuaaagagaaauaauaaccaaauauuauuaaugaaucuugaucgauucuguuuggaacaaaggagcuauagaagaaauuuagcugguggcaacuggguuaauuugcauauaaauuggguauuagauccuauuagggauuuaucauuaauuaucucaugugauaaagauauuccaauuauacaagagaaugucuccuuuuuuagaaaccaagaaauaaggcaaaaguaugucaacagcaaaguggauaaauuaugcuauauucagacaauggaacguuauuuauaaaccaauuuaaaaaaugauuacaacuacugguaaaugacauggaugaaucucacaauguugaccaguuacuaagugagucaaggagggaauaagaguugugacuaggaaguagcagaggcaguuugugacuggagaccaguaauguucuauuuacugauccaguugugaagagauggguguuucuacuacaacguuaaaacuaugaauaucuggauuauguacuacuuuguaugcauauuuuuguuucacaaugugaaauaaaaaggguauuauaaacuuuaugccaguaaguuugaagguguauaagaaagaaaccaauuccuggaaaaaaugcaacuugccaaaaugacauaggaagagauacaaaaucugaaucuucuuaaaucuauuuuuaaaacugggccgggcccaguggcucacaccuguaaucacagcacuuugggaggccgagguggauggaucacgaggucaggaguuugagaccagacugaccaacacagugaaacuccguucuacuaaaaauacaaaaauuagccgggcaugguggugcaugccugcaauccgagcuacucaggaugcuaagacaggagaaucacuugaacccaggaggcagagguugcggugagccaagaucacgcucuugcacucuagccagggcgacagagcgagacugucucaaaaaauaaaauaaaauaaaauaaauauauauauauauuuaaaauauauauuauauauauuuauaauauuuaaauauauauaucuaaaauauauacauuauauauauguauauuuuuaaaaacugaauugaaucaguaguccaaaaaaauccacaauaagaaaauucuaggucuagauggcuucucauuggcaaauucuaccaaacauucaaagaugaauagagaagacaaagaagggagggauucucauaacuugcuuuaugagacagccauaaccuuacucagaagaguaaagaggaaaauuauaggugaaauguauucaugaacauacauuuuaaaauucuaaacaaaauaugacugaauccaauccacaaacauuaaaaaaaagcuuuuccuucucucuuguacuaaguuaaacuuacucguauuucuacauuuaacugcucaaugaggaucaauguauugagaaaaaguugaggaugaggauucccuacuuuacaaagaguuuauuaagaguguaaugaaagugauuuaugugaauuauuuauacuaauaaaaaaaucuggccgggcacgguggcucacgccuguaauccagcacugugggaggccaaggcggaucacaaggucaggagaucaagaccauccuggccaaacacggugaaaugccugcucuacuaaaaaaauacaaaaaaaauuagcugggcaugguggugggcgccugcagucccagcuacucgggaggcugaggcaggagaauggcgugaacccaggagacggagcuugcagugagcugagaucgcuccacugcacuccagccugggcaacagagcgagacuccaucucaaaaaaaaaaaaaaaaaaucuuugauacuuaaauuggguggugaugauauggcuggagacuauacuagauauauguucuauagaacaaccaagucucauuuugagggcaacauaggauuuuuuauuuaagaaagaguuuagaaaacuaaaaagcacuauauacauugcaaggcauuauaacaacuaauauaaucguuuuauuuuagcuaaaauuuaugagcuaaaauuuaagcucaaccaaguucaguaucuuuguuuucuaauguaucaagugcuuagaacuauggcugguaugugauaggcauacagauacuuguugaauaaauaauuuuauucaauuuuuuucuaaaaucucuauuuaauaaacuaaggcaagaaacugguuuuauaugugcacuuuaaauuugcuuguuaacuaaagcacacucacuaauuugaaggcgucaugaaugcugaugucuuaaaaauuaagauuuaaaaaaaucuuccaaauccucuuuuaaacaauaaagaaccuaaacuuuaacugauuuauucuguuuaacuuguaacucaauuuuccaccacugaagaaaacgcuaacuuuuacaaauuaacaugcucaaccuccaaaaucugcccuuuacuuuuguuuguuucaaucuaauaaaauacuuuuacauuucauauuaagguugacugauaaauuaugauagcaugaugcaguuuauaaguauguuaggaacaucuuauguuuacaaaaaaaaaaaccaguauuuuuugcaacaacucuuaaaaaugcaaaagccuacaucaauuauaccucacacagccaaaugccauuagucgauacuuguuauuuacugcuacacacguuccgucaacaacaucuuguggccaaacuccaugaagcugcuauaauaaagaaaaauaguuaaggcuuaaaaaguguuucuccaaauuuaccguagucaauauaauucuccuucaauaaacauacaauuucauaaugcuuuauuugguuucaucugcagaggaaaauaucccaccaggacuaccacaauagucucccuuaaaauacuaccaaauagucucccuuaaaaccucaaacuucucaugaauuggucugauaaauacucagcucaguccagugcuaguuaauuuauuuaaaaaacacuaaaauauggaaauucaucuccaaauucaaauaaagaugacuuucuuguuagaauguaaacauuuugacagcggaaacagcaucuaacuugcucacuguaauuauucucaucaccuagcacauaguauuuaacuucucagucagugaaaaguaguacauucuguuugguuuauucuuuagaagcaaaauugcuuacuauucucuacaauucccuucuuuauaguguaaugguuaauagcaugguaucuggaagccugacagcucaggacugcuuucacuccucaaaauaaguauuugaucuuuuuuaagcuucaguuuucuuaucguauuuaccucucaggguguuucaaagauuaaaugaagauacacauguaaacuauuuaggacaaugccuaccauucaacaagcauucaauaaauaaaugacauuauuaguaagcauauaugcuauuuccauaugccaucuccauauauagagaauagauucagcucaguuguuugcuccuaucugucaaaucacagacauuuuagaugauaaauuccaaggcaaaggucauaaucauuaguucaguuagcagaaaaaguggcacacuauaauauagcacuuuauuuuuggaugauccuaauaguaaacauuaaagauacaauauaaucacaacuauaugaacuagaauccuacagauuucauuuaauuccacaaucagcuauauaaucuacuaucuaaacacggaaucuuugcuuuaguaggaauuguaucuuuuaauuuuaauaauaaaacuggacauuuuaugucacaaaugguaaagacagcagugagcauuauuucucugaacugcugcuuagacugaaauucaguccuacaauaaguauuuucuaggugguuaccauucaccaggcacugcucuaggugcugaggcuauacuagcacaccaaaaucucuacuuguaugcuugcuuuacauuugagucaagagacagacaaguuaaaaaaguauauugaauacuggagguuaaaaaauacuauacaaaaaaaauuaagcaaugcuggugaagagggaguacaggggaaggauguaauauuaaacagguuucccuauaaggaugccuuuugaggaaaguccucaaagaaauaaaacaaguguaaaagcccuaauguaggagcauuucuggcaugcucaaagaccagcaaagaagccuguguggauagagugaaguggauggguugugaaaggaaaguaguauaugugguaagagauguaacaggaggucagauaauuagggcuuugaaggccaccauaagaauuuuggcuuuuucuucaaguuauauagaagaagaauauucaaauuuuuuaaacuuuucugucaugaauuauaauaaagaauacaugaaaaugaaauguacaucucaauaucacaaagcaaacacuuguggaauugcuacucaggccaagaaucaugaguacccaaaagucucccaauagugcccuucccaaucacuguauccucacaccccuacaacaaaaaauauccagauuuacaugguaaucaccuccuucuuucuuuuaaaucauuaccacuuaaacaugcacccauauauacucuaauuuagaaaugccuacauuauuugcccuuuaauuuuuaccuaaaauggaaucauagcauguauuccuuugugucuagcuguuuuuugcuuaccaugucuguaagaucuaucuguguuguugcauauagccuaauuuguucauguucauuguaggcuuaaauauugggcuuagcucacuggauugcuggccucccuuagucuggcaacucuuuacugucuuguuugcucucuaagggcuucaagcauauuaaaaaauauauuuuuucuccagcucuuuuaguccucaggagguucuguccuaauaaucuaguccuacugaaugagucuccacagaggacugacauaaucacauuuuaacacaucuguuaaaugucauuuaguuauuucccuauuaccauuaauacauagguacuguuuucuuguaauuuguauuuucuaucuauaccuuauuuaguaaugcccaucugcuuuucauuaguuuuuaaauccuuaacuuauuagaaaaaauuauuuaauuacauacuaauaaacacugagaauauauuuuguacuaacucuaaaguacuuggaaaagagucaaucacuuuuucagcucuaauauuuuuauuuccagucuaaacauuuaagucccaaagauaauuacaaauauauaugcaccuuauaggaaaaaaaaaagaguuuuuucuaauucaucaaaaguuuauuuuuauucuuauuuauguucugacacaggugaucacaaauacauuauuuaguaccuuacuaucugaauaaaguugauaacggaagauaguagauaggaauauuaaaguugauaccaaacagaaugacaacaauuaaaaaaggccauuaaaaacuuaaauuccuuuccaguuaaagagagaugacugaauauaaauauuuagcuucuuggacuccuaaaacuguaacuucuagaagagaaaagaguuuuuguuuaaaaaaacauaaagcagcaaagacaaaaauaauaggaggcggcauuagaaaauuuuagaagcuggaaagcauaucaaugaguagaauccuuaacugacagggaagaaugcugagaaacgucuaaauuuaaguuguaggguacacgaaaggcuugggaauucaggggucuuugaaaggcuaaauuaaauguaguagaagugguucaaaaccuacuuaaagaagcaaccagguccucccagagcacuuccccaaagcugagcagccaauaaauacccuaccuccacuccuacggaaaacuggauauuuuucuuuggagaaaaacaaaacaaaacacccccaccccuaccaccuccaccagaggccuauggaccacacugaaaacagggauagaaaauaaagguucacaucuugaauuuggacccgcuagcuuaacucuucuguaacucaaaucccagaauacugggguagccaaguauauauccucuagaaaggacugcaggacucuuuuccaaggaacacuggagacagagaggggagaggggagcagaagggagggacagagggaaggguauggcucuaaagguaggaggacccccaaguaaauaacucagucagcucauccuaugguaaaggacauaguaaaccaaacgaaccaaaauucacaguuuucaauaaauuauuuuaauuuuaggucucugucacagcagccaaauccauauauuaauuagcuauuagcuauuaaaagauccgacacaaauaagaguaaagggaaucucaggauaauuaugacagaaggccaaaaaacagcuguguuaaagauuauaguaagcaagcagucuaauuuggagcaggccagaaggcucccagagaaauuucuuuaagaagaugaaaugggagguuccaagauggccaaauaggaacagcuccaguguacagcucccagcaugagugaugcagaggaugggugauuucugcauuuccaacugaaguaccagguucaucucacuagggcuugucagacagugggugcagcccauggagugugagcccaaggaggacagggcaucaccucacccgggaagugcaaggggucggggaauuccuuuucauagccaaaggaagccaugacagaugguacauggaaaaucgggacacucccacccuaauacugcgcuuuuccaauggucuuagcaaacagcacaccaggagauuauauccugcgccuggcuuggagggucccaugcccauggagccuugcucacugcuagcacagcaacucagauugaacugcaagauggcagcgaagcugggggaggggugucuaccauugcuaaggcuugaauagguaaacaaaguggcagggaagcuccaaguggguggagcccaccgcagcucaaggaggccugccugccucuguagacuccaccucugggggcaggguauagcugaacaaaaggcagcagacaguucugcagacguaaaugucccugucuaacagcuuugaagagaguagugguuugcccagcacggagucugaggucugagaacagacagacugccuccucaagugggucccugacccauaaguagccuaacugggagacaccucccauuaggggccaacugacaccucaauccagcugggugccccucuaagaugaaccuuccagaagaaggaucaggcagcaacauuugccguucugcaauaugugcuguucugcagccuccgcuagugauacccaggcaaacagggucuggaguggaccuccagcaaacuccaacagaccuacagcugaggguccugacuguuagaaggaaaacuaacaaacagaaaggacauccacaccaaaaccccauauguaugucagcaucaucaaagacuaaaggcagauaaaaccaaagauggggagaaaccagagcagaaaagcuaaaauucuaaaaaucagagcaccucuucaccuccaaaggaacgcagcuccuugccagcaauggaacaaagcucgauggagaaugacuuugaugaguugagagaagaaggcuucagacgaucaguaauaacaaacuucuccaagcuaaagaaggaugcucgaacccauugcaaagaagcaaaaaaucuugaaaaaagauuagacaaauggcuaacuagaauaaacagcguagcaaggaccuaaaaugacgugauggagcugaaaaccaucgcacgagaacuaugugaugccugcacaagcuucaguagccgauuugaucgaaugauugaagaucaaaugaaugaaaugaagugagaagagaaguuuagagaaaaaaagaguaaaaagaaaugaacaaagccucccagaaaaaugggacugugugaaaagaugaaaucuacgucugacugcuguaccugaaagugacggggagaauggaaccaaguuggaaaacacucugcaggauguuauccaggagaacuuccccaaccuagcaaggcagaccaacauucaaauucaggaaauacagggaacgccacaaagauacuccucgagaagagcaacuccaagacacauaauugucagacucaccaaaguugaaaugaaggaaaaaauguuaagggcagccagagagaaaggucggguuacccacaaagggaagccuaucagacuaacagcagaucucuaagcagaaacucuacaagccagaagauagugggggccaauauucaacauucuuauagaaaagaauuuucaacccagaauuucauauccagccaaacuaagcuucguaagugaaggagaaauaaaauccuuuacagacaagcaaaugcugagagauuuugucaccaccaagccugccuuacaagagcuccugaaggaagcacuaaauauggaaaggaacaacugguaccagccacugcaaaaacaugccaaauuguaaagaccaucgaugcuaggaagaaacugcaucaacuaaugugcaaaauaaccagcuaacaucauaaugacaggaucaaauucacacauaacaauaguaaccuuaaauguaaauggacuaaaugcuccgauuaaaagacacagacuggcaaauuggauaaagugucaagacccaucauugugcuguauucuggagaccuaccuuacgugcagagacacacauaggcucaaaauaaagggauggaggaagaucaaccaagcaaauggaaaacaaaaaaaagcagggguugcaauccuaguaucugauaaaacagacuuuaaaccaacaaagaucaauagagacaaagaaggccauugcauaaugcuaaagggaucaauucaacaagaagagcuaacuauccuaaauauauaugcacccaauacaggagcacccagauucauaaagcaaguccuuagagaccuacaaagagacuuagacucccacacaauaauaaugggagacuuuaacaccccaccguaaacauuagacagaucaaagagacagaaaguuaacaaggguauccaggaauugaacucagcucugcaccaagugguccuaauagacaucuacagaacucuccaccccaaaucaacagaauauacauucuucucagcaccacaucacacuuauuccaaaauugaccacauaguuggaaguaccccucagcaaauguaaaaaaccagaaauuauaaccaacugucucucagaccacagugcaaucaaacuagaacucaggauuaagaaacucacucaaaaccacucaacuacaugaaacugaacaaccugcuccugaaugacuacuggguacauaacgaaaugaaggcagaaauaaagauguucuuugaaaccaacgagaacaaagacacaacauaccagaaucucugggacauauuuaaagcaguguguagagggaaauuuauaggauuaaaugcccacaacagaaagcacgaaagaucuaaaauugacacccuaacaucacaauuaaaagaacuagagaagcaggagcagacacauucaaaagcuagcagaagguaagaaauaacuaagaucagagcagaacugaaggagauagagacauaaaaaaaccaucaaaaaaaucaaugaaugcaggagcugguuuuuugaaaagacugacgaaauugauagaccacuagcaagacuaaugaagaaguaaagagagaagaaucaaguagacgcaauaaaaaaugauaaaggggauaucaccaccgaucccacagaaauacaaacuaccaucagagaauacuauaaacaccucuaagcaaauaaacuagaaacucuagaagaaauggauaaauuccuggacaaauacacccucccaagacuaaaccaggaagaagcugaaucccugaauagaccaauaacaggcucugaaauugaggcaauaauuaauagccuacuaaccaaaaaaaguccaggacgagacagauucacagccaaauucuaucagagguacaaagaggaacugguaccauuccuucugaaacuauuccaaucaauagaaaaagagggaacccucccuaacucauuuuaugaggccugcaucauccugauaucaaagccuggcagagacacaacaaaaaaagagaauauuagaccaauaucccuuaugaacaaugaugcaaaaauccucaauaaaauacuggcaaaccgaauccagcagcacaucaaaaagcuuauccaccacuaucaaguuggcuucaucccugggaugcaaggcugguucaagauacgaaaaucaauaacgguaauacagcauauaaacagaaccaaagacaaaaaccacaugauuaucucaauagaugcagaaaaggccuuugacaaaauucaacaguccuuccugcuaaaaagucucaauaaacuagguauugaugggacguaucucaaaauaauaagagcuacuuaugacaaacccacaaauaucauacugaaugggcaaaaacuggaagcauucccuuugaaaacuggcacaagacagggauguccucucucaccacuccuauucaacacaguguuggaaguucuggccagagcaaucaggcagaagaaagaaauaaaggguauucaauuaggaaaagaggaagucaaauugucccuguuugcagaugacaugauuguauaucuagaaaacuccauagucucagcgcaaaaucuccuuaagcugauaggcaacuucagcaaagucucaggauacaaaaugaaugugcaaaaaucacaagcauuccuauacaccaauaacagacaaacacagaaccaaaucaugagugaacucccauucacaauugcuucaaagagaauaaaauaccuaggaauccaacuuacaagggaugugaaggaccucuucaaggagaacuacaaaccacugcucaacgaaauaaaagaggacacaaacaaaugaaagaacuuuccaugcucauggauaggaagaaucaauauugugaaaauggccauacugcccaaggucauuuauagauucaaugccauccccaucaaguuaccaaugacuuucuucacagaguuggaaaaaacuacuuuaaaguucauauggaaccaaaaaacagccugcauugcgaagacaauccuaagccaaaagaacaaagcuggaggcaucacgcuaccugacuucaaacuauacuacaaggcuacaguaaccaaaacagcaugguacugguaccaaaacagagaucuagaccaauggaacagaacagagcccucagaaauaauaccacacaucuacaaccaucugaucuuugacaaaccugacaaaaacaagaaacggggaaaggauucucuauuuaauaaauggugcugguaaaacgggcuagccauauguagaaagcugaaacuggauccuuuccuuacaccuuauacaaaaauuaauucaagauggauuaaagacuuaaauguuggaccuaaaaccauaaaaacccuagaagaaaaccuagacaauaccauucaggccauaggcaugggcaaggacuucaugacuaaaacaccaaaagcaauggcaacaaaagccaaaauugacaaaugggaucuaauucaacuaaagagcuucugcacagcaaaagaaacuaccaucagagugaacaggcaaccuacagaaugggaaaaaauuuuuaccaucuacccaucugacaaagggcuaauauccagaaacuacaaagaacuuaaacaaauuuacaagaaaaaaaucaaaccaccccaucaaaaagugggcgaaggcuaugaacagacacuucucaaaagaagacauuuaugcagccaacagacacaugaaaaaaugcucauuaucacuggccaucaaagaaaugcaaaucaaaaccacaaugagauaccaucucacaccaguuaaaauggugaucauuaaaaacuuaggaaacaauagguccuggagaggauguggagaaauaggaauacuuuuacacuguuggugggacuguaaacuaguucaaccauuguggaagacaguguggcgauucuucaaggaucuaaaacuagaaauaucauuugauccagccaucccauuacuggguauauacccaaaggauuauaaaucaugcugcuauaaagacacacgcacauguauguuuauuguggcacuauucaaauagcaaagacuugguaccaagcccaguguccaucaaugacagacuggauuaagaaaauguggcacauauacaccauggaauacuaugcagccauaaaaaaggaugaguucauguccuuuguaggcacaugggugaaguuggaaaccaucauucugagcaaacuauugcaaggacaaaaaaccaaacaccguauguucugauucauaggugggaauugaacaaugagaacacuuggacacaagguggggaacaucacacaccagggccugucgugggguggggcgagggggggagggauagcauuaggagauauaccuaauguaaaugacgaguuaaugggugcagaacaccaacauggcacauguguacauauguaacaaaccugcacgcugugcacauguacccuagaacuuaaaaaaguaaauaaaaagauagauuuagaaagggaucucugauaucacagugggcuucagaaaaccaguguaaguucuuucuaguauuaaagucagaaaaguuuaugugaagaaauauuuacaugugcauggaggcuaugaacaugcauguggacgugugauacauaccuauagacccacacauacacugcauagguacacacacacacacacacacacacacacacacacucucucucucuuauaguuuuugcaagcucauuccuucuguaagccauccuuaagugauauaguuccucgggguaaaaaaaaaaaaaaaaaaaucucuuccuccauuaaauuguuuugugguacuguggaaaaaaaaaaaaaaagaagaagaagaugaaaugggcugggcaccauggcugacgccuguaaucccagcacauugggaggcugagguggguggaucaccugagguugguaggucaagaccagccugaccaacagggagaaaccccgucucuacuaaagacacaaaauuaggcgggcgugguggugcaugccuguaaucccagcaacucgggaggcugaagcaggagaaucgcuugaacccgagaggcggagguuguggugagccgagaucgugccacugcacuccagucuggacaacaagagcaaaauuccaucucaaaaaaaaaaaaaagaaaacaaaaaagaugaaaugaacagaacagcuaauauguuugaaaaagcugggaggauauuuacacaacugacaguuuggguugaguaagagauaaguacacaaaaauuaagcaaauguaaagaacaaggcaaucauuaauuccuagcaggaggaaaaaucugcaguaaaggaaaaauaauuauacugacagagacaggaguuggccaaggguccccagugaaaacccacuuucaagcccaaaaagugccugaaggcugaaagaugggacuccuugucccagaugaaacuggugauccagagggauaaauaacugcccguuugccguuuccugagugauucuuucugaauaaugcccacaagcgcacuaggagaaugggguuaaguucacgccuuguucagcggguaggacccuggggcucuucagcgugugugugugcacgcgcgugugugcugggguuugguaaucaaucugugaagugggagccuguuagcaggacaucaucuuuauuugcugagagcuugcuuuuaauaaauucugcucuccucaccuuucaguaugucugcaugccuaaucuuuccuggcugugugacaagaaccugcuuuuagcuaaacuaaggagcaaaaacuucugcgucaguaccacaugguuucgguacuaauggggcuuacauauugauaaaaauauaaacaauuaauaguaaccuaaucaaaaucacaauaacuauaaugggaacaugagaagaauauaaguaugguggaagcagggaagagggaaguaaauggucacuuucaacaguaagaagucaauaaacacagccuaagaacuaaaaauuaaaggaaauauucagaguaguggagauuaaaaaucaaaauaaccaguaaaggaauaacaaguaguugccuccaaaaguggaaaauuaggcaugaggagagcagggaggagaacaggaaucauuauuuuucuuuaacauguccaagagaauuuugucuacuuauacuauuuauauguuugguuugauuaaaaaauuaacaacccuuaaaaucuuacaugaaugaugaaaauagagaagaauuugauaacaaagaauaaaauaaguacacaauaacaaaaaacccuucaaaguaaauaagucauaccucugcaguaaaucuacuugacacugguguaauaaauccaacuuuaccaucauuaaauacaacagcaaacccaucaaguguggcacaguauuccaugucucugauguguacgucugugaagcccaggaaugaaccuacugaugaaaaaaauaagcacaugaaauaggauuaagaauauaauaaauuacucucucacuuuuugccagaaaaaccuguaaguuuaaaaggguaaaaauaaugaccuaacaacccuaaauaauuaaacuguccuuuccuauuaaaugccucucucaccccgccucucauacucugcccaccucuccccuugcauaaguaauuccaaagaaguguucauccauagaagauaccuaacuagacaucaaacauuaaacaacugguucaaccucauguagaaaguauagcuaccucuagaugacugcaggucuacugaaaaggguacugugcaaagauuaauggcuuuccuuccauuugucauuccuucccagugaauaagaugaagaaguccaucagaaguagcaaccaggagaucuuccaacacagacugcaaacuguagguagaaucaauuaauuuuuaagagagcauacugggaaagcaauguguaugaauauuaaaacugcuuuagagaauacucaugcaaaaaugaucaugaaaccauuuacaaaacaucuccauuuaucugcaacuuuaucuauguauauuucaaucuagaaucagaaauccugaaagaaaugaaagacuaugggcacucacagucacaaacuugauaacugauaaaacuaguuaaaaacuacaaauauugaaacagcaaauuagaagauggaaacagaagugauagcagaaagaaagaaaaagagguagagaaaccauaaaaugaauaaacccaacuaauaacaguaugacaaucuagagccauuaaguguagagguaacaaugcucuggcacuuguccaauaaaacuuugaauaaugauggaaauguucuauaucugugcuaucuguaaacaguagcuaugagcuguauguggugacuauacacuugaaauauggcuagugcaauaaaauaacugaaauuuuauuuacuuuucauuaauguaaauuuaaauaaauucaugugugacuaguggcuacuguauuggaguauaguuccaggccaauauauuucuuagguauuagcaagucucacauuguucauuccuucuacaaacauuuacugagccuauccucugugacaggugcuauacugugugcuggauauucgaggaugaauaaaauauucuccgucuucagaggacuucucaggcaagaaaucaaaaauaguuacauagcaugaucucaucacuuaucaauauuuaugaagauauucagcauuuacuucuuuaauggggaaauagccuguuuugcucaccucuguaugcacagccccaagggcaguguuaguuaaaucugucacuaaauauuugugcaaaggaggcaagaagagggaaaggguuagaggaaagaggaacccauaaaugagaccgcaaagguacuggcacaaagaaaaagacaaccagggaaaccaguagaaacugauaucaagaaagccaaggaaguaagaugaauuuaagaaagaguguucaaaguaucaaauacuauauaaggaaaaacaaaaaauguuauguguauauuauauauacccuauuaaauacuauuaaauuccuuuucauacuuaagagcauauuucugaaauauuuuaauccauaaugaugaaaaaaaugucuuuuaguauuuuaauucuuaaacuaaaccuuuaauucuuuggaaaguugacuucaauuacucauacuccaaagauuucagcuaauguagaauuugcuguuuuuuccccaacuauaaaaauacugaaaaagaucagaaacagauguuucuuuacccagcucuauuucuugaacuucacagccauuuguaaucaauuaaaauucccaguuuuuagacauuucacuuuuuaaagcauuauauauuaauuucaaauuuauauuucagugauaaaaucuauguguaucauuugguggguagaguauaaaaaguuuauguuuuagaugcacuacuauaugcuaugaaaauauguaauucaaaaucuaagcuguuggaaaucugaauuacuuuugagccuuaaagaaauguaauuauggggccugagucacacaauaggcagcuauaaucuaggcagcugucaucuuucuuucucugauuauagauuagcuuucuuccuuacuguauuguuuuauaaaugcuguaaaugacuaaagggcuccagggaagaccccuucccucuucacuguugaucuucaugguagauuaacuucccucuuaucuuucuuacacaaagacuucauggcuaucacauugucuuaaaauggaauguuaaauacacucuuuuuaaauuggaaaugaaaacuagcuguaaagacaagccauaaagaaaacaaacuguaacuaaauuguaacucauaaaccagccuuguauagaaaacauuauaauccuacuaaacuuuauuuuccaccuauauaagcaagaacugaacuuuuuuuuuuuuuuuuuuuuuuuuuuugagacggagucuugcucuguugcccaagcuggagugcagugguaccaucucagcucacugcaaccucugccucccagguucaagugauucuccugccucagccucccuaguagcugggauuacaggcgcacgccaccaugcccagcuaauuuuuguauuuuuaguagagacaagguuucgccguguuggccaggcucgucuugaacuccugaccucaggugaucgacccaccuuggccuccaaagugcugggauuacaggcgugagccacugcgccuggcugaacuuuuuuuuuuuuuauuuuuaaacagucucuuacucugcugcccaggcuagagugcaguggcgcgaucucagcucacugaaaccuccgccucccgggauucuccugccucagccuccugaguagcugcgaugacaggcaugcgccaccacgcccagcuaauuuuucuguuugugguagagacaagguuucaccauguuggccaggcugguuuugaacuccugaccucaggugauccacccgccucggccucccagugugcugggauuauaggugugagcuacugugccuggccugcaagaacugaacuuuuaacuuuggaacacugaccccauuuucugaagucuguucucccggauuggucagcuuucugcuugcauuaauuccagaaucugauccuuuugauuacuucaaguugacaaugucaagagaggcaauuuagcagaguagucacugguuuaccagugauuuuccuuggaaggagucagcaucguuuauuccaaacuacauucucccucuccccuaacccuaucucccuagaaaaucacuguauacaacagaguuauccuccaguaaucugacuaccugcuagacaaaacucaacaaucgucugacaaaauuaagaguucauaaucucuauaacaugauaaucagugaugcugcaacaaacaaaugacuggccagaugugugaauaaacaggaaaauguaaccuagagucaagagaaaaauccaucaauauaaauagacuuauagauaaucuugauauuggaauuagcagauaggcuuuuuaaaaacugugacagacauaauaaauaaucuacaggaagagauagauauauccuucucauuuaauugaaaguggacaaacuuguuaaaacaaaggcugagccaggcgugguggcuugugccuauaaucccagcuacuaggaggcugaggcaggaggaaugcuugagcccaggagcucgagaccaacugagcagcacagugagacuaccaccucuaaaaaaauuuagaaauaaaaaagcuggugucaguuguuaaaauacuaauaauucuauaaauguugguaaauagaccuugccccaagucaccuaaguguuugcuacaacugacuccccucccucagaaaaaucuggccaacugaaggauucauuauuggcguaguagggcgaugucagaacccuguucgauaacuaauaacccaugucuuuucaugcuguauugguucuuaaauuuuuguuucuuuugagacacagucucuguugcccuggcuggagugcaguggcacaaucucagcucacugcaaccucugccucccggguucaagcaauuauugugccucagccuccugaguagcugggaguacaggcgugugccaccacacccagcuaauuuuuauauuuuuaguagagacaggguuucacuauguuggcuaggcuggucucaaacuccugaccucaugaucugcccuucuguccccuuggccucccaaagugcugggauuauaggcaugagccaccgugcccagccugguucugaaauauuuuuaauaucacaacuguuaaugaguacauuuaaaaauuuagguaaauacacucuaaguuauauccuuagagagccucuucaaucauugacuucauuaauuuuaugagagcuaugugguaucccaggugugcguguguguuaaauguauguuuaaauuuaggaucuuggcugggugugguggcucaacaccugcaaucccagcacuuugagaggccaaggaggggagaucgcuugagcuuaggaguuugagaccagccucaacaacauggugaaaccuugucucuacaauaaaguacaaaaaauuagcgugcugugacgugugccuguagucccagcuacuugauaggcugaggugagaucacuggagcccaggaggcugaggcugcagugagcugugaucaugccgcugcaauuagcugugauugugccacugcacuucagccugggugacaaggugagacccugucggaggaguggggagagagguagggaaggggaugggaggggaggggaagggaggggaggggaaacucucauuaaaauuauguuuuuaccuucuaaacauucucuauccucaauuaauaacaaaaguuagaugcuuaacauuaauauuuuuucuucaaaucaaaaauaaaagaugagauaguacucuuaccccuauaagcaacagcauaaccaauauccuagccuuaucugacuuauauuuguggugacaggagggaaaauaauugguuauaaaaaucuaaguuucaugucuucucacucgauuuaaaaucuauagcaaauuucaaauuuccagcaguuauguguuucaggugcugauaacuuuguucugaaaugcaguuauuucacuggaguuuugagagaaaccuuacagauuuccaaccaccuaaauucauagauuaaaaccuagcaccugacagguuaaacuuggacaagauggcagaauuguuuuuuuuucuuuuuggcucuuuuucuauucuauuuccaugcaccauacaagguuucccaccagguggagguagaaagccaagccuguacaauuccaccuuuucuugguaccuacagacacucagaauuccuuauguaucaaguuacuuucuugaaaacgauucccaugcugaaauaaauaaaaugugaagugaugaauaaccuugugaccaaggcgaugaguaacuuugaacucaaucuucuguaacacugauuacauuuaagcaaauaauaauuguguucuuuucuaugagaauaagauaugaaggggauggaccaaacaaggcaagacaauacccagccacuugcauaguuuuaauguuucaguaucauucuguacaguacucuaacaagagaaauggugaaauaaaccuuuacuuagaacugugagucagagggauuuuuuuaaaaguagcaugacauucauauaauucaauacauuuacauaguucaauauuaaaaaagaguacacaauaaaaagcuuuucccccaaaccugucccauagcuacucaguucucauccccaguuucuuauguauucuuccagaaaaauacaugcucucucuuuuaaacaagauggagauaccucaucucccuuuuaaaaacaaacauuagcaacauaagcauuuugcuuuuuucacccaacaacauauuuggaaagauuuuuuuccauaaagaauguccucaauguuuuuacagcugcguaucguuuaaauaaauuuucuuauaucuacacaauggaaaagauaugcagcuaaacuaagugacaacuaaaacaucaauaguggaacaacaauuaaagaaauaaagccaaauuguagguaagauuuuuucuaccaauggguauaaaauagauuuuugguauucugguauuucuggccacuuugucauaaaaccuuuauucauacuuggaugaaaaaguguaacuuucuuccaaguguauauaaacuucccagaagcuuauggcaacuuuggaaacaaaggcacuuucucuuuuccucaacuugugugcuuucaucaguauuguuuugggaaauauggacuguuaucacucaaucaaacaauucuagaccuuauaaaauauaaauuucaaaauaagauuauaguugguauauucaauuuuauuauaauaauuuaaguauuaagugccaucuguaaaacuuccauugucuuauaaggguuaaucaagcauuuccagaacuaagaaguuaucuugaauuaaaagaaauuaaacuaacuuuccuguuggucaugggauuuacgaacuacauugucuacugucaucacacaaugucaaauuuaaccaaaguacuguaccucaugaugggugcuuguaaauccaguauuuuccucaucuccaaauuuaaugcuggagcacacuguucuuccuuaaaaugggguguccccuucauuuguggacuuccucuaaaacaaacagcauagaguuaaagaaagaugcugaauuugccuccauucuguggcuaauacacauacaaucaaauaaaguaaaugaaauaaaacuuacaaaucagguauucauccuucagauucucaaaugaaaaacagacuuaaauucuauuauagcagacauuaucuacuuaucaauuggaaauaaauguuugaccaauguaauuuguguuaggagggugggaagaagagcagagaaucugagaaaaaaacccacuugaaauaaaagugaacuaacucuaaagagaaccaacaggcauuuuguuuaaaauuccugagggcccuuucuaagguggacaacuauggaaaaaaguaucauucuauacaguaucugucccagugauccaaaucguguggcuucaucuuuacuuacuccacaccuuauccuucauuccuauucuuugggugugaaucagaauuaaggugaaauucaagggugcaauuaggagauguuucacaaguuacuuaguaauaaguagcuaaauaccuaaaauuuuaaaucccuggcaucaaauagcugcaguagagugcugggucaaugccaacuuaacugaacugucacacacgacccuucaaaggacuacagguuguuuuguauucuuuaucuccacauggcaugguagaccaguaucuucuucagugccugugcuggaauuuaacaguuaucugucucucaccaucagcuaucacuuguggcaacaauuagccugcugaugucaucucucccuuuccagucaaguacauuccuauaauuugucgauacuauuaaaauaugcacaaagaggcaaacaaguccaauagcuuucaaaguuccuggcuuugggaaauauauuuugaugcucauuuuuuuaguuuucuuucuuacuuauuuuugcuuauuuuuuuguuacagacuauuuuucuuauaaaguuuuguggugauuuauuaccauucuauccugcuacuacuaugaacuggaguacuuacuuaauuccuucuaagucuaaaugacuaaacuagcuaauguuuaaccauacagguucguguucaacuaacaugucugacugaugugacagccuguaaaaaggacaugaaaguaauuaguuuauaggagucacauuuaaacugcugaacacacagucugugaugauuuacugagaugucuucgauguauuaauauaucugguuuuaaaguuaaauuuuauuuuccaaaguaauauauauacagaaguuaaaauucaaauagggcuagaaagcuuaagacagaaaacaacacagagguagacuccuuucaguggaaacuuaaaaagacauaugucuucuuuugagaagugucuguucauauccuuugcccacuuuuugaugggguuguuuuuuucuuguaaauuuguuugaguccuuuguagaugcuggauauuagcccuuugucagaugaguagauugcaaaaauguucucccauucuguagguugccucuucacucugaugguaguuucuuuugcugcgcagaagcucuuuaacagacacaugaaaaaaugcucaucaucacuggccaucagagaaaugcaaaucaaaaccacaaugagauaccaucucacaccaguuagaauggugaucauuaaaaagucaggaaacaacaggugcuggagaggaugugaagaaauaggaacacuuuuacauuguuggugggacugcaaacuaguucaacuauuguggaagacaguguggcgauuccuuagggaucuagaacuagaaauaccauuugacccagcaaucccauuacuagguauauacccaaaggaauauaaaucaugcugcuauaaagacacaugcgcauguauguuuauugcggcacuacucacaauagcaaagacuuggaaccaacccaaauguucaacaaugauagacuggauuaagaaaauguggcacauauacaccauggaauacuaugcagccauauaaaaggaugaguucauguccuuuguagggacauagaugaagcuggaaaccaucauucucagcaaacugucgcaaggacaaaaaaccaaacaccgcauguucucacucauaggugggaauugaacaaugagaacacuuggacacaggaaagggaccaucacacaucagguccuguuguggggugggggcagcagggagggauagcauuaggagauauaccuaauguaaaugacgaguuaaugggugcagaacaccaacacagcacauguauacauauguaacaaaccugcacauugugcacauguacccuagaacuuaaaguauaauaaaaauauauauauauauaaaauaaagauaaaaaggaaaacaaacaaaaaagacguauguccugauuugaacagaccaacuccuaaaauaacagcucugaguuaaaaugggaaaacugaacacagacugaguauuugaugacacuaauaaacuauuaauucuguuggguaauaauauugugguuugguuuccuuaaaaugucuaccuguuacagacaaaacagaagcauuuaggguugaaugauauaguauaugaaaguugcuuuaauaauuaaaaaguaugcaugcauggggagagggggauguugacaacuuuugaaucugggagauaaguacacuggggacauguccuuuuagauucucaaguguggcuguggaguucaaugacauuccuauucacagacuagcucuuuuuccucugaaguaccuaggaucuucuuuuuauauauccgauggguucugaaauuucaaaauaauuaauuuuucuacaaguaugugaauguuuaucauugcacugagcaccugguagaccuguucaaucuacugauguauuuaguuuaaacucuaggaaauuuacauguuuuguuuccuuaauauaauaauaagcuucuccauucccuguucucucuuucuacaacuccuagucaguuagauauuaaaccucauauuaaacucuaauuuucucuuuucucucuuauucuugucuuuuauucuauauccagggaaaguuccucaacuguuucuuucaaugcuuuuacugaauauauuucuacuauuguacuuuucauucugagaauuuucucauccacuccccccguuuucuuaaaccauccuaccuuguuugauuagccaaaaucugucuaagguuguuaauuauuuccucaaacuguuuucauuccuucaaguaucuguuuacuuuaaguuccuuuuuucugguauguguuucuaaguuacacuggaaacuuuccuaaaauggcuaacaauguuuaguccuuuguucuuauuuuagagguuaacaauaaaaaggugacuacgugucugcaggcugucaacugguggacuucagcaggguaguggccagccagcacuuuuuugaggucuucaaauacuaguaccuguugagcaguuuuucuucagugguuccauuucuccaggaaggaucccucaaaccugccugggauaucaaagcgugaaagacagaagucuggagccaagcaggguaaagaggcacuaugacaacuuuagcaucucacucuucuguuaaauauaauacauauuguuaaaccagacaguauauuuccugugaggugggaacauaggaauccuuauucaguguuuucaagcaaucucuauguugauggccccugccucacuccuauauucuguaguaccaguccuucuaagcucuaagccuuucugaguuugcagguaaaacaaggugcuuuuuaucaguauccuguagguucuuaagcgcucaaguuugaugcucuuccuuaguuauuuaucuuucucuuuggauuuuuagcucaaggguuggagauaccucuaguuuaaauuaaagaugggaauuuuauuucagcuuuuuuucuguuggugauuaucaagagaaagaauugaaaccacauuaccuaucuuaaaacuggaaaccguguuuuucuuuauaugaauauucucauuuauuacaacuaaaguauuacaagaacuuuaaagcaaauuuaaguaaauucuaauuucuucaugacuuccauuauaaaauuagagauacaucucgcaggaaaguuuccauccugucuuccaaacauacuaaaauagagcaaacuuuaaaaaauuacaguaacaaaaaaauucugacuuucucauaaaaaauauuauuacuuagaauucaacuauaauuugauaagguacagcaucagaugacuggaagagagucacagaagaugaggcuagaagaauaaguugaagccagauuaugaaagcacugaaugccaggagaauaggaauagagcauuuacuauguaugaaacaguguacaaaacguucuauacacauccucucaaccaaucauuuguaaucuuuugagacaggaauuaucuccacuuuuucagagagaaaacugaaacguacaaauauugagaacuuugcucuugaucacaaagcuaagaaaguaagggagcugauaaucaaacucuaauauuuaaggcucuaagcaacugaaaauuagaguuaaagagacuaacacaguaaccucugucugcacguagaaauaauggaaugaaugcuaaggaauggauuggggauggaguagggaagggaacacacacuguaaauguuaauguuuuucguaucuggacagacggcagaacugcaguuuccugccuucuuaaaauuagguguggccacaugauuuacuuuggccuauaaaauaugaggggaagugauuugugucauuucugaacagaagauuuaagagccaacacuugguacauguuuuguuuuuaauccucuacugugaugauuuaagcuaugcugacuaauauaguguacaaaaucaaguaacuaacaauuguuagauuuuuguccuguaaaacucaacaaauuaacaguuugugacuauucgacaugagugauuucauuaacuauggaauccaagaaauaggaaaaaagaaugaaaaaaaaauagacccaguuuaaagacuuaugggaacaacaucauaaauaccaacgccugucuguaugauggaaguccaaaggcaaggagagagaaaagagaauauaugaagaaaucaugguuacaaacuuuccaaaucugagaaagccaagagucuuucuuccaagaaacuccaaguaggauaaauuuuaaaagaugcacacagagacacaucauguucaaacugucaaaaaaacgaagagaaucuugaaagcagcaagagauguaugugacuccucacauacaagagaucccaaguaagacugacagccaacuuuucauaggaaaccauggaggccagagaacagugggaugacauauuucaagugcugaaauaucuagaaaaauuauccuucaaaaacaaaaaagaaauuaaugaauuuccagauaaacaaaaaguugagggaauuugucacaaguagaccugaacuaccagaaaugcuaaaggaaguucuucagccugaaaaaacaagaggcaauaacucaaacccauguaagaaaauaaagaacacugauaaaaguaauuacauagguaaauauaaaagccagcaguauuuuugguucagaaaucugccuuuuuuucccuauaugacucaaaagacaagugcauaaaacaguaauuauauaucuauguuaacaguuacacaauguauaaagauguaauuugucauaacaacaacauaaaaagggagagagggagauguacgggaacauaguuuugagauauuauugaagcuaaguugguauuacuucaaacuaggcuguuguacaugcaagauguuaauuuaauccccaagguaaccauuaauaacuaaaacauguacaaaaaaggaaaugagaaaggaguugaaaugguacaaugcaaaaaaaucaaaccaacaacaacaauaaaaacaacaacaacaacaacaaaaaggcagcaguggaggaacccaggacaaaaaagauacagacauaauagaaaacaaauagcaaaauggcagaaauccuucuuuaucaguaaguacuuuaauguaaauggauuaaaugcauucauuaaaaggcaagcauuaucagaauggauucgaauaaaccaaaugaguccauuuauaagcugucuacaagaaaauuacuuuagauccaaggaaacaaguugaagguggaaggaaggaaaaauauauuccaugcaaauaguaggguggcugugguaaaaucagaaacaaacaaacaaacaaacaaaaaaacaaaagacuuuaggaacuaucacaagagacaaagaaggauuuuuauaaugaucaaacagucaaucuagcaagaagauaccacaccuauaaagagauucaaauauagcaucagagccacaaaauauuaauauaugaagaaagaacacaaaacugaagggaaaaauagauguguaauaauguuggagacuucaauaccccacuuucaauaauggauagaacuggacagaaaauaaggaaauagagaaguuaaauaacacuauauaaaccacuuagaccuaagacacauacugaauaugccacccaacagcagaauacauauuauucucaaaugcacauggaacauucuccaagacagaauggauauuaaaccacaaaaaagucuuaauaaauuuuaaaagacugaaagcacauaaaguaucuucucuaaccaaauggaauauaacuaaaaaucaguaaaagaaaaacuagaaaauucaaauauguggaaauucaaaauacacuguaaaacaaucaaugacucaaagaagaaccaaaagggaaaucaggaaaugcucugaaacuaaugaaaacaaacaugcaacguuaugggauacagugaaugaaguccucagagagaaauuuauagguaaaaugccuauauuaagaaaaagauuucaaaucaguaaccuaacuuuauaccuuauggaacuaguaaaagagcuggcagaaggauggaugugauaaaaauuagaguggcuauacaugaaaucgagaauagaaaaacagagaaaaaucaauuaaagcaaguugguuguuugaaaacaucaauacaauugaaaaaccuaaggaaaaagaagacuuuauaagucugaaaugaaagugggaauauuauuacugaucauacaaaaaaauaguauggguuauaagagaauauuguaaacaacugaaugcuaacaaguuagauaaccuauguuaaauggacaaauuccuagaaacacacaaauuucccaacugacucgaggaaauaaaacauaugaauagaccuauaauaaguaaugaaauugagucacuaaucaaaaaaccucccaauaaagaagaacccaaaacaagauggcuuaauuagugaccuauacaauauuuaaauaagaaugaacauucauccuucucaagauguuauuaaaaaaaaauagguaagaggagggaacacuuucuaauucauuccuuuuuuuugagacagagucuugcucugucgcuaggcuggagugcaguggugcgaucucagcucaccgcaaccuccgacucccugguucaagcaauucuccugccuuagccucccgaguaccugggauuacaggcaugugccaccaugcccagcuaauuuuuuuauuuuagaugcaguuucaccauguuggucaggauggucuagaucuccugaccucgugaucugcccaccuuggccucccaaaaugcugggauuacaggcguuaagccaccauccccggacuucuaauucauucuaugaggccagaauuacccugauaccaaagucagacaaagacacugcaagaaaaggaaaccauggcucaauauaccuuaugaauauagauguaaaaaaaauccugaacaaaauauuagcaaacuggauccaguagcauauuaaaaggauuauccaccacuaccaagugggcuuuagccuaagaauacaauggugguucaacacaugaaaaucaauguaauacaauguaaucauauuaauagaaugaaggggaaaaaucccagaaugauuucaauucaugcagaaaaagcaucugaaaaaauaguaauaaucuuuuaagauaaaaacacucaacaaaugaggaaaggaagggaacuucuucaaaaugauaaaggacauauaugauaaagcgcacagcuaacaucuuacucaacaguaaaugacuguuuacugacugaaaguuuucccgcuacgaucaugcaugagacaagaaugcugcucucacuacuuccguucagcauaauacuggacauucuagacagcaaucaaguaagaaaaagaaaagucauccaacagaaacggaaaaaaugggacucucuuuauucaaagaugucauaauaguauaguauauauagaaaauucuaaagaauccacagaagaguuauuagagcuaauaaauucaucaaagcuguaguacaugaucaacacagaaaucguauauauuucucuacgcuagcaauaaaaauuucagaaaacaacuccauuuacaauagcaucaaaaaggaauaaaauacuugggaauaaacugacccaaggaugaguaagaguuguaugcguaaauaaauuaagggagaacuaagaaauuggaaagguauauuauguucaugaauggaauauuuaauauuguuacgauaauacuucccaaacagcuauagauuaaaugcaauuucuaccaaaaucccaauguucuuuuaaaaaaaaaaaaaaaaaaaacagaaaugggaaagcugauccuaaaauucauacagaaaggcaaggaaccccgaagagccaaaauaaucuugaaaagaagaacaaaguuggagaauucacauuuccugaucacaaaaccuacugcaaagcuacaguaaccaacacagugugguaaugauacaagggcagacauacagaucaauggaauggaauuaagagccuaauaauaaaccuguauaccuauggucaauugauuauuggcaaaggugccaagugcacucaacaggggaaacaacauucucuguacuaagacaacugaauaaccauuuacgaaagaauuaaguuggauccuuaucucacaucauaaguaaaaaauaauucaaaaugaauaaaaacucuaaauauaagagcuaaaacuauucuuaaaaaaauagaagaaaauauaggcguaaauugucauggccuugcauuuggcaauuguuuucuagauauaaaaaaacuguaaggaacaaaauauauauauaaauuggacuucaucaaaauuaaacuuuuuugugcaaaauacacuaccaagaaagugaaaagcccagacaaugagaaaaaaaauaugaaaaucauguaucuuaaaaggauguaguauccagaauauauaaauaauucuuauaacucaaagauaaacaaaccaauuaaaaagaagggagaggcagggcaugguggcucaugcuuguaauuccagcacuuuggggggccaagacaggaggauugcuugagcccaggaguuugagacuagcuugaacaauguagugagaucccaacuucacaaaaaaaucaaaaaauuagccaggugugguggugcaugccuguagucccagcuacucuggugacugaggugagaggauugcuugagcccaagaaaucaaggaugcagugagcuaugauugugacacugccuggaagacagagcaagaagcuuucuuuaaaaaaauaaaaaaaaaaaagacagugggaagaagacuugaauagauauuuaucuagagaagauacacaaauggccaaagagcaaaugaaaguauguucaaugucauuaaucauuagggaaauacacaucaaaaccauaaugagauacuauuucacauucauugggaugacccuaauauaauaaaaaaaaaaacccagaaaauaacaaauguugaugaggauauggagaaaccagaaccuucacauauggcuugugggaaaacagucuggcaguuucucaaaaaguuaaacauagaauuaccauguaaccuagcaauucuacuuccagguauauacccaaaaauaauugaaaacagguguucaaauacaaauuguacaugaacaacugcuaugaacacuccuagucauagcaggacuguuccaauagccaaaaagugaaaacaaccucaauggccaucaccugauucauggauaaacacccugugguaaauccauauaacaaaauauuauucagccauaaaagaaacgaaguacugauacaugcuaaaacacgaauuaaccuugaaaacauuacauuaagaagacacaaaagguacauagugugugauuccauuuauacaaaguauccagcaauuaaauaagacacaaaagguacaugcuguauuauauuuauauaguguauccagaauaggcaaauccagagagacacagacaagaaacaaauguaugguucuaggggcugagagcagaagagaacagggaaugacugcuuaaugaauccaugguuucugccuggagugauguaaaaguucuggaacuagguaauugugauaguuguacaaaacacuguaaauguacuuaaugcuaugugagacauggagucaaaggagguuauuuuggagcuuuaagaauuaaugacugcccuacuguguuucagaucugcacggggcuuauagucccuuucuuuuggcugauucuucccuuucggaacgggaguauuaaccaaugucuguauucccauuguaucuuggaaguuauuaacuuguuuuugauuuuacaggcucauaggcagaagagacuaguuuugucucagaugagacuucggacuuuugaguuaaugcuggaauggguucagacuuugggggacucuugugaaggcaugauuguauuuuaaaugugagaaagacaugagauuuggcaggggacaaggguggaauuacaugguuugggucucugucccuacacaaaucuuaugucaaauuguaauccccaacguuggagguggggccuggugggaggugacuggaucaugagggcaauuuccccuuuggugcuguucuugugauaguaaguuaucgugagaucugguuguuuaaaaguguguagcucaguugcaugcaguggcucacgccuguaauccuagcacuuugggaggccaagucgggcagaaugccugagcucaggaguucgagaccagccugggcaacagggugaaagccugucuccacuaaaauacacacacaaaaaaaauuagccgggcauggcggcgugugccuguagucccagcuacucaggaggcugaagcaggagaauugcuucaacccgggaggcggagguugcagugagccgagauggugccacugcacuccagccuggcaacagagugagacucugucucaaacaaacaaacaaacaaaaacaaaaacaaaaacaaaaacaaaacaaaacaaaaaaaaaguguguaaguguguagcaccucuccccggcuuccugcucuggccguguaagaggugccugcuuccccuucuccuucugucaugacuguaaguuuccugaggccuccccagccauucuuccuguauagccugcggaacugugaaccaauuaaaccucuuuucuuuauaaauuacccagucuuagguguuuauuuauggcagugugagaauagacuaauauaccucaugacucagcucagaugcuacucucuuuacaaagaauuccucaauaauacacugaaaguauauucccuuucuaaacugccucccaaagcuauuuaucuguagcuccuuuagaguacacaucacuuuuacaguauauuugauauuaucugaauuuagcuuuuguccccuuaauaaacuaugagcuucagacugggaaaaaaucaacucuaauucacaccauugccuuguauauagcccaaaaccaacaaaugucuuaaaugaguaaagaugaguguccccuuggaggccuuauuuccugagucuuagcuauuccaggcaauugaugauguuuaauacguggaucccugcauaagugggauguaugcacguauguuuuuugacauuuugaguguauuaaauguuaacaguuacuccuuugcuuuugaucccagucaugugcuugagaaacuaaccagcuucaauauuuuaauuaugaugguuuucucacuaaaagcaaaauuguuuggaagaacagauaauagauuugacaugcacuaccuaccauauucauacuaauguuauaguacgaauuauacagagcaaaaguuaaguuaaacuauacaagguaaggaagauggauagaaaacaaaaaccugaauuuucaagagaaaauguaacugaacuuuucuuuuuuuuuuuuuuuaaauggagucuugcucugucacccaggcuggagugcaguggugcaaucucggcaaacugcaauguccaccucccaguucaagcaauuugcuucagccuccugaguagccgggauuaccacaccagcuaauuuuuguauuguuaguagagacggggguucugcuauguuggucaggcuggucuugaacucccgaccucaagugauccacccgccuugggccucccaaagugcugagauugcaggcgugagccaccucacccagcccaaacauuuauuucuaagcuacacuuugcauuuaaaucgauauacuccaaaggauucaauauagaugcccauaaaaaagauaaauaucuccaucaggagugcuauguacacauccacucaugaaagaaaaaaaacauucagagcuuuucuauaggucucaaacagaagagccagcuauaccacaguuuuaccacaaaugggugauaacaaguuauuguuuacuugcacuaaugaaauagaacccagccaacuuaagucauagugauaguuuugauaaauuuugagaagaaacaugaagggaaauuaaacaccagacuuugaccauacgauucugagaagaaucugaacuaaaagcuagguaagcuaacuggggaaaagaaugugaagaguagggaagcaguaggaaauuauacuuauuugaaaaaaaauauuuauaacuugcaguugucuuugugaaacuacauggaaaagaaaaaauuuaauuauuuucuaacuuuuauuaagauuauuauuugugacuccucuaguucaaaguuauaggaaguuuuaagugaucuguuccaacgauuuucccacaagcuuuguuuuuagugugcacuugugcagaaugaagguguuuacacaaugcauauaucaugcuuuggcaaaaauaccugcucaugaaaugguacaaagcuuguuagacaauucaaguauuuuaagaagaaacaaaauauauaauuuauuauauauuuauaaggcauauuuauaaauauacauuaauauacguaagagaauuuaauuuguaagauuccccucuaaaaguguugaaauuugcuagauuuacgaauagauuuuuaagauuuguagauggaacuuaaaaguuugagcuacaguuauuauuuugaagcucuaauaaauugaauauuuuuaauccaaaguaaacucuaaauaaauauucagauuuuuuacuuugaaaacacaaaaucacaaaugaacaaaaagaaaugaaacagcugaauacauuaugggauaggcaaaagggauuaaucccauuauaauccccucaauaauguucuaaauuucuaucuauuugagauuaacuggggcuaacaaaaacaaacuaacaaaauuuauagaacuagcuaagaagugucggucauucccagcucaguauugguuaaucaggugcucucccuacaagccauggcagaauuugugaaggaaagaacagaaaugucaaugaaggaaacuuggugggguuggguggggacagcccauggaacgaugacccugagagacaagaaaccagugaaaggaaaaaaaaaaaaaaaaguaggaauuuuuuucuuaaugcaguuucggaucaauugugugacaguuuucuuaaugcauucaaaguuguugugguucuuaaagccaagagguuuacacaucacugacuauauaaaacuaauucuguagacaauuugucuuauuuacagauagauaacuuucagauaugcuuuaaaguuuaaucuugguaaaccaccacuaauuuuaauacuguauaugaaauccaauaauauaauuuaguuucagaaucagagugaacauacaucagaaaguguuguaaaucucagauuauugcaaaaaucuaacaugugaaaaauccaacaauuacauuuuauuuacaaaaauugauuuacauaggauuuguuaaaauccaauuuaugaaacagaacaaaucuagagacacuagguugcccuuaccacuuguguggaauuugucucucuagaaaguuuuauaaaauguugcuuuuauauuuuaguuauauaugcaauauacaaacaguuuuuugaaaaaaaaaaaaagacauugaaauaaauguaagcuauacauacauuuaagaaagaugaauaaaaacauuuacccacuaauuccaguucagaauugcagguggccacggcccaucccagcagcuuggggccaaagcugaagcccaccuuggaccagaugucauuccauuggagggcgcacucacacacauaccccacacucgcucagacuggggccaugcagaugcugauucacccaaagcguacaucuuugggaugugggaggaaacuacaguacuacacagacauagggagaauaugaaaauuccauauugacaguggcccuggccagggaucaauuuuuuucccucaucgauguuaugacauuauucaaggauaugauguaaggaguuucucgcuauauuaaagaagcuaucuuuguuaauacuuggaauuuucaaguauuguauaaaugaauacucugccuaaguuccccagaggagucaagucuguuauugcuuacauuugauacaugacucaaucugagacuugcuuuugaacaaguacaccuguauuuuuuggcaaccucuuaaaguuuugucauucuucaaauucuaguucacucuaaaaccucgcaguuaaugaacuagaauccccuucuuuuuuaaacacuuauaaauugucauaaauaugcaauggaggcacauuauauuuacauaauucagaaggcaaccuagacaacaauaccaguugcaacuuauuaagaaucuaaucacucauuuuucucauuuuauagacacacagcacagaaagcaacuuuagaaaauggcuuuuccaaagucuugggaaaaagcagaaucugaacuggaaccugggccucucugauuccaacugccauauuuuuuuccacaucucuaaacugcuggauauuuaucugagguaucaauagcaagucuaagaaaaauaucacaagaaaguaggaaaaaugaagcuaagccgguuuuauuaauguauuuuccauacauuaacuuuuguaacuaaaaguaaagccucccaguuuucuauuccaaugaaugauaaggcauucauguuaaugaguggcccuuaaagggccaugaaaaaaauaaaauguuucuaugggaugggucaaccacuagucaaacuucccaggacacugagcggggaguaauuucucaucaaauugguaaaaaccaaaaaucaaaccacaauaccaaguguagcauaaaaacuacacagaagucuuaaaagaaaagaagacugcuuuuaaagcaugucaaguaugcuuugagggcuagaucaggugauacagaaaacugauucacaaauucaacagccauuucuuugagcaaauucuucugugcaggagauaccaaaugcuuuaagugccagcuaaagaaaagaauaauguggcaaauaaccuaauagauuuggggugugggggaacagaaacuucaagaaugcaauuaauuauaguguuuuuccuugcaacauaacuuaccuaaguccugacuucucucccaaguauagaacucaagucuccuuaucuacaaaacuucccuugacaacuaaucacuuuacccugaaaugcuauuaugacuuuucaagauauuuaccuggcaaucuguuauuuuauauugccauuaacuuuaaacaauuauucauuagcaucuucaguagcaguguauagcaaguguuuuacagauagcaggcauacaauaaaugaggaugaauccauuugagaugauucugaaaugugcaaggcuugaucuagaaaguucuggcaguccuauguaaauucugggacuaagaggcuuuaguucuccaaccauaauucuggaaaggcucagaacgauuucuuuuccuaaaacuccaggccucauauuucaucauuugcauucaucauuguuuacuggaaugcuuacaauaauaaaaaguauuuuuggaugaaaugaaauaaugauaucuuggaugugcuuaaauauacuccaguggaaaaagacugaaaauuguucaaacugacugauggacacacagauggucauuuuauuauucuacuaauagaguaccugguaccaaacuagugcccagaaacaagagaacuggacaaaauagaucaaccaaccauauucagacaugagacagcaggcagcacaggacugauaucaugagggaaggaaaacaaacagguuuucuggcagaagucaccaucuaaccucuuaagguuuuguccaucauguagagugagagaaaccaagcauaguauggcagccuuguuaaguugaggagaaaaagauuaaaguucagagaagcagaagcagcuauuugugaagcagagcaccagugaugugggagccacacagagaaaagcucuagaaaccugcagggguuucccgagucuuacugaauacuauccaaauacauagugacacuccacaaauacaggcaaagaaugacuacuaggguuuuuggcuacccaguucauauaggacugggagacauuucgguucugacuagccagaauggagagaccuucuuaaagaccuaggacauucaguggacuucagaagggcuaagcuagcuuaacaguuaaauccauccuaaaagacauacaaaaagccucaaaagaucaguaagaucuccaagcagcuuaccugccacccaaaacaaccuucaauacucuuuaaaggaaaaggacaaaaaucagacaauggauaauguaauacaguaucuaacauccaaucugaaauuacuagacaugugauaugacccagcaauucuauuccuagguauuuauuuacucaagagauacaggacaacuggagagugaaaugagauuagaaucuaaaaaagcaaaguucacauuuuuuuacuuuuuaucuuuauagaucucucauuguuggauuuuuuuuuaaguaagaagguauugaugaauuaguaguguaaauuuuuaaaacauacuaugggaaugcacaugccagaucaguuauuuauuggguacaggggcggauauaggagaguugagggcagaagguuuauagaguacaacagaugucugaccugagcuugaaaaccaacucagauaaauuucuuacauaaaaaaagauagcaggggagucauacugaauagagcaaauaacaaaggaauagaggcauuaaauaggaauuguggguucgauguguucaagauauggagaaaguagguucuaaaugccaggccagagagcuuggacuucguuuuggaaaaaaaaaaaaauuguuaucaaugcaaaugauaaacuucauuauguaggugaaagagacuaggggaagagaaaugaguuagugaauaagcuuuuuuaauagacaaggaggaggacaugagggccccuaaaaagaccaaugagaguaaaauagaguuaaaugaauuccagaggcacuggaaaacucuaaucaaucaguaaaauuugaugacugaacaaauauguaaagugaagaaacaauccagaggaagaaacaaagaauuaaagguuuucuaccucauacaacguacaaaagaugaugguaacugcaaaaaaguuuagcaaagcaauagcauguuuggcuuggcaggggguaagugagugagguuuagacaugaaucugacauuaagaagacauaauaggccgggugcaguggcucacgccugaaaucccagcacuuugggaggccgaggcaggcagaucacuugaggucaggaguucaagaccauccuggccaacauagugaaaccccgucucuacuaaaaauacaaaaauuagcuaggugugguggugcaugccuguagucccagcuacucaggauugagacaugagaaucgcuugaacccagaaggcggagauugcagggagccaagaucacgccacugcacuccagcacaggcgacagagcgagacucugucucaaaaaaaaaaaaaaaaaaagauauaauaauaauccaggagaaaagugacaagaccuaaacugaacuagugucauugggaauuacgaggagggaaaagaaaugacauacaagguagaauauacuagacuggauauagacuggcuauugauguuagugggcaggaagagugaauaaacucaaauacacgguggugccauuuacuggaagaaaaaagcgggugcgcucuugacuuucccaggauucaguuaccuaaaaaucagacuguauuuucauuuuuacagcuaauaaaaaaaguucaucauuucuuacuaacuauaaauuauuauaggaccuaaaauuuauucacgguaucuucuuaugaauuuucauaccugcuaaaucucaccaauccagaauugucuuccccuggauauauguuuuguuaccucaucaucuuugagauccuuuuauaugucaucuucucagugaagacacugaccacuauuuuaagucauauuccacucucuauucccuuacccugcuuaauuuuucuccauagaguggaucaccuaacucauaauguauuuuacuuaucacccucuacuagaagaauaacaagaucuaucagcagggcuuuuuguuuuguuguuuuuuuccacuguuagaucucuaguaucuacaacagugccuagagcuggacaaaauucaauacuuuuuaaauggauagacagauggaugaaaauaauuuucagaagaguuuuuugaaagacguaguacccuuucaccagacuuuucauagaaccaaaaaaaaaaaagccaccaaaaaccaaaacugcuuaucguuuauauuaucacacauugagacagccuccagucugacagaaacaaugugcagggcucucugauuugggcaguccuaccauucuuuggauucaggugccauccuuggaaguguggccaauaagggaguuuucacuauccagaacuuauauaauaacacuguugccaauccuauuaauaagugcucaugcaacuauaaugugaaguaauggaugcauguaauaugcaaaguucaguaguaaaaggucacccauguacauuuacagaauauaaacacacugaaaucaaauuagacacgggauguuuucagaggcucaagcagaacaaaaaacaucaagaucacuaacauacuuugucaaguuuauaaacugaauguagaacaagguuuauuauuagaaauacggggaaaaaguggcuaaaguuccucucuagaaaaagaacacucacaacauauuagcaaaaagaaacauauauugagggaaacuuucaugagucuguaacuaauucagaucucuugucaccuuuaaauuugauacgauuuagaugcuucugucccuuacuguagguuucuucugcaaagaagcuggauuuuagaaggggcaaguuguguugaaguuaaaaauugcuaaccucagguagcuaugcucuucuuccuuuccagcuggcacuaauucauuagcagugagcugguaagaaguauugccaucugaugaaauuauauggggaggguggagggggaagaggagaaggagauuugauuauauuuuggagugacuuuuuuucuucagugaaaaagaccaguaucuuuacuauauaauaauuaaauguacugaauuucaguacagaaacuuuuuuuuuuuuuaaagaaacucagccucaaaaaugcuagucucuaacaaaaaagaggguaauaguagcagugaaaagacaggaagaagggggaaaaaaaucucugcucucaacaaaguauacaugaugaugacauauuuguuuaaauuuuuuucauuaugcugaaauuaaacaugaugugcaauuuagaaaucuacuaaacuucuauuuaaacauaagcauaugaacacauuuuaaagcuaaacacaaauuauuucugacuuaucccuggaaguuuccuucauuaauuucacuaaaauuuccaagccauaaaauaaaauguccagacaaccuucaacuagucugguccacuggucuguguaacuaauaugaagagauaauguaauauacaauggaaucuaagauuucuaaaauggaaaauucauucaccaaagaauaaaugaucuuugagguacagagucacuuaauaagacugccaccauuguuauagacugacucccaacaucuauagaaggaugcuagaaacaacacuagguggaaacuaggaaagaucaugaggcaucugaacuguguucucagauggagcauaguggaaaaggauaugcagucugagguuaagaugcugucacauaauacagggaaguuaagauacucuagaaaaacuccugugaugaacuuguaagauuuacagaagagaaacgagagacaauaguauuucuauaacuaagugagaagaggaugauuaaccacuggccucaguaauuauacugccucuauucuucaggacuauuagaaaccacuccagaucauuucuccuuuuuccauucucuacucccagauaaaccccaaaguaguagcuggauggagcauaaacaggguugagacaguauauuacugauuaauagcacagacuuuagagcuacaacacuuaugucugaauccuagcuguacaacuuauucgcgugugacuaugggugaguuacucugccucucugugcagcaguuuguaaaacaguuauaccuaacuaccucauaggguugcuaaagggauuaaauacguauuaaaaaaugcuuagaacagugucucaaacuacagaaggguuuauaauggcacagaugacaaugaagauaccacugucaaaaccaaacuuuacuuuccucaaaaccuuauauaaccacuauuuuucagguuuuaagaauaugaauucacauaauccucuuaacaaugaaagaaguuauuuuuauucccauuguacaaauggguucugcagaaaaaccaagaaacucacuagacuaaguaacauaacuagaacagucaagcacacaaauacacaacaggcugacuuuaaucugcagaacuauuuucauauaagagauuuuagguagcaguuacuagaaguuagacucuggcaaagaaguaaaauaucaaguagauauauauguauauauuuaaaaauuacuuaaaagcuuagaaaugaaguaaacacuuggugaaaaaaauuacugauaauaacaguuguccuuuauuaauuaucccauaagcuaggugcuuaccuaagcauuaaauaugaaugaucucauuuaaucuuaugagaugauuacuacuguuauccuacucuacagaugaggaaaguuuuuggugguauuaaauaacuugaaagaagucauauagcugaaaaguggcacagccaacauuuaauuucaggucuaucugacaccaaagccuguaucuuuaacuauuauucgaacugcucuaaagcaaugcacauuuuauugaggccagccacugaaaccuaaaacuuucaauauaguaaaagaaugcccaaauuaagaaagagaguauguuuuuuauuuaguucucugccuuaacacauagagucaaacacagcaaaguucacgcauugucaggacuacuuaguuaacuggugucucuugcaguuuuagaaucagaaaagaaagaaacuguuucuuaaaacuuuucuggaacacaaaaagugggucucaaaauacuauuccaaaacacuauaaacauguaaugguauuagugaacugaaauaaagaaaauagaauuuucacuguuucaagagaaguuauuucucuaccaugcccacaggaacauaaauuaauggaguuaaauuguuguuucugauuacugcuuuuuauuuauaggaacaugucuaaauuaagcaauaaaacaaacauaguaguuuaaaaugcaccaguaaaucuaauuuuagucauugauuacaacaguucuucaaaagaaucacaaaauuaucacuuagaaugcaaaaaaauucuuuuuucaguuuuacccauaaaacugaauuuaaaauuucuaaauacaucaugauguuccuaucauuuugcacuauauuuaugugucaaaaauuuuugcacuaaauauuuuuauugaaaaauaaacaaguuaaauugaaucccaucaucaaaaaagucuguacuuuaaagauuuccaaaaccgaauaccucaguuagcacuauacuuguuacaaaaacaaguggcuauagcaucaagaaaaucuaacuaguugaaaauuuaagaguugaaaagcagaagaaucacuacaguucuaccauucaggaacaauuacuauaaauauuuguacuguauugcucuagauuuugucuuuagaugacuugcguuguuuuguuuuauacagucauggucauauuacauauauaauuuugugugacuuguuucuucacuuggcauuauaauauggucaaguucuuaaguuuauacauuuuucugagacauaaugacuacauaucacuauaagagaaggauguaccacaguuaacuuguuaaccagcucccuauuaucacaccuuuguguaucagaagugugcaacacaacuuuuauuauaccucugcgagcaguaauaauucuuuaauuauuaaaaaauaaaaaugguuauauuuaauguuuauuuuauuuggguuuauuuuauuuaacguuuauuuuauuuggguuacuacugggucuaaauacuuucucuugaguuuguuaguuacaguauuuccuuuaaugagacuacuuucccuauuuaucuacuggaaucucugugugcuuauuggcaauuuauauaucucuuuuauauaaaaguaguaagacuuggcccuauuuaccacaaauauuuuucccaaguuauuugcuguuaauguuuuucuuuuuuucuguuaauauucaaaaauuuaaacuuuucacacaguaaaaucugucuuucuaauuucuuauauaccuauuaaacuuuggauaucuuccaccaucuagaaaugugauaaaugcucuuauauuuuuaucuggcuuuauggcuugauuaaaaaaaaaaaaagauggaaugcuuuacaauuguauguucuuuuauuucaaaaguuaaggccugcuauaaggaaaagaaugcaaaauauacauaacuacacaguguaaagggcaaaaguccacguuuuucccaaauuuaaaccaagagguaauaacugucugagguucuuuuuuuucuaugcauauacaaaagcacaugcaaaaguaccuguaacuuaccaacauuucaacucuuccucucaugaucucuuagcucuucccuaauaaggaaugagaaaugcuagaccuggaauauauuaacagucauucugaauacccaagaaaauagucuugauauaguuuaucaucaagauucccagacuuaaagaauucuuuauucaagaaaugacaguucaaagaccugguaauuuuuuaaauacuauuugggaaaugcugguuuaguuuuauucuaaucacuacagacaacucaaaacuguaauguuuuucugaauauaaaguaugcaaaucacauauuaaaagaaugaaaggcaacaaacuuacuugggauacacugguucauaaagguacuuguccccucuuguagauguaauaugaaaaaacaagauguauccauuugccgucugaaagagaaauuuuauuaaucaugaauuaaagaguaaggcuauaacuguaacccugaauuuuaauuuuauaaauucuuacuucgaaaaaaaauuuauucuccaauacccucccuuggagaauuauagccuaauuaugcaaauagaagcgacuuuuuaauauaacccauguugaaaaaaaggguuuuuacagauuucaaaaucuuucagugaaaucaguacuucauaaaguauucuagacaugcauacucucaaguaacugcauuauucaauaaugaguaagugacuauuuugcaaaauauauaguacuuuuugaacucugcacuaauauggcaaauuauuauucuaaguuuauaaagcaacaaugccacuuuauggcuuuauuacaccuuuaagacaaaacgcuuacucuacucaaaauuuacacaguauuaacuucagaacagcauauuuauauauuucaaaaacaaucuuuuggucucugauuuacuacaaaauauagccccagauacagacauaaaacagagcaaaccuuuaauuuccaaaauuugaguaucagcuaguucauuuuucuaaguuaacaaaauauuuuuuaacaacaaauuguaggccgggcgcgguggcucacaccuguaaucccaguauuuugggaggccaaggcgggcagaucacgaggucaggagaucaagaccauucuggcuaacguggugaaacccugucucuacuaaaaaaauacaaaaaaauuagccgggcgugguggcaggcgccuguaaucccagcuacucaggaggcugaggcaggagaauggcgugaacccagaaggcggagcuugcagugagcuaagaucgcgccacugcacuccccgcugggcgacagagcgagacuccgucucaaaaaaaaaaaaaaaaaaaaaagaaauuguauuaaaaacagugcuauuacaugaucaugacauacaucugcgucaugacauacauacauuugugaaguucaaacaaccauuuuacauuucuguaaguacaaaauauuauauuuagcuguuuccagccaaacauuuuuacgccuaacagagugaaguggcaguguuuugcccaaacuacuuuacaguaauacugaauuccuaucauuuuagagggaggugggcauguacucaaaguagaaccaaagaaaaccaagaaauuauccaagguuucaaauuacuuucuaauucuggcuuccuguuuuucaaaggaaugaccaagaaaauacuuaguuucuucagcaaaaccaggugguuugcuuucuuuuugaccauuaacuuuacuauuuuauaauguauuugaaacuagaguuucaacacuguaagauacaaaaacaaaagggugaaaauucuucagauaagaucaucuuucuaauucuuuaugugcaauuuuauguucuugcaauauggagaguauggaagcaaaaggaaaauggcuucaaaucaaaucauaacaaagguuucacacauaaaaaaacaagaacaacaacaacaacaaaaacagacaaaaucuaugaaauacuuuucaaaacacuggcaucaagcaaugaaggccagucauccuugagagauaagaaacaacugaagugacccuccuacucuuacccagcuuacugccuugugagaauuucugggucagcacacuuagaaggcgcacuaagacaaagccuggcagacuuccagaguugagaagaagcugaagaguccaggaagaguaagacaaacaugagacauaaugaaaaaucaaccaaucaaaacaaugcauaacucaaucagauguuaaaauuagcacaaaaggacauuaaaaccuuuugcuauauuucauaauguuccaaaugugaacuauauucuguauguuccaaagguuaggcaauauagaaaacucaaacaaaacucuagaaacagaaauacuaaaauaucugagaugaaaaagacauuggcuggaugaaugacagguuagacaaugaucagaaaagcacagcaauaaaaauuauccauaaugaaacacacacacacacaaaaaaacccaaaauaaaacagaaacaaaaucagugaauugaggaacaacuucauguagcccaauauacauauaaacagagucuccgcaugacagggguaagagucagaaaaaaaauauuuaauuaaauucaaauuucauuugcuucacuuaaauuucuuuaaaagauaacaggcuuuaaaacaagaauaauagcaguguaugcugggguuuauaccguguguaaaaauaaaauguguauaauauauguuuccugaucccaauagaacaaaacuagaaacaaauaaaaaaaauucuggaaagcccacaaauauuuugaagcuuaacugcauacuucuaaauaacccaugaaucaaaggagaaaaagggaaauuuuaaaaauacaucaucccaaaauuugugggaugcugcuaaagcaguacuaaagaggaaauuuacagccuuaaaauacuuauauuagaaaaaaaggaaaaucucaaaucaaugacaagcuucuaccuuaaacuagaaacaaauuaaacuagagcaaacgaaauccaaagcaagugguggaggguggggaagcaugcaaauaacagagaucagagugguaaucaaugaaauagaaaacagaaaaauaaaaucaaugaauaaaaaucugggguucuuuuguuauuguuuuagaagaucacuaaaacugacauauuucuggucacacugaucaggcaaaaaagagccacuaacagaaaucaaagaggugauaucacuacaaauucuagagguauuaaaagaauaaugaggucacauuauuaauaugacaauaauuuuaacaacuuggaugagauggacaaauuccuugauaaacacaaaccaccaaaguucacugaaaagaaaucuguacccugaaaagccaaugucuguuaaagaaauuauaauuccaauucaaauccuuuccacaaagaaaauucuaggcugagacagcaucacugguaaauucuaccaacucuuuaagaaauaaauaauaucaguugaauacagacucuuccagaacaccaaagagaaggaaccacuuccuaucucauuuuaugaggccucauaacaaaaccagacaaagacauuauaacuacaggccaagaucccucauuaacauauucuuuuuuuuuauuauuauacuuuaaguuuuaggguacaugugcacauugugcagguuaguuacauauguauacaugugccauacuggugcgcugcacccacuaacucgucaucuagccuuagguauaucucccagugcuaucccuccccccuccccccaccccaccacaguccccagagugugauauuccccuucaugucucccugugaucucauuguucaauucccaccuaugagugagaauaugcgguguuugguuuuuuguucuugugauaguuuacugagaaugaugauuuccaauuucauccaugucucuacaaaggacaugaacucaucauuuuuuauggcugcauacuauuccaugguguauaugugccacauuuucuuaauccagucuaucauuguuggacauuuggguugguuucaagucuuugcuauugugaauagugccacaauaaacauacgugugcaugugucuuuauagcggcaugauuuauagucauuuggguauauacccaguaaugggauggcugggucaaaugguauuucuaguucuagaucccugaggaaucgccacacugacuuccacaaugguugaacuaguuuacagucccaccaacaguguaaaacuguuccuauuucuccacauccucuccagcaccuguuguuuccugacuuuuuaaugauugccauucuaacuggugugagaugauaucucauaguggcuuugauuugcauuucucugauggccagugaugaugagcauuuuuucauguguuuuuuggcugcauaaaugucuucuuuucagaagugucuguucauguccuucgcccacuuuuugauggguuuguuuguuuuuuucuuguaaauuuguuugaguucauuguagauucuggauauuagcccuuugucagaugaguagguugcaaaaauuuucucccauguuguagguugccuguucacucugaugguaguuucuuuugcugugcagaagcucuuuaguugaauuacaucccauuugucaauuuuggcuuuuguugccauugcuuuugguguuuuagacaugaaguccuugcccaugccuauguccugaaugguaaugccuagguuuucuucuaggguuuuuaugguuuuaggucuaacauuuaaaucuuuaauccaucuugaauugauuuuuguauaagguguaaggaaggcauccaguuucagcuuucuacauauggcuagccaguuuucccagcaccauuuauuaaauagggaauccuuuccccauugcuuguuuuucucagguuugucaaagaucagauaguuguagguauguggcguuauuucugagggcucuguucuguuccauugaucuauaucucuguuuugguaccaguaccaugcuguuuugguuacuguagccuuguaguauaguugaagucagguagugugaugccuccagcuuuguucuuuuggcuuaggauugacuuggcgaugcgggcucuuuuuugguuccauaugaacuuuaaaguaguuuuuuccaauucugugaagaaacucauugguagcuugauggggauggcauugaaucuguaaaucaccuugggcaguauggccauuuucacgauauugauucuuccuacccaugagcauggaauguucuuccauuuguuuguauccucuuuuauuuccuugagcagugguuuguaguucuccuucccucauuaacauauucuaaacaaaauuauagcaaauuaaauucaaccuuauaaaaaaaaaacaucacaaccaaaugagguuuauccaagaaugcaggguugggguuuaacaaaauuaaauacauguaauuuaccuuauuaacaaacuaaaaaaggaaaaccaugacagucugaauacauugcauuaaaagcauuagacaaaauucaacauccauuccugauuaaaaauucucaguaaauuaggaagaaaugggaaacuuccauaucuggaugaaagagauuuauaaaauauuuauaacaucauucuuaaugguaaaagacugaaugccuucaucauauucaacacugucuagacucuaggcaguaaauucagacaagaaaaagaaaagguauauaaauuggggagaaaaaguaaaacuguuuuugauauggucauuugcauaggacuccuaauggaauuaacuauaauaagugaguuuaguaugacugcuggacacaagacaaauauagaaaaaucaacugcauuuuuacauacuaauaagaacaauuagaaaaugaaaaaaaucaguaacauuaaaguugugagauauggauaaaucuggcaaaagagaugaaauacuuguacacugauaacuagaaaacagugcugaaaguaaaaauacuucaauggagaaauacaucuuguuuauauugcuaagauagcaacucuccccaaauggauccaaagauucaauguaaucccaaucaaacucccagcagacauuucuguauaaauugaugagauggcggggggggggggggggggggggggggguggagccaagauggccaaauaggaacagcuccagucuacagcucccagcaugagcaacacagaagacgggugauuucugcauuuacaacugagaugccggguucaucucaccggggugugccggacagugggugcagcgcacugugcgugagcugaagcagggcaaggcaucaccucaccugggaagcgcaaggggucagggaauucccuuuccuagucaaagaaaggggugacagacggcaccaggaaaaucgagucacucccacccuaauacugugcucuuccaacaggguuaacaaauggcauaccaggagauuauaucccgcaccuggcucggaggguccuaugcccacggagccucgcucauugcuagcacagcagucugagaucaaacugcaagguggcagcgaggcugggggaggggcgcccgccauucccgaggcuugaguagguaaacaaagcagccgggaaguugaacuggguggagcccaccacagcucaaggaggcccgccuuccucagcagucuccaccucugggggcagggcacagacaaacaaaaggcagcaguaaccucugcagacuuaaaugucccugucugacagcuuugaagaggguaguggcucucccagcacacagcuugagaucugagaaccggcagacugccuccucaagugggucccugaccccugaguagcauaacugaggggcaccccccaguagggacagacugacacuucacacggccggguacuccucugagacaaaacuuccagagcaacgaucaggcagcagcauuugagguucaccaauauccacuguucugcagccacugcugcugauacccaggcaaacagcgucuggaguggaccuccagcaaacuccaacagaccugcagcugaggguccugacuguuagagggaaaacuaacaaucagaaaggacauccacaccaaaaacccaccuguacgucaccaucaucaaagaccaaagguagauaaaaccacaaagacggggaaaaaacagagcagaaaaaccggaaacucuaaaaaucagagugccucuucuccuccaaaggaacgcagcuccucacaaacaauguaacaaagcuugauggaaaaugacuuugacgaguugaaagaaggcuucagaaaaucaaauuacucugugcgaaccaauggcaaagaaguuaaaaaccuugaaaaaaaauuagacgaauggcuaacuagaauaaccaauggagagaaguccuuaaaggaccugauggagcugaaacccauggcacgagaacuacgugacgaaugcgcaagccucaguagccgaugcgaucaacuggaagaaaggguaucagcgauggaagaugaaaugaaugaaaugaagcgagaagagaaguguagagaaaaaagaauaaaaagaaacgaacaaagccuccaagaaauauaggacuaugugaaaagacaaaaucuaugucugauugguguaccugaccugaaagugacggggagaauggaaccaaguuggaaaacacucugcaggauauuauccaggagaacuuccccaaucuagcaaggcaggccaacauucaaauucaggaaauacagagaacgccacaaagauacuccuugagaagagcaacuccaagacacauaauugucagauucagcaaaguugaaaugaaggaaaaaauguuaagggcagccacagagaaaggucggguuacccacaaagagaagcccaucagacuaacagccgaucucuuggcagaaacucgacaagccagaagagagugagggccaauauucaacauucuuaaagaaaagaauuuucaacccagaauuucauauccagccaaacuaagcuucauaagugaaagagaaauaaaauccuuuacagacaggcaaaugcugagagauuuuguccccaccaggccugccuuaaaagagcuccugaaagaagcacuaaacguggaaaggaaaaacugguaccagccacugcaaaaacaugccaaauuguaaagaccaucaaggcuaggaagaaacugcaucaacuaacaagcaaaauaaccagcuaacaucauaaugacaggaucaaauucacacauaacaauauuaaccuuaaauguaaaugggcuaaaugcuccaauuaaaagacacagacuggcaaauuggauaaagacucaagacccaucagugugcuguauucaggaaacucaucucaggugcagagacacacauaggcucaaaauaaagggauggaggaagaucuaccaaacaaauggaaaacaaaaaaaggcagggguugcaauccuacucucggauaaaacagacuuuaaaccaacaaagaucaaaagagacaaagaaggccauuacauaaugguaaagggaucaauucaacaagaagagcuaacuauccuaaauauauaugcacccaauacaggagcacgcaauacaggagcaccuagauucauaaagcaaguccuugcugaccuacaaagagacuuagacucccacacaauaauaaugggagacuuuaacaccccacugucaccauuagacagaucaaagagacagaaaguuaacaaggauauccaggaauugaacucagcacugcaccaagcagaccuaauagacaucuacagaacucuccaccccaaaucaacagaauauacauucuuuucagcaacacaccacaccuauuccaaaauugaccacauaguuugaaguaaggcacuccucagcaaauguaaaagaacagaaauuauaacaaacugucugucagaccauagugcaaucaaacuagaacucaggauuaagaaacucacucaaaaccacucaacuacauggacacugaacaaccugcuccugcgaaaugaaggcagaaauaaagauguucuuugaaaccaacgagaacaaagacacaacauaaccagaaucucugggacacauucaaagcagugcguagagggaauuuuauagcacuaaaugcccacaagagaaagcaggaaagaucuaaaauugacacccuaacaucacaauuaaaauaacuagagaagcaagagcaaacacauucaaaagcuagcagaagguaagaaauaacuaagaucagagcagaacugaaggaaauagagacacaaaaaaaccuuaaaaaaaaucggccgggcgcgguggcucacgccuguaaucccagcacuuugggaggccgaggcgggcggaucacgaggucaggagaucgagaccauccuggcuaacaaggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaaaaaaaucaaugacugcaggagcugguguucuggaaagaucaacaaaauugauagaccgcuagcaagacuaauaaagaagaaaacggagaagaaucaaacagacgcaauaaaaaaugacaaaggggauaucaccaccaaucccacagaaauacaaacuaccaucagagaauaccauaaacaccucuacacaaauaaacuagaaaaucuagaagaaauggauaaguuccuggacacauacacccuacaccuucccaagacuaaaccaggaagaagcagaaucucugaauagaccaauaacaggcucugaaauugaggcaauaauuaauagcuuaccaaccaaaaaaaguccagaaccagauggauucacagcugaauucuaccagagguacaaggaagagaugguaccauuccuucugaaacuauuccaaucaauagaaaaagagggaauccucccuaacucauuugaugacgccagcaucacccugauaucaaagccuggcagagacacaacaaaaaaagaaaauuuuagaccaauauccuugaugaacauugaagcaaaaauccucaauaaaauacuggcaaacugaauccagcagcacaucaaaaagcuuauccaccaugaucaagugggcuucaucccugggaugcaaggcugguucaacauacgaaaaucaauaaauguaauccagcauauaaacagagccaaagacaaaaaccacaugauuaucucaauagaugcagaaaaggccuuugacaaaauucaacaacccuucaugcuaaaaacucucaauaaauuagguauugaugggauguaucucaaaauaguaagagcuaucuaugacaaacccacagccaauauuauacuggauggacaaaaacuggaagcauucccuuugaaaacuggcacaagacagggaugcccucucucaccacuccuauucaacauaguguuggaaguucuggccagggcaaucaggcaggagaaggaaauaaagggcauucaauuaggaaaagaggaagucaaauugucccugucugcagaugacaugauuguauaucuagaaaaccccaucguaucagcccaaaaucuccuuaagcugauaagcaacuucagcaaagucucaggauacaaaaucaaugugcaaaaaucacaagcauucuuauacaccaauaacagacaaacacagagccaaaucaugagugaacucccauucacaauugcuucaaagagaauaaaauaccuaggaauccaacuuacaagggaugugaaggaccucuucaaggagaacuacaaagcacugcccaaugaaauaaaagaggauacaaacaaauggaagaacuuuccaugcucauggauaggaagaaucaauaucgugaaaauagccauacugcucaagguaauuuauagauucaaugccauccccaucaagcuaccaaugacuuucuucacagaauuggaaaaaacuacuuuaaaguucauauggaaccaaaaaagagccugcauugccaagacaauccuaagucaaaagaacaaagcuggaggcaucacacuaccugacuucaaacuauacuauaaggcuauaguaaccaaaacaguacugguaccaaaacagagauauagaccaauggaacagaacagagcccucagaaauaaugccacauaucuacaacuaucugaucuuggacaaaccugacaaaaacaagaaauggggaaaggauucccuauuuaauaaauggugcugggaaaacuggcuagccauauguagaaagcugaaacuggaucccuuccuuauaccuuauacaaaaauuaauucaagauggauuaaagacuuaaauguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauucaacuaaagagcuucugcacagcaaaagaaacuaccaucagagugaacaggcaaccuacagaaugggaaaaaauuuuugcaaccuacucaucugacaaagggcuaauauccagaaucuacaaugaacucaaacaaauuuacaagaaaaaaacaaccccaucaaaaagugggcgaaagauacaaacagacacuucucaaaagaagacauuuaugcagccaaaaaacacaugaaaaaaugcucaucaucacuggccaucagagaaaugcaaaucaaagccacuaugagauaucaucucacaccaguuagaauggcaaucauuaaaaagucaggaaacaacaggugcuggagaggauguggagaaauaggaacaguuuuacacuguuggugggacuguaaacuaguucaaccauuguggaagucaguguggcgauuccucagggaucuagaacuagaaauaccauuugacccagccaucccauuacuggguauauacccaaaugacuauaaaucaugcugcuauaaagacacaugcacacguauguuuacugcggcacuauucacaauagcaaacacuugaaaccaagccaaauguccaacaaugauagacuggauuaagaaaauguggcacauauauaccauggaauacuaugcagccauaaaaaaggaugaguucauguccuuuguagggacauggaugaagcuggaaaccaucauucucagcaaacuaucccaaggacaaaaaaacaaacaccgcauguucucacucauaggugggaauugaacaaugagaacacauggacacaggaaggggaacaucacacacuggggacuguuguggggugggggcaggggggagggauagcauuaggagauauaccuaaugcuaaaugaguuaaugggugcaucacacuaacauggcacauguauacauauguaacaaaccuacacauugugcacauguacccuaaaacuuaaaguauaauaauaauaaaauuuaaaaaaaaagaguaaacauggugagaaaaauguuuguucaguggaaguuuuuucaaaacaauguaguuuuaauuuacauauaaugcuauaaguaaaaauaacccuuauaucuaugcucuaauucuuuuccuguguuuuaauguuuacaaaaaaaaauugagaugaacauaaaauauggaaauacaaaggccuacaauagcaaaagcaacuuugaaaaugaacaaaguuggagaccuaacacugugugauuucaaaaauuauuauauaucuagaguaaucaaaaugauguuaaauauauacaaauagaucauggaacagaaugaaguauauagaaguaaacccacacauauguagacaacugauuuuugacaaaggugcaaaagauaugcuguguagaagggauaaucuuuucaaccaauuguacuggaacagauaucaagaugcaaaauaugaacuuaacaacaagaaaucaaggaucccaucuaaaaaaaugggcaaaagauuugaacacacauuuuaccaaauaagacacacacauaacaaauaaacaaaugagaaaaauguucaacaucauuaguuauuagaaaaaugcaaguuaaaauuauaaugagauaucacuacaccacuaccagaaugacuaaaauuaaaaaggcauacccuaccacauguuggcaaagauagaggaaaauagaaauucucauacacugcuagcgggaauguaaaaugguauaacuacuucagaaaaguuucacauuuccuuuaaaagucaaauauacuucuaccauauaauguagcuguuccacucauggauauuuacccaacagaaaaggaaauacgcauccauacaaagacuuguacaucaauguucauguaguuuuguuuguuacagccccaaacgggaaacaagucaaacuguccaucaacagaugaauggauaaaccaacugugagaaauccguaaacuaauacucauaaugaauuacugauucacgacaaaauggaugaaucucaaaauaugcugagagaaacuagaaaaaauaaguauacaguguaugacuuaauuuauauaaaaccagaaaacacaaaguaauuggcagugacaaaaagcagaucagucguugguuuugagagagguggggauucuuaaaacaguagagcaauuuuuuucuuuaaaccccauuaaaaaagugccagugagauuucuuuuuaagauacaaauugauaaggagaugccuauggcucuaauaaugaugcagaaauagagcuuucaaaauauuacuaacauuucauuauuagccauguauucuugagcagguuacuuaaccucucuguacccuaguuugcucaacuguaugaugggaauauaaaaguaucuaccuugagaggauuguuaugaauaacaaauuaauuuuaauacacauaaagcacuacaacagugccuagaacauagacaccucccaaaauuuacuauuauaauuauacaauuuaaucuucaaguacaccguuaauucauauucaauauauuucauacaaggauaaaaaacuauagaauacauuugaggaaaagaaucauuaaauuaguaacguuucagaaucugauaaagcuuugguuaccuagaaaguuugcuuauccaggccaggugcaguggcucacaucuguaaucccagcacuuugggagucugaggugggcguaucacuuaaguccaggagauugagaccagccugggcaacacagcaagaccucgucuuucguuagcuuuacaaaggugguuuaguuuuggggaagggccauuaucauuuaaacuauaaauuucuccuaaaguuagcauggccuaggcccaggaaugaccaagggcaguugggagguuaaaggcaagauggggguuagauuagauuucuuuuacugucauaauuuucucauuguuauuuuugcaaaggugguuucaagaucaauaauuuaccacugacugcaaaugugcuguaugcauauuaugaauagcauaauuuuuauauucaguauauaauuaaaacucuuccucaucuuucaaaggaagaagaguuuagugaaaguuuaagcaacugguacauuaguuuuuacauaugauuccuccauguuauuuguaggccauuuuguauguacauuuuuccccccuaaaauucccacuagacaguacagagggaacagucugauagcuuuauuuuuauaucagaaauaauuucacauuaauuuauuaagugacuaccuuuuauauuacgcuaaauauuaagacaacaaagaaguuagaagaaauuauacuugucguaaguugaagaaauaaaguacauaaagaguaacaaaauaauuuaauauuuuuggccacugaaaaucuaauuuuuauuucacuuauuuauuacuuauaguuguuagauaggaguucuaaguuucucuucaaagaaucgauaugucaguaaguucaauucuuugccuucuacuuuuaaacuuaacuuccucauaaagcaaucuuuuuagauuaccuccuccacccugacucauuccgauuaccuacuccacccugacucguucccauuaccugcucauucuccacccugacucauuccaauuuccugcucugccauaaccauuuuucccgccaaaccacucgcccagucacucucuuuaaauuagccaaucggaauuaguuuagccugugcggucuaacccuagccaagaggggaacgacacagcagcaggggccacgugcgucagggauaagaaccccuuccccucccuuguccaagugugcgcucaccauugcuccaucuguaagggcgcaccccucuauagaaguacacugccuugcugagaauuaaaaagaaaauuuuauauuugagugcuauuucuuuuguggcaccaacacuuuauuuagaacauaguuguaaaccaagaaguaucugagacaggucucaaucaauuuagaaguuuauuuugccaagguuaagcauaugcccggaacaaaaaaacagaaucacagugacagucugugaucugugccuuucuccaaagaugaauuugagggcuucaaucuuuaaaggggaaaagugggcuggaggggagagaaggaggguaugguaauccacaaguuccaagagaaaagagcagguaggggaauagucaauuauguauucgucuggcaucauuaaacaggcacuuuacauaagauauggugaacauaaguagcuacuuguggaguagguaaccuaaccuuuuaucuguaguuaucagcucaggaacaaaaggaaaggcaguuucuugcaugacugggcuuucagcuuauuuuuucccuuuuggaguggugaauugggguccugaguuuuuauuauccuuucaccaccgucuuauuucuagaacuuuguggagauguuaagauaaauauaauauuagucauaguaaucuggcuuauauuaaauauauugaguaaaugcugaccugcuucuaguaauuuaauucauccuuacuugggcuauuuaaaacaugaauuaacauuuuagcuuauaugaauuuuaaaauucauacaggaucauaaaugaauuuuuguuaaauuuuuuuuuuaugaaugacaaauuucuccauguucaaugaagaaaacccaagaaacacagaaaguaacaaaaauaaacugccaauaguuucaccauucacagauaaucauuaucaauuuuuauguaguccuuaugucuuuuccagggacauuugcacaaacucuuauauuuuacagcauauuagacuucugcugaagucuguuuuuaaauccaaacugaugauacuguaaaugccugcuaauguaacugguuaugacgagcacaguugauaaaucuguuaguuucuuaaguagaggguuaucuaaaauacaauuuuuuucuuuauauaaagcuaucauacaguuuuauaaucugcuuuuaugacauuauuuuaucacaaauguuguauaaacuuaacauucuucuguaacuugauuuuaaaugucugcauuggauucuaacucagaaaugaguaaauuuuuaaacugauaaauauauacaggaacuuuuaucauuuucacacaaaauuggaaucuuaauuuacacauuaccaugcaauuugauuuuuuucacuuaguguuuucugacuguucuuccacauucauagauacacuuacuacuauuuuuaguauuugugugauauuccaaaguauggaaguuucuuauuuacuuugcuauucuuuucuugauggaccuuuggcaacuacagacaaugcugcaaucaacauuuauuuauauauauauauauauauauaucuccuuauguuuuggugcauauauauuuugugggguaccuucccuuaaguaggauugccaagucaaaguguauguauguacauucauuuuaauauguauugccaaauuuauccaaaaaauuacauuaauucccaguaacacucuacuuguuccuagaauuccuguuuaugccugcauuagauuggugaaaaauggucuuauuuuaauuuccauuuguuuccuugcuagugaugcuuaucuuuucauuuuuauuggcucuucauacuucuccuucugcaaguugccuuguucguccauuuuucaauaggauggucuuccauaggaaguuuuuauuaauaugaauauuaauacagauaauaauugucccuaagcauugcauauaccuaacauggaugguauggucaucacguuucauuuucuugucuaaacuuguuuaucaccuaucucucacuaaccuaggaauuaguuacauguccacuugcuuguccuguucacuguagcuccaauaccaaggcauucccuuauuaaacgaaauaaauuauccgaacauaccguuacuuaaccgagauaaaggacauccugucuagguacaggauuguuagagauucuuuuuucauggcuaugagauguuguucuaauguucccuuaaguuuccaggguuaguagugagaagucuauugucaaugugauucucuuucccuuuucucugaaugauuuuucucaugacugaaauucaguuauuucugcacauuaucucuagauauguacguuuuuucauuaaacuuuuuccacauagccccacccgcaaucaaauguaucuaagucucagccuuuucaaucugacaaccuucaauguuucuaaacuagguaaguuucuucuauuauuuccuaaacuaauacuuguucugucuuguuuucuuucuauaacacucauucccaaaccucuugaauuugcuccugcaggucucuuaucuuuucaaaaauaauuuuauuucuauaugccuuacaucaugaaauuguuucuauuugaucuucuggaacaaaagauucagcucucacaagggguuauuuaucaguucaucuguugaauuuuucucuuaggaaauuuuuagcucugaaaaauccugauuauguucuaauuacauuuucugaaaguucuuaguaauuuuuuucuuaauuuacuacauucuucugucucaucccuguggcucaucaauaggagccacauauuuuacuuguuuaguuuggucuuacaucguaaaguuaaugagcucccuuagugguuuuuuucuuugcuguguuccauuagccaccuguagagguuaggcuuugauguggguaucuggcaaugcaaaccuacagaugcuggauaaagugacaguuugcagaggcagacaagcucacauacugcugagcugaggcuucagcagucuccucucaggcacugucucugaguagaagggccggcuuccucagaccaugagguguggcagcaacugaguucaccugugcaaccucuacucuaaguccgcagcaguuaacagaguuuuaugggaagcccugcuaauguccacuuccaggagcagacacaguccucccuuuucugaagggaaaccacaggauuccacuuuuuuaagcucacuuagagaacugugaaaucucagauccugucucagugccuuaaggaguggcaaagcaaaccuuucccucugccugguccuucagcaccuauucuuucccuaaagaacuugauaucuugaugauucugacuuuaggcucauguuuauacuccugagaagaggagaggaguuaggaaugggggcuuaguccuucuaucuucucagaauuuagaaauuaacuuaaaccauuucuacuaguuguucaaaguuuuuguagccucugccugcaaaacagguucuuuuuuauuuucauuucuuucauuaugauauaaaauaauacaggcugggugcagugacucaugcccauaaucccaacacuucgggaggccggggcaggcgggucaccugaggucaggaguuagagaccagccuggccaacauggcaaaacccugucgcuacuaagaauacaaaaauuaguugggccugguggcgagcaccuguaaucccaacuacuugggaggguaaggcagggagaacugcuugaaccugggaggcggagguugcagugagcagagauugcgcugcgccacuccacuccagucugggugacagagcaagaugccgucucaaaaaaaaaaaaauaauaauaauaauaauaaaauaaauaauacagagagccaucucuguauuauuugguaauaguuuagaaaggucacugauauuuuuguaucaucuguuuagcaagacauuaggaggaggagaggagccugaauucugcuaaaguguaaauguaaacaauuaccagucauuauuccagaggucacaagauuugcaacuuccccaauuacuccugcagguaacaucacuacuguagaaccuaagauuggccuuuucagauaccuucucagguuuuugcauuucugacggcggagggcuccacguggacccaccaacugguccugguccugugguccuacucagaaguggacucgacaugaagaccauuuuccacaccucugacugccucccuaaccaaucagcagcacccauucccugccccaccaaacuauccuugaaaaacccuagccuccaaauauuggggaagacuuauuugaauaauaaaacuauggcgcuucuguucagccagcucuucaugaauuaaacuuucucuauugcaauuccucugucuugauaaaucaauuguauucaggcagcaggcaaaacgaaacuguugggcaguuacaauaguuuuaauggauauaucugggcucauuccaucuuuauauaaugcuuuggauuuuauauauaaaaaugaaaugacucaaaaaaucauaaaaggaguauuaaggcaauuuuauauuacaugguuaagaauucuacugcacaguaauauacaauaaguaggucauggcagaccaacucucccaacagcuagaaaaaggcagaaaacauaaaaaauuauauuuuuaaaggcaucaggcaagcuauggaaucaauaaggccuagacugauuaaaauucauaguaggagggcuguucagaaguaagcugauuuuuuuuccccuaagagcauucaccaauucugggcacaggcuaagaaagcagcagacuuaguucaggcagacgccugcuggagcaaagaaaaaucagcaaagcucuuggcaguuacauaggguugaagaaauaaucagacuugaaaugccucaacuccacagccaauuuuucccacaagacaucugcugaacuuagaagcugcagaaggggcucaagggcucgaaagcaaacuucauacaggcaaaguaaaauuuccuguauuugugagaugcacagguauccauacuaacuggagaccugaugugccucaaacacauaaccagugacaaagauucugugcuuagucaaacuuuagucaggcuccugaaccuucuucucuuagguccaucugugcauuuccuuauaaaauccaguuuagcaagacccccacacuugauaucugauuagguggcucauccuccaaucuccccuaagugaugucugaucacccuggucugucuucagcaagaauccuguuguuuuagccagaauccccauuaccccugauguuuccucuuauuaauuuucuauccauugacucccacacugcuccuuggcuauaaauucccacuugcccaugcugaagaagugagcccaaucucucuuugccacugcaagaacccacugcaguguucccuauauauacugcgauaguccccaaaaaaguuuuccuuacuguguuucaacaaguauuauucgauaauuuuuucuuuaacaccaauuuuacccucaagacaucugcugaauuuugaugucauaugggcaagaugacaaucaaaugcccaucaaucaacaaguggauaaagaaaaugugguauauauauacaccaucgaauacuacucagucacaaaaaggagcaaaauaauggcauuugcagcaaccuggauggaauugaagacuauuauucuaagugaaguaauucaggaauggaaaaccaaacauccuacguucucacucauaauugggagcuaagcugugagaacacaaagacauaauaaugauacaauggacuuuggggacucagggaaaagggugggaggcgggugagggauaaaagacuacaaauuggguacacaguguacacugcuugggugaugggugcaccaaaaucuccccucucuugggaguaggauaaggaaaucuuacaugacuggcuggcaacagagaaaacaaaagagaaacuucagagaccacccaucagaagaaauacauacuaugcaaaaagaguuucaaaaaaucauaaaaggaacucuucaguaaucaaggagcagaaccccagcaaucucugagggcuaggagaauuagauuuccaaagucaccacaacauaauacucaguccaguucucaaugaaaaauuacaacacauaaaaagaaacagaaaaguauggcccagucauagaaaauaaagaauauggcagaaaccaucccuaaggaagcccagacauuugaauuauuaaucugagacauuaaaucaacacucuuaaauauguucaaugagcuaaaggagaccaugggcaaaaaacuaaagaaaaucaagaaaacaaugucuaaacaaaaugagaauaucgauaaaagggaaaauuuuuuuuaaaggaacugaaaaaauucugaagauaaaaaguacaguaacuaaaaugaaaaauucacuacagaaauucaauagcaaauuugagcagacggaaaagauaaauguacuugaaaauaagacauuugaaauuaugcaaucuaaggagcaaaaagaagaauaaagaaaaauaagcagagucugggggaccuguggggcaccauuaaucacaacaacauacauaauauaggaauagaaguauggaggaaagagaaaugguugaaaaugucaggagccuuaaugaaauccgugaauauacaaauccaagaaauuccaaaaaggauaaacucagagacccacacugagacacacuagaaucaaacugcugaaaccaaaagacagaauuuugaaaacauuaacagagaagcagcuuaucaaauauaaggguuccucagugauaugguuuggcuguguccccaaccaaauuucaucuugaauuguaguucccauaauccccugugucaugggagggaccuggcgggagguaauugaaucacagaggugguacccucacgguguucucgugauaaugagugaguucuuacgagaucugaugguacuuuaauagguggcuuuucucccucugcucagcacuucucuccugccaccacgugaagagggacauguuuguuuccccugcugccaugauuguaauuuuccugaggccuccccagccauguagaacuguaagucaauuaaaccucuuuccuuuauaaauuacccagucuugggcaguucuuuauagcagcaugagaaagaacuaauacaguaaauugguacugcagagaguggggugcugcuauaaagauacccaaaaauguggaagcaacuuuggagcuggguaacuggcagagguuggaacaguagacauccacacuuaaaaaggcacaucucaggcccagugcgguggcucaugccuguaaucccagcacuugacaggccaaggcaggaugaucgcuugagccuaggaguuugagaccagccuggccaacguagugagaucacaucucuacaaaaauuaaacaaaaucagccaggcgugguggugcgugccuauggucccagcuacuagggaggcugagggagaggauuacuuaagcccaggaaaucaagacugcagugagcuaugaucaugccacugcauuucagccugggcaacaaaacaggaagcugucucaaaaaaaaaaaaaaaaaagguggcgguggagggacauuucaaauaaauaaccuaaaugugcacauaaaauaacuaaauaacaaagagcaaaguaaucccgaagcuagcagaagaaaggaaauaauaaaaguuagagcaaaauaaaaagagaauggaaaaacaauaaagaaaauacacuuuaacaaaaauuguuuuuuuccugauacggagucuugcucuauugcccaggcuggagugcugugacaagaucaaaacucaugguaaccuugaacuccugggcacaggugauccuccugacucacccuccugagcagcuaggacuacaaucaugugccaacucaccuggcuaaguuuauuuuuuguagcgauggcauuaugcuaugucccccaggcuccccuguaacucccugccucaagcaauccucccgccucagcuucccaaagugcugggauuacagacaugagccaucacauccagccaaaaguugacucuuugaaaaaucaacaaaacugauaaaccucuagguaaguuaagaaaaaagggagaugauucaaaucacaaaaaucagaaagaacauuaccaguaauuuugcauaaauaacagagauuaugagaauacaauaaagaguuguauuccaacaaaucagacaagccagaugaaacugacaaaguucuaaaaacauacaaucuaccaaaacugacuugaguuuugguaaucaauauaaaucaauauauugugugaauacagaugcaaaaguccucagcaaauacuucauacaucgugacaaagugggauucauucacugaaugcaaggaugauucaauguaggaaaaucaaucaaugaaauacacuacauuaacaggaugaagaaaaaauccacguuucucaauugacgcaaagagagcauuugacaaaauuuaacaccuuuaacaauaaaagcaugccagaaacuaagaacagaaguaaauaaccucaacauaauaaagaccauauaugaaaaaccuaaagccaacauuauacucaauggugacagacugaaagccuucccgcuagaacaagaacaagauaaggauacccacuuuuaccacuuaauucaacauaguauugaaaguuccaccaagagcaauuaaacaagaaaacgagauaaaggcauccaaaucagaccacagagauguauaaauaaugcacacaaaaauuauuagagcuaauaaaguuagcaaagucguaggauauaaaaucaauacacaaaaaucacauauauccauacagcauggaagagaaagguuuccugcaguguagcacagccacacugccagaucauggccagacugcuucuuuacgugagaccucaauccacuccuccucaugggguagugggucuucccagcuggggucuugagccacccccaauuagacagagcucuaauuuccccccaggacggaguauaccugaguggugggguaggcugccacacuggcauucaggcuucucaaucaguccagccuguggguccuggagagcccauaccaauuggggggcugaaggaauccccaacacagcacaccugcugcagccagacugcuucuuuaagugggucccugaucccguuccuccugacugggugacaucucccaacagaggucuccagccaccuccuccaggcacaucugagcuaacaacaggucaguaccccccugugaaggagcuuccaaagaagaaggaggcugccaucuuugcuguuuugcagcccucccuggugauaccuccagguacaggaaaaaucgaggcaacuagggucuggaguagacccccacaaauggcagcaguucuauggaagaguggccuguuaaaagaaaaacaaacagaaaacaacaauaucaacaaaaaagacccuacaaaaaaccccauucaaaggucagcaaccucaaagaucaaaggcagauaagcccacaaagauaagaaauuaaucaaugcaaaaaugcuaaaaacucaaaaaaccagagugccuauucuccuccaaaugaccacaacaccucuccagcaagggcucacaacugggcugaggcugagaaagcugaaugacagaaguaggcuuuggaagguggguaacaacgaacuucacugagcuaaaggagcaaguuuuaacccaaugcaaaguaagaaacaugacaaaacaauacaggacgugccaaguucuuagagaccuucaaagagacuuagacucccacacaauaauagugggagacuuuaacacaccacugacaaugugagagauaagcagccaguuuagagaggaaguuaacugaccuauuagagcugagaaacacacuacaagaucaaaaaagacaaagggcauuacauaacaauaaaggguucaauucaacaagaagagcuaaauguccucaauauauacgcucccaauguaggaacacccagauucacaaagcaaguucuuagggaccuugaaagagacuuaaacucccacacaauaauagugggagacuggaacacaccacugacaauacuaggaggagccaguuuagagagcaacauaaccgaccuguuagagcucagaaacauacuacaagaacuucacaaugcaaucacaacuauuaauagcagaauagaccaaguggagaaaagaaucucagagcuugaagacuaucuugcugaaauaagauaagcggacaagaauagagaaaaaagaaugaaaaugaauaaaaccucugagaaaugugggauuauguaaauaaacugaaccuaagacugacugggguaccugaaagagauggggagaauggaacgaaguuggaaaacauauuucaggauaucauccaggagaacuuccccaaccuaggaagacaggccaacauucaaauucaggaaaugcagaaaaccucaguaagauauucccugagaagaucaaccccaagacauauaaucaucagauucugcaaggucaaaaugaaagaaaaauguuaagggcagucagacagaaagaccaggucaccuacgaaggggaggcccaugagacuaacaauagaccucucagugaaaacccuaaaagccagaagagauuggggccaauauuaaacauucuuuuuuuuuuuugacagagucucgcuccguugccaggcuggagugcaguggugcaaucucagcucacugcaaccucugccuucuggguucaagcaauucuccugccucagccuccugaguagcugggacuacagguaugcgccacgacacucagcuaauuauuuuuguauuuuuaguagagaugggguuuuucacaauguuggccaggauggugucgaucucuugaccucguuauccgcccgccuuggccucccaaagugcugggauuacaggugugagccaccacaccuggccaauauuaaacauucuuaaaguaaagaauuuccaacccagaauuucauaucuggcgaaacuaagcuuuauaagcaaaggagaaacaagauccuguucagacaagcaaacgcugagggaauucguaaccaucagaccugcuuugcaagagcuccugaaggaagcacuaaauauggaaaggaaaaaccauuaccagccacuacaaaaacacacugaaguaaacagaucagugacacuaugaaggaaccacauaagucugcaaaauaaccaacuaguaucuugaugacaggaucaaauccacacauaacaauacuaaccuuaaauguaaaugggcuaaaugcuccaauuaaaagacacagaauggcaagcuaaauaaagaaccaagacccagcgguaugcugucuucaaaagacccauaucaugugcaaagacacacaucccaaaauaaagggauggaggaaaauuuaccaagcaaauggaaaacagaaagaaccacggacugcgauccuaguuucucacaaaacagacuuuaaaugaaaaaagauaaaaaaggcaaagggcguuacauaaaggguucaauuuaauaagcgccaaauauccuccauauaugcacacacaguauaggaacacccagauuccuaaagcaaguucuuagagaccuucaaaaagacuuagacucccacacaauaauaguagcagacuuaacacaccauugacaauauuaggcagaucaccaagacagaaaauuaacagauauucaugaucugaacuuagcucuagaucaaguggaccugacagauaucuacagaacucuccauccuaaaacaacagaaacuaauuguucucaucaucacaaggcacuuacucuaaauuugaucacauaaucggaaguaaaacacucuucagcaaaugcaaaagaacugaaaugauaacagucucucagaccacaacacucaaaaaaauucacucagaagaauuaagaaauucacucaaaaccacacaacuacauggaaauugaacagccugcuccugagugacuugaguaaauaaugaaauuaaggcagaaaucaagaaguccuuugaaacuaaugagaacaaagagacaauguaccagaaucucugggaugcagcuaaagcaguguugagggaaauuuauagcacuacaugcccacaucaaaaagcuacaaagaucucaaguuaacaaccuaacaccacaacuaagagaacuagagaaacaagaacaaacccaaaagcuagcagaagacaagauauaaccaagaucagagcagaacugaaggagauagagacaugaaagaccauucaaacgaucaaugaauccaagagcugguuauuuaaaaaaauuaauagaauacauagacugcuagcuagauuaauaaagaagaaaagagaagauuuaaauaaacacaaucagaaaugauaaaggggauaucauccugaccccaaagaaauacaaacaaucaucagagaauacuauaaaugcaucaaugcacauuaaauagaaaaucuagaagaaauggauacuuuucuggacacauacacccucccuaagacugaaccaggaagaaacugaaucucugaauagaccaauaaugaguccugaaauugagaaguaauaaagagccuagcaacccaaaaaaaaaaaccagcccaggacagacagauucacagcugaauucuaccagagguacaaagaagagcugguauuauuucuacugaaacuauuccaaaacaauugaaaauuagggauuccuccuuaauucauucuaugaggccagcaucaucuugauaccaaaaccuggcagagacaaaacaaaaaaaaagaaaaccucaggccaauaugcuugaugaacaucaaugcaaaaauucucaacaaaauacuggcaaauauccaguagcccaucaaaaaguuuauccaucauguccaaguagacuucauccccggaaugcaagacugguucaacauacacaauucaauaaaugugauucaucacauaaacagaacugaacacaaaaaccacaugauuaucucaauagaugcggaaaaggucuuuaauaaaauucaacaucgcuuuagguuaaaaacucucaauaaaccagauauugaaggaacauacuucaaaauaauaagagucauauaugacaaacccacagccaauaucauaaugaauggacaaaagcuggaagcauuccccuugaaaaaaggcacaagacaaggaugcccucucucaccaguccuauucaacauaguauuggcaguucuggcuggggcaaucaggcaagagaaagaaauaaaggguauucaaauaggaagagagaaaauuaaacuaucuuuguuugcagaugacaugauccuauauuagaaaaccccauugccucagcccaaaagcuuuguaagcugauaagcaacuucagcaaagucuaaggauagaaaauuaaugugcaaaaaucauuagcauucuuauacaucaacaggcaagcagacagccaaaucaugaaugaacucccauucacaguuggucacaaaugaauaaaauaccuagcaauacagcuaacaagggaggugaagaaccucuucaaggggaacuacaaaccaacuuucaaacaaaugacagaugacacgaacaaauggaaaaacauuccauguucauggcuaggaagagucaauauugugaaaaugguuauacuacccaaaguaauuuauagauucaaugcuauccccauuaaacuaccacugacauucuucacggaauuagaaaaaagcuauuuuaaaauucauauggaaccaacaaagaguccgaauagccaaggcaaucaaagcaaaaagaacaaggccagaggcaucaugcuaccugacuuaaaacuguaacacagggcuacaguaaccaaaacagcaugguacuggcacaagaauaaacacauagaccaacguaacagaauagagaacccagaaacaagaacacccaccuacaccaucugaucuuagcaaaccugacaaacacaagcaauggggaaaggauuccccauguaauauauggugcugggaguacuggcuagcuguaugcagaaaauugaaacuggaccccuuccuuacacccuaaaggaaaaugaacucaagauugauuaaagauuuaaauguaaaacccaggaagaaaaucuagacaauaccauuugggacacaggcacaggcagagauuucacgacaaggaugacaaaagcaauugcaacaaaagcaaaaauugacaaaugggaucuaaucgaacugaagagcuucugcacagcaacagaaacuaucauuggagugagcagauaaacaacagaaugguagcaaauuuuuggaaucuauuaaucugacaaagaaaggucuaauauccagcaucuacaaugaacuuaauaacuuacaagaaaaaaaaaaucccauuaagaagugggcaaaggacaugaacagacacuucucaaaagaagacauaaauguggccaacaaauacauuuuaaaaagcucaacaucacugauuauuagagaaauucaagucaaaaccacaaugagauaccgucucacacaagccagaauggcuauuacuaaaaagucaaaaaacaacaggugcugguuagguuguggagaaaaaggaaugcuuuuacacuguugguaggaguggaaauuaguucaaccauuauggaagacaguaggcaauuccucaaagaccuagaggcagaaauaccguuugacccaauaaucucauuacuggguauaccccccaaaauauaaaucauucuauuacaaacauucaugcaugcauauauucacugcagcacuauucacaauagcaaagacauggaaucaaccugaaugucccccgaugauagacugaauaaaagaaaugugguacauauacacgauggaauacuaugcagccacaaaaaggaacaagaucauauccuuugcagggacaugguuggagcuggaaaccauuauccucagcaaacuaacacaggaacagaaaaucaaauaccacauguuuucacuuauaagugggagcugaaugaugagaacauauggacacaugggggaaacaacauacacuggggucuguuagaggauggaggggcagggcgcaggaugagggagagcaucuggaagaauagcuaauggaugcugggcuuaauaccuaggugauggcauaaucugugcaaggaaaccaccauagcacauguuuaccuaugcaacaaacccacacauccuacacauguacccugaaguuaaguuggaaaaaaucagauauaugucuacacacuuggaaugaacaacugaaaaggaaacuuaaaaacaauuccauuuacaauagcaucaaaaagaaauuuaaaacuuaaaaauaaauuuaaugaagcaggaaaaagacuugcauacugaacaccagaaaacacuccuuacagaaauugaaggucuaaauaauugauaagacauugcauguucauaggcuggaagacuuaaauuaaugcuucccaaagagaacuacagauucaaugcagucucuaccaaauucccaaugguauuuuuuacagaaauagaaaaccaguucaaacagucauauagcaucuuagggacuggcucagaauagucaaaacuauagaugauacugaacuuaugaugguucaacuuacgacauuaugauggauguuuggggcuguuaaauuuuuuacuuaugguauuuucaacuuacaauggguugacaauggguugacaugacuuauauccugaaauacaacaauaaaauuggaggauuccacuuccugauuucaaaaguuacuacaaagccacaguaauuuaaaaacugugguacuggaauaaggacagacauauauaacaaugaaacagaauggagcauccagaaauaaccccaaauaccaauggccaauugauuuucaacaagacuaccaagaccguucaaugggaaaagaauaguucuuuaacauauuguacuguaacauuuaacauaaaguacaacuuuuuuugguaauauacauccacuaaugagaauuagauucuuuuuguggaaauaaccuuuuugguaaauugggguuuaaaguacuuuucccuaucaucaaaauugagugcaaauuuucaucuauuaaugcugguccuuaaugacauuuuacauaauucauauuugaaaacauuuucuaauacagcaaaagcuauuuuccaaaguuauuuagugucuguuaagugguagauggugguccuucaaguaaagaaaaaaaaaaaagucagucucgguaaaaaaaaaaacaaaaaaacuuuccaauaaacuuuuaucacuacccaagccauaacagcuguggaggagggcaauucaagauauuccugcuuccaucucugaaaaaacuuacacuaaccauagguuuuaaaagucuuauauuuucacaaacuuuguaaaucuguccaacuaagucuuuugcugcuccauguggauuuuuacuacuaucaauuaauacaacuucuuagauucuacuucggguuguacugaauuaguauuuucucaacuccuuugagaauuuuuuucaucuggaauuguucugcaggucauucacaguaauucuuagucaauucauacuucacauggaccacugaaauuuacaacugagcaguauuauaacaucugucaauuuaucaaaaacuaagcaaacuuacuuuuacugcacuuucauuuucauauuuuauuuuugugaaggaauuuuguggugagcuguucugugcuaaauuuuuuaauucuucuaacuuaaccuucaguacauucugauaagugcuuagucuagugaugucagcuuauauucuuuuggcauagcuauagugccauugaauaauaaauacaauauuuugccaucuaauucaauaauaaaagaaaccacacuacagugugcuuuaaaaacaaaacaaagucuuuuugucuucuuugguucuuuugacaugaguauguacuagaauaaaaauaauauaaaaugucacagaauggcaauauguguacacuugaaauguuaugaaguuacaacuguguuacuacacagugcauugaacagaagagcaaagcaaugagagcaccacauacacuugcuguaagaacuucaauucaaucugcuauuguagcuugaaagaaguuacagacaauacauaaaucagugaggauuuucgugccccaguaaaauuuuaguuauggacacugaaauuuaaguaucacauaauuuucaacuguagcaaauauucuucuuugacuuguuuugauuauuuaaauauguaaaaacuauucuuacauuauggucuguguacaaacaggcaccagggcauauuugguacauggucagucaucugcaaacuccugcuauaggaagcguagaacuacucaguauuuuucaucauaugaacauuucagacuauuaaccuagucaguguuauauacaguauggacuagaaagggaccaacgcaaagagauaaauuagauauaaggauauaguaaauggaagcugaguagcuaaguuuauaccuuaucucucuaauauacacuacgcauguaaccuuggauaagacaauuuuucagauccucaauuuacacauccauuaugaaggauaauaauaucuacuucaaagcacuuaucuaaagauuaaaugggaugauccauguaaacugauuacaauuguacucaucggauaggaggugcucaauaauguuaauuaaccacauauauuacugcuaaugcauauuaagucauaaugacagccuuagacagugaugaaacaugaacugaaaagguaaaauuaaacauaucuaggcacguuuaauagaacagaagaaaaaaaggagaaacagauccaaauggauauggaaauuuuaguauaacauaugcacauaaagcuuauuauuuucuggaauaucuuuuggaauggaagggaggaauuuaaauauaaauucaagaauaucaugugaauauguuuuaaaaaacuagauaagacuucaaggacaaaacaguaaagugagaacaacaaacagaaaaggauauaggugcuauguuuagggauggaaggaagcagcagagucaaaacagaagcuauaguaggaguaacacgcacagaauaauuaguaaagcaguuagacuucaagggcaaaacaguaaagugagaacaacaaacagaaaaggauacaggugcuauguuuagggauauaggugcuuuguuaaggaaguagcagagucagaagaaaagcuauaguaggaguaauccacauagaauaaucaguaaagcaauuccuaucagaauaaaauaaauacuuaugagugcaaaagacugaaagaaagucaucuaagagaaucaaauuuaaaugcgauguaaugauuucauaagaaaacacuauuuagcgguaaaaucuacuuacugauacagcuaucaugguacuaucuggccuccauucagcuugcuuguaggauccaaacugaguagaugauuuugcaggcuccuuguagguuacaauuaacacacuaggcugugugauuaaaaaaaaaaaaaaguuguauuuuuuaucaauaucucauaaaaauacacaaauaaaauuuaagauaacagaguauucaaaguauuuuuacaguaaaauaaaagacaauauugauauuaaacuaucggcuuucaacauugcaagcauaucaaccaaaacaaagaccuaaaccuacgccuguauuauuaaagaaacugaauuaauaauuaauaaucauccaaaacagaaagaaccaggacuaaauguguucauaggugaagucuaccaaacguuuaagggagaaauuacaccaauucuuuacaaagccuuccacaagauagaagcaggaguacuuccuaauuuugaguccagcauucccuuaauaccaaaaucagaaaaggauauuacaugaaaagaaaacuacaggccaggcgcgguggcucaugccuguaaucccagcacuuugggaggccauggugggcggaucacaagguuaggagauggagaccauccuggcuaacacagugaaaccccguuucuacuaaaaauacaaaaaaauuagcugggcgugguggcaggcgccuguagucccagcuacucaggaggcugaggcaggagaauagcgugaaccugggaggcagagcuugcagugagccgagaucacaacaacacugcacuccagccuaggugacaaagcgagacucugucucaaaaacaaaaacaaaaaaacacuacagaucaacaucucuuaugaacauagauauaaaaccucucaacaaaauauuagcaaaucaaauccaacaagguauuaaaaaaaauuaaacaccauaaccaaauacgauauaccccagaaauacaagccugguucggcauucaaaacucaauuaauauaauccaucacaucaacaggcuacagaaaaaucacaugauuauuucaauaaacacagaaaaagcacuuaacaaaucuaacaaccaagauaaaaacgcugagcaaggccgggcgccacggcucaugccuguaaucccagcacuuugggaggcugagguuggcagaucaccugaggucaggaguuugcgaccagccuggccaauauggugaaaccccaucucuacuaaaaauacaaaaauuagcccggugugguggcaggcgccuauaaugccagcuauuugggaggcugaggcaggagaaucacuugaaccugagagguggagguugcagugagcugagauugugagacugcacuccagccugggcaaaagagcgagacucugucuccauaaaacaaaacaaauaaacaaaaaacacugagcaaacuacagaacaacacucauucaugauuuuaaaaaaaccucucgggaauagaaagaaauuuuuucaacgugauaaagaagaucuaugagaaaccuacagcucaacgcuuuccugcuaagaucaggaacaagggaaggaugucuccacucacagcagcuuuucaacagaauaguggaagucccagcuaauucaauaagaccacaaaaaggaauaaaagguaaagagauugggaaggaauaaauaaaacugucuuuacucauagauaaugugaucaucuauguagaaaauuugacagaauugacccaaaaauccuccuagaauaaguaacuauagcaagguuacaggauccaagauuaauauacaaaagucaauaaauuuucuauauaccagcaauaaaaaaguggaauuugucauuauaaacacauuugcaggccaggcgcaguagcucaugccuguaaucccuacacuuugaaaggccaaggcaggcagaucacuuaaggucaggaguucaagaccagccuggccaacauggugaaacccaucucuacuaaaaauacaaaaauuagccaggugugguuacaucucuacuaaaaauacaaaaauuaaucccagcuacucaggaggcugaggcagaagaacugcuuaaaccugggagguacagguugcagugagcugagacugcgcuacugcacuccacccuaggcaacagaaacugaaucucaaaaacaaaaacaaagcugggcacaguggcucacgccuguaaucccaacacuuugggaggccaagauagacaaaucaccugaggucaggaguucgagaccagcccgccaacauggugaaaccccgucucuacuaaaaaauuacaaaaauuagcuggacaugguggcagucaccuguaaucccagcuacucgggagaauguggcaggagaaucgcuugaacccgggaggcagaggcugcagugagucaagaccacaccauugcacuccagccuggguagcaagagugagacucuaccuccaaaaaaaagaaaccaaacaaacaaaaacaaaaaauacacacuugcagccugggcaacauggugaaaccuugucucuacaaacaaaacaauacaaaaauuagcugggcaugguggcacacaccuguagucccagcuacucaggaggcugaagugggagauugcucgagccugggaggcagagguugcagugagcugagaucaugucacugcacuccagccuaagugauagaguaagaugcugucucaaaaacauaaaaaauguaaaaagcauuuuuaaaaaacuauguaacacaauacguuuaucuauagaaaaaaguuacaaaacacuaaugaaagauaccaaagaagagcuaaauaaauggagacaggcugggugugguugugcaugccuguaaucccagcacuuugggaggcugaggcaggcagaucaccaggucaaaaguuugagaccaaccuggccaacacagugaaaccccaucucuacuaaaaauacaaaaauuagccgggcguaguggugugcaccuguagucacagcuacucgggaggcugaggcaggagaaucacuugaacccaggagacggaggcugcagugagccaagacugcgccauugcacuccagcuugggugacagagugaaacuccgucucaaaaaaagaaagaaagaaagaaagaaagaaaaaaauaaauggagacauauaccauguuaaugaauacaaagacucaauacugucacaauaugucaguucuucccaacuugauauacagauuuaauacaaucucaaucaaauucccagcaauuuauuuucuggcuaucaacaaagucacucuaaaguugauacagagaggcaaaagaccaagacuagcaacuuaauacuggagaagacaauguuggaagaccggcauuaccugacuucaagacuuacuauaaagcuaaaguagucaagaaagugugguauuaacaaaauaauaaacaaaucaaucaauggaacagaauagagagcccagaaauagacacacacaaauauaugccaacugaucuuuaacaaacaaggaaaggaaguacaacagagaaaagacagucuuugcaaugaauaguauucaaacaacuagacgucaacauucacaaaaauaaauaccugaugaacacagaugcaaaaguccucaacaaaaugguagcaaaccaaauucaacaauucaucaugaucaaguaggacugaucccaggaaugcaaggaugguucagcacagacaaaucaauaaaugugauauauuacauuaacagaauaaaaggcaaaaaccccaugaucauuucaggagaggcagaaaaagcauuugacaaaacucaacaucuauucuugacaacaacucuuaacaaauuaagaauagaaagaauguaacucaacacaauaaaagccauauaugacaaacccauagcuaacacuacugaauaaggaaaaguugaaaucuuuuccucuaaucuggaauaagacaaggauacuaucuuucaccacuuuuauucaacgcaguacuggaaauccuagccagagcaauuaggcaagaaaaaaaaaagaauaaaaaguauccaaauuaauuggaaaggagaagucaaauuaacacuauuugcagguaacacaaucuuacauauagaaacccuaaagaugccaccaaaaaagugguagaacaaaauaauucaguaaaguuguagaauacaaaaucaauauacaaaaaccaguaaugccucuauacacuaauagugaauuagcugaaaaaagaaaucaacaaaacaaucccacuuauuaauagcuauaaaaaaacccaaagaacaaaaaauuuaauugaagaaguaaaagaucacuacaaugaaaacuaugaaacaguaauaaaaugaagaaaacacaaauacauggaaagauaucccauguuuauagauuggaaaaauuaauacuguuaaauuguccauaugacccaaagugaucuacagauccaauguaaucccuaccaaaauaccaaugauaugccucacagcaguggaaaacacaagccuaaaauucauacugaaccacagaggaccucaaauagccaaagcaaucuugaacaaaaauaacaaaguuaguggaauuacacuaccugacuucaaaauauacuacaaagcuguauuaaccaaaacaccaugguacuggcaauaaaagcaaauaaaacaauggaacaaaauagcccagaaauaaauccaugcuuuuacagccaacugauuuucaaaaaacaggugccaagagcacacauuggagaaaggauaaucuaauaaauggugcugggaaaccuggauagccacaugcaaaagaaugaaauuagacccuuaucuuacuauacacaaaacucauuucaaaauagauuaaagaggcuaggugcgguggcucaugccuguaaucccagcacuuugggaggccgaggugggcagaucacuugagaucaggaguucgagaccaaccuggccaacauggcaaaaccccaucucuaauaaaaaaaaauacaaaaauuagcugggcaugguggcaugcaccuguaaucucagcuacucgggaggcugaggcaggagaaucacuugaacccaggagguggagguugaagugagcugagaucacaccacugcacucaagaaugaaggacagggugagacugucucaauaaaaaaaaaaaaaaaaaaaaaagauuaaagacuuaaauguaagacccaaaacuaugaaacuacuggaagaaaaacauaaaggaaaugauucauuauauuggucugagcaaggaauuuuuuggauaagaccugaaaagcacaggcaacaacagcaaaaauagaggaggggcuucaagauagcugacuagagacaucagcccuugccuccuucacaaaaaaaaaacccaaacagggaggagucacacuuucaacagaacaucuaagacacaacacuggaauuuagcagagaagugacaggaaacaccuaaagcaaggaagaagagggaagcaagguuguuugcuuggccuuuaucgaccuggagcacagagcagaucuccagugugggggaaagguaaaugagagauacccagcagcucacacucccaccacggacuccugcaacccuagcuuacagagaggggguccagagacuagcauagagaacuucuuagagaccaugugaugacacugcuccagagagagagcucacacuggguccuguaccaccugcaugagaccuaaacaguuacagcauggugucauuuucaguccagcucuuaacaggcugcauccugcccuugagcacaagagucccugcauuuccacauuaguaaagcccuacuaacauucccugcauccaccugggggccuacagugaugcaaugccacuuggacccagcagaguggcagagucccugguauuaaagcauauauaaaauccuacacuguggagaacaggcaagugcaaugcacuggggaggguauacuggggaggcuaucacaaggacaaaaagagccaaagcguacacuucugagagccuaaacccugcuagccugggguugcugccacugacaguaaccccaucuccacuaacagcaagacugcagcacacuugaacauguccugaggacagaaucucccagcaugccagugucaauguuccugacacugcuuggagcaaagcauaccauaccugccccaccccagccucuggugugaggcuacugacaccgacaccaacccuauccccucuaguagcagggccacaguggacaugcacaugcccugaggcaaggcucucucuauccacuguugcuaccugagcacucuaccagggggccugaagacaggcccaccuggccuggcaccacauacccccaagggcccaagcauagagauuggagcauagagauugccucacccugucugccacucacacauacgcacuccuacagggaagccugagagucagcccacccagccugaugcuaccaucacaacuacugccauagcccauaccacaugcacugcccagggauccaaggaccuacccacucaccuggucauccacugcaaccaccagcaccuaagcaagccauauggaggccuaagaaucaacccaauuaaaccugcuaacaccaugccuguguacccuggggccgaaggacaggcacacagucugcugcugccaccacuggugcccaaggacuggccuaccuagcaucccacugcccaggagaacuucaccucagccucugcuaacaauugcacccuaaaccacugaggaaaucacagacaccacuaaugcuauauauggcuaaaaaggucauaugaaaaauacacuacugcacacacccagaaucaaagacaaggugcccuacccaaccaacaccacggauagaucuucaggaaaaagucuaccucucugaaagccaaucuaaaaaacuggaagaagcaacuguuacaccagagguacagacaucaacuuguaaguauacaaguaaugugaaaaaaaaaaaacaagaaauuaugacaucuccaaaggaacacaauaauuccccagcaacagauucuaauaaaaaagaaauuuaugaaaugccagcaacaggauucaaaauaauacuaaagacacucagugagauagagaacacaaaaauacaaagaaaucagaaaaacaauucaagauaugaaugaaaaauucaccaaaaagauagauaucauaaaaaaggaaccaaacagaaauccucaaaccgaagaauucacuaaguggaauaaaaaauacauucaagugcuucagcaauggaugauaucaagcagaagaaugaauuucagauuuuugaaauaacucagaaaacaaaacaagaauaaauaagaaugaacaaagccuacaugacauaugggacaccauaaagugaucuauuugaauuuuugguguuacagaaggcaaagacaagaucaaaggagcagaaaaagaaccaauggacauucaggaguauucuauguaauuaccauuuauuuagacaguuuucuaaguuccucuugguauuaauuucuaguuugaggauucuacuguggucuaagaagacacuugauauaguuuugaguuuaauuuuuuuuuucuuuuuuaagauagggucuaucucuguugccaggcuggagugaaguggcacaaucauagcucauugcagccuuuaccucccuggcucaaaugauucucccacuucagccucccagaguuuuaaaauguuuugagacuuguuuugugcauagcaaaggaaacaauccaacagaguaaagaaauaaccuuccuuuugaaugguagacaauaguugcaaacuaugcaucugacaagaaacuaaaaaccagaauauacaaggaacucaaacaacucaacaguuaaaacaaaacauucccauuaaaaagugggcaaaagacauaaacauuuuuucaaaagacauauggauggccaacagguacaucaaaagaggcucaacaucacuaaucaucaggaaaaugaaaaucaaaaccacaagauaucaucuuaacccaguuagaauagcaauuauuaaaaagaaaacauaacagauguugaugagaaugcagagaaaagggaacuccugugguggaaauauaaauuaguacagccauuaccaaaaacaguaugaagauuucucgaaaaguaaaaauagaacuaccauaugauccagcaaucccacuguuagguauuuauccaaaagaaacaaaauaaauacaucaaagggauauuugcacccccaaguucauagccacacuguuaacauuagcaaagauauggaaucaaccuaaguguccaccaacagauaaucauuucaauugagucagaaaaaacaucugauaaaacucaauauccuuucaugcuaaaaauacucaaaaaacuaugaauagaagcaaacuaucucaagauaauaaaaaggccauauauaaaaaaccuauaccuggcuaggcaugauggcucacagcuguaaucucagcacuucaggaggccgagacagguggaucaccugaggucaggagcucgagaccagucugaacaacauggcaaaacccugucucuacuaaaaauacaagaaauuagucggguaugguggcgggcgccuguaaucccagcuacuugggaggcugaggcagaagaauugcuugaacucgggagguggcgguugcaguaagccgagaucacaccauugcacuccggccugggcaacagagcaagaaaaaaccacuaccacuaccaccaccaccaccaccaucaccaccaccaccaccaccaccaccaccaccaccacccacccccacacacacaaacaaaaaacaaacaaacaaaaacaaaaaacaaaacaacaacuuguaaccagcaucaaacucaauggugaaaagauggaaagcuuuuccucaaaggucagaauuaagacaaagaugcccauucuuaccacuuccauucaacguaauaccuaaagcccuagccagagcaaucagcaaggaaaugaaauaaaauaaaucuaacuuggaaaugaauaaguaaaauuauauguuugaagaugacaugaucuuauauguaaagacucuaaagauuccacaacaacaacaaaccuguuagaaugaaugaauucaggaaaacugcagaauacaaaaucaacacagaaaaaucagcaaaccguaacaucaaaaagaauaaaguacuuaggacuaaaccuaaccaagcaggcaaaagacuucuacagugaaaacugcaaaauaucacugaaagaaauuagacacaaauaaaugaaaagauauccucuguucauggauuagaaaauuuaauauuguuaagaugucaauacuacccaaagcaaucuacauagucaauguaaguccuuucaaaauccuaacagcauuuuuagcagaaacagaaaaauccauccuaaaauucauauggauucccaagagaccucgaauagacaaaacaaacuugaaaauaacaaaguuggacgucucacauuuccugacaucaaaacuuacuagaagacuacagcaaucaaaauacugucguacuggcacaaggauacacauauagaccaacagaauaaaacacagaguccagaaauacacucuugcauaaauagucaaauuauuuuccacaaggcuaccuagaccauucaaaggggaaaaggaaagaaagucuuuucaacaaacagugcugggaaaacuggauauccacauguaaaaaaauaaagcuggacccuuaucuuauacuauauacaaaaauugucucaaagugaucaaaacucuaaacagaagaccucacccuauaaaacucuuagaagaaaacacaagccaaaaacuucaugacuuuggauuugaaaacaauuucuuggauaugauacugaaagcacaggcaacaaaaaaaaauagguaagacagacuucaucaaaauugaaaaugcugugcaucaauggcuacuacaaagagaguaaaaauguaacccuugaaacagaagaaaauacagucacgugucacuuuaacaagaggggauaaguuccaagaaaugcaucacuaggcaauuuugucaucaugugaacaucacaguggguacuuaacacaaaccuagacguuauggccuacuacacaccuuggcuauaagguauacccuauugcuccuaggauacaagccuauauagcauauuacuauacugaauacauaagcaauugugccauaaugguaaauauuucuauaucuaaauacuucuaaacauagaaaaaguaaugcauuacacuauauaaaauuucuauugucacuaggcaagaagaauuuuucagcuccauuagaauuuuauagggccaccaucauauaaugcagucuguugacaggaacaucucaaacugccauuacauggagcauaacuguauuagaaaccacauaucugauaaaggauuauacccagaauacaugaagcguuacaacucaacaaaaaauaacccaagaaaaacaaugggcaaagaacuucaacggacacuuucaaagaaggcauacacaugacuuacaaguacauaaaagaugcucgacauuaauaaccauuaggaaaaugcaaaccaaaaccaugacauaccacauuggacccaauggaauggcaaucaucaaaacaacagaaaacaaguacuagcaaggaugugaagaaacuggaaccacuguauugcugguaagaauguaaaaugauguacacuguggaaacacaguauguggcaauuucuuaacauuaaaaaaaaaagcaaaauuucucaaaaaaaaaaaaaaccuauagaauaaccaaaugaaacagcagguccacuucuggguauguacccaaaagaaguaaagcagggaucuggauauuugucuacccauguucacagcagcauuauucacaauauccaagagguaaaagcagcccauguguccaucaacagaugaaugaauaaaacaaaaugcaguauguacauauacaauggaguaucauucagccuuaagaaggaaggaaauuuugguacaugcuacagcauggauaaaacuuaagacaugcugagugcaauaagucaaucacaaaaagacaaauagugugugguuccacuugucugagguacccacacaaaucaaauucauaaagacagaaaauacaauaguaguuuccagggacugaugggaugagaaaaccaggaauuaccauuuacaggguacgaagcuucaguuugggaaaaugaaaaugaaaguucuggauacugauggugguaaugguuacaugauaaugugaauguacuuaaugcugcagaacuuugcgaaguauauaucugcuaaauaauuuguaucaagacauauaaagaacucuuacaacugaauaauaagagaaauauuccacuuaaacaaaaauggucugggcaucauggcuaauacuuguaauuccaacacuuucggaggauagccugacgaugggaguuuaagaccagccugggcaacuuauggagacccugucucuacaaaauuuuuaaauaagugaggcaugcuguugggcaucuguagucccagcuacuagggaggcugggguggaaggaucacuugagcccaagaguucaaggcugcagugacccaagaucagaucacuguuuuuuuuuuaaauggacaaaggauuugaauagauaauuaacuacauagguauagcgaaauggcuaauaagauauauaaauggaauaagauauauaaauagcuaauaagcaaaugaaaucaugccaaacauuuuuuagucauuagaaaaacaccaaauuaaagccacaaauaagacaccacuacaaacccucuagaacggguguggagaaacagaaacuuccauacauuauuggugggguuguaaaaugcuacagucacuuuggaacaaaguuuugcacuuuaccaauaaguuaaacuugccauaugacuuaguaguugcacuccuagguaucucucuagaagaguaacauuuauccacacacagacauguauacaaauguuuacagcaguauuacucacaaucauucaaaaugagaguauuauucacaaugacucaaauaccugucaacuggugaauggagauagaaaugcggcauaugcaaauaauggaaaaauauucagcaacaaaaaggaauacuaccacauggacauagaguguggaauaacagauaccagacucagaaggaugagaaggggauaaaggauaagaaguuacuuauguguacaaugcacauucuuuagcugaugauuacacuaaaagcccagacuuuaccacugugcaauaugucccuguaaaaaaacugcacuuguaucccuuaguuuacacacauuuugaaaaaagaaauauuaugaccuggaugcaccucaaaaacauuaugcuaaauaaaaaccaaacacaaaugaccauauaccauaugauuccaaugauaugaaaauucuaggaaagcuaaaucaaauggacaaaaaguaggccaagguuuucuaaggcuggaaugggagaagagguugaugacaaaugggcauaguacuuuuuaaggcugauauaaauguucuaaaacuagacugugauuauggaugcacaacacuauaaauuuacuaaaaaucaauguacacuuagauguauuuuuaugcaccucaaagcucuuaaaaauuuaaaccauagcaaauucuacaguauuaucuacaauaauauccaaauuuucauagguaaauuuuuguaugauuuaugguugaaauaagguaaacuacuugggggacaguagauuugugacagcaacucaaaggaaagcaauuguaacuuaaagguaagaaaccucucugauuccaaccaauugaugccugcucaugaguaagaaaucugaacgaagaaacugucucauuuuguggcagguguaaauuccaaaauauuuuuaaauuguaaauuuauuuuauuuuuucugauuaaauaaauugccuaacaaacuaauacagguggaacacuuuaaugcagguccuauaucaccauuuuagaugacauacaaauacugaaguaaacaaucacauaggaaaaaaaucuuuuuucaacuccucuucaaucuuuuuuauuuacguaaggagaguaucuaaaugaggugcuaguuuauuuuuaagcaccuugcauaaaaagggcuaauugcccuuuuuaauaaaggaguaauuaugaguuuggcaggaaaccauauuuuucauaacuuuuuuuuugagaaaggguuucacccugucauccuggcuggguugccauagugcaaucauggcucacugcagccucaaccuccuaggcucaaacuacucuguaguucaucaaaauuuaaauaguauacagucauucauauagaaucacucaaacuccugguucucaguauguguuuauauugacaugaucuaugaaaaaaagaaagccauagaagaaaaagcaguauaaacaaauuuaaaaggagauuuuagucaucuucauguguuuaugaaucaagacaucccaggcucaaacaauccucccaccucagccaccagauuagcugagaccacaggcaugcaccaccauggccagcugauuuuuuuauuuuuauuuuuuauagagaugggggucucccuauacuguccagacuggucuugaacuccugggcucaagugauccucccaccuaggcccccaaaagugcugagguuacaggugugagccaccaugcccagacuuauaaaauuguuuuuauuguauuccuucauaauaucuucuauucauaaaaaugguacuagauuuccauuuaugguaaaaguauaaauucauuuauuuugaaagagacuuucaaguuuaaaaguuacaaugaauagguaguaugagaacaggccaaaagucaugaaugagaaauaaaaagaacuuaaauuugggaaacuuugcuuacuaugauguaaaauaccuaguccacaguaaacuccaaauaaauauuuaacuauaauauggauuauguuaaugauucauaaacaccugaagaugacugcccggcaguggccaggcagaacccacuauggcccugugguagugguggccacagaggcagauucuccucugccuguggacaggggaaaaagugggaagaauuuuguguuacgguuugagugccugcuuagccacaacagaacagaauaucaaacaaauugcuaagaauuuugacucuaaucccuggcuuccagacagcauuucuggacuggccugggguuuggggaaugagacacucugaagggaaggacauaaaccuggcuggcuucaccaccugcugaugguagagccuuagggccuugagugaacauaggugguagccaggugguggugacagcaggccuuggaugagacccagugcucugcuggcuucaggucuaacccagcuuaguuucaguggugguggcaacaggggugcuugcaucaacgcaugaacacaucccuaguuccaggagacucagcacagagagagacuccauuuguuuggaagaaaguaacagaaaagaacaagagucucuacgugguaauccaaauaauucuuccagauuuuauccaagaccaccaaggcaguaccucugagucugcaaaaaccucagcauuauugggcuuggggcccaagucccuucgaauaacuggaaagacuucucaaaaaggacagauacaaacaagcccagacugcaaagacuacaauaaauaccuaccucuuugaugccuacacaccaaugaacaucuacaagcaucaaaucaagaucauccaggaaaacaugaccccaccaaaugaacuaaguaaggcagggaccaauccuggaaaaacagagauagauaugugaccuuucaggcaggaauucaaaauagcuauguugaggaaagucaaagaaauugaagauaacacagagaaggaccucagaauucuaucacauuuuaaacaaagaaauuuaaauuuuuaaaaaucaagcagcaauucuaaaguugaaaaaugcaaccaacaaacugaagaaugcaucagagucucugaaaagcagaauugaucaagcagaagaaagaauuagugggcuuggagacaggcuacuugacaauauagucagaggagaccacaaaagaaaaaagaauagaaaacagugaagcaugccuaaaaaauagcaugaaaagggcaaauauaagagguauuggccuuaaagaggaaguagagaaagagaccggaguagaaaguucauucaaagggauaagagagaacuucccaaaccuagagaaagauaucugcauucaaguaugagaagguuacagaacgccaagcagauuuaaccuaaagaagaguaccucauggcggccgggcgcgguggcucaugccuguaaucccagcacuuugggaggccgaggcgggcagaucaugaggucaggagaucgagaccauccuggcuaacacagugaaaccccaucucuacuaaaaauacaaaaaauuagccgggugugguggugggcgccuguagucccagguacucaggaggcugaggcuggagaauggcgugaacccaggaggcagagcuugcagugagcugagauggcaccacugcacuccagccugggugacagagcaagaccccguccaaaaaaaaaaaaaagaagacuaccuuauggcaucuauaaacaaacucucaaaggauaguuucuuuaucaaggauaaagaaagauccuaaaaacggcaagagaaaagaaacaaauaacauacaauagagcuccaauaucucugacagcagacucuucaguaaaaaucuuacaggccaggagagaguggcacaauauguugaaagugcugacaaaaaaaacaaacaaaagcauuuaccuuagaacaguauauccagugaaaauauccuucaagcaugaaggagaaacaaagaccuucacagacaaaaaaugcugagagaguucaucaacacuggaucugcccucaagaaaugcuaaagggaguuguucaaucugaaagaaaagaguauuuaaugaccaagaagaaaccaucagaagguacaacucgcugguaauaguaagcacacagaaaaacacagaagaguauaacuccuucuacuugaguaguuuacacagcacaauuacacucuuauucuguaacuucaaauaaauaaccuaacaaugauucuuauuuuauaaguguuauuguaguguguaaacuacucuuaaguagaaagacugaugaaacgaaccaauaaagaauaacgacaacuuuucaagacauaguacaguaagacauaaggagaaacaacaaacaaaaaaguuaaaaagcagagggaugaaguuaaaguguagagggaugaaguuaaaguguagaguuuuaauuacacuuuuaauuacacuuuaaacacuuuguguguguuugacugcuuauacaaucaguguuaaguugucgugaguuuaaaauaauggguuauaagacaguacuugcaagucucacaguaaacucaaaucaaaaaacacaacagauacacaaaacauaaaaagcaagaaauuaaaucauagcaccagagaaaaccaccuucacuaaaaggaacacagcaaguaaagaaagaacgaagaccacaaaacaaccagaaaauauauaucaaaauggcagaagucccuacuuaucaauaauagcauugaauacaaauggaccaaacucuccaaucaaaagacagagagugggugaauggaugaaaaaacaagauccacugaucuguugcccacaagaaacacacuucacauacaaagguaugcauagacugaaaauaaggggaugaaaaagauauuacaugccaauggaaaccaaaagagcaggaguaauuauauaaauacugacaaaauagauuucaagacaaaaauugugagacaaagaaugucauuauauacugagaaaagagucaauccagcaauagaauauaacaaucauauguacauaugcacccaacacacccagauauacaaagcaaacauuauuagggcuaaagagagagcuagaccucaauaugauagcuggagacuucaacaccucacuuucagcacugaacccaacucccagacagaaacucaacaaagaaacaucggacuuaaucugcacuauacaacaaauggaccuaacagauauuuauagaacauuucauccaaagggugcagaacacacauucuuucccucaguacauggaucacuuaaggauugcucauaugauaggucacaaaucuuaaaauauucaaaaaaacugaaauaauaucaagcaucuucucucauaauagaguuaaacuagaaaucaauaagaacaauucuggaaaucauauaaacacuuggaaauuaaacaauauguuccugaaugaccaaugggucagugcagaaauuaagaagcaaacugaaaacuuuauugaaacaaaugauaauggaaacacaacauaucaaaaguuaugggagacagcaaaagcaguauuaacagagaaauuuauagcuauaaguauuacaccauaaaagaagaaaaauggccggguauaguggcucaugccugaauccuagcacuuugggagccgaggugggcagauugcuugagcucaggaauuugagaacagccugggaaacauggugaaauccugucucuacaaaaauuagcugggcacgguggcaugcaacuguagucccaacuauuuagggggcugaggugggaggaucacaugaacuugggagguugaggcuacagugagacgagauugcaccacugcacucuagccuggagaauaaagagagacccugucucagaaaacaagaagaaaaacuucaaauaaauaaccuaaugaugccucuuaaacaacaagaaaagcaagagcaaacaacccaaaauuaguaacagaaauaauaaagauggagcagaaauaaauuaacuugaaaugaagaaaauaaugcaaaagaccaaagaaacauaaaguugcuuuuuagaaaagauaaacaaaauugacaaaccuuaaaagagaaaaccaaaauaaauaaaaucagagauaagaaaggagauauuacaauugauaccgcaaaaauucaaacgaucaucacaaacuacuaugagcaacuauaugccaauaaacuggaaaaucuagaggaaauggauaaaucccuagcacauacaaccuaccaagauugaaucaugaagaaauucaaaaccugaacagacuaacaacagugagauugaaccuguaauaaaaagucucccaguaaagaaaagcccaagaccuagugguuucacugcucaauuccaacaaacauuuaaagaagaacaccaauacuacugaaacuguucugaaaaauacaggaggagggaguacuucuaaacucauucuaugaggccaggauuacccucauaccaaacccagacaaagacacaucaauaaagaaaacuacaggucaauauuucugaugaacacugaugugaaaacccucaacaaaauacaagcuaaugagauucaacaauauauuaaaaagaucauucaucaugaacaagugguauuuauuccagggaugcaaggaugguucaacauaugcaaaucaaucaaugugauacaucauaucaacagaaugaaggaccaaaacuauaugaucauuucaacugaugcugaaaaagcauuucauaaaaauucaacaucccuucauaaaaacccuaaaaaaacuggguauagaaggaacauaccucaacauaauaaaagccauauauaacagacccauagcuaguaucauacugaguauguaaaaaccgaaagccuuuccucuaagaucuggaacacgacaaagaugcccaccuucacuauuguuauucaacacaguacuggaaguguccaucaacagauggauggauaaagaaaacaugguacuugcacauaauggaguacuauucaguuacaaaaaaaaugagauccggucauuuacaacaacauggauggaacuagaggucauuauguuaagugcaauaagcaaggcauagagagacaaacaucgcauguucucacuuauuugugggaucuacaaaucaaaacaauugaacuaauggugauaaagaguggaaagaugauuaccagaggcugagaaagguaacuggggggauaggaagggaggugggaacggcuaauggguacaaaaaaagagaaugaguaugaccuaguauuugauagcacaacagggugacuacagucaaaauaauuuaauuguauauuuuaaaauaacuaugaguacauauggauuguuuggaacaugaagguuaaaugcuugaggggaugaauacccuauuuuucaugaacugauuguuacaaauugcacgcuaguaucaaaauaucucauggcuggguauaguggcucaugccuguaaucccagcacuuugggagcccgagguggauggaucacuugagcucaggaguucaagaccagcgugggcaacauggugaaaucccaucucuauaaaaaauuacagaaaaaaaaaaauuagccaagugcaguggggcacaccuguagucccagcuacuugggaggcugaagcaggacagcugcuugagcccaguaggcagagauugcagugagcugagauugugccacugcacuccaaccugggcaacugaagugaaacccugucucaaaaacaaacaaacaaacaaaaaaaucauaaauauauaccuacuguguucucacaaaaaucaaaacacuaaaacuuaaaaaaaaauugcugugccacacguaugacaaauaccuuaaauucauuaauauuaaaaauguuuauuaaacaucuuccuuguacaaggcacuauagauaauacaaauuaagauaguuucugugcuccagaaacuuauaaucuagcuggagaaauaaagcauaagugcaaaacuuacgauauaaagcaguaguucaaaggaaaaagcaaaauugucucugaagaugacauaaucuuauauuuagaaaaaccuaaaaaccaccaaaaaauuuagaacuaagaaaugaauuuaguaaaguugcaagauauaaaaucaauauacaagaauaaguuguguuucuacacaagaacaaugaguaucuaaaaaauaaauuaagaaaacauggcugggagugguggcucacaccuauaaucccagcacuuugggaggcugaggcaggcagaucaacugaggucaggaaucgauaccagccuggccaacauggugaaacccugucucuacuaaaaauacaaaaauuagccggguaugguggcaggcaccuguaaucccagcuacucaggaggcuggggcaggagaauugcuugaacccaggaggcagaggcugcagugaguugagaucgcuccauugcacuccagccucggugacaagagcgagacuuugucuaaaaaaaacagaaaaagaaaaagaaaacaauaccauuuaugguagcuccaaaaaacuaaauacuuagaauacauuuaaccgccacuaaacaccauaaaaugcugaugaaauaaacugaagaagguacaaauaaauggcuggauaucuuauguucauggauuggaagaauuaauauuguuaaaaugucccuacuauccaaaccaaucuauggauucaaugcaaucucuaucagaauuucaaugauauuuucacauaaacagaaaaacaauccuaaaauuuauacaaaaccacaauagcccaugaauagccaaggccaucuugagaaagaacaacaaagcuggaagugucacauuaccuguguguuaguccauuuucacacugcuauaacaaacuucccugagauuugguaauuuauaaagaaagguugaauagauucaguuccauaauggcuggugaggccucaggaaacuuacaaucauggcagaaggggaagcaggcacuuguuacaugcuggcaggcaagagagagacagagcguguagaaggaacagucaaacacuuauaaaaccaucagaucucgugagaacuuacuaucacaagaacagcaugaggaaaacucccgcuaugaucuaaugacccccuaccagguccugcccuccauacauggggauuaugaggauuacgauuagagaugaaauuuggguggggaaauagagccaaaccauaucaaccugauuucaaaguauauuacaaagcuauaguaaucaaaauaguaugguacugacauaaaaagagauacauagaccaaugcaacagaauggaguccagaaauaaaaccacgcaugcauauauagucaaucuuucacaaagugcuaagaauggagaaaacacaucuugcaacacugacuuuucaacaccauaguguuagaaaaacuggauauccacaugcuaaggaaggaaacuggacccuuaucuuacacuaucaacucaagaaggauuaaagacggagggggaaggaaggaugguuaauggguacaaaaaauagaaaaaaugaauaaggacugggugugguggcccaugcuuguaauccuagcacuuuaggaggcugagaugggcagaucacuuguguccaggagucugagaccggccugggcaacacagcaagaccacaucucuucaaaaaauuaacuaggcaugguggcaugcaucuguacucccagcuacucaggaugcuaaggugggagaauugcuugagcccaagaggucgaggcugcaguaagccaugaucaugacucuguacuccagagugacagagugagacccugucucaaaauaauaauggugaugaugaugaauaaaaucuaguauuugauaguacaacagggugacuauaguccuguaucaaaauaucccauauaccccacaaauacacagaucuacuauguacccacaaaaauuaaaauaagaagaaggaucaaagacuuaaauguaaaaccugaaaccaugcaaauccuagaagaaaacaggggaaaaacacccugacaucuguuuucacgaugguauuuuggaugacauggaaagcacaggugacaaaagcaaaaauaaacaaguaggauuacaugaaauuaaguuauuguacaguaaagaaaacaaucaacaagauaaaaaagcaaccuauggaauaggagaaaauaucugcaaaccauacaucuaaaagggggcuaauauucaagauauguaaggaacucauacaacucaguaccgagaaaaaaacaaaacagauaaccuaauuuaaaaauggacaagagaucugaacagauguuuuaccaaaaaacagccaauggccaauaggugcucaauacacuaaucaucagggagaugcaaaucaaaaccauaagauaccucacaccuguuaggauaucuauuaucaagaaguuaaaucauaacaaggucggcaaagacguggagaaaagggauccccucccuguacacuauugacgggacugcaaaaugguacagucaugauggaaaacagaaguuccucaaacuaaaaacaggacuaccacaugauccaacaauccuacuucuagguauauauccaaaggaauugaaaucaguaucucaaagagauaucugcacuuucauauucauugcagcauuauucaaaguagccaagauacagaaacaaccuaagugucugucaauagaugaauggauaaagaaaauguaacacacacacauacacacauaaaauauuauucagccuuuaaaaaacaaggaaauccugccaucugcaacaacauggacaaaacuuaaggacaguauacuaaguaagcaagacaaaaaacaacuucaugaucucauauauggaauauaaagacgucaaauucauaggaacagagaauagaacgaugauuaccaggggcugggaggugggugaaaugggaguauuucagucaaagguacaaauuuucagguauaagaugaauacguucuggggaccuaaugcauggcccaguaacuaucguuaauaaugacauuuauuuccauaauuaacauauauuguauacuugaaauuugcuaagagaguaggucuuaaguguucucaucccacauacaaaaaaagagggagcugugugagaugguggaucuguuaauuagacugauugugauuaucaacucacaggguagaucuaaguaucgcacagcacaccuuaaauauauacaauuuuuauuugucaauuauaccucaacaaagcuggcaguaguggggaagcaguaguucaucagaaaaaugaacacuuaugguuacgguagguaaagaaugacucauaaagaaaggauuucaacagcaguuaaaggauagauaauacucugacaggcagaaaugaggcaagagagcauuccaagaagggagugucugugauaucaaacuaaggaguuugaacuccauucuuucaucaacagugaacccuagaagacuucagagcagugaauuuauaaagaaggcucucuggagaaaguaauagaguuaaaagggugagaaaugggaaugcugggaaaauacaaauaaaauggucuuccugaggucaacacaguuaaucacauaccugauccaaagcuugguucuuuugacauaucauuguuuuuuuccaugauuagcacauaccaaugggaacuaaguuuuugcucaggauuacuaaacgacauauaauuuauuuuauaagccuaguaauuauuugcccauuucagcuuuuuauuagcuaccuacaacagugauaucucacaagauuuauauuaacacacuaacaucuaacacacuaacauauaacaugucucuucaucccuuuuauacacaucugucuuuuacaguugauguucaaaaauacuucugaagcuaauuuaaauguuuaaagucggugaccugaaaaacgagaaugucuauacaucuaauuuagaauggcuaaauucaaagauaccauucugauguucacauauauagacuuucauagucacaguuaguauauuaaaggaauaauucugggcccucaguacaguacaaaauguaauucaucucacacuacaccuacgucaaucauaaaucauaaccuaccuuaugcaacaguuucauccucaaagcugaaacuaguccuuuuacaauaaccuuagcagaaauguaccaacugcccccagucaaguucuaccucuaccaccccaaucuagccuacacauacugagccuuuuuuuaacaccauuuggggggcuccaaaauauaauauuggggcuccaauauaaaaaagcuaaguaacuaucuagaggcucuuuuguucauaaacaacacuauacuguauuucucaaauuugggguaggaaauaauucugaagagauaugagucuaaacaguggaauuccgaauaccuacuuagaauagaggacaguagguauaaguaguacauaaaaguucauuagaagacccauauaauguacaguuagagauuuuaauagagauucagucuuaugaauuaucacuguacacauacaauuuccacaauucuuuugaacauugaaacaaccagcuuagacuacuaaacgacugucccuuccacaaggcuaguugucucuuuuuaaaauauaucacuccuaagagagccugauuuacuaagugagcccuaacaaaauuucagguaagcaaaucuuguuuuaucaucucuacgagcaugucucccugccuucaaaugcccucaagcagcuguaagacuucaacucuguaaaauccuguagaucuucacauauuauuauaaaacuacuuguaucuacagccucucaaaaaucaaagcuuuuagcagcuccaugagaacuuuuuaaaccaauucacucuaaauuauggaaguauaacugauagcccuuuaauuuaccuaaaggcauuuucacuuuuaaaugaaguuuguuaaccuaauuaacuuacauacuuucaggaaguuuacaaauuagaaaaucaaaaugaaaacuuucauacagaguaagaaagggcauaucccaggaagagaagauuggaagcuggagucuagcauauguaucccacucaccuaggcauguaaucauacaccuuauaaucacuugguucaauauuugauuuuuuuuuuuuuuuuuuuuugagacagagucuugcucugucgccaggcuggagugcaguggugggaucuuggcucacugcaaccucugccucuuggguucaagcgauucuccugccucagccucccgaguagcuggggcuauaggcgugcaccaccacgcccagcuauuuuuuuguauuuuuaguagagacgggauuucaccauguuggccaggauggucucgaucucuugaccucgugaauaucugauuuuuuucagugacaacaaagcuggugcccagagaccaagguuaaccacucauacuacaguacuauacagccuccucuaagguauuccugcauuucauuucacuccagaccucuaaacccauggguucccuacagccuaacuuuugcacaacagaacuuaauaguaggggucccuggacuucuguggaaaaaggaaguugcaugugaggugggaauuugaaagaagaguaugaauaguuuaaauuccagaacugccuuggauuucuagaugucguauguaacuccaaaaccaaacaauagacaugcuuaagaauauucacaaugucccuaaauuaaagcauauguuuaugcuucucuuaugggggaauaaagugguuuacaggcuucuggucaauucauaggucauauuguuuacuuuuauuuaaaauuaaguuaggucugccuuuuuaaagguaagaaaaguuaaauuuuagacgaaagucuaaauuuguuacauucaaaaggaauuauguauuaaauucaaaagacaauuuaaauucaaguucuauuuuuuucugcaugugcuuuaaaguugaguuauauacaccuaaacaaauuaaaaauuauucaacuggcauauacauuguaaacgaauaucucauuuaggaaccagaugauacuuuauauauauuuacacauauguuuauauauauacacacacacauacauacauauauauucaaaauacaaucaggcacuagacaaaauagucauauuguugguauuacgauuuuauaaguuuguuuuguucugauuugcauuugaaaauuagaucagccaaaacuugauggcaaauagucugauuuacagcccaacuaugacagucaaaggagacaccagaauuacccgucacuaaaucccaucaccaguauuaccagggaagugggugaggacugucaagggcauuacagguaauggaacagcaacacacaaagauuuggggauuuuaacaaacuaaaaccaguauuucacgaacaccuaauaaggacaagaucacaaccuauccccacauggucaaauuaacuuggaaaggagaaaaacuucacucugacaucgauugguacugccuucuuuggggaggaaaaaaagcauuuuuauacucugaacucugucguucucauagacaaaguuauagcaguguuugcagagaguagggaguaucccauccaccacuuauuucuuucucauaucuacucaguaauucaauacaagaaagaaaaagauaaccaggacuuaaagcaaaaacagaauucaguuccaugcuccucccaagccuuauuauuuccagguguuauaacugggaguuccgcggacagauuugaguucuacuuccgcuccuuuaacccccuauuccgaagaguccaagagcagcagcaaagaaaaagaccaacucgaaaguggggaagggauguugggguuaaagaggggaguuaaauaaccagaccuuuagugaagaauaaagaauucaggcuguaguuuguagaaauaaguuauuacaggccuguaaagucuggcgcuggguaaagcccaagaggcuuucccuaacuccaaaacggcgaccuuuaaaguaagggaggguuggggcaccacagcggccggauuucuaauuguggaaaguuuaaacaaauuugucccucggggaaugggggaagggagagaagaacaagucugggcucggccggggagcgugcggagucugcacgccgcggccgucgguccaacgcggggaggcucagggauuuucggcagcagcgacuucauccaccccggaccgccggcuggaggacgugccugcagccggcggguaccugcggccaauucgguggaacgaggacgcggacugcgaaggcaggugggucuggcacgaaggggcaggaguccuaggcucuggguggaaguugggggugggacggcgccgggaggccggggaggcagcggcgaaaggcggcgggcggcucuacuuacucggcuguaccagaugcugaggcgggccgcggccagcacggcgaagaaagcccucugcgggucggacugaacguggaaaggcgccucggccgggcuccccagagggcacagcagccucuugggccagccgcucagaaaauacaugguccgugcggagcccccggcgcccccaguugcguccgucacacucagcggccccgggcuggucgcccaccucccacaccgccaccggccgagucggcggcggcggcggcggcagcucggggcaucugcccgcuggccuggccgggccgggccgacgcaaggcugcgcgacgaaggcacccccaagcugac

SEQ ID NO: 192980 - RNA, 195363 nt, Homo sapiens
gauugccacccaggacgaugagcggcugagauggagacgucugccucagccacugccuccgagaagcaagaagccaaaagugggauccuggaggccgcuggcuuccccgacccggguaaaaaggccucuccuuuggugguggcugcagcggcagcagcagcgguagcugcccaaggagguacuuucuguuucgcacacuuggagggcagcagggguguuuuucauuagcccguuaggauuuaauuagagugguggcccaugucgucagggaggcaugcuggguuuauggagggcgaagaggaaggcaccucugcucccaggaaucccaggcaccaugaaggucaccugugaguuugcuaagaggucuggccaccccaaguccagggggcugagcugccucagacagcgguggguggggccugaguacugggaggggagagagggaggaggggagagagggaggaggggcauggucgcugccaggcagcccuggggugcgugcagcuggcacauuugaaaugugcccagagaacuucuugccucuugcccgccaaggacuguuuuggaaaguaauugucuccugaugccuucuggcucuaauuagagggucagguucgggauuuacuaucuuaggugaauuuuuggccaacuuaauuauaacaaaagagacuacacgagccacagccucucauuuuacugccccaaagagaaagacucucugguuucuacugggccauccgugccagcaucccguugggaaaguuuggcgggaaggcgagaccuccgcugugucugcacaguccaucuggaggccacagaacuauuucugucucggaggaauggagagacuucgauuucuuuuccucccuuuuuguuccagugcauuuagucaggcccuguugcucucagggcugaggcacagcucagagagcaggcagggaagagaaugcgccuuuucuuccggcgggcgcuugggcagcgccccucacacuuugauguauacacaguuguugggggcuuguuuugguggagaccccgauucaauuaaguuggggcagggcuggcugaguuucugcauuucuguugggugccaagaugaugcuggggcugcugguucacaggccacgcuggggccggagcccaggaacauggaaagacccucggaggggcuuaggaguuggugcuucuacgaguggaccugagggccugcgggggguuguuacuguauuuacuuuuauuuuuccugcgguucuaagugggaggucauuauugggauguguggcucaugucaggaaagggagaucugaggucaaccuucaggccccuuggggagguggccuucugagcuggacgaugccucuccacccugugccccuuggacggggacucucuaggcccucccucugugaggaggggccagcuggggguggaggaagagcucuuagguggagugggaggagccaagcgcacagggagggaagagcugguggagcggcccugguccuggggccacacauggucuuuuccuuccccugggucagggccauccuuggccugugggggcaccuaaagcugccccucugcccaugcucugaggccuugugagcuccaggaagccuggccucuguguaugucuggccugccccaggguuuucagcgggaaccauccccccaucccuccgccccacacccugccucuccaagccaugaguggaucaugaaccaccauggugcaauuuccugaugugucacauuaguagaggacagacuuaggcaguaauuagacaguaauuagaauguaauugccggggagccccucuagugucaggcugaguucucauuauuggugcaauagcaacagaugcuugagggauucucaaucuguggcgggaguaggggccaggcaggaggcccaaaguuuggaguacagcaccuccacaaaggcccucaccucccaaccccaccccacugcagcacacccuuuccugcccaccccgcaggcccuuguugucugaucgcaggguggcuuggcuggugagguuccagcggaggguggacccagccuucgugagcauaguugccacagggcagguggccuguuagcuucagagcagucuugggccaugugucugcugcuggagaguugugaggaccccagagccuccucacccaucgcugcucccugcaccugucucugagcagcuuuuuuugggaaggguccuccuggagucaggggagagcagcugucccugcguggcgcaaagcagggacaucgugggccaagucuccuagugcugguaaaaugcgacggcugcauucguggaugggaugggaggugcgcuggccugggucccaguuuuccuaaucugugucgagaguggauuugacagguguuguccacagucuuuaugaucuuggaacuucgggucuuccuuaaauguuacuggaugguggcagaggugcaugagcaagaauccucauguauucagcaacccugagucccccagaaggcuccaaagagccauggaugugggccucacugccugcgggaguacagaccugucagcaggugaggagaaugugcggaaggaggugccuggaagcugcaggugguuggcgugggucccccucaggggcggggaugcucuuguguucaucucuaggucucagcaucuggugcugggccuggcaugagggguacccaagggucuucugggacuggaaugguguaggagaaaggguggcauuggugaaggaggaagucuucaugggccagaagcguuugcugcagccacugaggaguugggcacucagccaucaggcacagggcuggguguggacagugggugaggaggggccgugagggacuguaccaagccugggagagggacagugccgcagggugcaccccggguggaugcaaggguguggggagcugagaauuuuuguugaggggccccucuucucgaguuguuucuggcaaagacgaaucaucuuggucugggcgacugcucugaggccuguuugcugggggcaggagcagacugagucgacuccccuguugcugcgcaggugaccacuuagaagccuggcuccucugaggccuggcuuguuccuccaaaucccgugacauugucccccaugguucacacccugauuugcugucuggcggaaagggaugauuuauuauuauuauuauuauuuuauuuuuuauuuuuauuuauuuauuuuuuugagacagucuucacuuugucacacaggcuggagugcaguggcacgaucucagcucacugccagcuccgccucccagguucacgccauucuccugccucagccucccaguagcugggacuacaggcacccgccaccacaccuggcuaauuuuuuuguauuuuuuaguagagaugggguuucacuguguuagccaggauggucucaaucuccugaccucaugauccgcccgccucagccucccaaagugccgggauuacaggugugagccaccgcacccggccgaaagggaugacuuauacgagcuuaguguuuccugacuuauuacacaucagagaagguguggggugggugggucuuaucugaggaugucaggggcgcaguggugaggaaacagccaaauccugcaagcugucaggggcuguuuccuggcaucuguaagguauccagaugugggggcacccugcauuccccggcagcucauggccccucaugcagccucccccaccccucacugucaccaguuccgagagcuuccauuccacggcuagaauugcauggcuugaguugguugaaacaguacacauaccugcaggcagaaggauuucacuuuuuuguuuguuugcuuguuuuuugagacagagucucacucugucgcccaggcuagagugcaguggcaugaucucagcucacugcaaccucugccuccuggguucaagccauucuccugcuucagccuucugaguagcugggauuacaggugcccaccaccaugcccggcuaauuuuuguauuuuuaguagagaugggguuucaccauguuagccaggcuggucucgaauuccugaccucaagugauccgccugcccuggccucccaaagugcugggauuacaggcgugagccaccuugggauuucacuucugaguucuuuauaucugugaaaaauugaaaacagccuaccuguucauugauaggggauugguucaucuguggaacaucuugaauggaacacgauguagccacugaaaauguuaauuaagacuuuucaauuacagggugggaacaugcuuguauucuaauauuaagugggauaaaaagaaggugcaauugaucucaagcaccccuagcaaugagauagaaagugaagguucagagugaggagagaggacaugaagggggugggaggccccagccggaaagcucggaaaacccaggcaggagcuccuggaugccaggcugguguggucagagccucuccuucaguaccucccguauuguagaugagacugaggcccauuugggcauggggcuugcccaaggcuaccagcugcuucaaccacgagcugggcccggggcuuggggcuccugccucucacauggugagagucucuuucagguauuugcuuuuagauuguuauuuagauugcuguuagacuugggccuuaauuuagguccuacugcuaccccagggugaguguccagccuugguaaggucuccucaugugucuucaugccucaguucccucauccaucccaggcccugauggcaccugcucucuuccaaacagccaguuauuugaggucuggggccgugaguuauuugcaaagucaccuaccucgacuggccucuguugccugacuuccccuaggaguccaugaggucggaccuguugggggcuggguguuuccacuuagagucacuauuucccugugccagaauaugcgugagaaauauauuugcagagcagagcauggcugggcuggaccgagcuggaccaaaggaaaaagcagcccuguggucagacuggggaaagguuaguuuaaucaucuggcuggagcaguucauaagagcagacggcagaagccugggagggcgaguucuuucccagucucuuuugcuguugugcuaacacuuuggaggccauaaaucuuuuaaaacacauuuuggcccagagguuuuccccuccuuuaacuucuaaaaugguguaauuuuaaaagcaauuugauucagauguuucucauugcuuuauacugaaacuguccaaaugcuguuguauuuuccuccuccacuguggguucucuuucaaaaauauuucugaaccucucugugugccucacugagcaccagggacuacuauucagagccucugggauaauaugaaagguggagccaugaaacccagagcugggucugaucucaugaguuuugcuaguuucuggaaucaagcagccagacaggcuuuagacauccugggauguaccugcaauggccaacgcccaccucuuccacgaagcauccacugugugcugggccagguguccucccagugugggccgcaccagcaacaucagcauccccugggaauuguuagaaaugcuaauucuugagccccaccuuagaccuacugaaucugagucuguggggguagagcccagcaagcuguguuuacacaaacccucuuggugauucugauacacuccuaaguuggagaaccgcauguucugacuacaugagguagggugggucuucccauacauaaaaugggaguuagacacagagcugcagugcagagauuacaggagacuucugaugugcuuacacaggccugccagggcacuuccuggauaguagcuguaacacugccucucuuagugcaggcagugcuaaggaaguagugagaagcagcccaggcucuggaaccaggcugccugguuaagucccaguucuguugaccuuaggcagguccgugccucacuuuucucaucuauaaaaugggcaugaucuugguugugagcauuccuugaguuagcacaugggaagugcuucgaaaaguguugggcacagagggccuugugugagguccaaguugaguauuugcuuuaugaacuauugcuauucuuccuaccaguuuuccuuuucuagaucugcauacucugccugacuuagaaaguuucccuuucacugguaacccuugccugcugacccguugaggcugacagcaggugggaaacccagguuucuggugacuuccuacuugagaguggugggugcccugggcuggaaaucagaccugggugccugucccacuuugcuuugcucccagggccuguccugggugucugucccgagugggcuccuggccucucugacuuggucuuuuccccagcacgcuggagaccagaccagaccaaagguuacuaaagcuggccaagccuuagacucucgugacaaucacuauguaagugcaggguccagggcagccccugggcuggggccugggcauauguauuuuuaauacgcuucacaggucauugggcgcaguccguccaaggcaugaacaagaucccuuggaguauucaagagucucagggggggagacuacgguuugcagcugguaguacuggcggggcugugaccaggcuagcauagcuagggucaagcacuagacgacuuucagcagagcgcuccaguguuccaggaggcgugugugcuaccuacucauacugacagcccuccuaucuucuucauuggcccugcuggguucuuggaaaguuuuucugaggcacaguuuugcuuaguggcgaggcaugcaugucuauaugggaaugcugugcaaauagcagaauauuuagacgacucauuuucauuguguuggccagagcuagaaaauccccucccaccaccugccuuaccacaccuaggaaucuguccaauaccccuccauugguacguaccuccaagucccuggugucuuugcacucugucuuuuucugugccuccaggauguccuugugggcagggcauugcuuguucaccacuguccccacauccccgcuugcagcagacaucccauaggggauuauggaaucugaugcuaucaugccagagguguucccggugggcugguguggucagcugucucuggguauaagggucaguugaggcuggccguggucuuuggccccccugccaggccccauggccagcagggagcugagugggccaccuucccuggcuuauccgaguuucucugcuggggccacacacuuuugccuuggaccugaugcacccaggugugacuaagugggcaauuacucuuauuuaagugauuuucaggacggcuguugaugcugcugggcuuguuuuauggcccagccauccagaacaaccaguuccccucagacuuuguccagagagcagagcugaguuccccugacagccugguucacccaggaagcggggugcaggcugaccacccagauguuuuucagaugguucaggaguguacugcaagguuggacgccuggggcgggagcaugagguuggagacuucuuccugcucccagcagagucuagugggaagagcauggcuuggggucaggcagaucugggcucuucuuacccucugcuuaccagccgugucuucugggcaaaucaaggaacuucucugagauucgugcaguggcgaugguaguggucacuacuucuggcuaccauggaacuaagcgagacaaggucugcaggguggcuagcagagcaugugggcacggaggaaguaaauguccacauaacggaaacccgagcauuccucuggccuguccuggccucacacucacugccacucagaacggcugccguccagaaucagccuggccgccccauuuccccaagcacaacagguuuguucucugcuucuggccgcagcccggggucuggacucugggaggcucuccuggccccugccugucgcuccccuugguugcagagaccggcacacauguuucacgucaccucugugucaccuuguuuucuggcugguuccuauaagcuggugaacccuaccugccuggaaugacagugucagaggacagugccgguggcuccugccccugugugcucccuggggccuuggccaugccuggccggcacuccuucauuucucacgguucacugugaauguucagcugaugcagaguugggugaagcuucaaagucauuuccacuuacagaacuggaagaagcuuuugaaauccucuaguuugaauccauucauuuuacagauguggaaacugagguccagagacacaaaaugcagaggguugccuagugauauuacuuggacuggaaaccaauuccgcaggaacauuccaucacaugggacacagcugucccucaaccuggcccuccuccuggcccaaaccccaacuucccaagugacuguguuuauguuggaaacauuuuucugacguuugguucugucaaaacuaauuuuagcauuucuaaagcuugguaaaaauacagccucauuacuuugaugucagugcauaguuuacuauuaguauauucugggguuuaucauuuuagucauguuuaacacggcugugccaggcaugcacuauuaaaucuggcuuauuuuacauuccuguccggaauuauuuauuuguaacaauuuccucucuaucaaaagacacagcuaaugcuguguuuuaauguguuauuuacacacaaaauaaccuauuuacaacucaguaugcgccggagggagaauggaugggccccuguuuccugcauucuguuauaucagaguuuaacaaucuggauugcuaauagaaccauuuaucauuacuugggagggggggaaagagauaauuuauuuuauguuuguggccaggucucaccgccucugaucuugggaccauuuugaggauaaugaagugaagcccugcauuuggugggggcuguggggcacccgggccugggugccucuggguucccugcauucaugugcacauccuacagauggucccgaacuguggaccagagagguggugaugacagggacguugccucugccuucuaggagcuuccaguuagaggugacacucagcagauggugacgaauccugcccauagggcuucacgggggaggcagugucugagccuggggacauucgggguuccaccagguggaaagaggaaagggugggugggcccuggugggaggaggaggggcagaguggcccccugggaguguggggagggaggacugggcgccaucagcucagucuguaugucuccugcgugaguccauaugucuccugccuggcauauggggucugaaggacaaggcuccuguugcccugcggggaggcgcagagauggcuggcacccaggugggugcauagcugauccagggugcaggccgaggucccggaggcuccacugaagucucuuugaauggacauugagggguaaggagggaaagcgccauuugaagcugcuguccucuaugaagcucuguguggacaccagagggggauaggaagugggggaagaugcauuuaagaagcaggggccauggcccuguccccaaaagcuugugguucccccauggagaaaccagacaccccaguuacgaugcugaugugggcauugucugcugccugcagugauccaggaaaacauuagggaaggaguguggucucaguaggaccugguaacacugcuguguacagcccugugaccuggcugcucagucagucccacagaaagccacugugcacucagaucagggggcuggggagggggucaccaaagugugauugcaaaguguggcagggcuugggcaagccccuggggacgaugcagggagccaucagccccaggacaccagcauggucugggggauggggccugggcuuggacaggugagguuugaacccuugcccugccccuucucgguuggguauccugugcugauccgaaccccaguguccucauuuuaaacgcaggccaaaaugcguaucuuuggagggcuaggcugaccaauaaugagacuccagugcuuagagggucccuggcacacaguuggcauucuguacaugguaguucagcuguuaguauuaugguucuugcucuuauuaugauucuuaauucaagaacuguuuucugaggguagcgcauacguuccuuaaaaauauuugagagagcaaaugaaggagcugagucucuauaaugaguuagcaguucacccgugaugugcaaggaggaaccacacucuagccugagaaacagcaugggcaaagguccuggggucugagaauggcuggagaggcugagcugagcgggaagcacuggcaaaugaggcugguuuugucagccccuuggcaaagggcucccuucccuccccgauccuggcacaagcucacaucugaggccgagucuaguggccccuccuagggucuguguccucccucugcucacagccacacguggacgcugguaacucagccaggcccugugugcacggcuugcuuggaccacccccccacacaccuccccgcccccgccacccugagcaucuggcuucuucuccuucugggugggcaggguggggagggagccagaggggcucugucuugagaagccgcccuuggcucuuuccccuugaauauguccuggcuggcccugcugucagagggcguggaccucugcuuuguguuuugggggauugugaagcuugaaacccuggcaccagacagccaggccucugggcagagcagggccucauccgccgucugacuuuccaucucguuuucagcagugauauuugagaggaaguuuggguuugguauggagccgggcaguggacaccgcuuugcaccuucuauuaucccugcaauucuagaaauggaaggacguccaggagaagccccuugcagggccaagcauguggucucuguguggugugaugguggccaggguggggaagucccugcccccgccgagugcugcaaucccaccauuagguguuuacccccuugcugucaccuuaccucuggguuugugcaaaggccccuguuguccaucauccuccugugaccucuccccaguggcuccuggaucagcuggagagggccaggcuucugagcacuggaguaccugugccuggggaagcucacccaggagagaagagggucagggagggaagaaaaacuugccaacgacacacuuugcugacugggugaguugcugaggcucgaugucagcgagaucuuuguccuguugccaguccccagacugugagguuuccacgcuggagucaauggcccucuacgccauguuggugacaagaaaagcaacaggcaccuucacuuagaggacagacaagugugaguucacaucuagguguaggagcaggggccacccuugccuugucugucugugaaaugggggugacaaggcuccccucagccaacucuguagugcaggguggccuggcaugugggcagcgggcugcuguuguuauucucaugggauaguggcaacccuugccugaaagcaccugaggccguuugugucuucaguggcucgggcacuguggagcuucccagcugcccauaguucucagcagcgcccacaugccuggcccccuggguuuucuagcuccaggucaucagggagggaggacccaccaguuccacucuucaagaacuaccuccgauaauugaaaaccuaugugcacacaaaacuuuguauauggguguuuauagcaauguuaguuacgauagucccaaaauggaaaugacccaagcauccauccgcuaaugaauggaugagcagaacgugguauguauguacaauggaauauuacugagucauaaaaaggagugaagugcuaaucaaugguauacacaaaugaaccucgcaaacauaugcuaagagaaagaagccgggcauaaaagcacaaauauuguaggauuccauucccaugaauugucuagaaugacaaauccauagagacagaagggagaugaggaggugccaggggcugggagaagagggaauggggaaugauugcuaugggcuugggguuucuuuuuggagggaugaaaauguucuguaauuagauaguggugaugguugcaacagcucugugaauguacuaaaaaccacugaauuguggacuuuacaagggugcauuuuaugguaugugaauuacaucucuguuuaaaaaagaagggagggaggagaaagaaaggauagaaggaaggaaaagaggaaggaagugcgggggagggagggcgccuguggcggcaugggggccuggucgugcugcugcucacagccccugggaucuccaagugccuugugcaccgcuaccccucagggaggacccugcuuccccuggccaaugagcagccuucccaucuaaucuauaggccccagaagcucuaaaaauaacugaaguggaagggggauguuuaaugacaaaguaaauaauuacauuaagggugcgaguuuggaggggagcugaguaaaucaccgagaaagagcaccagccuccagcuaacuuccacuccuuuaucaccagauuacauccuccuuggaaccugaaucauugacuguggcugguggcaggcucugcaguggugggggcugcggucaggcaggugcugagagagaugcccugugagcauuucagggugacccugcuggccccaacuccagguggaugagccccaggggcgggggcccugugcugcuggaaauuaacuacucugcuggggggagccaggucucagggauggccucacagccuugcugcccacagcuggagggggccaggcuucugagccagaguggcuucaggggccauuugguccauugagguccaaggagggggauggucuugccagugcuacgcggugaguaucuaccagaucuugguagggagauuucugggagugguguucccaguccaggugugcugggccgucuucuguguugagagcaacaucugcagugggcaagccccagacagacuauagcccucggaaguggcagcguucaccagcuuuggcauggugugggcuggggcugucuggcacaccugcccaccuccccuguccuggccuggagcccucauuuagucccuuccauugcugucccuccucccucuaccucauggccucauccuguccucagggaggcccagccaacagccucucuccucucccuggcccugugcuaccccucaggauauagaggaugggcaggcucccaggcuuaugggaugugcuaauaggggcgcuuggaagggaugaggauacagggagacagcagugccuuggccugaagggacagaucuucucgauagaaacugaguuaggacacuugcugcaagcaacagaagcccgcucuggcucucugaagcuacguggcguucugguccuccguaacucagaaguucaggguuagauuugcuuuuaggacuagcuaagcuugaggcuccagugacgucacugggacaugucucuuucuguccgugaucucgauuggcuuuccgcuggccuggcauucugauagcucugaucaccagaggguggaguugcugaugugugccugauacccaugagcucagauggaggagugucucauuccgggugauuccaggaaaagcccugggggcaacuuauuggcuaggccugggucccaugcacccuugugaaccauccacugugaccgagccauguaguauuuuguggggucccaugcauaccugugcaaaguggggugggucagcccccuuaucugcuggagcugugcguagaaggguggcccaugugcugcuggucaagccaaauaccaguguccgccucccugaagccagauggcaggaggagugggcaggagacccggagaggccugggcaccuguagacauccacugguggaugguggggucagaguugggcccuucagaagcagcaaggaguccucuggucauucuauccccccagccucauucuuuggguuguaccaggggugcugucccccuccccuacuuguccuuuugagcuccccauaaggguacacaaagugcucccugagaagugccagaccagagccuuggagaggaaaugcuagaaaguuccagggguggcaucgcuaaggagggcuccuuaaagaaugagagagcuacugggaagguggaggugagcagaggcucaacgagggguggaugacagggcacaugccagggcagggagcagcgccugcuggagaggaggcuucauacuagggguaggaggagaggugcaguuggaaagggagguuggaaucacuguggggagccugggaugcccugagaggaauuuggauggagggguaguagggagccauugaagggcuuugagcaggggaggggcauuuagaaucagcacaucucuuugcugauugauuugaagcauuccauacccacaaaugaaauccugcuggacagcucugcuuuucagaagauucuuuuuccucccucccucccuccuucccucccucuuuccuucucuuccuuuuuuccacaaguguuuacuggggcccuacuaugcgccgggcaguguagucccuggguggcagcagcgaacacacaggcaagguccacuucucuggaacugacauucuaguugggagacacaggcaaguacccaaaucaaugacugugcggaacaggauguaagauggguauucuggcagggagagaugggggaucggcggccucagccuuccuugagacaggaacacuuuucccaggguuguugaagccacugucucucucaaaugugcugguuagggcgcaauagaaaaccacuuccucugcugugggaggagaagaaacucaucccgaagccagcugcaggcugaagagcggguucaggucaccccuguacagcaggacagggccacacacacaugucgcggcccgguccccucacugcguugggaguccgguguccccaggagccgcuggaugggcccuugugcaggcagaugcccuggguccuggccccacuugugggagcuguggcgguucccgugcauccuugucuuucacgggggaaugaugaggacuucccuccuagggccguggucagggcugaagcugagacgcaggccggauuacgauccacagggucauccucacagggguuuucgaaggacugaccgugcugccaccaugggggaccugaggcccuucuuuccaucacuggggucaugacucccagaguggccuucugggggcaugucuggccucucccuacccucacacccuggcgugucaugguggaacccauggucucugucuggggacaucaccuuuccuagucauucaggcugccggggagccccuuucuccuguugccguccuuggcaugcgggcucugaccucucuuuuccuggaacuuuuucuccugggcuguguuuuucaggucucugaaccucuggugcuggcccaggugagugcccccuccaauccugccagugugugagcucuguucucccucuuccacaugggggaugcuucacagcagugagggcgagagucuucucuucuuucuguguguccccacugaagaaggcggggacaccuggccauguuguggagccuuuccuggguagggaaagagcgcuggucuggguugggagauggacccccagcacugcgagguccccagacgauggcugugaaagggucccgaagaauuuucagcaugccacacacaggauguaaaguguuggcgcuccuggccagcgccugagcaccacuaauauggacaauguccuggcagggccgggguggugaaacaugcuucuuuugugcaucuguucccaaggaggaauuggaggcuucugaagacuuaaaaaccacaccaaaacaaaauaaccagagaaaauguuucccugugcugugguucuaagagcugcauugcuuuggggaagaagggaaggcaagaacccccuuugaaaucuuuucccggaggaggugggggauggcgugggugcccauggacaugcaguccacgugauggcugccacgugcccuugagcauccucaucccagaauggcccagcugcgcacagaggaacagccugauccccucagcugcguugagucuugggagagggagagccaagcuccaggugucgauugaaacucugaguccugcucgugcaaggacuuugcagcugcgugacugcccggggcgaugggugcuaccacacuugucugccaggccauucuccugacaauguucuuguacaugcagcugcagcuggccccagauccccaggucccccaccaccacccuggccccucacugcugacuucuccuccaucucuugccauucuugcaugcagucuuguccccaagacaaguagggaagauggugccagccuagugggcuacuuuguccugagaaggucauguucagcuuccccaccauccaagggaagucugugccccugauuugaggggaagaugcauuuucuaagguuacuucaacuuauggugucuuaguuaucauucuuagaagcaggcucuuaagagaaggauucugguauaccugguuuauuuggaguuguagggaagggaguggugaggugagacgggaggaaagcacccauaaagggaggcuaagagagucagcugcccccgagaacaacuggagcuucaucccuggggggacucugggagcuggcaugguuaucccaucccagagaaaggaagcagcucuaaacaccaauugcuggcagugccccacugaggguuccuuuugcacuccagaccuguugcacagcugggcaaagugggcuuuggagacagaaaacccucaguuaaccacggugcuggugguuggaaaggaugugugcaccaaagggguaagggcaccgggauuugagugggaaucaacaggaucugcccuacagagaugggggugguaagugcugaucgccaugauuucugggggcuuaggaagccuuuucugugucuguaugauuuugugguuaaacaugaaugcugauggcugaaaggugugugagugugguaaaauggauacuucuaggcagaucaccuggcuguugucagauaucagugccucacugggaaugaguugaucagauuucaugcugagagcaguguugggugggguggagcaggggucccauccuccggcuacagacuggcaccaguccaugcccuguugugaaccaggccgcauagcgggaggugagcagcaggcaagagcauuaccaccugagccgcaccuucugucagaucagcagcggcauuacauucucacaggagcaagaacccuauugugaacugugcauuugagggaucuagguugcgugcuccuuaugagaaucuaaugccugaugcaccugagguggaacaguuuugggauuccugcccccgcccgccccaccccccgcccccgcugcauuggucccuggaaaaauugucuuccaugaaacuggucccuggugccaaaaagcuucgggaccauugggguagagggcaggacagaggcugccucuuggaggaugaggucagaaaugggcgugaugguccuggagauccccugaguguauccucaaagacaagggccaguguccuguccuguccuguccuguugaugccagcguccacgggccugagacagggagaggucgaugguucucccagcuaagccuuuuagaauggaggagaccccagacccugagccccagggaugagccugaucuauaaccagucauugaaaauacauacagugaaauggaaguuucugccauugagcaggcucuugcugaccgcuguaaagauaaguaacggcaguuuucaggccacuuaaacccuuaccuuugggguauuaaggggucucugcagacaguaagucuuuaucgggaaguguuuacucauaaaaaaacacagugaagccggggagagaaagcaccucagccuuuauggcgccacaacccaucuguaacaggagcugcaaaucaccugugggcugcagacgauucugcccaaaaguugggggcggaagugagaguaaaagcugacuugcuaccaugcagacagcauugccugccccgccagcccccucccuccaccgauagagggacugugcugccguguguguggcucagccgucuugcuguggcucccaaguaccacgggauugagccugagcucuguggucacgugcccccuggcccaccucucuagccucugugccugcgcaccucugacggugcucccugcuuccagagugccuuccccugcuuuucuaccccugggagggcuacccaaaugcccuccccauaccaguuagaguccgaucaguggaguagaaucaccgugagagacuuggaaccaggguggugauaggaucagcuccugcccagucgugggagcagugauaucucuacaaagccacggucucugccucuggugcugggcugaagucauuguaggucaguggcauuggcgaucugaggggguguuaggugugacgugggggagaacaaggacaagcuggaacccaccaggaugguuagaguucacgccugccuuccuguacuuccagcuucaugauggauagguggaugcacaugggguuggagguggguuguaugacccucccccuuggaacuauauccacuccuggcucuaugggagaaagagcuggcuccaacccucuuugccccacagaucagugaugauguuuggggacugagggagccucugggauccuacaguagcaguuccaaaccuuuugguccacagaucccuguacacuuaaaaauuacugaggaccccaaagagcuuuuuuuuuuuuuuuugagacugagucucgcugugucgcccagacuggagugcagugcaguggugcgaucucaguucacugcaaccuccgccucccggguucaggugauucuccugccucagccuccugaguagcugggauuacaggugcgugccaucaugcccggcuaauuuuuguauuuuuguagagacgggguuuugccauguuggccaggcuggucucaaacuccugaccucaagugaucggcccaucuaggccucccaaagugcugggauuacaggcauaagccacggcgcccggccccaaagagcuuuuuuaauguggguuauaucuauugauauuuaccuuguuugaaacuuaaaaaaaugagaacuauuuaaaauauuuugucuucaaauucauuugaaaauaacaaugauacaacuauuauauuuaugaaaagagcuucuccaaaauuaaaaaaaaaaguaagaagaguaggauuacacuucugcaaauauccuuaauuucugucuuaauggaagacagcuaaauucucaugucuacuucugcauugagucuguugcacuauguuguuuugguuaaaauauaugaaggaaauccagucuaauacagaucuagagauagaaaagaggaggguauuuuaaaagccuuuucgccuaauuuggauguucuuugaugcugcaccaaaacacgacauuauggaaucugaaacagaucaaaggccuucccaugcuguugguuaaaauccaugggucugucuugcacuuugaauggauauuuuuuuacccaugcguuauuuuguauaaccgugcaucagucauucagaauuagaagcccacaucuuccaaauuagaaguccagaucuuccaaagcuacacuggaaaauacagagacaaugagcgaggaagacaaaugagguuuuaggauuauuaugaaaaugugacuuugcccaucucuugagaggaccgcugcucuaugccauccuuccuccuaaucccacauagauuucugcuguggccagcccucacccggaaccacacagggaagugcguaaugucagcuuggcgaaguggccucgguaugaagccacccccacugccuccguggggucucucccccagcucccagccccgcagucuggcugcgcuugugcccugaaggagcaggccaugcucacugcccaccugucaccccuuccaucacaugcccaucaugacaggcccccucacuucaccccauuggccccgcugaugagcucgcuguggaccaucgggggaucuccugccuccuccucuuacagucucaucaccgcuccgccucagcccuuuccuucccuggcuucuaagcuccccuuguguucuccugccugccccuuuucccucaggugaaggucccaggcuuuguccugagugcucuucucuugucacuggaaacucaucgcgggggcaccuggguagcaagacccucucagcugucucugcccagaccccuauaucugucucaucagcuccaacugcucauccacuggccugccuggugcuggaugucccaggcuguguacacagugccccuccccacccaucccacaucaccuggccccgcuccagacuccuuugcgggcguagcguccucacccacucgcucguauggagcaaaccuaagagacccggccggccugagaaccauguggcagggcugaggggauggauccgcacgggaccuucugaggacagcuuccugaggccuccauguccugccauuacacaugaggcccagaaggguccccugguuugcccagggccucacaugggauuugaugggauccuguuucuaaaccccgugcuccacucuugccugugcuuuuccagggcccuugguucaagggcccuguggcccugugccugcaucugguugagguucacagcugccugaacacuggggccuugcagagagguggugggaggagcuggagagcuccaaggagccccgcuuucauccccgagggguggcagugccucuuccaagccugcagggcagggguguggagggugaagucuaacaccaggacagccaguggguacauuuagggcucuuguuugccauccaagaagaagccuccaagaagaaaguagcaucugcuucucuaaucagccccugggaaggaguguggacgugccaguggccugagacagagauaaauggugugcaccgacccuuugaacuggcugggccuagucugggugcauuuagugcagacaaagccaagagccaggaaggacugaaccacacaaggccgagcugggccaggcacuggcauuggcuaaguccuuaccgaguaggugcugggcacuacuggaaggaagcaagagugcgucucucccugccccuccuccccaaaccccacucccaacacgaaucacuccugagucuugauaauauuccgagugagucugggccccaggcgugucucuccagggacucuccagucccccagugucuccgcccaggcccugugcccugccaaaucccaaggcuccuucaaggccaaauucaguagucaauucuguuucauucaaaaggcauuuagauguuuacgaaaggccuacugguuagcauguuaccagggccacccggcuaguaagugguuugagccaggauuugaacuugaauccuucugagccucccccaccuuaugcugauaaccugcuuaucugaagcagccgcagccccccgcccucuuuuacugauacccacuucuagguuacgugcugggaaacauaucauuuuguuagaauaguuucuaagccaagaauccagacgcacugaauaagggccuagggggcuuuuaucauacacucuuagugcaaagccucugagauguagguuuaggggcucaggggcuucuuggcucuuguuggguuccuggcugcagcugguagaguugccuuuuaggagugagugaccuccagaugggugagguuuguguugcacuuuaaaaguacugauaguagauauucagagugacagagugccacuaauagagauuuuuuuuuuuuuuuuuuuugagauggagucacucuguuguccaagcuggagugcaauggugugaucuuggcucacugcaaccuccgccucccagguucaggcaauuuuccugccucagccucccaaguagcugagauuacaggcgucugccaccaugccuggcuauuuuuaauauuuuuaguagagacgggguuuugccauguugaccaggcuggucucgaacuccugaccucaggugaucugcccgccucagccuccuaaagugcugggauugcaggcgugagucacugcaccccaccgguuuuuguauuuucuauccacccucguuuuuaaucuuccuuugccauuccuccuuuagcagcugaaagccaauggcaggcacagagaauucuauaaccugagccuuguucucaagaaccagaaaucugaaggacuuugccacaggcaguuuauucaucugcuugcaggcauuuaccaguuacugugccaguccguuaugcuggggcaaauaccccacuggccaagcccccagggagcucaccagcuaagaagaaggacugaucagugcaaggacagcaucuuagugugguaacgacuccaagagaagucauuuccagauacuucauccugcugcugggggaagagaggcagggaagacuucuuggaggaggccagacccagccugagcugggucuugagggaugaauacggguucacuaggcagaaaaguggggcccagagaacagaauacgagcacaggcagcaggauggccagccgccaaggccaugggaaccuggggaagguuggcugcuuugcuggaggaaaccuccagcagcaucuacugaggcauccacccuuagaaagacugaggcugaugaaggcaagugaaggaaagguccaggcuggucccuuuugcccucugucugguuuucucugagcuaagauaguucucucuggcucccuuaaaaucaggacaguggagcgaagguggguuugggggccaauuucuccuccucucagccaucccaggcuuugcuuucuugccgagucuaaacucucagcugucgcccucguauuugcucaggggccccuguuagggggacugugcacuuucauccagcuggacgccggaguucccuggaagccgagaggguuaaaucaccaagccagcuggugagcauuaguuccccccucuccaggcaguaacgucagaggcugaugcuggcggcaaagaagcugguggcaggaggaggcggagagcugccuugaggcacuccgggggugggcuccuggccugggacccugccccagcaacccccagguaggcuggcuguggaugugugggcuccggacacccugcggggacggcugcuguccacgccaguguguggacgugugugcacacccugugugucuguguuucuucucuuugugagaguuagccuucugcuguggcaaaaacuucaguggagaaggaaagagugagcgcuggagaggguagcuuuuuuucuagugggaaggggacugacuucuuuaaacaaacacucaaguguuccaguggccacggagcaggcagaugugggccacacugcaucuuccaggguuucucuaugccacuuggggugcagucuugaguggccagaggagcaguuugcugagguggcuuaagaacauguuuucucaucugucugugaccaggaggcguuucgaagggcuugccaugugccgacucaguaacuaguguguggccucccggugguuucagaugccuugccaaggccgacccacccaccuccucgaggaaaugcaaaaaguguuuucagggcccagaacacuaagccugggaugaucugcuccucccugacuggcagccugucuugcgugggcggcugagcucgcagccaccaggaccugauggggacaguguuuccuggggccucuguacgggggagguucucucgaguugcaaaggugcagaugcgccaggaggguucuuggccccuaggcuucauggauagaguuuacuaggacaagcaaaggccuggugugcgaucuguuuuccuauuugacuggauguugggagaaaaauguccaaauuagggaugggcccauggcucagcugagcagaacacugggugaacuucuacugugaaagaaauagcagauccggcggacauuuaugggcgacagagaaggguagcucagcauugaggagggaguuuggucucauucuggccgagacugucaaauccucggaugggcuuguaaaccagcuccuggccuagccucaucaaacgugaggaugaggaagagagagccuggugggcccuggggaggggaccugcacucucagugggacaccuggugaccaguaagccugguccacugcccuuccucacccucucgucuuucuaauaaacagaggggaggugccugugcauagacuuggggacuauuacauugacucagaaagacccucuuuucccuuuugccccaaccagugcuuuacgagguugccuaagccugugcugcgacccccagaggcaggugcaaccccauuuuacagauggggaugcugaggcucuucaccagggccgcccagcuggauggcaguggggugggucacaccgagccuccuuuccccugggcugggcugccacccgaggcccccacuauguguuccuguuugccuuugacuccacgggggccgggagaaaguggcacuggggaugccaccaggcugcuugucaacuggccuuugcuguguuccacaccucugacauggaggugaggcugugguggcuaagaccgggcggugggccgaguucauguuccugcuaugccagugauagcuggacgagaccuagagcaaggcugugaacucuuguggccuuggaguucuugucugugcagcauccuuucgggugcaaggauuguuacaaggguugagugagcuguuaucagcgaagcacugaacagugucuggaaggugauaaacucaacaaagugucucuggaguuagagcagccuucuuguggucccuggacccagcagugugcuaugggcauagugcccugcacagcggguccagcucaagggacagggacaaaaugaccuuuucagaagcguguuaggaaacagcccgaugggcccuaaggcuccagaaccuuuguguucccugaauccugacccucacaggguccuugcaugaacuugacacaauuaauaccaagagagauggugcuguccccauuccaccccuuugcauguggcugaaggucacaaggauagcaaauggaaaugccuccgcaaaucaccuguuuacuauuuuucugauuauuaaagugauugaaaaugugaugacuguggaaaagcccaaugaacauaucauuauguucuucccugauuccaccucccaaggaugacccucacucacauguuaguauguuucuuuccaguucuuucuuuccaugccauacuucccuuccaauggaagguucaauuaaggacguuaaaauacaacaacaaaacacacaaaaguaacucccugggcuuuugaaauucaaagcuucagaggaaaugguacgaaugcaacccaaauggcaaauuucccaucugauuuuauuuucaguacacucugaacccaucuucugccccuuacccuagcucuuccucaggcaaccuugaguuuccuucucuaaggggaaucuugcaggaguggucuaggacugggaggcugagggggcauuggaggagacaccuggacaggugugcacagagguggaugugagagguggaugaaggacaucccaacagggaaccugcucccacccccugcaccccccgccacccggcuguguguuucccaggcgaggcuguguuugacaugcagcggccgcacaccgucuuugguaugccguuuggucccggacuuaaugaguucugcagggacgcuccacuguagcuaaagaucauuuaccugaauugcuuuuuaauuucugccgugggaagcugcccccggugugauauaauuacauuauaauuuacagcaaucccaaaucuauaaauuuagccauacaguggggggaagggacuggaguuguguguggggcugggggagaaaucccccccaucauuaaguaaacccacauuucugggugcagguuccagucccugggcagguguggaggaggcagagagggacaucacucgcccaguacacgcugaagugugcuuuaacaccacagagcauucgggcuggagcugcuagugggagaggaugagagagugaugugacauucuuucugaucugcccucuuauagcauuuuugcugugggauguggggagcacacagaaguggguagccuggggacaucuauggaaugccuagcauuggaaggcagggaucggaauccuucccugauucucuuaugggaagaucucccggcugugggcuguggagaggagagcugggccucaggguggagucccggggaugucucugggcagauggagccacucccugggagcuuguggcaugugcggaagugaagccgugugggauuccgauaggccuaggcgaaggcgcaguaccaugcaggccaagggagggguuuccuuucugcacccacaaaaggguucacauuccugguggcccugccauuccacgucacuguguaauuugccguauuccuguaaaaccaugcauggaccaaaauuauucauauuuuaugggcauaaaggcaguucauuaauuaauggaauucuauggugaauuaacuuuauuuaacaaagaaagaaccagguuuuucugauucgucugcucuggagaucuaaacguucauaucuuggggggauuccguugggaugacuuuguagcagugggaggcaguauagcagcuaaagcaccaguggaacccagguucggagaagcuaagucacuuaccccacaucacguagcugguggaggagaaaaagacccugugaaggcuguuggauggggaagguaaguagggggauagagagggaggaagagggaggcagcaacaaauuuacucgcuguguugaccuugacuguuacgaguuugccccuuggccagggggacuguguggaguggugcucuggcagcagccuucccccuuacaggggugugggcccccacccugauacaggugauugucccucgccaccccgggaagcugcugauccucaggcccacccucugagcuuuggcucuuacguucacgagcgcuggggcucagagauggcagaauggcggcuccagagugucccuccaggugcuugucauuagccacugcccccugcuccaucucuggcuguaagccccuuugggcccccuuugggucuacaccagcaccugucaaacugacucugaggaggucagagagggcaagucauuuaccccaaaugacacagcuggucuuugaggauguaagccuguccugagggccuugcuuugagauaaggugucccacagccugauguuccaaccaagugggacaugaggaccugaacucccuugucagugacacaccugacaaaggauguccccauggcauuucuuuguuguuguuguuguuguuuugucuugagacagguuaucgcucaguugcucaggcuggagugcggugacacaaucguggcccacuguagccucgaccacccgggcucaagcaauccucccaccucacccucccaaguagcugggacuacaggugccugccaucacaccuggcuuauuuuuguauuuuuuauagagacaggguuucaacuuguugcccaggcuggucucgaacuccugaccucaagugguccccuucccaaagugcugggauuacaggugugagccauugugccuggcccccaugauauuucuuauagccauugguacugccaugauuugggaguuuugggagaauugaagcaaguacuuagaaucugaaagaaugcauuuccuguuuaaggagcccauuuaucacucagguuuuacaaauacaugauaaagcccaaggaaggccuggcccuguccaccugugcagccacucacugcccucacauuaaaacaaccucaccuggcugugagugugugcuuggcugugaggagugugcaacuggcugugaaugcgccuggcugugagugugugcuggacugugugcgccuagcugugagugcaccuggcuauaaggagugugcuccuggcugugagugugcaucuggcugugagugugaccuggcugugggugugcaccugacugugagugugugccuagcuguaaggagugugcuccuggcugugagugugcuccuggcugugggugugcaccuggcugugagugugugcuggacuguaagcaugcaccugacugugagcgugcaccggacugugagugugcaccuggcuguaagcuccuucugcccagaugccuguccuuugccugcuccuuccaggaaagcugccuugaugacagcccucccuccaugucccccuccuggugcuuccugcagacaucagaucccugugggugucuucugacaagucuuaccccugccccuagggcuaagccccaaggccaggagauguuuggauaaucuggccagggaucacaggagcgcuccuuccuguggcugcugguucgcagauggccuugcacaagccuuggcugcucagagcuuugcacuccagcuguggcccagcagugucccagggagggauaggaugcugggugagaacaccacaggcccuuacugcugggcacgaugggaggcugccuggugacggccgccuuuguuaugacagagcagagcguugggccguggccaggcucuguccagagacagcugcgaggcuuccaacccggcuggguggggugggagggagcuguggcuggcaugcaucugcaugcacccaacuuagcaaguucagcauggaggagagagggagagaggggagaagcugagacagagaggggcugagugcaugcagcugaagcagugcccucgucccagucugaaugugccagagccagguugggcgugagggucugccguccuguuuacauuuacucgugccuccuguacugcaggcuccagagcuggaguuuuuauucagcuucugauguuuauauacacaguuuucaugcacaggcccagaacccagccagcccccucccucugcugcuguucgaucugggaggcagugugcgucuccacacagaggagaccgcuggacugcacucuggaggaagugggguccccuccgugugggaccuugcuugaggugggcagaggugcuuuggagugguggagauuuuuaucucauguauggucuuucgugucuaaucuuggcaaaagaugggauucccugcauugccguuuuacagauuagggaccugaguuucagagagcauguacucugcgucacacagguuggggaaguggcuuugaacccaggcccaugggauuccaaugccuauggccucuugaccccaggccuuucgggaaugauuugagaagcaggcaguucagucccucuguaccugcgguccccagugacagcucagagcccguuucagauccgccugggcaaccugcccggcucccgcuuccucugucuccccuucaaaugcuggcacauucuccauagugacuucccagccugccacaucuccccacaccccagccacgcauaaccacuggcggcucccgggacaaguggggcucccaccauuucgcuuucacuguguggugacucccauggguccaugagggacugcuguguccccagcuccuagaacagggccuggcacugcccaugccagugguuuguugacuaaauccgugaccggaugagugcuucagggaccucuaggcuucccucagagccagcccagaaacacaaacauaugacuauguugcccagacccguggcugucuucuuucaggacagcggaguuggcacagccaaacccgagugucugcugauaugcuucuugcuaaguggugagcccggcgucucuaaguagugccucugccugugagcgggugaugaagagucaguggggauucauacccauacugugugaauaggauggcuacuauuaagaaaaacacucagaaaacagaacaggugcuggugaggauguggagaaguuggccuccuugugcacugcuggugggaaugugaaauagugcagccacuuuggaagacaguaugggaguuccuuggaaaaugaaacagaauuaccuuacaauccagcaauucuccuuuuggauuuagacucagaaaaguugaaaguaggguccugaagagauauuugcacacccauguucauagcagccuuauucacaauagccaaaaaguggaagcuacccaaggguccauugauggaugaaugaauaaacaaaauguggugcgugauacagagggcuguuaugcagccuuaaaaaggaaggacauucggacacagcacagaugaaccuugagaacguuaugcuaagugaaauaagucagucacaaaaggacauauacuguuuuauuccacuuauacgcggucccuagagucgucagaaucguagagacagaaagcagaguugugauugccaggggccggagggaggaaggagugaggaguucauguugaaugggugcagaauuucaauuugggaagaugaaaaagcucuggagauggauggucgugaugguugcggaacaacgugaauguacucaaugccucugaauuguacacuuaaaaggcauggaaaugguacauuuuauguuuuguauauuuuccugcaaguuuagaaaaugaaauuauugaagagagccugaggagcaggucuaaacacccauggacuucuaaagcuuccgugaaccuuggguccuccugguuccuccaccaucgaugaccagugugucacccccugguucagugcccucuuuaugcaugagagcagcuugcugggccaaggcccccgggccagguggcuucucugaggaaacguucguuaguucuccccgcucucucaccagagaaagcaccugugaggccagccucuugucugagccccugcccggagacuccgaggacauucgagcucucaaccccagacagacgcugaggguggaaccuguggaaaauauguugguuuuagaaauuuaaaccugauuuuuuucuccucugugaaaagaaucaaaauccagcauaagcuuauuacaggcggacugagguuauuuugggaaguagcaauuaaagguuuuauauuuuuccucucccuuuugcccuugcagcuugcacaggucugugaagcuauuaaaccuucacccaacccacagcccggaggaaucugcccugccccguuucuccuccaguucagugccuugggaaagaaaagaaaguuaaauucguauuaauuacagccaaauccgcucaguaagcacuugcugaauaugcuugaggaugagguuuaaagcucuccuccaaacaaaacgguaaaaugaaaggaauaauuuauuuggucagacacuauaauuugccacgucauuccauuucucuuguuacuaaaauggauucucugcugaggccgugacuuccaacuccaaaaaaaaaaaaaaaagaucauccacagccacuauuccucacaauuucucugaaagguccuccuugccccaccacgcugaagcuaggcccagggcucuuggaagaaacacacagcacuugcuccugcacacugacacacucugucacccaaaaugacaugcugucacucauacucacacaccacaugcucacagucacacacguacgcaugcaugcacacagggacagccacgcaccugcacccaugcacgcacucacugucacacacaccaucaccacgugcacacccagcacccacacgcacccuucauacacuuauacacacaugcacacauucgcaugcacacgccugcacucacacagucacagauacacagggacacagagccccaggggcaguaugccucagagcauguuaguacuuccauaaacgaucucuuuccacaucauuuacagagugggcgcauugugagugucuuaaguuucugaccaggguuaaugucuuucugaggcugacuuagcucaaaggcagugucaugauuaagaucucaggcccaggaguuggacagugcuagggcugagccccagcccagccacuuaacagcugugugacauucgucaaguagaaggaguucccccagccuuagcuucccaucucuagguggugauaaugaagaguugaccucauaggguacaucugaggaauaaaccaaggcugggccuaacagcuguuucccaggagguucucaucugaguuggcugauaucgucauuauuaucaccaauccguaaugcuggugucccauccguucuccaagugcugacuuggcuguagcugugggcccgggccugggagaaggggacuguguccaccaggguggcugcaggagggccuaugugggccuugagauccugcuuccuggccaggacccauuccuucauggggcaccuuccccaguucucagggcugggggcacucagagggaagugcagggcugaguucauguaaguucugcaagcaaguucuggucccuuugagucagcacugugcuaggcauucagaggggagggggcgcauguuuugcuaagggcaggugugccugcguguguguguguguauauaugugcacguguguguaaaguuuccuuagaagagguggcuuuugagcagaagcgccuugggugaaaaguguagcaggcuuggaagucagagugugcugcugagugagugggagucugguggagguggucuuucuaaccggccacaagacccugggcccgcucugccccuccgucugaguaccugccaucccagggggugagugcuggcugggcuccuggugcagccaccugcaccgugcagugccaucaccgggucgugucuugagccccuccuugcccuccuguuuguuuaaguggccuuggccuagcucccucugcccucugagggucucacugugcccuagcccugugggcauagugccuggcacauagggggcccucagucuagggcacagggugaguagaggaggagguuggcccugcuggggcagcaugcuugccaagccuguguguguguggguuuuuguucaugcuucugcugguguguacggagaagugggcccagacacacacagacauacacggaugcccaccaggccccacguccauccaugggaagggcagcacaugcugguaauguguuccccaaacagcagccucuugggcugccugagcucagggcagagcagggacggggccuguuuguuggggcuccagcagggcaggggagggcagagagugugagcccucuggagaaugugcagguggcugggggagugcccuucccagaaccucauggcuggaccugugagacucccugcccguccugguccccaccauguucccucuguuuucugggugacucucucugccuccuuucucugguucucucuguccuucucugacuuuguugcugucucucucacuguuucuuugucugucccucucuucucugucauucuguuucucucacuuggucccuguccuggaucacucugugucucugugucuucugucucuguguccugguuucacucugccuccguaucucucucugucucuuuuuuuuuuuuuugccuguuuggucucuuuguuuuccugucauucuuuuucccucauuugguccucaguuucagcucugccugucucucucucuguuucugucauucucucucucucuuucugucauccucucucuuucugugucauucuccauguuuguccuucuguucccuuuccuugucugucucugcacaccaagguugcucccagcugggagguuggcccugucccgaugccuggcccuucuucugccaaaggcaucuuggaaagacuugagguuauucuggugcauucaguccagcgcuugauaauuguacuaaccuggcaauuggcaagugcuccucccaaagaaaacccucacagugcagggugcucugcugugggcaccaggccucccuggagguuacagggcucacaguguggggacagguuguccaggggcagcuggagcauccacugggaugcugaugucaggccagagggcaccuguguuuuccugggugacaggccacaagcaggacagcucacacccaggaaaauaaaagccaggcucagaguacuugauuccuuauuaugguuggggauagucaguaaaauaguagauuccguuuugagagcaguaucagugcucuggggccugugaagggagcuuugggugugcucucugguugucacacagcccccgguggugcagguuauugucccagucuguaggaagggaggugccuccuggucugguggcugggaguguggcuuuaaauccagcucugauucuuaccaacucacccaacucuccaggccucaguuucugcauuugucuguggguuguugugaggauucagugaggucaugcucacaaaguaccugcguggaguaaggaugaaaucaauggcacuagugucagggcugucucaaagauuaucacuuagucucaggggcuggagugccagugggauuaccuacgcuggacugcgucugcugcccacccaucgcuucccauauggggcaccacaaggcggggugguucuugguuuguucuuucaaucagcaguaaacaccagguacacagcaugguacuugcuugguggagaggaaucaguguggauuggggccccaguccaugcccaccuggcacagggugcaccaucuggucccacaaggagucagagccccggccacugaggacuucaucucugugucuuaagagcucaucggucuugaauuugcccccuggcugccccuggcaagugcuggggcuuauacccaggagaccuggggucaaugacuugaaaaugaaguacccagaaccccaucacccuaccccacagacccagaauuuuagagagauggcagagagaagaaaggaggugcuaggaaggguugcagaggcugccugaggcacgggguggcaccaggcugacccgggcagcagggccuggggcugaggcccaggcugugucccuuccugaugcggccugagccugggcacuggucagucaucccuguguggcggagaacucuaaaccucgcuugcuucuccucuaggcacacucgggcccuuguaagggaacaauaugucccucucccacccccagcccagggcugagcagaccucaggcccuuugggacugcugcuucugcccagggugaggcuggcugugacucuuuuggaguguguucgggcaaugagaaaaucugugacuuucugcuuugagaagagacaaaccugggcuggaagguagcucuuucccugcaggcugugugaugggcaggucacgucacucccugagccuuaggccauggagucuucaagaggacgggugggcuguuagguggcagcagaccggggaaggucugguccuccacagggcagcagcagguggcucaggggcucugcuggucucuuuccucucugagacccuuccucagccgggugcuggccaagaauagcuggaaaggaccuuccugccugaaggaugggauguacuagguugugcucagggaccaggucagacauggaaacuuggggccuggagcccagggacauggcugcccauggccucuuaccagccuggauugcucugggacucuuccucucccagcccaccuccaggccuccuucauuuuauucuccucgccuuugccuuucucuccuguccacccuccugcauuuccuuucccuguccuagcuccuuuucuuucuuccucggcuugugccuaaggccuccagggccuacgagaugguguuugccuguugcggauucucagggccagaggcaguauagcugggggccuggcauuuggggaggguuccuaagggcuguaaccccagaaacauucccccugcagagggcagucugcucccucccugagcuaggugagggucugcaauggguccagaacaugggaucuauaccaaguucugggaaccagcucaacaggccugggccugccucucacaucucugugcccuggcugugugacccugggcaaggcacugcaccucucugagaccuguuuccccaucuagagcacccaaagaaucaggcugccuuugcagggcugucaugaguggaagccucaucccccaaccuuggaugagcagaccccucaaaugugcagcuacccacagagauuuugacuguccauggacuuugguguucagacaucacaacagccaccucccaccaccgaggucagcuccugccacgcuucuggucaucaacaggacugccaagacuccugggcugggagcauccuuuagcuccccaaaccugcuagcuggcaggaaacauggaggccauuuagggacauucagcauuugaacuuaagauuuguuuucaguagaacccacaaacccaguuuuaaaauucaguuggaaaccaauccacaagucuucaaagucaucuuagugcaguucuuaaacuugcaaaguaacaccuagugggucugucauuggcuugucuggcucagcugaagucagagcucacagcacacuggccuaacucucagucuggcuucaaaguaaccugugaugcugcugcacagcucugggggugcucagucccccgcccccaaccgccacaucaucuugcccagcauccucugcacaauguacaaaaauguuuucaaaugcagguuuuagcaugauucagguauggugaggccaguagagcaggggagaguugccauugaaaagaugauuuguuauucacacuucccagugggaggacaccccacaccauacaggacuacuuggggaagcaucagggucagucagugaggcauccaggggagagcaugggaaggaggcuucauugguuuuuguggaagggcuggcaaggcagggccagaagcuuaggguuggccgguuugaaugauucuagcagucucugggccauaggggccaucgcucuuugucugagaccuggcccugggguguuagggcagaggcauguggccucccagaguguagagccagguaggggagaugguuuggaguauggacucuggaucaguugguuugcacacaaaaaggcucacuccugggugagugcuuugcugucacucagccagccuugggaggggcugccuucccucagucaucgaagccccagaugugagaacauuagaaacacagaaaacaagaaaguagaguuaauaccaaucaucaggagcugugagauggggucuggguucuugcagaccccuuuguucacagaccuuuuccuggauuucuuuugcaccugguuucagaugccugugucccccugcagugauggcuaccgugucauccaagucaucacuaacuuucugugggggguuaugcacaaggcaugauccugguguuguucugguuucaaggcugagaggucguguguaaggaccuucuggugcacuccucauguggcauuucaggggcucugcaccccauguucucugggcuaaacccacauggguccucacucuucagcucguuuuccacuguuugugugcgacauuuggguggaguugugaccaggcagccuuaucauuuuuggagcaaacauuacuauuuugauaaauugacugguuuuugacaaacacaccaaacugaaaaaaagacaaucucucugagggaaggaaagugaucaucaaacagugaagaccaggauuugggggugguauggguggagccaauggucuuuuaguggcauugcuguacucauuugauagacaaagaagcugaagcaggaaaagaagcuuaggcagugccccacagagcugcccaggagcugagcacaaccaauaccaggcuuuggugggaguugaucagaugcagccuuagggaagauuggcucccguuguugcucaggugaggcgucaguccucccaggccccagccagucacaggcaccagacuuuuuuuuuuuuuuuuuggagacagagucucgcucugucacccaggcuggagugcaguggcaugauuucggcucagugcaacccccgucuccuggguuccggagauucucccgccucagccuccugaguagcuaggauuauaggcgcccgccaccacaccuggcuaauguuuguauuuuuagaaaagaugggguuucaccauguugaccaggcuagucuccgacuccugaccucaggugauccgcccaccucagcuucccaaagugcugagauuacaggugugagccaccgcaucggcccagacuaucuguuuugaccuuacauguaacuuugcucuggaaguaucuuaccuuggcaugucuggucuuuggagaacacacauaugcacagaaagagaugugugugugcguuuguguguguguauguguguguguguauacauauauauuuaaauauuuaauauuuuaaccacaccaaagagauguaacaaauacauguaccuccaugcagcuuaacuuuuuuuugccauuuuuagucugcagcaugucaaggugggggauguucugcccuggaugcagacauuagggagugugcauuguuuauagagaauucaaaagcaauaaucaaacuggcuaacaguuuacuauauguuauuacuauguccuggcaauuuuaaccuaugucagugaugacacagcccugacugggguagucugaucccauggcccccccaucugggcuguuaaacccugauuugaaccccuaucuauugcucuuccuugauuccaucacccucuucuaucuccugccccccaggaguagcgucagaccagagaauguuguguuugucaucccucuggcauauuuccccguuuuuacuuuauauguaaaugcccauacaggguggguuucaaaaguugauuaagauguuaucuuauuauguguguguauauguguauauuuuuuucugugcacaagauuauguuuuugagauguauucaugucguuaccugaagcucugauuugcucauugaaagcuccguagacgccacaauaaaugaauauuccacagccgauuucucuccucgccuguugagguaauuuacauuauuuacacuuuuuuauuguugcagacauuguugccauggguggcacaccucccccugugucccugugggagaacuuucuucacagcagggguuuauaaaaucaauuucaugggaaacagcauuuaaaaagaugcaauagaaaauaucacaauacauugcaaguauuaaaguuuugucagacuguuuuauuuaugugugugugccugugugugugcauggacaccuggagcacauugcaacacaacguguguuucuuucucuguaucacacugcucauuuagaagcccaagcccaguggaaggguagaugugcugggcuguuggguguacacacuuguagcuuuguuagauauugccaaauugcucuccaaaguggcugcacaguuucuucagccucacuuuucaugaaaugguugacaauauuagacuggaauuuuuuccagucuaauagugaaugaucuuaguuucauuugcauucugcucuuuugcaacguauuggacguuugggcugcuucucccugauuugccuauccaucuccuuugcugagcuuuuuacuggguugcuguguuuuccugaaaguacuuuuaagagauacuaaucuuaaaaaucuuaaucuuaggccgggcgcgguggcucacgccuguaaucccagcacuuugggaggccgaggcgggcggaucacgaggucaggagaucgagaccauccuggcuaacacggugaaacccugucucuacuaaaaauacagaaaacuagccgggugugguggcgggcgccuguagucccagcuacucgggaggcugaggcaggagaauggcgugaacccaggaggcggagcuugcagugagccaagaucacaccacugcacuccagccugggcaacagagcgagacuccaucucaaaaaaaaaaaaaaaaaaaaagucuuaaucuuguuuagacauguuauaaauaauuucucagucuucuguuggccauuaucuuuggguauggcaugguuuauugagacaacgguuguacauuuuaacacagucgaguguaugauucuuuuccucuguggcuuguguuuguauuuuaggagguucuuucuguccuugaggucauacggcuauucuccuauucuaaaauuuaaaaaauugugcauuuacauguagcuuuuaaauuuagcugagacuguuuugucuuugacauuauguagagaucaaauuuguuuuacuuuaucuaugugaauaaucgucucaguagcaauuauucuauuucuuaauuuuuaaugauuuuuuuaaaugcaaaaacugucacaugucaauuuuccuugcauauguagcucuguuuccgggcucccuacuuuguuccuuuggucuauuaguuucuucuggugccaucucacauugucuuaggucuuacagcuuucuguuaagcauggcagggaaaauccccucauguguuccucuuucaaauggucuuggcucuuuuucugcccuuguucuaccgugagaacuuuaggaucaacuuguuagaguccugaaaaucccuguugggguuuugauuauaauugaguuauuugugaaugaauuuggagaagauugccaucuuugucauuuugaguuuucccgcccaugaucacggccuuucucccuauacuuauugguuauuuuaugucuuuuuguuuuaucauuuguaucauaagggucuuacacauuuuuuguuacauuuauucauaaguauucugaaguuuucuuugcugcuguaaauguuauauauauaaaauauacacacacauauauauauguuuaaaaauuacaguuucuaguucauuauugcuggcaucuaggcauguaguuaaauuuuauauauugauuguauuucuagcaaucuugcugaucuuuuacuaguuuuaaaugugucccuacaaauuuuauagacauuuuauuuaaucuugucauuuacaaauggugauagcuuuuuccuuucuuuccaauuuuucucucuuuaguuauuuucuugccucuuacugugcugucuagauuagcacugucuaauaaaaauauaaugugaaccacauuuaauuuuaaaauuucugauagccacauugucuuaguccacuuuguguugcuauaacagaauaucagacugggaaauuuauaaagaaaagucauuuacacucaugcaccccauaacaauauuuuggacaaucaugaaccgcauauaggacaguggucccauaagauuauaaucccauguuuuuacuguaccuuuucuagguuuagacauguuuagauauacaaauccuuaccauuguguuacaguugccuacaauauucccuauaguaaccugcuguaggccagggucaauagguuccaggaagaaccuauaucauauagccugggugugugguaggcuauacauuuagugaugcaccuagugaugcauaucucagcacauaucccugucauuaaguggugcaggacuguauuucucacaguucuggaggcugggaaguccaagguugaggaaccugcaucuggcaagggccuucuugcugugucauuccaucagcagugagacugacccauaaauuuccauucuucuccuuauuuaguugaauuuucaacuaaauuaaccucauaacauguccuaaggaaugcuucccuuuccaauauucaaauauuugcauaccguauggauuaucuucaaauauuuuaauauauuuguauauguucauauuuguauaugucaacgauauguuaaggauuguugucaaauauuuguacauguuacaaaguuuggaaaaacccaaacuaccaaaccucagccuggguuuguugguuucuuaacguuuuuuaaaaaauuacuaauucaguuuauuuaaugguuagagguaauuccaguuuucuauuucuuugugucaucuuucauucaaccaaucaaucuaccucugucuucaggaauguguucauuuuucuuguuuuuaaauuuagcagcaguguuuauaacuauauccccuuuuucauucucuauguuauuuauuugucccuucccuguuucuugguuagucuucacagaguuuuauuuuuuauuuauuuuuuugagauggagucucacucuugucacucaggcuggagugcagugacacgaauucagcucacugcaaccuccgccucccagguucaagagauucucccgccucagccacccgaguagcugggauuacaggcgugcgcaaccacacccagcuaauuuuuguauuuuuaguagagacguaguuucaucauguuggccaggcuggucaugaacucuggaccucaaguaauccaccugccuuggccucccaaagugcugggauuacaggcgugagccacugcacccagccuuuucacagaguuuuauuaauccuugcaaaggucuaauucaggaguugguugauucucuuucucguuucuuuguuuucucucuuacagguuucuuuuauaaugaugucauuauaucguuuccuuucuuucuuaggugugcuuugacauuauuuucccaauuccuugaauugggcaccuaugugauugauuuuuagccuuccuccuuuucuacucuucuugauauaaacauauuucuaaguuaugcuucaguuacaucccgcacauucugaaacauagcaauuuuauuaaauuugaagccuuaggauccacgucuuuguacaguuuugaaaaauuuccaccaaccaucucuucaaauuaugccuuuccccgcuucuguccauucucucuuccuggaacuuucuuauucugucuuccaugugucggcaccugguuuuuauauuacccauguuucuguuaugcauuuucuaauccucucucaagcugacuuugauaaugcucuuugugguaucuggugacucuugugugugugucugcaugucugugcaugcacgcgugugcaugggcacuuuguaauuucagauaaugaguggagauuuauuugaaggaaaccugugcagcaugaguuaaggcuaucccuccaaagugcuuuucugugugacuaccagguucuucaggaguagcacagaugugagaucaauuuuguauucuuuugauagcuuagggguccuggaccacauggggacuauaaauuugaaccaucacucagcgagaaggcaagcauguggcuacaaacacucagaagauacuuuuucagcuccucugcccguuucccagcagaggcgugagaagccaagcaucuuggugugucccugugcuggugggcauugaaggguauccagccuguuacuagagaugcagcgaucccauggccuuugcacgugggggucucggaucccccuucuuguuucucccagacuccaggccuccuguccucucacugcauggucgcuaaaaagagauccacuggguuacugaggccaacacccacuccugggcugcuuagugucagcucucugucuggucuuuggggucccuuuguuaucuggcccuacguggccucuuuccuugccagcugaaaugugcaucuaaacagauguucauucuguuuauugagcuggagggccuuuaguuucccuuguugaucguauggcugaaacucgaagucgcuacgcuguuguuuuuccuaugcaaaauuaaagguagaaaaugaaguugauggagaaagaaacacacauuuugagaaagaacuguguaauuauuauccacucccugcaaaagacccaugaaguggucgguuuucagaggaggaaauccuuggcgucugccuuauuccaaaauccacuggcuaagucacucaccaccuaagcccucuuggacgaggaccaaggcuucuacgcuccauacuaaggcacaaugugagggauucuacagagggccuagugaagagagaggagagggcccauuucaucucacuuugccuggggccauccugcacgcugcucugcugugugaucucugcaggacacuugaccauuuugugaacacauccuuaucagugaacugcuauuuuuguaauggcaguuccccccagacacugaauccacaagcuuaagguaagcuuaagucaagagugaugacuucuugacuauucuaguuuuucugucuucauucauuucaacaguauuuaccgagggucuucugugugcccagcacuguccugggcacuguuuaaaacauugcuucauugccucugguaugccaggugcuggcaggacagaggagaacuggacuugccuucuagccugcucagaguauggugggggagaggccugucccuagauuccagugcagagcagaaugcgugggccaguuggggucucugguuccccaguugggaggaggaccauugcaagccagucuggagggugugugugugugugugugugugugugugugugugugugugaugcugggcucugggaaagauaaaugaaggcccuucuccuucacuccaguucacuuuuggaugaacuguuggagguauuuggcuuuugguaaguuuuuuuuaaaauuuuauuauuuuagcuacaguaauuuacaugauucaaacucaauaguuaccuauuugucaacucaaaaaaaaaaaaaaaaaaacagacuucuuugcuuaaaguugaugagauugaaaccaaaaaaaauucaggaguuacuaaagguuauauggugaaaaaucucccucucagccagcccccugguuccccucccuggagacgaccaauguucccugccucucacauauccuuugcaagagauucuagauguauacacauaaauaaaacauuauuuguuuauauuuauauaugugugcuuaccuauaaauuuacacacauacauacauauauauguuuuuuaaugcaauugucagcaucuuguuuuuuuugcaugacaauguaucuuggaaauugguccauaucagaccuggagcgcuucuucauuuguuuuuauggcuguuugguauuccauuauguggacagacuguaauuuauuuaacgagucucccucugauggauauuuagauuuccaaucuuccgcuauuuucaaacaaugccaugagaaaucaucuugccaaggugcgucccacauuugagagcauguuugugggaugcaggauguagcuuacagggagcuccuggcaugccgaugugagaaccgacccuccauagcaaggcugccccacauggcgugggcuggccuggccucugagcuuccuaagggcuaaaccuauaguuacaagaauuuuccuaagccccucagccacagauauauaauguguaguuucugaaugagugaaugaaaauacuuacacuucagagaaauuguccuuagcagaaggcauaggacauaguuuuauuuguuagacuuacagaccaucugccugugaauucaaauaauaguuuucuuguuguuuuugaaaugaauacauuccaugagagcugcuuacucagaccuucaguggcccagcuggaagucugguuggggaaucauucccuggguuguacaaguuggugcaccagauuaaagauaaagucauuuaugaugacacuaaaauaauaugagcaucacauuugguagagacuuuguuuuugacguaacccaagauaagaccuuaucugcuguguguacgggaaggugcccuucaauaaaggccucauuuuccuuuuaauauuccagaaugcagugggagugaaugaaugcuggcagccagccuuuacggagcuaccuccccaccaagaugcucccauuuaguccucccaacccuguuguuacugccacuuugcagacaccuuuggcucaggcggugaagucacuuucccaagaucccauaggcaggauccauaccaggcuuccagccccgagguagugcuguucagagcugagcccaucacuguggcuacccaggcacacuuagaacuuagacgucaggacaagaucugucuauacuuacagcuguacccagucuguguuuuggaguucacaaaaauaaccucaaaugagauuacaaggguaacugaggugccguuuaaggacauuauguccccuguuucuuccaugaaaauauuuugaaaaggaaagcaaauaccccgcuuugguuaaggucuguguaguggauugcagggcagcugggacucugcagguuccacgggcgucagaggggcucuggaucagggaggagugugguuuauuuuuguuguuguuguuuugagacagagucucccucugucucccaggcuggagugcaauggcacgaucucgacucacugcagccucugccucccggguugaagugauuauccugucucagucucccaaguagcugggauuacagguacaugccaccacgcuuggcuaauuuuuguauuuuuaguagagacaggguuucaccauguuggcuaggcuggucucgaacuccugaccucaagugauccgcccaccucagccucccaaagugcugggauuacaggcgugagacaccgugccuguccaggagugugguuuugcuggagccugcagugugguccccggcaggacccaucucucacugggccuguuucccaccuuuuacaucagggcaaggguccuaucugaugucaccaaagaacccugaguagcuccuagcagagggugcuugacauuuucccuaguucgaaauuagcagucagcacacgugucuguuaagggccagagaguaaagauuucagucuuuccaggccauacguauggucucugucacaacuacucuccucugccacuggagcucaaaagcagcauagaugguaugugcaugaucgagcagggcugugucccagugaaaugagcaguggacagauuuggccucaggcuguaguuugcuaauccuuacuuugauugccuaauggcauuagauggaaucugcauaaaauuaguacauccagcccuacuuggguacaagcuccauuucuugugucuuuauagugggugcagguggggcuuggagggucuccgucccuuccugucacuuugcuggcugggaaaucagaagaccaacugcuaacugacuagccuggagcagccuuuguugcucugaaccucacuuuccccaucuguaaaaugggaagguuggacuaugguuucucaaagauucuuuccagcuccaaaauguucugaauucuaguuagaaaggaaauuaacguuuucuucccuggagguugugguuucaguuugugucuuuggucaccaagacaaaguggauaggguaauuugguguugugaucugcaccccaaagggcacuuacuuucuggggcaccccauccuagcagagaccccucagucucaggagccaguuggguagggauaauccuuauugcuuucuuggcccacauaguguccugaaaauaaggcuucaccugugaguugcugcaugauuccaggugaugaacguuaaccucucuagccuccuguucuccaccuggaauugcccccuguguagacugggugggaggagcaggugaggaaaaaaaggagaaagaagcugggcacgguggcucauaucuauaaucccagcacuuucggaggcugagguggguggaucacuugaggucaggaguucgagaccagucuggccagcaugguaaaaccucgucucuacuaaaaauacaaaaaauaggcagccaugguggugcacgccuguaaucccagcuguucgggaggcugaggcaugagaaucacuugaacccgggagguggagguugcagugagccgagauugugccacugcacuccagccugggugacagaguaagacucugucucaaaaauauaaacuaaaaaugaaggagaaagagaugcuuuggaaaugcaaacagcgcuagggcuucauuaagacgaugacaugucuugugguuguuccaagggaagacaugcuauacagggaggaaacauccccacuuggcuucaaggaacuagaucaguccugguucagccaaggcccaggcacgcccacgugggccuggacuuucugccgugcucacaugcugcagcugccaguuggcuggggcuggcugccuccagucuccuucucagacacuccgcccaguuuuggguggccuggggacuggagaggugcucccugggagaccuggaaagcaaacggcacagcagucgggagccccggucagcuucuugugcugacuuggcucauucuaccacuaaugaacucgggacacugccuggacucuuuccugauuggaaucaugggauggggugguacccgcauggauaccucuguuucuguggcaaaucauccacuuaguaaauauucauuacuuauuagguuccagguauugugccuggaauacgugguaguauuauguagauauuguugcugagguuuuccuaauugccaggcaucagacuaaauauuacacagguuagcccauuugauccucacaacaacccuuuccaauuuacagaugggaaaacugaggcuaaguggaauuaucuaagucagucagcugguuagaggcagagccaggaucugggucuguaacuggacaucacugggggcucugccuuuccccaggucagcugggagaugucacuagggggguccgaagcacgacuagaccuacucguguguugucauuuguggagugggccugguuuagaucucccccgucagucauucugguuucuugccguggaguggccucccuuccaccuucuucaaagccacccaauuggggucauuuuccuagcuugcuggauggagcuaauuacagcaugcuccuggucccuggcccuuccaugugcaucugucuggugagagauagguggaguucugggcucucuguuucuggcugcucagcaaaaaucacucagaagagguuuugugaaagccuuugugggccucagccauaacuggcugggccugggaggugcccagguaucugcaucguuagagcaagcucucuaagggggcucuucacagcugcugggucuccgggcaguugguaauuuggugugggcugagugcacagguggugguacuguaccuguucugcagggguccugaggggcuggcaccucuccgggcuguuuuccaacagccccuggucgugccgaagcaccuguccugccuuucuguuccaggccacucagguguaccaggucaagaggcagccguguuugguuccccucaaugagucuggcucuggcaaaaccauggcucaggcauggagcugggcagucccaagcuugguccucagcccuuucccuucaaagccaguugggugaguuccuugaccucccugagauucucuuuuuucaccuauaaaacccauguuucuagcugcaucucagaguugcugugcagauggaagcguccuuguguucagaggagugacagugaccgugucuucagcccaggccuugcacagcgcgggcaccgcagcuguuuguuugcagcuccugggagcaagcauggguuuuagcugugucuuuccagcuccuaauaaagucuuggccuguggcaagagcucagcuacucugguuuagucuccagguuuggggguugugaugguuagaccgucauggcuuuccuugcuucucgggggcucugcgucugaaacaagaggugcgaggagggcaaccaaucauccggguuugccugggacuuagggaauuccuggaauaguccuaggaaaaccugaggcucuggcaaggaagaacagugcugacugcuccaucaggcucagcaggcacugugcugagggcucgucauccugggaugggcccaaaacguuuuaauuuuuuaauaaucggaagaaaauaaaugaauauaauccagcccagaagccuggauuauauucgucuuuaaaccaacacauuaguaaaauauaauuuuuaaugugucuuauggaggaggagguccacacagguaaaagcguuucgagguaugagagggaccaugcaguucugggagagaccacugcacccagggacccccugccuuccacgucucuugaagaucaggaggaagagaagacagccaaagagaacuccugcgaggcuccuccugaguuuccagcgauggaaggaagcggagcaauggcuguuucugggccugccaccgccuagaacuuggauugggggguuggugaacuuggauugggggauggauugggggauuggauuggagcaggcugaaugucagcccuggaaacugccacuggccucccagagugagcugggagauccugguguucagauguuccugccuuggcugcguggggggcaggggcgggggggcggugguuccuauuuggagccagggaguugauuuaauacagcugaggccaagacccagcguggagccuacgacugcagcuggaucccugccagcccucuuucccagccgcauguggcuccaaaucccagaaagggagaaacccgcuguggggagggggugcagcagaugucacuguccccacaugguacuucuuguuuaucuuuuauuaaaggcaggcgcuuaggcaggggcagugcucagagcagcccuugugagcgggccaugguggcggccucccucagaagcugugggaagagggagaaggcaugaauaaugcaggcugcaucuugacggagcuuguccggcccccgcagaccgcgcagcgcgcaccugagcaagcacuuugaaugccucuggcuucugaacuugagaaggaagcucccgggaugggccugacuccgccgccugguugcaauaguccuggaaggggcggcggagcaagcagaagccuccugcccuggcccguggguuugcaccagcuagaacguggggcuccuccauuaagagcuccuuggcguugggagcuacgcagccucaccccucaucuuaucacaccaggagaccggcgagcagaguggggauggccacacagggaguucgcagcaggguggugcucugccuaccgacucgccccugggguugucccugucgccucagccuuucucuuuauuuuggguggaggcaggguacucaggacagggaugaaaacuuaggucuguuuuucauuguucauccuauucuuggcaacuuuugcagaaggcgcuggcaggaaggagacccuggggagggaagaguuggaggagaaagaagucuccuuggcaccuuugccuuuccugcuaaaaaugguggcaguucugcauuucuacuaaaaauagcuaguccucugucaagaaggccacccacacugggguguggggacuggggacagcaagaugugggcccugggccacacauucuguggagaggccuagaagcucacagauagucacuuuucuuaggaagaaggaaggaguggcaggaaggggcugggaugccaucucuggagagcggagcggcacuccugccccugugugacaaggacaggucugcacacucugucauguauuacucuaaguggcuuuaauauuaaauggaugaugaaggcaaggauaaacaaacuguagcuuaccauauaauggaauaguauucaaccaucaaaaggaaggagauucugacacaugcugcaacauggaugaaccccaaggauaugcgcuaagugaaacaagccagacacuagaggacacguccucaugauucuacuuauaugaggccccuaggguagucaaauucagagagacagaaaguagaaucgcagcugucagcggcuggggaagaggggaaugaggaguuaauguuuaaugugcacagaguuucaguuugggaagauggaaaaguuuugaagauucacaacaaugugaauguauuugaugccacugaacuguacacuuaaaaaugguuaaaaugguaagucuuauguuauauauauuuuaccaucauuuuaaaaaaauuaaaugggugucguugauuccucucuuccucucaaccucccauauagaaugacuagaauccagguguuuaucuuuuaugccaauagugaugaugaugaugaugaucaugaugaugaugaugauggcggcaauuguguucuuuuguagagaaaguaagguaacucucugggguaaccagggcagacccugugaguauuggauccuagugccaagcuuggagcacucuggcauuugggggucucccuauggaauugcuaaagcuaccauuggacaagccccacucaucuaugcagaacuucuaaccaaguuuccagucccucuucuuuaaaugugaguggacacccaggguuuaagugacaucugaagaaaggcugcuaugugaaagagcaacguccacauggacgacugggaaagcaugguucccaaagcagcggaauucaggaggagaugaaaauguaaacagaaaauugaccucccacccauugguauccucagaaaggcccaagaaagcauugcauccauaaaacaagaacaggaugcuaugaaauaagaauauuuggagaacaaaaaagagcuuuagauuaaaaauaugauaguugaaauaaaaaguucauuaaagggauacaugacauuucaugaaaagaagaagaaagcaaagacuggaacaucugaaaggaaagcugagaaagaugcaauacaaaggcaggugauggaguauuugacuaauggaaguuucagaaacugaaacagaaaacagacgggagaagguuauacaagaacaauacaagaaaauugccuggaucaggacaaaaaucuucacauuaaaacaucccucagugugcccagcacuuuaaaagaaaaaaaauaauuuagacaugugauuguaaaauuucaaauaaccaagaauaaaguaacgcuucugaaaacuucuagagaaggggagaacagaacagaacagaacagaacaaaacaaaacuaaacagccuaggucaucuacaaacgaaggaggacuaaacuacuacccuuccgaucaacagcagugagugugucaagucagugaauuugcccugggaaauuagcaaugaaacuaucagacaagcucucaggcagaugggaggggacaauaaggcuaucuucagucauauaggagggacucaaagcauuuaccuucuguauaucuuuggccuuuacuuaaggauucucucuuacagcguaagggaguaagugaaugcagggaagaccugaggucccaggagggagacccccaagaagggaaugauagcaaggccggggcugugcagcugcccccucucuacagucagagcagaggcuugagggauuccaggggagggacuccagaagagggcugcagcccuggugccuuuggaggaucgggagcugcugucaucacugugcgagaggcagggguuggccuuauacaccauucuguguguggugggggagguccaagugaauugaguuguccucuguauaaauaaccaauaaaucagaaacauuaagcucauaggauuaaagaaucaaaacgugguauuuuaauaccuuccuuauauagaucagauagcugccagaggaauuaagagcaggaacauuuuuucaaaguuaaaagugguugccuccagggcacagggaggggacuauugccuuucauuauaagcccuuuggugcuauuuguucuuuaaaaaaucauacgcagaucuuuucucagccuuuuggcuaagaucaaguguaaaaaucauaugcaggauugcuuagauuuuuuuaaaaaaagaaaaagaaucaugaaaauuaaaaugaaagaacuugcaugggccccaguuuguaacaagaacucauuggggguggacucagggcagcauggaacaggccucucagugguguuccugggaccaugggcugggccaccuuaagggaggucaugauggcuaggcugggcugggacuggagugaccucucaagugaggaguuuucaguucuauguugcucuguuuggauuuacuuuuuuggaaauacacaaaaaugcagcccgugggcccccagggccaggggacuggagguggccccugcucuuguugccugcagguugugguugggcuugucugacaugcagcaugaccaggaaggcuuugucaaggcugcugugugccuggggucauuagauccugggaugacugccugugacuuaggccuggucccugcccuuggggccuggcugguacugaacuggagucugguguagcuccaggcagacugaaaggccccaccagggaggucuucacacuguccccgaacacagaggaggcagugagugccagccgggcaucaggcagugggcuugggcuaaaccagugcaguccccaccucccuggcacuccuguuccugugaggaagaauagacaaucaacaagucaacacacaggugaaacacuuugagggagaggugcuaugaagaaaauagagugggcaugagaggguaacugggagaugccccccacuggguacuggggaaggccuuucccaggaggucccauuugagaacugaaagcuuagauagcgugagccuuaggaagcagguuugcagagaauacaagcagugccaucugguaggaggggcagcauugccacgucuuggagaaauacaccagucaauugaggagugagcugagacuggaaaggcaggccagaggugggacaaggagccugacuccacacuaagggcgagaagucccaggcccagagugaguggggaaggcccuaagggaguuguaggauuagaacccagauggcauucgccuguguggagggugaaccugagcuuggagucuuucaggaguuggagagaggaggaggacagguuggagcacauggagucaucccuacccugcccaggccuauggaucgcacagagacggaugggcagagagucguuccccaugcagcggggcuccuccugagcuccauuuucgggccagcucugugcugggcuuggguggggccacugcaggccaaaggaggugcugaaacacauagcacuccugccuacccccaccaggggugccagggggacagcuggcuuuccgacaggacccccagaugauaugucguguccgugccaaugaagucgaggcaggacugagggacgaguguguuucugagggauggcauccaggaccagugccagcauuccagaggcagggccgccuguaaacacagacaggggagguagcuguuuaugugguugguuugaggaaggcuucucugcccacagauaccucuccugccuccccagcccacuuugggaucaagccuagaauuccaccauuauagguucauuccuuuggcuugcaauacaaacaucccagugaggaggugaucccugagcugucacugguacugagcaccccguaugccuugguaggucaucaggaccuuugccauucaacaggacagccagccagcacucgcugugcccaguguguggccacugugaugguucugggugugugaagagggucaggugcuguccacccacucugggggagacagacgcaggaagggauaaugaguaaugaauucugugagagaguggccaggaacagaggagcacagagaagacagcaaugugcauccuugggcaaaucgaaaaucccaaauccccuacccucucuggcccucgacaugaucgcucaggagacaguagacgacacugucucugcaaggcgagugaaggccagcaaggugcuggcccucagagggucuuuggcaaaggcuuucugcgggggcuggagggggguaggucuagguucagcugaggcugaaaggagggccaggagaccuucaaagggacagagaaggugcaggcagaccaggacgaggagguuggcacaaaggugugaggcauggggcugccaagagcaguuugauccaggacagaagcuggagauuugaguucagagaaugacaccucaggucacuagggacugggccuggggagagaggaggugucguggaagagaaauucugugacaugguuccaccauugguucuggggagaagauucuccugcagcucagaggggucucccuugagaaaggcccugggccugucuagcaggagcagcaggccugccagucugcaagggcuggcaugggauugcaaugcugagcuuucuggcuguuuggaucuguuguuuuucuaagucacuagucccuugcauauuaagagaaagaagagagugaaacccaaaagaugacauaaucauacuuuccuucauuuuccaaugaaggucucccuuuugcuuuuccaaauuguugcuaucaggagaaagacgcacaugguuucuguaugacauguguugagccucucuccucgcaggccccaggggucagguccccaccuugggacuugcuuugauucucaccuccuggcaucuguguggggugcugucugaauggcaugguuacaggugcagcuggcuagggugggucuaggggacugcauuugcacgguggugguaguggggauguggguccccuaugagauggagcagcuuggggguaacagccaagauguacaggcacuuccuguccaugguggccuguggcucccccgagcccauuuuugucuccuccuucauucuaccagcauuuaucaaacaccuauuguguaucggggcuauagugggaaauaagacagauuccugcccucaaacugcucacauucugguggaaaaaaaccagccaagaguguaggaguuacaguguagagagguaagagcacaaaagggcagcccaagggcagggccgggagucaaggagagcuuccuggaggaggugacuccugagcugagucucagaagaggagcagaaguuugggucaaaaauuucuaggcaaagaguacagcaagugugaaggcagugacccuggcaggcccugucaguucaccuccauccucuggucacacuugggucccacuuuuaagagggucugccugccaguuccagccgcgcauagccuucccuuuccugaggccgacaggaugugucauaucaccugcccagugcugcuucaaggggggcugccccagucaucugcugagugugugagcaguccccuccccugcaggcugugacaaucaggggaaaucaggaucccagaagaaccuuuggaacccugaggggcuacagcugcagaaggggucguguuucaugucacccauuauauuuggucuccacgauguguauguucugagguuuucugcuuucaaugccugggacacgccugaagaugaggagaaaccagaaggaaggcaugugcaccagaauggacuucuugagugcucgcuguuugccuagcaugggguucuuaaauuaucaggugcaucagaaucacccaagagacuuguuaaacaugagauucugggcuccauccugaguuucugacucaguaggccugcgauggggcuugaaaguuugcauuuguaaguccccagaugcugcugcugcugcuguuggcccagaacacacuuggaaagccucugguucagcccagggcugggcacucuggccuguccagggccagcauggggcaggaccccuucgugggcuggcaggagcccugcacacccuccacacagagcaggcuccccucgaggucaucgcggaaugacccugauuuccucaucuaauuugagaggagguuuauuugggcaggaauaauaaaaagcacagcaaaugagcagaggaaaacagaacccaccagacaugcaaacucacagaaauaaacaauuugccgaugaucagggaagaggcuacaggaaggaguuugugcagacagcuccuaugagaaaauggucccugggaggucccagagggcuuuccggcugcacgcugacccuggaggcagcugucagcuguggcaccaugguuguucucgugcuuggagcugucuucaaagccagugagcgagccacucaagaaacuugguuggucagguggcuucacagauguacucugcuuuuuacccaaacagucugcacagugcauuguccaucagcauguguacccagggagcacugugaauucagggcccugugucuccaguacucagcaugguuacagaaugggugaaggugcagugaagugacacccucuucccaucacuaaggauauucacaagguuuaaaaacaguucccaaagcaggauucccaaagacgcucuccagagaaaccguggagccccccaggggaauugagaugaugaaacuacugcgagcucacuuuucuuaggguuccaggcacugcuugguuuuccaugcacuggauuauuuaauccuccaacagcccugguaacagucccauaauccucacuggacagugggggaaauggagaccacagaggugaugugaugggccugaggucccacagcugguaagggguggagcagccuuccagcccuggcucucugacccugggccucugcucugagccucugugcugggccuccucuccacucaggaaggcacacauauguucuauuagguucauuaaggaaaaucaguuacccuauuuaaaacaccagcaggcaccauuugugcagcgccuacuuggaucuggggaccuggauuaucucgugccaucuugauaaaagcaaggucacugugcuuguccccaguuuacaaaggggucauuugaggcucagggagggaggugacuugagcagggcuguacaacuggaacugaucccugggcugcugacuccucagccugaguucucccugcuguccaucccgcacuuauuuuccaacaccucaggcugagaagcugccuguucugccugccuggcuucucucaugaugccagccaggagggagugagggcagggggugcccaccucuagcagcucaggcagguucuaaugugggcauuggcagcgccuucugggaucagagcugcugugccacucaccuugccacccuuuguugcaccuucuagcuccuuccuguggggcuccagguugggaaucaggccucccauuuauggcagguuugggccgacugugcccgggccaggaagcaggacggcuccuagguagagauuuggaugggguucucaccaucaugggccucguuuuaaaguggaccugcccaccgccccgaucuccacugccuguagacuuugcaguguccggaccuggcuuugaccugggaccagccacuguguaagggagcuggcucagcugccuacagaacacucucauggcaccggaaccuccagggcccccuaaucuccagggacugcagucccgagcccucugucauucuacuugccugaccacugcccucccauggcucugcagaccagcgcuuuccugggcugcucuguuggcugucccacugcauuccucaggggcgucugaagaagccucguguggcuggaauggggauaaaauccagacggaaaggccucugaugaggacuugggccuuuggugugccuggcucacuucaggccuggagggaguagcccucucuggguugaacugggcccagaggcccucugauuuauaucaaggugggagcugccugggcaggcagaaauaauaaaggugugggccggggcuuauggaagaugggguggagggaaagcugggcagaaaagcucauccuuccaugccuuuuggccaugcuagccuaaagaccaggggaaggcuuagagcuuagugaugcacccaagacgugcagggcuguggaucuuaaccucugaagccacugcccacucugugggcagcugcacaucacaaagaucuaaacugaaauggcuauggaggaaagaggagugagguggggaggaggguagugacagagagaugacaggaggaaauauccugacuagagagcuuccauccauucaaccacccaccuacccaucugcccauccacuuacccauuugcccacccaccuacccaucugcccacccaccuaccuaucugcccacucaccuaccuacccaucugcccacccacccacccaccuacccaucugcccacccacccacccaccuaccuacccaucugcucacccacccaccuaccuacccaucuucccacccagccacccaccuacccaucugcccgcccacccaccgacccacccaccuaccuacccaucugcccacccacucacccaccuauccauccauccacccacccauuaacugauccaccucacccaaacacccaccuacucaucaacccauccauccuacccaaacaccuauccauucauccacccaccaggccaccccgcuauccaaugcauuuuucaucaaucaccugcuauauuccagcauuuucauccaggucccaccucaguguagcccacaggggaucaacccccccacccccacccccaccaccaguuucugaucucuuuuugcacgcacagccugaugguggcccugggcccuuguaaacccuccuucccauuuucugauacucugcuuguuucuccucguggcccacugagauaguaagcuccuucacucagaguugcgguugcuucuaauucccucgcaccuuucuuagagcucuccuuggaggaguugcucagagcaucuuuugugggucgauggaaagguuacugggaaacuucaguuguuugagacugggaucaccuggccucuguguaggguggucgaggugagaagggagcucacguuaggugaacaccugcugagugcucagggggcgggggagaaugacagcuuggugcuggggaaagaacccauguuuggagcuggcaggggugggauugguucccggaguugaugccagcuguguggcuuucaacaagucacuuaagcuuuccgagucucaguguuuuuauuugucaagaaacaaaauauaaacaaaccugaacaauuaaaugcacauguaaguacuccuugugguacuuggcauguggcuagugggugauggucucuccccaugcccccgccauguccauagauuugaagacugaucaaggcuacuuuguugaguuaaaaugggcauagaugaagcuuggcucugggucagggccaagcuagugaacaacaaugggcagccucugauguuucuggccucucgccuccacccuuguccugucucauccucuuggccaccggccugcuaguccccugggcaggaugggggaagagacaagcugcugaguugcuggagggcaggauggcuuggauucagccugcugccuugcuguggacccuguggcucaggcccucugugcagcccaguggccggaggcugguuauccauaagcaggaaaugguggaggugagcugagcaugagaugaugucaggagauguggggcaggaggcugggcucuggggagggccugcagugcuggggggcacaggcauuuaaucaacugaauucccacuguccucucuccaacuccauuuauuaccuauuaaauaauuaucucauuuggaaaguguuucuuaauguagggcagacucuauccccagggccauggguuuugcaacgaguugucuccugugugcguguuccaggcuugggcaggaccggagcguucuugcccuggcugugccucugccugaaccaggcuuuccggaggcacgguaaagcgggugcccccuccccucgaccuggcuaauagccucauuacaaggguuuucuuaagcaguauucugucuucuaaaggggacugccuagggcugggcuucugaaguuacuugcuauuuucugggacucugccuuaggaucuccaaaacgucugaaaaugucagggaugggagaggccuuugucguuuuuacaggugaggccacucaggcccugagaucacacauugaguugauggcaaaagcagaagccuaggccucccgccugcaaaugcagagcuugcucugcuucaucuccuuuugucuuggaaugucauuggagcuuaaggguggccccuuccccucuugaaggaagggcuguuuccugaaacaagagcagggaagcuguguugagugaaugcagcucugccucacaacagcccuacagauacucccuccuuuuuuuuuuuuuuuuuuuuuuugacagagucucgcucugucaccaggcuggaguacaguggugcaaucuuggcucacugcaaccucugccucccggguucaagugauucuccugcuucagccuccggaguagcugggacuacaggagcacaccaccguacccagcuaauuuuuguauuuuuaguagagaugggguuucaccauguuggccacaauggucuccaucucucggccucaggugauccgcccgccuuggccuccuaaaguuuggggauuacaggcgugagccaucgggcccggccuuuuuuuuuuuuuucuuuugagauggaguuuugcucuugucacccaggcuggagcgcaauggcacaaucucagcucacugcaaccuccgccuccuggccucuuggccaggcuggucuggagcuccugaccucagacgaucugcccaccucagccucccaaagugcugcgaugacaggcgugagccaccaugcccggccaauacucccuuuuuuguuauuaauaaguuauacagacuuucuagaacaugugcaaacaguacugaagcacguguagaaacacaagccuugccccucugucugcuccccagaggucauggugguggucaggcaggugcacgcccuccuccuggcuguggugugaggguggauugaaggggaccaaggagagugcaucggagugcaucauuaagguccucuaggcaagaagcagagguaauggaccagggugggcuucagauuugucuuccaguuucagguguuuagaguaaggucaagcggucaguaccacagcgugcccugaggauggcuucggucaguuccaguacccccaaggagcugcaugaaggucucaccucauccuaucaccuacccugggcuucuucaucugcaggguggggcucacuguccucagguccugagauucucucaggcccccaacacaggcccuggggcugcccaugaucaggccagcugucaguguccauugcagaagcucagagggcccccugggacuuggcucccuuucgagauucugggagcagacuacagcagcggucacugacccuggaguggucacgggccacuuugaggaguuggauagcuugaaggaugaauggcugagcugcagggagagaucuggggagggcauuucaggcaacgguucuggugggucaaaagaugcaggagggaccuggguguagccuguuugccugcaagaaggcccuguguggaagaggcaggguuccuuauggauccugggccuggcccauuguuaacagggagccgucugggacucuagagcagugagggggcagcccagguacaagacacauggugaugaggaaggagcuagggucagacccuggcucggccacuugguuuccugaggcccugcguggauuaccccauuucuaauauggccaggguuaauguaccuggcccaaggauuguugugaaaauuagagauccguuauggccagcacacaggagugugcaauggugaugcaaaugauauaaaugaugaugaaugaggcagaagcuggaccacucugccuuuaaaauccugaagcccuagaugcccacccuaaucaugagagcugucauuuauuaugcaaugacugggugaugauuagagcccauuuacccucugcaagagagucucuaucacccauuuuacaggugaggaacccgaguuuccugaugucucugaggccauguagcccaugagugacggagugcgaauuccauucugugcugucuguucagugugguucauauucuaccagacuccagcccugccugugaaaccccauauguagugggugcugacgugaauaugaaauagcaggugugccccaugagagaagcucagcaggccccugcaggcuuccuggaggcaccuccuguaguauggcccuuggaugggccugcugccccugugauucagcuccagguggagccugggaggggucccaguccugggccuguggcuggagucgcccacgcuauagucauccagucuccugucaagaucuuuugcucacucaacuugcuuuuuaaaacaaaaaagcauccaagugguucagucuccaagccugggcugcucuugggcccucuugagaauuuggacaccaggguuugcugauugccacagcagggauuaacccuccacggcccguggcauucucccagcucgcugacccugggggaaccggggccugcugagcugagcccuuuguuaauacagacgaaaaaggcauuaaccugccgguccugaggcuguccaccgcagaaaugugacuucccugccugcacguuaagugcuaauaugcucacuagcuggccuguccaccccacagacucauuaccgccugaccacaguggaauugcagagccaggcagggguugugucugcaggcucuggcagcucggcagauuucaaugagaugaucgcuugucauuucuuauuaaugagcgagugccugauucauuauacaucugaggggugaaccaccccagauggggaggaggaacacggagaugugcaggcaccacagaaggggugacguggcccgugugugagucuuuucuuccucuuucuuccugcaagaaacaacuaagaaaagcuuucccgcuuuggcaggcaaggcuugggugacaggcuauguaauggugaaggggaggcagccccauggcaaagggaaauuaucgcauagagggcagaugucuaugcaggagggcuuccaaggagaccuggaaugaauguggggugagcccuggcccaaaggcauuugcuaaauguuuguggaauaaacaaaugccuacacaggaaaugccuccuaacauaaggaugcaguucgcccaccccuccgccaggcuccugcugugugccaggcauugcacgagguacuggggacacagcaggccuugccgucugggggcuccagggacuccuggguuaugucugcccugccacuaagguauccgugugacuucaggcaucccuguuuccuuaucuguaaaacaugcugagcugugcgugaccccgucucucugucuucugugggguggauuggcaagagcugugggagccggagcccuuguggguccaucgugagcacuuuguguguaggugggccggugagggugcugagcugggcagguggggggccaagccugggccuucucagaucuuugaggaaaugcacaauaucuuauucauuaucgcuucacuggugccugugcagggcaggcacuccgagguucugggugagcgagugugggguuagcaauacagccaaaguggaaggcuggccccggcucagagcggggcuccucccgccuaagaggacagccugcucagaccuccagcuaauagggcugguggcaaauuguacuuuguguucauugguagcaugagauuguagcucguaucucuuucccucccuggcuccccagucggagggagcuuccagaggcaguggagcagcuggggaucagcucugccccuugccagcugcaaaaacucaagucuuggguuuucauccauguuaacaacaucugcuucauaggccugcaaggugaccagagcgccuggaaggggcuauugcugugguugagccauuggaggacuuggcuuagacaacucacaacuuggacuuagucaagaccaaugagaggacaacaugccuacugauggauuaacaggaguuucugggagacccuggaagcaugaagcccacaaguucccuaaagaggagcaauugcaggcauuucuccggcagccgaccacugccccucaggacccuugcaugccuuggcuccggccagugcccguguugccccuggucaagggcugccugacccagucagugcuugccucuuccugaccgcggucuccaccccacaccugugauugcacaaccccagggcuguagaauccaccacgggccgucucuccugcuaugaugagagccugccuugcuucaagcacuaggacuccacgugaagaacacacaguucuuuauucuguuuuaaucagaugcuuaaugauuuucagucuacuuaauuacuaguauuguauuuuuuaaauagagguuuuaacugcaucuauguaguaucuuagccacaauguggauuaucugggcauuugugggcuaacauggaaagcuacucauauuauguuacauuauuuuuuaugggaaaaugcauuuaaguuccaaaucauugauuuauaauaugucgaccuuugagaacacagcucauuuguaagugggaauagccuguauucagaacaacauaaagggucugauauguccugggaacagcacagauaagcugagucacaggagggcgaggccgaggcagcccuuccaggaagccuuuugcuuggaggaggaguugauggggcugaggcgucaaugugaacaggagagaggguggcgucugcugugucugcugugucugcgggcauauuagggucaauggaaaggccaguuuggcagcaaaaugacuuguguguggagggcggcuggagaaguagacaaauucccaagggcagucacuggacuuagagguuaccuacugggcuuugguggagccagggaaaguucuggguguggagaguccugguggcagccugcaggaggaggcucugugagggcccguguggggacacugguaggaugccauggucuuccugcagggcuggcacacacagacgggagggcugcuuccaggaaagguaguucugggagacacuguccccugggacaagagcacacaggcuggucuugacuguaguuuuguugccuggcuguguccguuucccaccugcuguuuuuuacauggguugcucagggccaaggcagcuccagcugaucccaucuccaaccucugccccugcaaguccugcucugugcagagcccaugugucucgauggcugaagguaggggucgaauggggauuggagugggcuugccagaggcacucccacccucucuuuuuuuuuugagacggagucucgcucugucugucgcccaggcuggagugcaguggcacgaucucggcucacugcaagcuccgccucccagguucacaccauucuccugccucagccucccaaguagcugaaacuacaggugcccaccaccacacccagcuaauuuuuuuguauuuuuagccaggauggucucgaucucuugaccucguaauccacccacguuggccucccaaagugcugggauuacgggcgugagucaccgcgcccggccccauccucucuuaccugagcagggcuuuggcucucugugggucacuuguaugucauggaagggcauuucuucaaaccccuccuccucuaagccuggcugaagagaaccagcucagaaucaucacugccuauggaaggccuggcccaggcugcagacaccuugggaaggggucucucuggagauggccgugggguccagagagcagcccuuucuguggggcauucacuguugggguccaaccaguucucuuccaacucgguagugccucauucugagccugaacauugccccagggaagcugaggggaagggcuggugauggugcccugggauucugccugaggccucaucacuuccaucuauggguaguauccggggcuggggagcccgagccaggagggcugacuaaacguggcucgagugucugagcgcuugccugugucaguggagcccuucgcgguuccagagcagccacugcauggaggggagccucaucgaugagcucacugcaugcaaacaguagcugggccagguccugcugucugcauagaugcccugccccccauguaacacaguugccacccgacuacugucagaaggaucaggauucugaacuuaaggaguucuguccucgccacuaggagggacgggguccuucuggcaagggucccaucaggaaagaguuggaggcuccauuccaccagccuccagcauggucuaguucucccccgaggcugaggaaaaguuugguucccuucccuuguuuucuuucuguggccuuugcggugcccuuggaggcaguaccacccaagaagggguucugcuuuucaguuuugcugacccgggagcguugggguugagcuuuuuguguaagugaccgggacaaaccucugaucccuuugcaaccccauggcccuauagaagugucgcugaagcagcgucugguuugaccaucuucuccccaucccugccaucccaggaagccaccugacucaucucaagggcugcuguaugccguggggaggguauaugcggugcucagauagugccagccaacgccugcucaugcagccccucugcauucaaggcuuugccaugcgucccacuccggguaccccaggcaggccaggcucucucucuggaccuggcacccccccuguucaagagagggaagagcaggccauuuccagcccaacacccugugccuggggccagcacugcccagacucagaguggggaugcaguugguguuuaugggacucacucuugcuccccaugcugaaagauguccacaguuccuucaagauucgaggaaggcccaugcaggccugagcugauuucuuggcuuaagauggggucccauagccccccgccuccugcauaagaaacaugucuuacucuagaggccucagccugugcuucugcaggaauguagcagaggguguuggggauaggguagggcuggagcuuggccacagucagagggucucggguagggacguggagucugagccugugacgaggagagcuacgggacaggucagggcaagggcagcggguggccgacucuggagugccccccuccuggucagggcccuuccucccauccuguccugggauuaaugucaaaugucuugugcuuaaugguuuaaugucaaaugucuuguacuuaaugguaaucccauugcuuaagguaagaucucccuuuuggggacagaagagcuguuuuucauauucuugaugccuugagaucagaugcaaaagaagguauagaaugccauuggggugacaaagagugaugacgacaauagcaaugaccccuccccaccccauuaugucuccugccaucccccacccccauuagcagaaaaugcagcauccuugcacauggcaccuggcagacagggcggguggugaguggcugaguggaaucagcaguccgggcagcccucaccagcggguccgugagcuuuggaggugcugagguuccagucuucuguuugauuggaacuccgugucccaaaguacuuuucacgugcccacucccugcggaagggaaaagagggugggugugauuuuccacagcuugauucgaaagacugaaacucgaugagugacauuucaggcuggcuggggauguggguucagauccccccaugaccccugugugugaggagccaccuucaccugcacugcccgcagggacuccacuuccaggcucugcagcucucagugcccucagggaacugcagggagccggcucagaaggugcacaguggccugggggccagucaugucuuucacagccuugugcgccuuggacaagucucccucccuucccgggccucaauuuccccuucuuacccagugggcugccuaguccacauggccccuaagaucccacccagcuuccucuuccucuuggggccacagagucaggaguuggaggcagcaugacccccaaguuccagacccuggagggcagccgcugccccuggaaggcaugccgacgucagcuucucccgggaggcggaauucaugcgggcccuagucugagaaaggcacccgcaggguggacagcaugcugcccgccagcaguguggcuggauccccgaguccagccagccuuuccguuagccagccagccagcgagcgcuccuaaacccuggccgccgccgguuauaaaugauucaugcagccccgccucccucggcggccacuugauguucccugcgcuccagcccggcgguccaccgccucuccugccgcugggcagugccgccgcugggcagugcccuccccgcaccgccgccccucugggugcugcgucccuccgcccuccccgcacgcuggguaaguugaaggaggacggcagcuuuuccggagacgcucccuggaaaggagugcugaugaggccgcucuugugugugaaggccuggccugcagcgcccuucucccacgucccuuccccuugucugcugcgcuccaaguuugaagccagcaagcauaaguaggcgccaaggcagggaggcugugcugggccucaggcggggggagcuggagggaaggagggagggaggaugggggaggaaaggaaggaacuggguggacacagcuggaggggaggagagagagggaauguggggaggcauggaggcacugccgagaaaauggagcaagaaagugaggcggcuccugcguggacccaggcgagcgugccagggacugggggcucuggaagauucacacugucagccguaggcguucuuuccugcccccccagccucccgcaacggauguacuccgagcccuucgaacucucgggguaccagugagaacucugaacugagaguuucuucugagauccggcaaagccgagcuucugagagcucagucuucgccacuucaauuccccgcgguuugagcugcaaggaggacuccagacaagaagcuuuauugucugcgagucccagcucacgguuacuuagaaaaacauguguguguuaaaacagcuucccgggggaccaugcuguuuucgcgugaggaaugaauuuggggaaaguuaaguauaggagagaaggaaacaaaaucauaucgaacaggaauguucuggaggcuuggcaaaaucuagaagacacuuuauuucaucgucuuuuuucuuugcaacaucuaucgaaucuuucuucuuuugacuuucuaaagggcuuuacccagcccugccuucugggccccagagguccuaaaagugggaggacuuuuuccagugggaggugaugcugccccuaaggccuugcagggaaggaacaggcaggggcagcuggcccccucccuccuggggacacuugcauuuucccuuugccauucagaaacaaaguuagguaaggaggugagaccuuccugggagcugccuuuugggaaauggugauugugaccucaaaucaugucagagugugacuugcuagaagagaaauggucgagggaagagggggcgggugacuggaacccucagguaacagguagggaugcagcagcaguguccuggaaagacccuucugugcauuuuguggggagacuuuccaggccaaggcaaggagaacguguggcaucuucugagagggaaagaggagcucaaggaagaggggaaaggucauugcccuuggaccuugcaggaagcaaggugcaggggcgggcacaucguauuggaggucaugagauuugggauccucucagugcacugggaaggacaugaccaggugguuguguggggacauggcucuagcugcuuucuggagacaggacugggccaagaguucucuauucuguuccauuggucuaugugccuguuuuuguaccaaugcuuuuuuggcagggaggucacagaggagaccauuucugggccuggaauuccugagaguggccuggccccaguggggacagggaggggagagaagcaaccuggggcacacuucccuagccaguccuauguuugugagaccugggagggcuguggucagggggcugggcccugggggcaacagugccuuugcauuugaacacaaagugccacuugguauaaugggcacagcucagucuuggcuguucuugaguuuuaaacaaaucaugauccccaccuuccaaacaauuuaguuuuuuuccccuagcuagccccaucacaaacuuuugaagcaugaaaugaauuuugcuggcccucaccaauaggauccuuucccuagauaauggauuuuaugaaauggccauaauccuccuagguaaugagcaaaagcuacacucuccacuuggguccagcauuccucuuccugauuuaugauagauugguuaaaauaguaaacugauagcaguugcaaaauagucaucaaucaccaggcagugucgcuuaaacuacagaaagguuuccagaagugagaugcuggaagccagagagagaacaauuuggcaauaccaaaggcauaaagcaccaaugaaaucaaaucucuguauuuguauucugaagacagaggaguagaguggcucaggguacuaaggaaggaaggaaaugcaagcaaacccguuccccaaggucaaaggacacccccuccugagcuccaggcugcagggggcccugcagggggaccuucaguccagggaguucuucagggggacuguccagagggcucugcagggugcugcagagcucucaccaguagguuuaguguucuguuucucuuucuagacaguuuuggaaaguuuuccaauuucuaacauguauaaauauguugggcuaauauacaguaauggcuuuuaaagcaaaguuuuucaaaaguauaagaggauugaagugcaaagcuaucaaggccaugcccaggucucacccgugcucccucacccccuugccccuucguccagacaccuggccugccacacccagcccaggacagaacuuuucuuuccuccuguacgcugagcugucagaccaugaguguucaucaugggcugaggugauaguugaugcuggagaaacuaauguuuuagggaccaaaacaaggucugcagcaguguuuccauggaacugccuuagucuggaugaguaaccucauggcuguagauuacuugcaucaucaguucaggagaaaacauucuccuccauuggaugaauagaugaaugaguggugagaagcuguagagaucuuguguggugucaacgcccucauuucacaggggaggaaacugagucccgagagagggcagcgacuugguucaggucucagggaauuggugaaagagauuggaguauggccucagcggaggugugacugccagugacaccugccggaaugugaacuucacggauagcgcuggcucacaccuguguugcuuaguguaggcugcugagcugaccacuugcccuugauuauuucaagugaccgcgccaugugccaccuucagaccugcucccagaucgaucccagagccuagggugggacugugguugcugucaucauaggugugugauuuuccacaggucauauaacccucuugagccucaucuuccucuucugugauaugagagacucuuccugcagaaccuggcguguaauacaugcaaccugcaugcccaccuucaguccagcaagcagccaucaggcaccaauucuagaccgaguccugggccgccacagaaacucaaaguuagauaggagcugggugggaaggcaaggaacacucaggauuuugaacacagcugucaaccccuauuccuuaauugagaaaggcaaauccugggacuugaauaaggagauugggaagacucauggcugcacuagugcaugaaauauuaugguaaaagcaggagaauaaggcaguccuuuucuuagcccuguucuucuccaggccagagccugggcuuuaacacugacucaggcagcagccccugcagaagcuaccugcagccagguuggccugugcucccagagccccugccauggauguccauaggagccucuuuaucccaaagccauggcuuccuucucaaagauagggcuguacuucccugcuuuccuggugcccacacagcugugcaugguggacgcuccaugaguguuuacucagugaggaugcacgggagcuggcugauguugagaaacggagaugagacuucagggcuggaaaacacagcugccugaacccacgcccaggcgucacccaugcucccucguccccucgccacucuguccugacaccuggcuggccacacccagaccaggacagaacuuugcuuuccuccugugcaccggagcugucagaccgugggugcuaaucaugggcugaucugugcucuuauagguauggcuugcaaaggacgucuuuuguuccuguuagaguagcuaaccucuaaaucuauuuaauaccucuucccugguuguccaucauuaugacacaugauuuuccaaaggauuuacuauuaguuagcagcacagggcuuucucccugggguagcagcuacuugcagugaagaaaaugcauguucaauguagcaauuugucuuuuuuuauauauuuauuauaagaguaaaugaguuauuguuggagacuucaauauuauugcaaauuaggugcugcaaacagagccgggcccauuuauuauguuucucaacucccacagcaagccuaccaguucagaaaucagcugagaguuguggcccuucccagggugagcauggagggacccccggggucugggcaugacaaccacgacgucacauugugccagaggcaaaagaaacaggagccaccugugcaggcgggugaggggcccuggaagggagcacaaaguuuguugugccagguggucaguggcuggugggcugacagcuguggucagagagcuguaggagguggagugaccucacgcugugacacuugcuccaagcccauagcuguggucauggagcagaggugaggugguagauguuuccagaguggccccuaagccaugaacucacuuucaagguauuggcaguuuaggccacagagacuggacccagguucugauuuagggugugccccgugacagagagugguggcuggaauuaaccagcuuacagugggguccccuggaauggugcacuccccagugaggaguggcugcugccuaguccuguccuuucgccaccugcccagacuagggguggacacaggggcugcaggaugcauagaauguuaggguccugccuaccagagaugaaggucauacugcaaagugggcaugcuggcuguguguggucaacaccaagaagugggcaggcugaggcccuggcauacagcccugcuccauggcuggaagaguccacagggaaggccaccuagcccagugaucaggagcacaggcuucuggugacaagccagcccagauuggaguccaggugucgucaccugcugguugugugauugcggacaagaugcucaacuuugcuguaaccucagugucucuucuguaaaauggggcugauaauccauagguauuauuggcguuaaaugagcucuugugcuugaaacacucagcauaguacuagcccaugguaagggcucagauaugucacuuguucaauuacuauucaguaggcuucucugaacgugacaggcuaaacucgaaacauuaauuagucacuucauuugauggcaauaguaauaaaugugagugacagacacgaaagaggcuacccucaguguaccacccagggagagccagaguuaagauuuuggaauauaugcuugcagucuucuguguuguauauagugugugcacaauuauucacacacacauaccugccugcuuuuuacaaaaugggauuauauugugcuugcuaccucguaaccuuuccaccugagaauggauacugucauuacugaugccuuuccguucaaguuuuucugcaguugcagucucaaacuuuuuggucucaggaccccuuuauacccucaaaaauuauugguagcuucaaagagcuuuuguuuuuguaguguguauuuauugguauuuacuguucuagaaauuaaaacugagaaauuuaaaagauauuuuaaacuuauuuaaaccuaauaguaauagacccauuucauguuaaugaaaacaaccaauuuuuauggaaaauauuucccagaacaacaacaaaaaugugaaagauggcauuacuuuucaauuugacagaccucuuugcugucuggccuaguggaaggaugcauucuccuagcuuuuccgccuugggucuguugcauagcagccucuggacacccacagugucuauucaagagagaagaagagugaaaaacacaaauaauguauuaguauagagauaguuuugacuuugcagaccccuugaggcagucuuggggauccccagggcucugcagucuacauuuugguccgcuuuugaaugccuacagaauguuuuugaccuucccaccugaggcugggcugggaacaucccuccagcaaccacaggcuccccgagccuccucaucugaccgaaccuguguccacagagcaucugagcucuccucucuaucauugugaaauggaccgacauaaaaucucucuuguuugcagaguucguaacgacagagaacauuuccauaccuucucacaaucaucuuuguggggagacagccaggagacugcacccucuugccuagaacacccauguuguggccagauccccaugucgggaaccugcuccagggauaaucugcugcccccaaguccugggggucugguuccaugggguuugcucaucuucuaggacuuuggucacaggggaacaauccaacuccugccuccuccucaccccagaggcucccggcugcacacagcuggccagagugacgguguucaaccgccuggugccuccuuuucagaaccaccccucccagccaacagagcccggucugugcgggcuccgugggucugugugagagccccuguuugccuuggcuuuggucugucuucucaacuggcuggccggcccuuuucaaaaaucggcuggguguuaugaaacuuuauuuuccaaagagaaaaauuucugggccuguagcaagagggaaaaaaguuauacuaauaaucaaaagcaccaguagucaaaguaggauggugaggguuuggagaaacacugaaaguugucacaaaacacugcagcucacccaucagccgcagcccccgucugugcgcagagcccuagccaugcuggcuucucccugcgucagcauuuggggaaagacggaugugccuggaagcgggccuugcuccugucuguguagacaggccggcguugaaugucuacggguggcaucuaucauccgugaccuguagcauuugugcuuuuuguuuauggucucucggcaugcauuguuuucucggggcugaaauauagcacgcuaaugagguaucucucugcucaggaggacgcaggcagcucagaaagacgccucggcagcaugcugacuaguuugucaacagccacucgcuguggcagcugcugucccagccaagaagaaaagaguaggaaaugcuaggagaagcugcagcuggggguggaggguacucggugccugggaaccucagcucaguugagugucugcccugcaggugacuugauguuuggcccuggugccagucauuucuaggagguauacgacuugggggugucaagcaaacuagguuaggguccuagcuucccagacacuuucggccugaaacacucggcuccuggagccuguuuccuaacccauaaaacggugaggugaccucugccuuugugggugucugagacucgccaguggccuguguucugugcuggguaaauggcaucagggagccugcugguggugccugugccuggcauggggcuacuuuguaugugcagguguuuuuccuaagcugggaccuggggacaggcaugugccaugcaugucagcacucagugucugagcagaguuaggcugacucagugucuguuguuggcucugggugcuaacaggcacaguguggacaaaggagccuggaaaaguggaccacaucuagagggaaggcccauaaagugacuuugggcuggccaucauagccuagggauucaagcucugggaacgagagggaccacagugcugcucacuuggaggaggguauauggggaaggagcaaaguccuuucuccguggggaaauggcccuugaggcuaggcagagaagaggacggucuuggaaggauuugcaaggagaguuacaguagacacagccuguccugcagaccccgcccugugccgagugcuaacggcggugcuaacagcugcugcuguuuauggagcacuaguugcagccaggcuucugcagacaguauuccucuucuucgccucaggacacccuugcguguguuauuaccuauaaauucugggcggucaggcacgaucuaaaccccaggaggauucuaguggaauucucuaagcugacuauaaaauucacauggaaggcaacaaaacgccaaagagccaggacuaaaagaugacagugaugggggaugaggugggggggcuggccuaccagaugcuaaaccauacuauaaagcuguagugauuaaaacacaguguugggacagaacggaggggccagaaauagagacaaguacaacuggggauuucguucucuuuuaacaaggauggcaguucaaaucuuagggaaagaauggacuguucaguaggcagugcugagacaauugguuauggaggggaaaaguuaaagccaugccaaaugcuccuuacaaaaauaaaugcaggccgggugcgguggcucacaccuguaaucccagcacuuugggaggccuaggcgggcagaucacgaggucaggagauggagaccauccuggcuaacgcggugaaaccccgucucuacuaaaaauacaaaaaacuuagccgggcgugguggcgggugccuguagucccagcuacucgggaggcugaggcgggagaguggcgugaacccaggccacggagcuugcagugagccgagauagcgccacugcacuccagccugggcgacagagcgagacuccgucucaaaaaaauaaacaaacaaacaaauaaauaaaugcaaaguggaaucaggagcugaauuucuuaaacauccaaaaugguggcagugggucucuccgcucagcugcuccagcagccacacuucccccggaagcucacugauauucucccagcagcgaagauaaaugagaucaaaucucaccaggaggaagauuuaaaaaucacuuaauacaguuuaaaauacucaccggagaaaucagacaaguaggggauggcagaagguggaggagggggacuuuucuugcagggguuugcagcuggcaggguuggaggagggacacaggugagucacaugcccucugaggaaggccuggcuccacuggggcuuugugugccagcucccagugggucggcagggaggagcaagguucugcuggcucugcugaggccgcccaugucagggucaggcacgugggguccgaggcagguggaggcucauucugaaaaggcagaugcacuugcagaaugauguuuaggauuugggcccuguuugcacggcccuuuccgugucccugugcuuaacuguagguuccuuguuuaauauucuuuuacuuaagacgugcccccaacuguguaagcuucaggccccauggaaccugggcugguccacugcucacucaguaggcagcaguaaguuggaagacaagaggccugagaaggccugggaggagcggggccucggccuugggucagccggugaugcauuugcauggggcuuggcccagcuccucagcaugaccuugggguggcuugccuggccuccccuccuccuccagcaggucagagccugccccugagcacugucccuggagcucuucccagcuugccuaucacaccacaucagucugaacucccugagaucagacuguggacccaaugcacagacccugggucacuuauuuguuucuccagggccuuguguguagauauuugagaaaguuuuaaacuauuuugauguggcuucaaaauggccacgcauccuucaaaaaaaauaugcaaauacaacauacauaaccguaaagugcaugcaucuuaaguggagggcguggugaauuuuugucguuugaacacauccacguaaccagcacccagaucaagagacagaccaugaccaugagccgaagccccccugugcccacucccagucacuagccaccacucccccauuuugggacaaccauacuucugacuucugagagcauagcuugguuuugcuugcuuuuguucuuuaugucaauggaauuaugcagugugugcacuuuucuaucugguugcuuucuuauguuuaggggauucauucguguuauuaccuguagucgugguuugcucuucuuauuguugaauaauauuuuuuccuguuauuguggauauagcacaauauaccaacguuuucugauguugaugggcauuuggguuguuuccaauuuggggcuauucugugcugcuuaugaacauccuuguacggucucgaugaaugucuaugugcauuuuucccagguauauaccuaggaauggaacugcuggguuauagggggcacauguggucagcucugauaaauacugccagcuguccaaagugguuguaccaauugccuuaguuuugauacuggaauuugcuauuaaaagauuuauuuucucgaacauucuuuuauauuaacaucuaggaaaaacuguugagaucaauauggauacauuaaaguguugacugagccugggucccugaugagaaacugaagaauugugaacuucagaaaaauagaccugggggaauauucugugauucacugacucccucacuuaccuauuuguucuuccuucagccacagauauucauuauguguauccucccucccaggggcagagcaaggaagucaagacaaucuuuucuccuuacgauaccaccgucaaauguauuaguuauuucuucuugccaauaauggcucuaacugaggaagcccaucucuuuauacaaaaaauuagguccaggaagagcugccuaagcagaaucaugguugcaguaaagucacuuuaugguguuuaaagacuuggcugaauaaaggggaaaguuuaaauaaauuagugucuagcuauggacugagacaguaugaauccacugaaauauuuaugaagaaucuuaaugacauaguacaauauuaaaaggaaaaaaaggauacagaauuacauacacaguauaaaaguuauuuuuuuaaacucauauccugucacaaaaagaaaaaacacacuuggucucauuuuucugguuuuaaaaaucuuucggccaggcacgguggcucacgccuguaaucucagcacuuugggaggccaaggcaggcggaucacaggucaggagaucgagaccauccuggcuaacacagugaaaccccgucucuacuaaaaauacaaaaaauuagccgggcgugguggugcgugccuguaaucccagcuacucaggaagucaggagaaucgcuugaacccaggaggcagagguugcagugaaccgagaucacaccacugcacuccagccugggugacagagcgagacuccaucuuaaaaaaaaaaaaaaaucuuucuucuggcugcaguccuccagcucaccccuucuugcccaauucuguuaucucagcauccucagaagcucagucugcgagcauggagaggauagugugugucuccuccggcauugccccgugggguuuggaauggcgcuggcugcuggcugccugggccuggcauuagcucauggaucucgguugcggaucaguuuccuuccccaggaggggcagggacuucacuuucuauggcuuaugugcuuuccuggggcccagcaugaggccuuucgccagacacugugcagcccagacuuguucccaggacaaugggugagaugaaaaagggcuugguacuaguggaggcacuuaguggcugcagcugaguguugggaagggcuggagagucaguugcagccaggucuggaggggcugugugcccagcuucagagcuuggguuuugaucagguuuuuguguuagaauccucauucugguggauuggagggagccccagagugaacauagagagaccuccuagccaggcaggagauaaccugagaucagugcaguaguuccucacccgugcguggggaggcagcaugagcaguuaggaggaggaugguguccacaguggucggauggcaccccagccaggccacggcgggcuggacagcacucucaggugacacguggccaccugccugccucuggcugcggccccaccacgggcuggaugccuggaugaaucucaggcuggagucacuuaacggcugggcugucacccugcaguaacccauaauuacuacuuaggaguuuguggacgaaaagcaguagauuccaauugaguguguuaaacucugcacgcgccuguucuaaugaggagcuuguaaccuaugagagcccgucugccgcgggaggcgggcucuugagccagagaagccagccagucauuuucuccagccucuagcugagccuccacggccagccauauuucagcauuuaggauuuuaagugcugguuaaaaugcucauauagggaaguguguauauuuucauauuucugcacaucaugcuagagacgaggguaggaauaaaucgguguggccagaggugccgcuucaagcugcuuuauucccucucugugcacaguguuaaacugggcugugucugacuucccaaccuucauccuguagggggcuguuacuggggaaagaaaguugucuuaaaggacccuggagugugagggauggaaaagcgaaagguuugucucugcaaacagguagugcugaguggucgccagcuuagagcccgucguccagaugcuuuguuuucucucuguuuuacaugaauuuccacugcacagccauuggaguuuugcuaguugggaauuuuaauuagagaauugggcaaacuucauuacuuuucauucagguuuaaggcaagagggcugauuaaauucauccaucuuccccaccgaaguccagccucugagguuuaaucccauugccugaaguccccaucaccccgccauccuccuuccuccuuccccgccucgcagacaagggcucucuuuccaacuccaccaccuguuccagccccggcucugcccgcaggaggggaaaccaggucacaucuguggucauucacaaacaaacauagcucugcuuugccccaccaagaggcugagccugugguuuuucuguccagguccugaaacaccccagacagcaagaaaaccagaaaaaagcagcuaugggcuagguuaggacaauugagguaucugcguaugagagagauuauaaauguguaccuccuggcuaaaguaugucuuucucuagcagaauugugauuugaacugcuuuugaaaauuaaaauguugguaugugaggugaaaaugagcuuaaucugggguguugaauaauuguuuucagccauugaacacaagucccagcauagcaucuaccuagcuacauggauggaaaugcaaauaucccccccugcccccaccagggagcaaaaugugaaauuugucuuucuuauuugccauccuucgaaggcagcacccccuguuaccaugauaacauaaccuugugcaccuccauuucugaaucuguaaaaugggggcaagucacuaaccuuauaagauggucgguggaauuaacuaagcaaauuuaucuaaagcaccugacacccuuucaggcacacagagguuccaagaucuucaaugugacgcuuucaagaaaggcaacucaaguucagggcuucugaauccuacuccaaauacccugucauagucaacacaucccugaaguucccuacaccaugccuagaagcacugaggcugggcaguaucuccuugugaaaggccuggcccccuuccccaggguccugcuugaaugucagaggacagguggggaggaggauggguggagaaggacaguggcagggaggacaguggggagagggcagguggggggaggacaggugaggggaggacagguaggggagggcaggagugggaggacuguggaagguggacagguugggggaggacagucguggggaagacaguggggagagggcaggucaagggagggcaggugggaggaggacagugggggaaagacagugguggggaggacagguaggggagggcagguagugggaggauagcugggguggcgggggggaggacaggugggggaggacagugcaaggagggcaguuugggggaggacaguguggggacggcagguggggggaggauagucgggaggacaguggggagagggcaggugggggaggacagugcgggggagaacagugcggaguggcacggucgccgggagaacaguggggagaacagugggagaagacagugggggagaacagucguggggacaguagagggcaagacaggugggagaggggcaugugggaaggaggggcagguggagcuggcggcaucaugaacuuuuggaauagcaaagggaguuggggcucugaaugucagcccagcaaccaaagauagcuggcaacgaaugguccaggucuuuugggauggaaugucauaggggacaacuaaggcccuguagguugauuccagaauacacuauccagguccagggugcaguggcuauaacuugcagaucaaacaauucacaccacuucaggaguugaacuuggcugugaguuuacgucuggucucuggacccauguggcugccuacagugaacuugaccuuuaggggcucuggcuucuggaaggagggaguuccaggagccacauccuccuuccaggaggccaggugacauggacaacgugagggaaggcagccagggcgugaggccuuggguugggucuccagggcagcucaccacagggaaggagugaagguggugaaggaucacccgggagaugcugcuugggcuggagggcgcccgcugcaggcgucagcugcugccggcugcgggaugugaucagcacuccucacuucauggccucaguucgcucgccugugaaauguaggugugugucccuggagucccuccaaagcucugugaauuuguggaacgcagauggagggaaggucaagcuugggagagggcgguggcuuuggcugcaacgcgaagccgacaagcacuggcagcaggccugcugggcugucuuugagcgcgggugucugggcccacccuccucugucggaucccugggucuucugucccucacuggacauguggaucugaccgccauccaggacguccccucuggguccugcuggcauuacuccagaaccacuucaucuuccuugcccuccagggcugagauagcugguuuggucucacaucuggucuuaagugggucuuuuuuuuuucuucucauuuugucuaucuuaaaaucagguuuaugaagguguaaauuacauauaguaaaauacacccuuuugaggcauacaguucuguuaauuuuaacaaauguauacgguuguguaaccaucacaaccaagauacagaacaguucccucuccccagagcgggcauccuguccuuccguagcugcucucccacccuccuacccccaacagccccuggcacacucuauuauguuucccaucccuauaauuuugccuuuuccugaauaucauauaaauggcaucauaaaguauguuuagcuggggcuuuugagagagaaguaauagguuccuuccguggguuuagccuuuuguuugcaucugcucucaugaaaaggucuaugcuuuuaucaagccuaaaagauaaccuuggccgggcugguggcucacaccuguaaucccagcaaguugggagguaaaggugagcagaucgcuugagcccaggaguuugagacaagccugggcaacauggcaaaaccccaucucuauuuuaaaaaagaaaaauuagccgagcaugguggcacgugccuacagucccagcuacuuggaaggcugaggugggaggaucacuugaggccaagagguugaggcuacaguuaacuaaggucgcaccacugcaccccagcccaggugacagagcgaaaccuugucucaaaacaaacaaauaaacaaacaaacccacgauaaccuugaagaagacagccgcacuguacaggaagcucuggugugugcagguauuuguagagcauuugcuacgcugacccguuaagucccuacagcagucucaugaggguaguuauuauuguaauccuguuuaacagaugaggaaaccgaggcucagagaaguguaaucauucacuguggucacauagcucagaucugaacccacuucugucauccucacuauucugugugguuguuuggcugagucuuggaugagggauacuugcaaugauagguagccucuggccccuggugguggggguagggagugggagagucggagagguagaagaaagccgcuagauccaggccucuagccccuaucucuacgggggacucccuuccaaggaaaauugucugugcuccagacccccgcagcagaugaguguguggaggccugauuuuggagaguggggauuugcacccuuccgcaggccaccccuguguuccugcucauacuuuugcauagccaccaccugaaguuagggcagccccagcccugggggagacuuuaggggccaggggcagcucagugcugggcucacaaccacagaacaccagcuuuccuggccuaggucacacuuugccaggccacaccaugaaggggagagagcgcccauccuuggggagcaggauccagggucugugagacccaggcgugggcugcagggagagugaggucguccgcacggaugguggaguggacagaggccagcagaggcugcgcgcccaugugcgggccaaggggagagcguagguaaaggacaguauugcagucuugggaccaagugccacuaaaccuuauggguaauggguuuuucauccccuggguaauaggagacaccaaaaaaugaggacauuacuuagugagucccucaccucccuggccccauucagcagacucggaggaaggacauugcccagcauugagccguguguggauuuaaugggguuuccagcuaaaccuuccaucaaauuuacggcugugccugucuccugaccuucccccucacacauucuuuucagaaaugaagcugugugcaggcugugaggugucacuucccccacgcuggagauauacagcuugggccuggguugagacaguggauuuaaucaggcuggguccccgcaguucacccgccccuaagcugagugacauuaggguggccgucggaguccagcuagagugggcagcacggagccagcaaguguuuguccugccagccacaggcuucugcucagccuugccucgccuccuugcugggagaguggcgcgugggggcccaacaucugcucacccccugggccggaaggugggguucuuccuguaaucuucucccacagcccccaccuccuaccauugcugccauggcgggagcaucaucagccggccucacuccugcuuuccccacuauccuaacagcugggcugcuccuggcucccucuccauucauuucuugccuuccaucuuggaaguguucagugucugcugaauccucccaccccaaccucacugccccucuagagcuuauugccuuucaaauacagcucaaauaucacaaccuccaggaggcuuuccccgaucucaucacccccagggaagagaucucccuucugcacaucaugcagaccggguccuagagggugaaccuuucucuguaugccuuucucuguugcugggccuggcccauggaagagacccaguaaauagacacugucauugucacagggccauguugucagaugccugcuccagagagugaagcugcagcuacauugccaagcucacugggcuuuguaaauggccccucaaccucaaaggcagcagcugcagucucacagcuggccucuggggaggcugccuuccgaggguggcuccccugagccuggccaccccagccucggaaaugcugacaaggccuuuccacccgucccuucuggggcagcguguguuuucauggcccuucacugacugaucccauguucaucucaccgacugccucagaggccucggggccuggggcggggcagcuauagcaacaggcagcguccagugcccacucggacacacagggcccuugaggcagcugcuggcagcaggaggcgucuagcaggugggcagagggacucaggcuugaggccacggggaggauuaaaaauaaaauugccucugcucccuggaagcugaggccucuguacuuggaguuggaggaugacagacacaggaggagggagaaucugcuagcaccaaacuccccucuaccuggucaugugugggagcggggccucacgugugggacacuaucauucacauucaagugaucauuauuaucacacagggccgugagcuaaaaccauacuucugucauucuuuggcucuaagaaaaugaaaaagggaaguaacuccauuuacugagcaccuguuauauaccagauaauuuuacaugcauuagcgugccauccucaugcuggccucaggaggugagaaccccuauucucauuuuuccaaaguaaauuugugugugugugugugucuguguguuuugguuuugggguuuuuuuuugagacagggucuuggaaccccuauucuaauuuuuccaaagugugugugugugugugugugugugugugugugugugugugugugugugugcguguauauuuugguuuuggguuuuuguuuuguuuuguuuuguuuuguuuuguuuuguuuuguuuuguuuuuugagucagggucuugcuguuugcccaggcuggagugcagugucauugaucauggcucacugcagccuuguccugcugggcuuaagcgauucucccaccucagccacuggaguaguugggaccacaggcgcgcaccaccacacuuagcuaaguuuuuaaauuuuuuguagagaagaggucucauuauuuugcccaggcugaucucgaacuccuggacucaagugauacucccaccuuggccucccuaagugcugggauuacaggcaugaaccacugggcacagccccaaaguguuuaugaaagggaguggcagggucagaccugcgcuccagagagcucauacuagccuuccugaggggcgugagugggugaggcagagguggaaaggcugggagccugcuuagugagcugcugagacagacaggaaauaaaggggccuggagugggacugcgguagccugcaugcuggccccaagccgcaccugguggguggacccagggccccaaggaaccccagacguugcuggcuggguggauggcggugcccuugcugaggcaggagacccugcccaggagcaagcacaaggugcugggagaagaugccacggucugucugugucaggcgaggcacauccaagaugccuggggcucacgcaagggcuggacggagagauccagggcucagaagagagaucugggcccgagacgcagaugcagaaacacauggugaaaauacucauccaacacacucacguuuuuccuccguaggugccagugacacugugggaagaugccuggcuucccaagcacaccucagacgcuggcccccgaucaaugccugugguccuugaaagcagauggccagaugcccugccugaaaacucccacauggcaagugguagaugucacaagccacagagcaccccccgcccacaagaucccccagccugcuugugggagggaacaucccauucuggugcuuuugaucucuuccugcaaauaugcagcucaggcgaccugggaauauucccccacagugaaccugaauugauacucaccaaauuagaucaauuccagccggagccuggagccugugauuaucacccucucaccgugcucuuuuccuugcugggcugcguguuggauuuccaaaaggcuuguaaucaacagcagagagagcuauguauagcccacuccccgcgcuggcgaagcccgggaaggccacuguuugagguuaggcuugagucaacuuguaccauguacuugggagccauucaaaagaggcggugcacacacaaaucaugauggggcuaaucagaaguuuggguauuuagugggauauguacacagcaaucauuguuggaagcgcccuucucccacagaggccauuaucccggagcggggugcuguuugccugguuuugucugggccacaauuugcauucacuugauggauugucagggucgggggucuccuccuugggaaacaguggagugacugcucagcacacucuuaagaggaaggggagcgcuaauaccagcguuugcccagguccuugagagggcccggggauccuaacgcagugcuagaucaauaugacaggcgcuaagaagcuugggacaugcauucacaaaccccuuuuauugcuccacuccaagccagggagaggggagcugcagcuugggcacagcuagcaggaccuggccgacaggcucuuguuuguuuucccggcugcgguggccugcgguucaguucaaguuugccaaagugauuuggaguggccuuccccagcugagccuugcgugggaccuguuaagccccugcucugucaccugccuucuuucugucuggcuggaugccgaaaagaaaccuccagagggagaagggagucggggagggguagaagggaggccuguuuugcccgcuggggcaagggcagcuguuucucuggggguaaacacucuuaguugccaaaaugcccugcaguugagugauguugcuuucucguuuggcaaggcgagagguguuuuuguuuuauuuuugguauuuuccugggacaucugugacaccuguugacuccaugaguucucucaaucucaucguccccgagcauuaggaacaaagcccaaggguuccacauucucuccuuuugaacagcaccgccaucacuuuuaucuucuuaauuuucaggguguuuucuucucuucagacaggagagacccugugcagugugauucaggggagagugggcaccagugagagacacacaggccgugagggccauguucccuaacaaacaguguuugguguggacagggccuacuagggugugguggguggggagauuguugaguuuuuuuuuauugcaaccagucuucagagcaaucagggauuuucuuuucuuucuucguucagaaacgugugaggaaagcugacuagcaucgacaaugccagguuuccucuguugggccuucuauucagggucgcugcuugcauguuccaguucugggucaggacucauggucagcguuggcugacaucucaguagcaagucuuuuuuccaggagaacccaacacuucaaaggcuuaucaguuaguggugacuucguguuucuaguucuccauguugauggcuaaaauggagacaguugaguuguccccaagaggggaccaagucuuuccuuuucccuggggguggggaggguagagugaaggaggcccaggcuagacggccgugaggacucuguccagaaagggccccuccagcaagggugauggguugggcgcugcaggaccgcggagaaacagaacgcaucuuuaucugguccuccgaaagaagugcgguggccauagucuccucuuuuagcccuuuucugccccugugucucagaaaagucuugaaagggcuggaagucugugggugauguuagccugcugagaugcucgaggaaacucaaauggcucuuucuuuguaucacgucuuuccugucaacucauaccccaccuugagccagcccucagaagaugguugcaagagacacaccuuggguaguaaagguggagaaagaaugcuuuccaguucagacagucagcuccuccaucgaggaaggaugagaaaucacagccuucaggauuucaggccaggcacaggacucuuagacuugauaccauaagcaugauucauaaaaggaaugauugacacauuggaccucgccaaaaucaaaaauuuugcucuucgaaagacccuguugagagggugaagagacaggcugcagaaugggagaaaauauuugcaaaccucauaccugacaagggacuaguacauagaauauguacucaaaacucaacaguaaaaaagaaacaauauaauuagaaaaugggcaaaaaacagaaagagaccuuucacaaaagaggauuauauaaauggccaauaagcacaugaaaagguguucaacuucacuagccauuaggaaaaugcuaauuacaacugagcgagguauuauacacacaucagaaugguuaaaagaaaaaauauucauaaugagaaugcagagaaacaggagcacucacacauagcuggugggaauguaagacgguacagccucucuagaaaacagucuggaagcuuauuauaaagguaaacauacugcauaggacccaacaguuacacccuugggcauuuauuccagagaagugaaaauuuauauucacacaaaaaccuguacacaaauauuuauaacaguuuuauuugugauguccccaaacuggaaacagcccagaugucuuuucguggucgagugguuagacaaacuguggcacauucauaccagggaauacuacucagcagugaaaagggacaaaccauagaugccuguaccaauuuggcugaaucuucggggaauuaugcugagugcaaaagccaaucccaaaagguuaccaacuauguguuuccauuuauguaacauguuugaugugaugaaauuuuagaaauggagaacagaucaaugguuuccaggguuuaaugacaguaggggugagggagaggagggcagcagaagggugcucaucgugacagaacuguuuaguauccugacugaggugguagauauugaaucuguaccuuuaaugaaauugcauaaaacuaaaugcacacacauucacauauauauauauauauauacacauaaaacuaaaugcauacacauucacauacauacauaccugcgugcaaguaaaacugaggaaauuagaacaaggcagaugcauuguaucacuaucaguaucuugauucugauauugcacuguagcuuugcaagacaugauuggggaaaucuagguaaaucauacacaggaugucuuccuguuacuucuuacagcugcauuugaaucucaaauuagcgaaaaauaaacaagguaauuaauauaugcaaugcgaauuacgucacgugucuucacuagcuuguccucaaguaagcaagccgugcuguuucccaaggggcugggccuccuucgggacaucuaugcuuaccuggaggcugguggguuauagcgaggugggggcacggguccccccaaagcuuggcuucgugaagcugguacccagguaguggggaggagagaggauguguguccuccaguucuccuucagucauuuucaccucuuggaguuugcaucuuggggauggcuucuccuaaugccuucccaggacuguguucauuuguucauucauucauucaucaguccauuugucagcagggauuucuugaggacccacugggcaccagacguggagcccacagaaaugaaaagauggaccuuucagcaucagggagcugauggcugguggggagcaggcaguggcuugaaugccacacaggaaggugcuaugggagaguagcaggcaccccucacccaggagugggugcacugggcggggugucugguggauaaagaagaaaucggggagccuugcuggaggugauggugcuuguguugccuguugaacaaguggguguaggcagagaaggaauuucuugagaggcaguguugccuagugguuaagaguuggcugccuggguuugaauuuggucucuguuuaacuucucuucuucaguuuccuuuuccaugaaaugaaggcaaaaagggacccuaccuuauaggcaucguaauguggaucaaaccaguucacauuuuucaggaccuggcccauggugaaugcuggguaaguguuugauaaauuaaaucacacaaauagaugaacgggcguacagaaugugauugaagccugggcuaugcugggagaaaucagagcuggaguacaggcugugaagggaagggggagcagcaaagggcagggccuggcuuuccccuggaugcuuaugggcaccucuccucuggggagccggcuaugcuccuggcuccaguagaguggagggcaccacacaugcuuucuuuacaggggaaggcgcuguucccuucucuuccuuacuugcccuuuccaugcacccugaccccacugaaaaagcagcagagaggggcuuugcacaccaggcuguccucauuuacucaguccagauaccugggagauugugagaagcuggaugcaccuuccuggaccagcgaccccucuuuccacugcacuccaggugugaccaaugccagucuucacugagcacagugggugaagcccccuucccaucccaccccacccugcaccuugugaccuccugcuuggcucugcggauuguggucaccaccuuggacuacuuaaccccagcacuuuggacaaagcuugacaucugaucaggugcucauuaaaagcacugucccauugucgggcccccauccaccucucucccccgucagccagggaagggaagauuuggucucuuugcucacgugacagagauguccccaccuuuuugaccuguugaagguucuucugggccacaggagaaacguuuguuucacgagagguuucugcagguggugggccugagccgccugcucugggaggacugagguuugggcugaggaacuacguggucauucggugguugauguggaguuggaagcccuugugggaccuugggcagggcacaggccucugucugccccuuggaaaagugggugcauaaauccugcucugugcauaaauccugucccagcuagccaggggcugcagaggggagaguucuggugcuggcccgguaccagcuuggaugguuaguguuuguggcaggagccaucaugcucugccucuccugccgccaccuccugaccacuuuacuggauccugcaccugcguguuugugccugaggggcuuuuucuugcugcugcgcugguggcaguucagggugccaggaaauuaacacugauaaucaguaacccuacuuaacaaaugucuauggcagaacugguguguaaauaccccagcucccucaccccucagcugggucuacucugguucucagaaguucuguguggagcucagcugcccuugcccagagugguagggggugugccauugucccugauucaccaccuucggugucucuuccugauguccucagcugcccugucaucuccaaaauaaaccacuugcacucacauccuugucucagguucugccccuaagagacccaaacccaaugggguuguugccacuuuucugauagaugcuguggauuugaagucaggaaggauagaccaccgcuaacccgaggagugaccgccagugugaaaugugggccaugaccccugccuggcagagcuccugcccccagcgugcauaguuaugaguuauuugacuaaggcaucuugccacagccuucucaaauaucucagcagcucagccuguccucuguaguuugggaggaaggcugaauggccaggaauagcuggggcuucuauuucuuguuuccuauuuuaguuuuuguccuuguuguuggaugacguggagggagaagggugggcucaaggugaauaaccaagcccagccccugaagggagaguucuuuucaaacccugguggccccugcccgccccccagccuccccucccccaccugggguauguguguggcucuggcacaauuaagauucuugcugggugcccccagcccccgcuggcccugcugcugagcagccugucuugaaggaucuucugagaacggacuccuuuucugggagcguuuauaagagauuucucauggcucaguuccccuauagaaaaccaggaauuguaagucuuacauagcucaagaaagaaagugaagggagugagucagagccggccaagaaugagugaacaggguugguggcagugucucgggaggaauuaccaaaaaagaaaugaaaggaaaaaagaagaaagaaaaaaaaaaaggaaaaagaaaagcaaaaccaaguuccccccaaccccccacaaaacagaaaaaaaagauaaacuuuuagcaaacuaauguggacagggggccucugaacucccuggcaaagcaguugggcgaggaagcggaugguuuucugggucuucaagugcauucugccuccuuaguccaggccuuuguggaccuggucugggggaauauuuagcaaagcuguuuauuuugcauaaacccgaguaaugacccagcccuaggggagggaauuguguggggcugacagcagcgugauuuaagggggagccaccugaccccugccccucccaaacguccccugcagaauaaacucgcuuucuucccagcccgcugcauguuaaucaaugccgaaggcugaggcccgagaggccuauuguggggacagucggguccuccuggggcuuuguggcagcuccagcugaguuccuuucucucugcugcucacucugacuuuccggaaaggccccaaucucacccuggagcucagcuugcuuuccugguucuucccaagcaauuguccgucucucagaucugugcacuuuuugaaagcaaaacucauuaguauauuuuuuaaauguguuuuugugacagaugucccuuagaaaggacaccccuuagaaaggauagcugccuggggcccgcguagcugauagcugccugggaccggcguggcuccgcugacucaggcuggguuucagcuacgccucugggggacuuuagccuugaguauacgcagccugggagucuccagugcucagagugccugcucuguucccuccugagcauucuguucccuucucacucucuuucuagagcgccagugugggaucaguucuuacugccaggggugggggcuaaucugugucuuguguccuugaggaccacaaaugaagacaugcauuaacccuuggggggggguaccagugauuucaaaccgcccccccauaaauccccccacuuccauuuuaccucuuuccucccauaugguuuucuuuucuuucuuuuuuuuuuuuuugagacagaguuuugcccuuguugcccaggcuggagcgcaguggcgcgaucuuggcucacugcaaccucugccuucugguuucaagcgauucuccugccucagccuccggaguagcugggacuacaggcgccugccaccaagccuggcuaauuuuuguauuuuuaguaaaggcaggguuucaccauguugaccaggcuugucuugaacuccugaccucgugaucugcccgccucagcuucccaaaguucugggauuacaggcgugagccacuguacccggcccaguaugguuuucuuucuagugccucaaugggugccuccuugaggaccuggcugauggggaggggaggggaggggcuccccgguggaggcuugggccaccaggcuguggacacugcauggaccucagccaucccugcaggcuggccuggcuucccucugugucagccuuuccagcguuugcagccagcaauucucuccuuggaaacugggagggaaaagaaaacaacaacaaugaaaaaacaacaacaaaacuaaacgugugaacuuggcuguaaguauggagcagaaaaguuuugcuuggauguggcacuggggaacugauggaaggaacaguccuuuguuagaaggggaggaaggggaagugaaguagucucuccuuagaauuggggugaauuguuaugaauaaaaaauacauacuucucagggcuggaugcaguggcucacaccuguaaucccagcacuuugggaggccaaggcaggcaaaucaccugaggucaggaguucgagaccaaccuggccaacauggugaaacgccaugucuacuaaaaauacaaaaaguagcugggcauggugacaugggccuguaaucccagcugcucgggaggcugaggcaggagaauugcuugaaccugggaggugaaggcuacaaugaacugagauugcaccacugcacuccagccugggugacagagcgagacuccgucacaaaaaacaagaacagaaacaauaacaaaaacaaaacaaaaacaugcuucucaguaaguuucccugggaggaugggcccggaacccagagacacuucgucuggucacuggucuccccucgucuuguaaucccuuccuugccucuuuuuaaaaggaaagguuugagcccacugugguugcuaugguuuucuaaccaacaccuugauauuugcaaagggcucugaagucauuagagcuauuucuugcucaucaccuccuggugagacagaugugacucuccccucccauuuuaugggugaggaaacugagauuggagaaggcagacaagggccaggguguccuggagcugugugaagguucuaggguugugauucaucaagccaacaguuagaacugucauaguuuuccugucccucucugucccugagugaucuugggcagguugguucucaccugccuugauggucuguggaucucauagcauuaaguguggcucagauuucucccucccuucuuucccccacccucucuccgccccacccugaggucagccugaaggcagcccccuagccccaccccaggccuagugggagacucagacacaccagggguguggguaggcgagggccaugaccccagaaggcuguuugggguccagagggagcccagaggggcccugucuucccugccugaggcagggugggauccggcaugucucagagauaugaguauuagccaggcccaccaagcugggguggggggguauugacaguaauaaggaggugguuucuguucugaagggugaaacucugaaggcccuagugcugguguggugguaacagcaguaaaaauuuuagcaccaccaacaacuggcauuuuguuuugaagguggaagugucaacaggucucuaccauggcuuccuuugaaaaacacacauacacacacacacacacacacacauacacccacccccccacacacucacacacacccauacacacacacacacacacacacacacacacacacacacacagccuucuucggaggccuuggcccuuuuucucaaggaauccccagcuugggcguuaaucccucaagagucaccaagaguuaacucuugagaagcucguuuauucauuuuuacccuauguaguucuacaggcagccuccaaaaaugcauaguguguaacagggcugaacaaaaaguggcggagaucaggggaaagaaaaaaaggggaucaugaaauagaaauuaacaaguugaaguugaggccagugcuugccuaggggcaggggaggaacguguccaccucugucccagguggccugugugagggagaggggcugggggaagagauuccugcacuguuccccauggggcugccugcgggcacaugccucuccccagcaccacccccacugacacgcuccagccgccacgcccucuccaucacaaauguggccacagcuccuggucuuguccgggucagccucagaaguagcaaacuccccguguugacuuccuguuaggggaacgaggauuccauccuuugaguccuaaaccucugaaacagcaugggccccugcucccuggcucugcccagaguugucagagauucagagaaucgucucucaguuuugcucaagagccugaacacuaccgcuuuccuacuaaaggcuaaaaauaaauuuugaagcaauaaaggugaucacaguagagacaguucuccacuuacaauggcucgacuuuacuguggguuuacuggggcaugguaaguugaggaguaaauguguuacuuuguaaggagggcaaagauuguaggcacaggguuuuuggaggccaggggauugauucuguuggguuucuagucuccucuggaugacaucaccaaccugaaaucccuuaccugugucauaacaaaggacacuuuguguaauuuucuuagauacucacaucuuuaccacucuauucuggaaaaaaauacccauuuaggccuugccguuaacaugucugaucucaggccugaagaucucuuagagacucaguuucccuuucuguacaaugaguggguuugacugauacucaugcugagcugguaucuuuuauccuguauuuauauaacauggucaccucuuuagggugcuaacauuuuaugagaccucuuuaaggugcuaaagucucaugauaucauccaguaacucuaccccaugaagggacauuuuauuacucauuaggcaucaaugucagguucagcaagucuuaucuugaugcugacccuugggaacugcaccuuucugcuuuccaccguucagaggaguugauacacugugauuuucagugaagggggaccacagguccccuucaccuguggucuuuucuuguugcuguuuuguggagugguuuccauccacccccuacucccucgaaauuaggguuaaaacgcaauggcauaaggcacugauauagauuaaaacacacacacacacacacacacacacacacacacacacaaaaugauugucauaaagaaaaucauuccaguccugugaguuugggauuauauuuuccccagacauuuacuguguuuauagagaaaaauaaauaucucuguaaacauguguuguauuuacagugaaaauaaauaucuaaauaaauauuaagcuuuuaaaauuggagcacucgcagaaggaaaugcaaauggaugugagcgagggcugccucacuuggggcgugcaugccuggauucgcacugaauuggggugcguuugucuuucuuuccagcucggagugcagagccaugcuucagggaggggaaaugaacauuuauggagcacccacuaugggcucgacacuuuacaaagagagcuucauuuuaucaccacccggcucuggguggcaaggaguaucuguguuacuuuguaaagagggcaaagauugugggcacagcguuuucggaggauucuguugguuucuagucuccucuggaugacaucaccaaucugaagucccuugcuuguaucauaacaaaguguccuuuguuauuuucucagauagagaaaauagaugaggaaacugcagcucagagaggugaagcgacuuguccaaaaugacaguuaccaguugggguagcuggauguuguucucacccagaaugaaagagcaaguuauggaacaaaucuguacauggcugcuggugcuaagacuuuucuaaauccaggaccaggguuagaaaagccaggagcuauggcaguugucagcacguggcaccuccagacacagaaacgaaagggucugcgguggaguccuuuuuccucuacucccuccgggagggccuggcugcucacgcauuuacgccucucuccaaacacuggguccuucacuggaaacuccucugaaggacagcaagccuccugcaccccgccaggagagcucuuuccuggagaucaaucugcagagagcaggcucauugugagccauugugagccagagcaggcugcagcugggccucaucugugcauuuguguuuuacaagcaggcgucuuggugggagauggguuuugcagaucaguguaauauagaagcaaacacuugaggaugggagggagagcacguuucucacuuuagggguuugcuuccaggacuuccuuuuuuggaaguauguucuuuuucucucucauacacacuuguguguacacacacauacacacacacacacacacacacauacacacaugcacacacauuccaccccacagccuguuccucaggcugcagcuuccccaaggaaggcgagugccccgagccugcuccuagcugagccugcgcaaggccaucagccagucuugucugggucgaaaaggucucguuggcugugugaugcaacuugcagugaacugagggugacugugggcgucacagcagcgucucagaaggcccuguucagcccugucugggaccuguauauaacggaacucagucucaccucugcagaauaggaauggcggugcccaucuuccucuuucuuguggcuacucugaggguuaagugaagucaucgaugaaaauacgcuuuagaaaugagguuuguacagcgaguguaaaggcaggcuguuuuucuaacugguguccaagccagguguggaccugcaguaaaaugcaaaugacccuguuauguggacaggggccauugugacagugagcuuuguuaggauugcugcaucacccacaagccuguuacugcugagccccaacuccagcuucugauuccaagggccugggaaggugcggaggauuugcgucucuagcaggcucccaggacaugcagaggcugccggccgggggccacacugggaacugcuggggaaaguuugcuuuacuuugaguucugaggcaggcaaggcagaagaggcagaaucuccugggggugggagggugguuacaaaaugaggccccagcuuguuugcagcccccauugccucuugaaugguggauauccuggcugccuugcucuuuucccuuccggcucuuucuuguuccuucuuuaacagaauauaucccuuaaaccagugcuucccaaacuucagugugcaaaagaaucagcccaggauccugcuaaacugccagcuucugaauccacagguccaggauggggucugggagucuucauuuuaaacacacaccaggugauggccacugcugcagcugcugagaagcaaggaccaaaacaggcaguuuccaaauaguaaagucacuucuguuuugcaaacucagauggcauuuucuccaugaagcucucauuaccuagcuuggugacccugugcauaggaucugagaacucgcugccuugguuucccuucugcacccuagcgauguuaacccuuggcccuaugaggguucuguggaagaaacaagaugaggggacaacacccaguuccuuuuaggcucuagauaaacauuauuugcugucuucuucugucuuuuacuuucacagccccuggguaaaauagacaagggaugugcguggagacggacauuguauccaaaaaucggaggucagugauguugagcgguuugcucaggaugguagaggcggcucuggagguggccccacaucugcugacuuccauguucagguucagaguuguggguucagauuucagaaugcggauccaucagagaaucugucuggucacucacuuuccuuugcacuuuucaagaauuugauccuuuuucuuuuuaagagggagaacagagcccucuuggcuggcagguguaaaucuucacuuugggguuuguuuguaccaggguauguucuuucucacacacccacauacuuacccucgcccccacuugcauagguaaacagcuuuuaaauguguauuuucuuucaaaauaaagccacuuaagcuuuaccaaaaugcacugcugacauggaauucacauuuggcaaaccccugccauccguguuuuacugagugcagacuauuguaaauuaagggaagucacuguguguguguuuuuuucuuccagacuguuauggaagcagagcugguccuaaguaaaagauaaauuauggcgggaucuaaagaggcaucauuuaaaaagugucaggauacaauuggguucuuaaaaaccaugcagagcugcuaaauucacaugaaaauugaguggagcuggauugccuggggugacagcguccuuggcauugauuuaucccaucuguuuggccggcccauaugacuugaggccucugguggagaggcggcuuccgcugggccggugcugcuccguggccucugcaggucuuccuggccccagcccccagccaggccacuggggagcaugaacagguccaggggucuucauagaccacuaggagaaagacaccaaugaaaggcaacauccacggagugcacauccuguuucuuauuauuugugauagaauccuugcaauaucgucuuaaagaaugauucuggacugaaucuaaccacuucccccuuguugagcuuuuagauuagauuaccuacaauuguuugguauuagaaguucuacugugauuaaaaucucuguuccagugcuguuuaccacuuagauuuuuacccuggaguagauuaaggaggugagauuacugacaaagaguaacuguuuccagcaagguucuucacaacacucuuuucagcauuggguauucucauuuuuaaacauauacuuguaauuuuuuagguagaaaaucguauuaauuugcaggaaauucagauuuguugugccuuuuuuuuaauaaaaagaguguuguggagacucaauuuggcaguugcgugcuggagccagcucauaccagcuaacaccagcuugugagagcugguucuacgcaucucucccaaacuauaugcucagugucuucuccuugguaccuugaaaucagccacagugagagcauuuacaccauggaaauuggcacaugcuacaagccauugacacccacccccccccacccccaaccccuugccccauugcuucccccaaaagcugguuguuaacaugugucagcauaccacugcagcuauuuaacaaccggcuauagaggacuugcugggaaaacacacaauaauaagaaaagccuaggguccagugagagaagaagcaauggugguuaauauuauaauaauugacacucuguggccaagggcuguaucuuugcaguacucaucggguguagugggaggggaaacagucccuucaagguuugaguauuucaggaaggcuuugcaggagaauuagagcuccagccagauuccccagagugugcaaaauaaggagggaagggggaaugaaggcuggagguauggugugcucaugggggugucaggaggcacucauuccuuguuguagaugauggccaaaauaaaaauuccagcuggugcugugaaccugaacuuugacauuagccagagcccuccagaggcugugcugccccucgccgggucccuccugggugauggccaugauagcaggaugcugugcaccuccuguuccuggcaucugguuccuauuuuauuagagguuggaguucacccucagcaaucuacagcaugcaugcauuucaaaggaaaugcuuaauuaguccccaagccugggcuucuuuaggcucccaaggagaaaugaauuuuguugccuugauggauuggggaggacagguggagcucucaaguauguuuguaaguugcagaaguuguucauuuggagacuguggguguaauaaaugguaugagcugaggcaggagagggaagugagacucaagugaugaauggcagagggggcauuuauugaagccaguucuccauggcaggauuuggggccagacaacaugggggaauaaacuuuuuuuaaugcaauucagggccgggcgcagugggucauuccuguaaucccaacacuuugggaggcugaggcagguggauuacuugaggucaggaguucgagaccagccuggacaacauggugaaacacgaucucuaguaaaaauacaaaaauuagccgggcacaguggcaggcacuuagaagaauugcuugaacccaggaggcgaagguugcagugagcugagaucacgccacuacacucaggcuugggcgacagagugagacuccaucucaaaaaaaaaaaauugcaauucagacaguuucuuuaaacaguccaccagccucuugauuguggguucugggugcuagugacccucccccugagagcccccaggcaggccugggccucacugagagagacaaagucccacugucaguucugacugacuguccccaggacccucagccuuagaucccuggacuuuggcauaaccacaggcagguuggcuaaggaugccugagaaaaaauagccaggcucuuggagucagacuuagcucgcugguccuuuauuucacauccugccuucauuuccagagcggguacugugcaaggugggugagucucuguccacuugagaugcagggugaccuacacaacacacaguaacaucuggguggugacagccaagugacaagcagccuucccaaaccccuuugugcuuccugcccuuggcugcugcuguucugccccucuuuccugcugagcccagauguguuccuccccaaggauccagagggaugaagaccaggaacuuaugaagcgggcgggugacuguggugacuucacaugggccaagaaacucagggguucauugcugcaggugggcuuucaggaaggggagauuggggaggggcaggugggcagugcagaguuuugggggaauauaacaagcauggagugugauccaaggguggggaggaggcugucccccucccccagcucaccucauccccaggcauguguuuaucccaugaggacagccaugggcagugggcauguaucuagaaauggugccaagagugacugggaggauggagaccccugaguucuggaacauucuaggcccuucuggaaagagcauuuggaacaccaagcaguauccuuaccuguaggacacugagauggcugaaucaguuacuguagguaaaaucauucauggauuuauucuuucacucauucuucauuccuugagcaugaaccugugccugcugugggggcagcccaggaccagucuucacccagaugcucguucuaaacucugccugcucuggugggaaggcagggcccugggcucugagagccugucggucccuggcuuucugugaccucacgagcucuggguuuugguuuucucccaucaggagaacgucugccuggcaccuccugggugcaggacagggucugugugaacaugugugagccauggagcggccugccaagggaaguggcacugugacugaggaaggacccaccuucccaggaggagggacccaccuuuccaggaggaggcgcagcuguucucaacgcccccugcccgauggaauccacuggggagcuuuuuaaaacgcuggugcccuggagccaccccagagagucugcuucuguacugggcuggguuuuggccucucuugauucccugguguuucuccuaugccuccagagccugcgaucuaccaaaguuggaaaauaaaggaggugagguggggguggaugaugucucucccaacucuauuggccccugugcuucggccucuggcccagcagagagaagggagggaguuuggcugguguggggcagggaggcaggaaggacagagcgccugagcugcaggcuuucccucagccauuaaaguuuaucguugccacggacagugauugaaaaaggcuuuuugcaggacugaaaugugagcaaugaaacuugccaguugguaccgacacagggcacuuaucucauaaaaauauccuccagugucaaaagguuucaguaaauguggcuggaaguauuagcagucauuucuggcagccucaggcucccuuggggccugcagugaggggcuguaaaagggggcucucaguuccugcaaagaagaagggagggagggagagaaggaggaggggaggggaagcccaaacucagccuacugcuguggggaaagugcuggaaccucuacggggcgccccacagcaucagugggggugccugucccugugcauacuccagcugcugacuuggagggugggagaacugccuaccagaggggccagcgugccgacuuccagccagccagggagugagguuauggguaugugauccugcuucugcugaccugcaaggaggaaauggagacucagagagguugggugaucugcccaaggucacccagcuguuaaguggcaaugucaggauuaggaagcuaaagcccuccuccuuuccagacgcucagagccugggaugaguucucugugucugggagcagggaguugccaaagaccaggcugaccugggcaggccucugcccacuguccaguggcuccucagggcuugggcuuggggcauagcucaggcccgcaucuggagggcccuucagcaggaacgaacguucuccaggaaggccugggcuucucuuguucuuguuauuccaucaggacccaauauagugcccaacacaccuuagcuaauugugaagcagguguuggcuguugcccugagguuaccaggggcugauugggggagggcuacacugccccccccccgcccccacaugggccccaguguccacccagguggucagugcacucagcuuaucccguccccugcccgucguugggcuccgguuaccugcguaggccacccuucgcccagauggggcugugcagucccaaggagggccggcgcuucucgccaagauggcaugcccugcucgcugugggcacagccaccugagcccagccuccugccagcagccacaccuacuuggggagcugggccagggaccuggucucaggcagcacggugcggggcaggcaagguguucaauaggaagucagggccccuggggugaccaggacuccuugacucugacuugaggggacagugggaguaggauuggguggccacaucccucgagugguuuccccucucccugccuguaccagcaggugggugaugaggcccacuccacacaucaggcccggagcccaggggugcugggugcagaccaugggguucacccucuccugcccuggacuccaggcaggcuggaaaggaguggagcacccaggguccagauucagcuggcaaggcuggcagcucaggaauaugccucagggucagaaacuaaggggccaggugagcaccgggcagcucaggcaagagcccuguccccaggcucuagcuccagcgcacucccucucuuuacacacuggccguguacaaucucguccuccuucaaggucgcagccaccacccaaugucucccagaggacagccucccaccaagagcugagcccccagcucuggccuccuuucuguaacuagucucuggacacagccacucuguguuccacagcaucucaaacucagcacuuucucgcccucaaaacaggccuucuccccuguguccccucucauaguugaggccaccagcacccaccuaagguaguuagcauccuuccuccagaaugcuugacucgcccucccugcauccccgcguggcagaguccugcuggcccugcauccugcauugagcaugagugcaccccucccuccuugccgccucugcccuucccgcccugguagaggcccuccaucugucacccaguggucacaagguaagaccagugucuuaauucauccccuugucugcagcaucacacacacaccccacccuccacaccaaccugucccugucacccccuugcauaaaccuuccuaaugucucuccaucaccagcagacuugugcccagcgucauuacaucaaacaagccuagucgcagcccagcccucaccugcugccuugccgcugaugcucugaccacacagggcucucggagucccagaagacuccacugcuccucaucccugugccuuugugugugccuucucagcccucuccucggcuuggcuucaccuguugacgggugcccugggugguccuugagaccuggcccagcacuuuuuccucugugcaucuuuagagcagaggcugggcccgagauccugcuggagguccguaaaccagagaaacuucccugaccugaagaugugggcugcacgguggagacugaacugggagccuggagacucuggggcucuggguggcaauggccucucguaggaagaucccacagggcucauuuauccauuaccauggggagugcguuuucuguagucagggcuuuugcuucucacguuauucagccgggcuguguaaugggaaagaacagucaccaucugcauggcaucuuccucgccagccagugggcagggcagguggcugcuuaaggcugcaagcuggagaaucgcagacgaggguucagaucuuccuugacaguuccucacuguguggucuuggaugggucauguacuccucaagccucuguuuccucaguguaaauggggguggugaucauaacccccccaacacacacacacacagaguugaaaugaagagcaaaucaacacaggaauaugaagugccuacaaccgugcccgcaggggaacuugcagcagcuuuugucauugugugguacacugagugcuucccaccggacugcugggcaugggaaagcaaucuuacuaucaggaacgaugcagcugugaugggugcugcccucaagggggagccaauugauccuuuuucaccaccuggugaaagcccccagcagggggcuagacuguccucaggagcccugguguggacagcacaggauggccucaugcccacauggggcccuauuauaggucauuaaaccugcccuuggcacuguggggucagcaggacugguugauaguggggacucuuauagcagaggagccauggccuggggggccugucacccaggggugacccuucaugcccugguuugguggucugugcacucagccgugcuuggcuuuggccugaguggggcuggccauuggggaaggugcccaagacuguccagagcguggcauggacauggguuucagggugacucauuugugcacacuuggguagaacaagagaaguggcauccucgccuccccucuggugggcagcugcauggggaccccuuucccaagccccuugcauauggaggcccccucuucugagcacuggaucugcuucccgugcagacucaugcucuagagucauccacugugggucccucucagcaccugaaaagggaaaagaagccuggguccugggcugagaacuaugaggcagggcccugcagccaucugugaugugggagaaggcaguuuccccuuccuaggagggaagacacccccugccccccaacagaccuggccacugcuugggcccccuggcuccagccccucccaccgaugggccacacauagcaugugcucugaagcugaagcugugguuuaggggaaaccaauguuaugggaacagcucccagcucuagcuugugucacuccagccuggaggcagauucagggugggugguuugguuugggaaucuuauuuugcccagaaaggaaggggggagccagccacuaaggagagugcugaauggcugauggcuggaggacagacugucuacaggagucagaugcaggcugagaaggcuucacguuagugccuagaucaccccccgucucugccugugccuggaaaauggcaucccugacccaggguggggaauuggggugcaguguugucuauggcuugugcuugugcugaggaguuaaccuccagcagagaggcugugaggcucccccaguuccccgguccccugagccaccagaagccauaggauuguggcaugauuguugucauucauugggaauaaaugcacccuccgccuuuuggcugacguggggagggcuugcuccugcccaaagugcucuuccugguugggucccacagagagaucaccuggaggugccucccaccugguguucccugccuggcugggcccugcagccucuucucaaauguggcccuacugucucccuccccaccaagcccagcuccccuccccugcugcccuucccucagccacuaucucuggucagcccuaccccaugccagcuuccucccacugcaccuggcucugucccuugcugugaacugucuuuuacaaagugccauccagaaggaaagaaaugcucaaaggacauugacuucauggccccagaccuggcaaccugaugcccagagguauaaaaauaugccucugugacugugguuagaucgugcacacccccucauuuauaaacccacuuuaggccgggcgugguggcucacaccuguaaucccagcacuuugggaggccgaggcaggcagaucacgaggucaggagauugagaccauccuggcuaacacggugaaacccugucucuacuaaaaauacaaaaaauuagccgggagugguggugggcgccuguggucccagcuacucgggaggcugaggcaggagaauggcaugaacccgggaggcggagcuugcagugagcugagaucacgccacugcacuccggccugggcgacagagugagacuccgucucaaaauaaaauaaaauaaaauuuuaaaauccacuuuacagguggggaccccacaacccuggggacagcagacccuucguaggccuuccuacagauuuauuccauaagggaccgaugacugaagccauagcuacagcuccuccguguaggcccagcuggggguggagugagccuccguccagccauagcuggggcugugggucccauuucccucuggguccccuccguuuuccugugcugugguuuccuccuuuuagcugucaugucccaaccuugaucccccuggggcaucugguccaccccugcccaugaggccuauguccaucccacaacuuauaaugcuaacaagccguuuggggccucccgguggucagcaggccugagccaggggugacagcagggcccucagccaccuggucccuuggcacggucugucagggcuucuugccuaaucaagggaugcauuuuaauuuaugcaaaugggggagggaugguggcagggagucacagacauccaucaccccauuuccuagcagcagucauucaucaguggggccuuaaagauaauacacuuuuuguuucaggcaauuacuuaaucuugacaaacuccuguguuaagcagggcuauuagcgggguccaucauuaaucagcgcagaaccaagugggugcuuuuucugaacugcaaucacucuuggggacccggggugggcccuuugccauccucgccgcccuaauuacacaagcagcaugcuaacaaccagcaucccacacguguugcaggggcgccaagccacgggcagaagaggggcccauuuuuaacgccagucagaauguuuucggagccaggcagaaugauacauggggguuauuagcagccaccaggaacacagcuggggaaacagauaacuccccuccccugggucccucccggacuugccucugacuucgcuggguaccugggcagcacuuagaugccgcugcauggcagacccauucuguuuuaagggguuacauuuccuuuuggaaagaccacgaaugaagugaaaauaccaaggcuggccuuguguuuccuggaguuuguuggugcuccaccuccuuaccagggccugggucacagaguacugcucccuccuccaucacacaccugugacccuuauuacaccaaugccuggcccaggcugcccugagggggagugggcacccaggagaacaggggaugagucgggcaaagacugggaccugggccuucccccggccucauuucuucuuccugguccaagaagagcucauaccgcccuacccuaccccacccaugucuggaauuucagagaaaugggcaugaggucuggcugugacacagauuagccauuugacugaaccagggcaaguuacugaacgcuccugugccucaguuuccucaucucuaaaguggagauaauaguaacaauaccuucaucaauugcuaugaggaugaaaugaguuaacaaaugcaacaugcucaggaaggcuccagugugaaggaagcccugugcacuggcuguuagaaccacugcgguuuccagucuccaaggaagggccagugcguggcugacuccuagaaacugcucugucuccuacugcggccccgagcagcauggcuuucucuccucgguccuaaauuaauuuagacugacagucgguagcuacuggccacccuuguuauccucggguucuguuuuccaauagugggaggauucacucauucauguauucauucauucacucacugggcacauacuccucaccuccuccaugccacucgcugggcuggucguugacucagaggaaaugguguggagggaguaucgucugccugcgguggagggggguggcagaagaaagguccaggaagcuuccuggaggcaggcucguguggacugggguugcugagggcaggcugaguuggcaugaugaggaugagggggugugguggggaggggcuuucuaggcaggguggagccuaggaggcauggggucugcaaggcugucauuugacccuggggcugggagagucuguggggcaggaucuggagguccugagugccaggcuggggcucuugacuccauucugcuggcaauggcaggaccuggggaccaccugucagucacucagacccuccuccuggucccccuacugaggugugacuggacccacaaagcagggccuuugcccacaaacgccucggaugagagugcacaggccaggcugcucuuggguuuguggaagggcagcucugguuucuccggccccgaaacacauuguauuugggaguuuuccccuagaucuuaaacccuguuuauuuaaaaagaaguagacucugucugcuuuuaauucacaugcuuagcucaucaaaauauuguuuugcaagagguuuuuuuuuuuuuuuuugaugucaggaaggcuuuggcauguuuuccuccucccuuucuucuacagucuuauucuaggaaauaagauucugggcaccgcucagggcuggaggguugggucaugagaccacauauucugugucucaguuucugaaccaacaaaauaggggagcaggcucuucccacggauucauggacuggccuccaguccugcugguggacaccguaucccagcaaagagaaauacuguuuccaugcgccacaguggucguugguggggagaguggggaggguggugggaauggcaugugcuccaaccaucauucaguuaacuggguccagaaucacacgggcagggagccaggcguccgaaaguguaacacggcuugcccgguguuucuccacgguccugccgcacugccccucaugaccccggcaugggcuuugcuuucugcggacccucuuauuugucgaagaucucgggaguccacacacccacucccgugucugggaacacuccaagcuuaucaagaacgcagcgggcagcaauccagggcagaacaagggaggugcugucgaccagcucugcgcggagaggucaaggguguggaaggguggggagagaggcacaggcugacuuaaucccuugggcggggcaccggccucacccacagaaucgcaaguaacccuccuacgauucugggaacguuugugaguuaaaugaauggaagggagggaggaaaggagggaagaaaaauaacuguguuuucaucaguaaauguaagcgaccaaauagaagucuguaggaagcuaagauucaaaggugaggaaggacugagguuuggggagaauucucaucaccauauuuuguguauugaugggacuuuuacuaagcuagacuagaauucugaagcaguggaaagucaauaaugauaacgaguuaggccugagcuguucaguaggguagccgcgagcuguguguggcugagugcuugcaauguggcuauccuaauugagaugugcugugagugcaagauagguaccagguuuugaagacguaguaggaauaaaagcauguaacacaucucauuaacaauuuuuuuacugguuccauguugaagugauaguauuuuugacguacugguucaauuaaauuguguuauuaaaauaaucaccuguuucuuuuuaguuuuuuuuaaauguggcuccuagaaaauuuacaauaacauauguggcccacauuguauuucuguuggccagggcugcauuggaugaguggacaccuagggaagauucuaguccaagguagagagaauuguaaaggaucccuuugaguaacauaauuauugggacugacaagaggcucccagaaaguggcccuuacgggaccugcuuggaugaaagaauggagagcauuuugucauuccccuguugauugcagaaagacaguaaguccagccccagugcucguuugcuuguccagguggcugauuccgcugcccgguuuuaaaggucauugauugucuguggcaggcccugccucagaaugcagccuggaauaaagaggugccuuggcucagccugggaaaccaucaccagggccugguggagaccaaaugugguggccuuacugucgucucaagagcuauggcagagugcaaagcugggacuugaugcucucggcaggacgcaaggcaggaccuauaagccagaucaagaaaccucuuguugggcucugcagggaaggggcuggaugcuaguuaaguacacagaauggcaagugacaccuucacgacccguggggaccagacagaggaauggcauggucauccuccugaaagggagaaucaccugcgacaagugggcuucuugccggggaccagucagcauugcaauagcuagccgacaaggucccugccagcugacggggucgccaguguauacugucaaaugaguaugucaaggggcagcaagauuuuaggggaaagccugaauccaucccaggccaccuggccuagcccuggccugugacagguggaaggagcacuagggccugggcaccgucuccuccagcuccugggcuggauuccugcuuucugcauuggauucugcaaggugccagggucccugggagccaugguccucugggcuucaaaucuauugcauuuugcaguggggaggcugcacacuacuuuuuuagaaaccuucugugaccaagacagaguuuucaaccuuaagcaagcuugaccagcccuauuguuucuuccagcccuaaaauucucuaaugugggacucuacaugucuacccagacagacaggcagccccucccauuccuugugauggcggggaucucccaggugucccucuggagcucaccccagucucccaccccuugcuaaaggggcaggagcccagcagaggggucuguagggauggccacaccggcacccuucggggcccuacugcgugccuggcccugcacuagcucuucuccacuucacagucucccucugacauggguccugucccuauccucauuuuacagauaaggacaccgaggcacaggaagguucggugagucagcaaucaagccagacuuggcuguggcacuggcggcagccucagcucuguccaacaggacacuaugccgccucuuguggccugucuccugucacuucaaggccacuguugcagggaacagaucccaugacugccuggcucccgagcggccagacccaaauggcacggggcuggccucucccguggcguuggcuggagcacacuccucacccuggaaugugcaggucccucugcaucccuaccugcccucaccaggagaccagucucagaacucugugccugguguggaguggcugugcuggccccagcccagcacacucucucuuucggcagcuaauuugucaaguaacaccucagccuggggugggcagugugcgugggcggacccagcagaggccacggguccugcuaggcugugucugcagggcaggccugauugcgugaguggccugggccucagccagccggacaccagccagcucgugguguuggaauuuccugucugauuuuaauuccuccccccacguuuuucccccaagugagacagaagcacuuuuuaguugcacguuguggaguggccauucaggauauuauucuuauuaaaugcuuccuguggggugguggcugggcaucaggagggccucuggaauucuccuguccuguggcuuauuauugaaaaucauggugccauuugcauaaggcccuggggaaggagguuuuccaugauucgugcucuuuuggugcuuccuaccucugaugcuuaggccagugacuucguccucauuugcgaacgaacaccuggucaccugggcucacguggcugaagggcuggccuuugaaagugucaggaucucagaacagaccaaggcucccuagcaaggggagaaagucccuggcagccucucccagcccuggugugcacuuucauucauguaccaucgaaaagcacagaccccuggaugccuuccaaaccugcauucccaguggcacccagaccccuugcagcugcugcucagaagcacugguaaauggucaccaggauucaaaugucucccccacucccgccucucugaucuucuguguugaguuucuccaguuaguacaaugccuaguaggcgcauggacaugauaaaugauuuccccuuccuuacugugcaacugggaacuauggagccacagcaaguguggaaaugccaaagggccugugagucucccucccgggguggucccuggagcagcagcaucugcaucacugggaaccuguuagacaugcccaggcucacugaggcaggagcucuggcaacagggcccagcaacagccugagaaaccccgauaucagggcuuagugggugcuucaucauguaccucuuacuauguguauuacaucauguguuccucucgaggacgccagcaagagauguuccucauccuguauguauaggagaggccacaugcuuugcaccggggcuuacacuucacucgguucagugccagggcacaauugggcauccugggcucacuguccgcacugcccugagccugaagagccugccauccucccccuuccuucuggcucugccaggucuggccucuuccaaugagccuuccuggcugcuccagaccucauggaaaucuuuuccugacuuugaggccacuugggcaguuugugcugcgugggccucgcugaaucccgcagggucaggcucuccagcuguggcaguggcuuacacagcagcgccccggggcacucccugugggcaggaauuaugccucuuguucucuguggccuccagagcccaugagcagcguccucuuacauugagcgaguaggggaagccuugaccugcagcagggugugugguugugacuuccaacuguggauggagaacucugcccuggguggugagcagcuccgccguggauuccagagacagcuguggagccaggcuugauggggcccaaagccuguguaugucaaggccauauuagugggacaaugugucugaacuacaucguaucccuagaucagaccuggaugguugaaggagggagcauccagccucuucuuugaagcuggugucgucguuucugguaucuucugggaagccuuuagguacaacuucccuggggauugggccugggaucuccacaggaauaggagagagcagagucuugcuccaugggauuugugacaagcccagaauaaauggccagaagcgaccuuagccaugcaaacagcaagcugacauccagcaucauugguguugggagggcgcuggccuucugggguucaucaccagaaugacggugcugaucgccauccuuacccaugagguuaacauuuuucauuucauaaggugucuucacauuccuguuucauauaggauuaagugguuuaacugaucaaauuguacauuaagcguggaauggaaaguagcaaucacucucacuuucuuucucucuguugagacuggggagucauugacgaccauguagccaguggugcaucuguucuuguuugacaacucagaccuggcccagggccccgagauggcacaugugugcauucaggccccacucuguucuccugagccugugcuuccuggcagagcccagaagcagccugaagaugcaguacccugcccagccuugcccuccuugcagcuuuguccaggccauccaugcgcccccuuuccuggagggaaguaguacuggguuugguguaaaauaauugaauuguagaggagaccccauccucugcacugcugcugccuugcagcacacaggaggagccuucaugagaugucauaggcugggaccuggucacaucccuucugccuugggcuucuccugcugcugacuuucccaagaggggaguuauugcugcagccaugggauauguggcugaugcagacaaggagagugggagcccuccuuuuaaacggaauucacaauaguguucaccugaacucccagaccaccuugcaaguucccuccccugcuuauuuucugcgggcagcauggacacagacacuagggaaagaauggugggaaccaccagagcuuguaguagccagccuaagccuccuggggauuggucaucugggaauaggggugaguggccagcagggauuaauuuauagaagaucuuuccugcaaagccauggcuuucaucaguuccugcauccucacucugucaagcagugaguuugcacagaguacacaucugugcauggagaacucugcccuggguggugagcagcuccgccguggauuccagagacagcugcagagcugggcuggguggagcccaaacccuguguaugucaaggccauaugaguggggugaugugucugaacuacaucguaucccuagaucagaccuggauggcugaaggagggagcaucgguggaugccuuauaugaguuucuaucugauacaucucaaugucccuuauacugggaauggaggaaaaguucucuucauuaccauagcaccgggacccuugucacaucugcucagagauggggaagggcauuaugacuuauuagggguuucuacucuauggacaccauaaauauucuuuuuuuuuuuuuuuuuuuggauauggagccucucucugucucccaggcuggagugcauuggcgcaaucucagcucacugcaaccuccagcucccagguucaaguuauucuccugccucagccucuccaguaacugggauuacaggcuugcaccaccaccccuggcuaauuuuuguauuuuuaguagagaugggguuucgccauguuggccaggauggugucaaacuccugaccucaggugauccacccaccucggccucccaaagaguugggauuacaggcgugagccacugcgcccagcccaccauaaauauucuucacagcaguuggguugaugucauuccuauuuuacagaugaugaaacugaagcuuggaacacucauuacuugcuagcgaaugacagagccgugguucacacucaggucugucuggauucauggcucaggugcguucugcuccuaucccaagcuccuuagacaacagggacaggugauguccuguaggacuguccucuggcugaugugugacacuggagcaagcuggacuucacucugacugcaaagguuaccuugacuuccagccugccccucuacugcuuuuuucuuucuucuacacuagcgccuucuuuugccaaagauauugguguauuuugugccuagguccuuccauuaggagaaaagcaaccaguaagccaucuacacuuuggugugaauccauucccaugacucccaaguucuguuugcuucuaagaaaauaauacugugcuggauguuacuuaauaugcaaggaauucuaaguuaaaggaacaugauaaauuaguuuuuaacuggagaaucccaaagucccccauagugggaacaaaauuggaugucaaaaagcccuucuccagucaucccagagacgugccaaguaagaaugccuccacuucagcugauuggaguccacuccucacguaagagugcccgacccgacgcagagcaggcaccccaggagugcuuugugugcgagugcuggccagggucccacacagaccaaagccuccuggccugaaggcugggaaggugcaugugggcaucacagaggccaccugaguguggcagguggacagggcauggggaccuaugguccugacacggggcccacccggugggugcaacauggcugcuccaaaggagucucucuccacguggcuccagcacuguccccugggauucacaccugcagcaugggagccaaucccuggaacccuccacagcaacacucagcaucaccgggcuuccccauccuggccacagccaaggggcugagggcccugguguuuggaaccaaaggccucaugcgcccuuccuugauuucuggucauggaugcagcuaccgcacuggccuccuacauggugacccuggagcggccaauugcccaagaaggauggggauccaggccccagccaugccacugccuuccuucccgggcccacaagcugcacugagauguguuugcgcugccucgucguaacacagaccuguauggugcaaggcugggccucaccuucccuccaucagugcuggggcaacucgauuucucucugaaaccgguuucuucucugguccaggccggccuggugcacagcgaccacaugcuuccaagcuaauucccucccgcagucuugauggaagagaccaugguaacuggagauggugcuaaucucuaggacuggacagcccagagggcuggggcauccccaacacagccacucuguccugggagguggcugcuuucaccucccuggccucucugccguggaacaggcccucaggcuucucugggagcccagccacggggcagugccucugcguuguggcaacacaugacuucauccgaggagaauuccuccggcugcugauggaggccgccuggucauguuuccaugacccaguuuucccgauucuuugucugaacucugcagaccccuaccuccuucucucccccaggaauccacaggaucauuucuaauggggcauuaacuugagccagguuuccggggaagggcuguccuugcccccucacugcccuccucacuaacacaagaagaccauuacacccaguacacugcccacaccaaugucugcucgcccugggaccgccagcaagaaacauuugguguugaaacugcagcguagaaaaguuccaggauuuuaaagaaaaagccgucacuccgccgccacccucagcuucucaggcuguugggcuuucuguguaggaucaaaaacaaaugugcauuuuuuuuuccagaggggagugaugauccauugaaaauucccaucuuagaguuucuuccucagaaacuuaaaaagagagucauuucuuugaaauggcauacgggguguguauguuuucagggggauggugugucugucccucugccggaaggacaugauuaauuuuggauuuuuucuuuuacuugaaaaaaaaaaaaaaacacaaaagccaacaaugaaagcuguguguguaagggucuggcucaggaugucacucaaggcagcgccuauucuucccacgcaucuucaugcuccucgugggcuucugcagccucuggaugcagcaguuucuugccagaguuggaaagcagaauuuuucccuccucagccuggccagggggcucugagcaaggcauucaccucugaauguuuccaucgggggcugugggacaauccgugcuggucugaaagagaccaccaaugagucagggucaaccuuuaucccucagguuacuugggaagaaaagguggucuguagagacugugugugcacgugugugcauguguguuggugggggguguuggggugcuguccuauuauaccugggcucagaggauuggggcuggggcuggggcuggugugucaaguggguuagaagggccguugggucagucauuauacauacagggccacaaagaugagccagcaucugcacccagagcccuggucugggccugcucaggaggucccuccugaagccuuggggugucacuggcuggaauaagcgaggcccuuugccugggaagugggcaaccauuuacagauagcaggaaugugccaguaggaagggaccucauagcuccucuaaucccuguuguacaaggagugugagacccagagaagggacauaauuuccccaaagucccauggccaccuagcggcagggccagucugggauuccuggcggaugggcaccacugccccacagcacuggacccuccuuguacagcauuuccaaaaguuguaucagagcaggugacugccugcucaggacuucccaggggcuucccagauugcucagaaaaaaaucccaagguucuucccauggccuggcuagugugauaggaccuucucuccugccuuuccaccuccauccauccuucugugccuggcaaguuagccuucaugcugaaaucacugaguucuccugacaccuggccuuugaauuugcuauuccuucugccccaagcuccuucuccaaagaggcugacuuaccuccgugccucauccaugucuccucuguucccucucccagguggauuuccuccuuagcuucaucccccucugacacuauguuauaaauauguuugcugacuuguccaccaccugucuccucucacugggccauggugugggcugccuugucacaacacuguucccagggccuagaacagugccugccacauagcaaaugcuugauacaagguagaugcaugcaugcauaaauaaaugagugaaugaauauuucuagaugacagcuauucauacuucacaacugcugaugugaauagauggggucuucucucugagggugagcggaagggucugggcaggucccuggucuuacuccuugcaacuuggccgacuagcuggccuuauacaucccuguccauccuggggcaaacacugugcuacuguauugggauagcagugccagaggcccuacucacugaaggccugcugcaugcugggugcugggcugagcuguguggggaaaagacuaugagaccaccagucacuuaccacccaauggaucauugcucuuauggaaguagagucccaccacccugagccuugauguucuuuccugaaaaaugggaauaagaacaagguuaaugguaaaacuaaaggugcugucagcaaagccccaugaggcagcagaccuugcuggagaugagcccccacaacagcaacccuagugggcacauugccacucugcccuggccaaccucacacaucaccgccaggacaggaggacccacuaacacguguucccaggcuccuccuggggauuccagggggugagagaggagugcacgggugcagccugcacauuccacaggugacccaggcuccuggagagcagcagagcugguaagaggugccaccugcagcccugccuaccuggagaaagagaaagugcuucuccugugaccuccacagccuccaccccaggagcugccagacaacagacggcaggccccacuauagcaggacucugugggaacccuccccaggccucuuucuggaagccucaggccccuccuccaacacacaccacauguacguacacacagcaauacacacauauggcacacacacacacauauacacagcaacauacacaccauaugcacauacacacagcaacacacacauauggcacacauacacauacacagcaacauacacacaccaccuccacauacacacagcaacacuuauacacauacagcacacacguacacauauacacagcaacacacacacacaacagcacacacauacacagcaacauacauguacaacacacacauacacagcaaugcauauguacacauacaacacacacaugcacauaaacacggcagcagacacauaccacacagcauaugcauauacacacagcaacacaugcauacaacaugcauguacauauacacagcaacacacauguauauacacacagcaacaugcacauacaacaacacacacauacagcauacauaugcacguauacgcaguaacacacaugcacauauaacauccaugcauaugcacacagcaacacacgcauacagcacacacauacacagcaacacauacauauacaacacacagcauauccacauacagcaacacacacaccacaugcacauacacagcaacgcacauacacauacaacacacaugcgcauauagcgauacacauacauauaaagacacacacguacuacaacagagacacacacgacacacuacacacauacacgcacugcacauacucacacaugcacgugcagcacacacauauacauaccccacacacgcuacauguagacacauaccacacacauaugcaaacacaccucacacacacguacauacacacacacacacaccauggcuuagucuuguggggcagagaggcagccucagugguaccuguacuucauguuugccuggcaaaccacugaagcucacaauguuccauagacuuuauagaccugggugaaguugccugaauccugaauccugagcagagcaugucagcucauagcuggggguagggugggguggucugggcucugauggcauuaggagacccccccucagccucuggaggagcaagaccaugaaugguaggcacaccagggugcugggggauggccugugugaagaccaaggaauccuggacugaaugcagcuuccuggggucgcugggaagacccaggagcugguauuugccaagugcugaaagcagagcuguggacugugugugcauuuguuaacuaaaguacauagcaagguggggacguggugggucgaugggggucugggaucacccuggcacuugggagcugccuccgagugucauuuaggcuggguggagggaaaagccauucagagccuucgauucuccucuuggcacugucguuuuuuaguccugugacuuugggcaaggccaugaaucauucuuggcuuccguuuccucaucucuuuaaugggcauaguaacacuaguugcaucagggggcuucuggaugugcaaggaaacauuuagaaauacacacacacacacacacacauacacacacaaccauuuuuauuuuguuggcaaaauacugaaaucuggucugcccugccauguuuuuaaggcccuuuucuacacauuugggaaagcgaacacuguuucccugcugacucccuggggauccaguggucucuuggucugugagcaagcagugcuuggccccccacccucccuaggguuugcaaccaguaugagccaguuuuccugugccccacauuaguaaauucauaguuugaugauggacuuuggaggcuccaaacaugagugcuacuuguccuccucagcagugacacuuguugaguguguccuaucugcacagucuccgggcgaagcgccuccugugugugggcuuuuuacgucuucaccacagccauguagguaguuacuguuauccauuuucagaugaacaaauggagacucagagaggcaaagaaacuuacaaaagucaugcagcaggugagugagcucugacccucaggguucccagccuccggagcaccugguggucccgucacagccaccuuagucacagccacaugcccggcucaccugugcagggccagggccucagagaaaagguuguccuuccagcacuugguggcucuggaagugagagcuggcccagaggcuuggaccacgugccugcaaccaacuccucuuugagucugaguuggggaaacugauugaaucagggugagaagauuugcuuuuuguuuuuccugguccccauggaaagugccaguauugugaaauuaugaagauggaguugaacauguaaaaauuaaaguuaaaauuucaggagaaaaauuucuucccauuaagaauccauuguguucaacccaagcauccauugacagaugaguggacaaaaaaaauguggucuauccaauacaauagauuguuauucagccuuaaaaaggaaggagauucuggcacaggcuguaacauggaugaaccuugaggacauuaugcgaagugaaauaagccagucucaaaaggacaaauacugucugaucuuuccugcauggaauagcuagcaugggaaauucauagaggcaggagguagaauggugaaugugcaggggcugggggagaguaaugggaguuaguguuucgugggugcagaguuucaguuguggagauggaugguggugaugauuacacaacaaugcaaaggggcuuaaugccacucaacugugcauguaaaaaaaugguuuaaaugggccgggcgugguggcucacgccuguaaucccagcacuuugggaggccgaggcgggcggaucacaaggucaggagauugagaccauccuggcuaacacggugaaaccucgucucuacuaaaaauacaaaaaaauuagccgggcguggugucgggcaccuguggucccagcuacucgggaggcugaggcaggagaauggugugaacccaggaggcggagcuugcagugagccgagaucgcuccacugcacuccagccugggugacagagcgagacuccgucucaaaaaaaaaaaaaaaaaaaaaaaaaaagauuuaaaugguaaauuucagaugucuuuacugcaagaaaaaaaaaaagaauucauaguauuuaugguauuguaccagaaucuguuugcacagaaacaguuaguagcauuauuuuucuauauuuuuuuguuugucuguuucuuuuuugguuuuuugaggugaaguuucgcucuuugccuguaaucccagcacuuugggaggccgaggcagauggaggucaggaguucgagagcaaccuggccaacaugaugaaaccccaucucuccuaaaaauuugucugcauuucuuagccuagcagucagcugaccuguacauaccuaucacaaacccauccacauuucuuuaaaauauucagaaauccaaacuuaacccugcuucccacuggccuguggccuucagacugagggagaguugacuaagaaauccccacuucuuagcccuuuucccaguauaacuacuuuguuaaaagccuucuuuuccuaaagccuauaauuauguuugccuccaggguacccaggaauuuuuucuuuuaauaaacaaagagcauccuacaauuaucaugaugauuugucgagggcaggccaaguucagacaggaggcugacucagcucuggaaacugacacgcacgugcuggcguuuucgauccugggggcacccgacagcguuuaggggucaagaauuaauauuaagagcuggagaacuaacagauccacauagauguccacuuuauacugccagcaaaacgggacagcaguugggugggauuuggccuuccugaggcuggcggcaccgucugugggccgugccaucacaaauggcucuaggucaacaccuccagccugcgugcacugcagcauccggaugccguaaccuggugcugcuggagccacacgcagccagggccggcaugggcagaagccggcggaguuggagccugucgcucugucagcccugauuugcgggcugagcccaguuuuguggcccugccuguaaucuccccgaguucaaagagugcuuagcugcuugucuuugucaagagcgcaguuggggaucuuuuaugugaaagauguagaauucucgggcagacuuugauuauuuauucaucccccuucgugggugugugaucgcgcgggcacugcggagccccuuguccuggcugcucuugcuaugaaauucauugagcuuuaaagcccuuugaaaguagcuuuuugagggagggggaaaguuuuugaagucuuguuucucucucccccucugcagugccgcagcaucucuugccaccauuccaugcgccccuaccgauugacaugcgacaccaggaaggaagguaccauuacgagccucauucuguccacggugugcacggguaaguccugcccucugccugcugcuccuggcgugcagucaccugccauggggaggcugggccggcagccucagccacaucuccugccucugucuuucuuuuggggguuccugaucuacauuguccugagcgggcgaucaccuuugcuaucauggccugggacccugugugagcaugugcgugggcaguguauaaacaccaaccacccccgagcccacaucaccacuuauaaggcucugggcuuccuugguguaucuauacaugguuuggagcucuuucuucauccaugaagugggaauccucucuaggucuaagaucccauauaaguaaggugaucuuagguaucuguuguuccagcauaauaauucagagcacccuuuuucacuucuucaagugucccccuuugaauaguaaauuguauagucaccauacuuaaaaggacaagcucaaagugaugcuuuggggcccuuccuauucccagcuuugaaguccccagguagaagguguggggucacccuguggucuccaccugccuaacccugucccugucauacccaccuggggccucuaagcccauuggcuggugucauuucuuggccuuuagggcucaaaagucuuggucucuggcuaucccauccguccuccuuccaggaaagaaggccccuccuucucccuacccccaaacucuccacugcuccccgcaccugccuccaggagagcucuuacaaaggucagccagccccaagaccccucucgacccagcaucuucaugcccacacccuccagcccccucaccuguucaugccaaggugcugucugugguucugucccaugucucugugccuggggccagcugccugcccagugugccuggaaucuccccccaacaggccaccuccaagccucaaccgaggagucaccuccucaggggcagugugauccuucacacugagcgggggcugcugcccucaauccacagcaucaucaucuguuuuugcaccugccucccagccagcucugagcucuccucucaccucugugucucaaugcugacaugaauagguguacaaccagugcucgcugaguggagagccucuccccgccugccgccaccuaugaaggcacauccuccuuccucuaccaucucccaucccagugaagucagucaacacuugcugggcccucacugugcucacagcauugugccucagcagaguccuguuuccggacacccauugccuccccaagacggagcaaaccugggacuucuacuuucuuuuuaaaaacuguuuuacuuuuaaauauuuuacucugaaauaauuaaggucauacaaaaacaguuccaaaaaccauaaaggcuuucuuguauaugcuucacgcagcuccucaaaugugggcaucuuacauaacccaagacugacagaaugcucuucacucacccacagagcuuauccagauuugcucaguugcccacuagugucuuuuuuuccugguucaagacccaauccuggaucccacguggcacuugguugccgagacuccuucgucaucuccugucugggacgguuccuuagucucuuuugucuuucaugaccuuggcaguuuuaaagaguacuggccaguuacuauauaagaugucucuggguuuggguuugccugauugaugcuguuucaugaugacauucggaucaugcguuuuggggaauaauacuauaaaagugauguuuguccuuugcaggcauccugucaggaggccuaugaucuucacgcuucucacugcuggaaauguugaucauuugguuaugggccugucugcuggcuucuccgcuuuaaaguugucccguucguaauuaauaaguauuuugugggguaauacuuagaggauauggaaauauccuguuucuuaucauauuuucauccguuaacuuauacauccaucgaugcuucuugccagaaacagucguuacuaguguuugccaaauggcgauuuucuguuucuaucauuuuguccacauuuagugguuggaauucuccuguaaggaaaagcugucccgccucccacauuucuuuguauauuugguugucuauuguuaugcacauggaugcaugguuuuuugugugauucuauggguuauacucuauuacuaccaauauuuauuguguucuuccaguugucccagauuuggccguuggggucccuuccaguuguccucugugucccguugacauguugggaacuuuuuguuuuauuucggugugcauaccugguucucacuugacuaggauccgcugccgcagccuuaugucugccugguggguguuggagucauuuccacccucugcucaccuccagggccccuccaccugcagguggcugagaccacagcuggagaaaccucuggaaggugcauguguuuggaacuaguugggccacccaaaaauugcccagucaguggugucugagacuccuaggagcauccagggagcucagucccuauuugggaggggguugcuguugcugauuucuugcucaugagucauguuuggcugguuccaugacacggauccugggcauagcaggccugccucaaagugcucccugcacgggauguuggucaggagaccugggcaaugcugagagcuuugugcagagacaguccaugcuggagugcuucugccugcaggugaauguccugguucaccucucccuauacaccugaaguguguagaggcaccaccagaaguguaggaagaccccaacagcgaugacugccuuccucaucauaacugaccuugugaaccggcccugcuguaaaugcuuuuauguguucaugccguuuaaucuucucaacaacccaaaaaagagucauuuuguguuuuuccauuuuacaaaugaaggaacugaagcagcacagaguggguagaugacuaacccuauggcucacccacuuugcaaguuagaaaucaaguuccagcccccugagcucaggcccuccgcugcaugcuggccuuucuugugggagcguaaguauggaccaugggucccucugacgaguccagccgagcccuucuugacagcaccucggcccuucguuagggcacugccccgaguccagucgcucccagaaccccuggccaagcagcagcaguguccccugggagucuguuguggguacugcagauccucaggccacagcccagccccauugagucagagacuccacggaaggggucugugucuaugugugccacgccuugcagguaaugcaguugcaggcuccagcuugacagcccuggcuacaggcagagcccccacugagaagggaggcccucagugccguccuucccuguguaggugggagcccugggcugggaaggggccugggucuucaccaggcuuugccaugcuccagcucuggguagggccugcuuccuucccuugccagugaggguggggugugcgcagagcacuuggagaagggggccguggaugcuggcaugcagcagggaggaguggcccagccagaggcccacagaaauggccuugucccucauggccuacacagcuccuucacugguuggauuccugaagagauuccuaaggcugcuguaacuaauuaccacaaacuucauggcuuaaaacaauguaaacuuauccucauaucauuccggaggucagaagucugaaauaagucuuaugguacuuaaaaucaaggaguuggcagggcugguuccuucuggaggcuccaggagagacucuuugacauuucuagguucuggagguugccugcauuccuuggcuuacagccccguccucacacacaucaccuuuucccccuugcucuguccucaccuugcccucuuccuagucugugggaguuuucuccccugcuucucucuucuaaggacaccugcuauugccuuucgggccuacugggauaauccacuuguggcucccauuucaagaucuuuaaaguagucaugucucuuaagucccguuugcuguagaaggaaacacuuaacaaaugccagggauuaggguguggauguucuugggggcuguuauucagguuauuugggaucacugagccccaguguggagucuggcaucagccuguagaauacaguaaaucauauuuauaauuugcaugggucugcagcaggccaggcacggcccugggcccugguauauuguacuggugaaucuuccugauugcucugugagauggggguuaagcuucaucuugcagaugcagacauugaggcucagagaggcacagugacuucugugugacaucccugcaagguaguuacuuccgugagggcaaggagaccaggcucuggggugcagaucuccuccccagccaaggaggggcuagucugguuaagccccagugaugggcagcagcauggugcucccagagccccccgucccuacgcgguccugcuggggugggcuuccagcggcuccacacuauccucaagacaguugguucccgccagacugagugggggacacagcaagagccucggggcuggcccugggcucuggaaagcccaugcccucaccucuuccgcccccagugucccaggugagaaccagggcaaagcuugugaggaaaauggccccguggcucuggcuuccaugaugaaugugguuggagcccgguggagaaucccgauccaucaagcccauguuguagcucgcuucucccugccagcaccaaaugugucuaauuacacagauguuugcacagcaaaugagguacggugucaucucauuucugugucagcugagccugagccugagccugcugcccugagcuggugaccauuucgugggugugcccgccccucagcccuugcaccuccugcuuuccacugcucaagcacccagacccccuccccguucccucucaggauccugauagcuccagggagggcgcacccagugugugcaggcuccagagagguguucccugcacucucucauucugcccugcccucugccccuccggaguaccuuggucaucacccaagagccugccauugucaguucucagccugccaggcuacccgcacugggacccauugccgaacccucccuagcugugauuaacaugaauuaacucaccucagcuuucucaucuauagaagggccagaucugcugagacaacccacauaacccagccaacugaguuauuuugagaaggagacaggguaaugugaguaaagcgucuagaacacuuuggaaacauucaauggauaugagcaacaaucgugaucauuguuguuauccucacuugcugauuugagaagggggccacggcaggcugggagacuggguggcagaggccggccacagcauguccuugggagaguugacugucuggggacuguggcacagaaggugggggauggggcugaaggagugcuguggugcgguguggugggggucuuucuuucccccaguugaggaauuuggacuuccuccuuuuggcaaccaggagcagcggggaguggucagauuuauuuucaggcagcuacagcaguaguuagggaguagacaggagaagggcgggaacuguggugagaggaccugccagagcugccacaguggcccuggggagaggggagcaggaccagggcugaccacccggcuguaaacaggcagcugcacguggggaaggcagggcauggagguuggugugaggacagccuugcagcccagcccagcucgauggccuccucauagacacccaagcccacuccucugcagagcacccuucccggucacuuaagguucaaaugcacagcaggcuugcauggcuuacugaugcucacgugguuccaggggaggaaagucaccacccacccguggacuccugcugcagugucuuugggcugugcaaaccacaagugauggggagacaaauggggcaggggugugugauugcuggucaagcaagguucucuugaagcccccauggggacaucccuaagucuccaagagucuguacaagggcgagaagagaaggccggcugugaauagggccacacacccccagcagucucuccaaccuugugacgcuaacaggaaagagaagcucuuuggaugcccucugggcccccugccucccagaaauaggcuugccagggugucauggggagcaaggcugagguguggcgaggaagggucccuaaguuggugcuccccauuuccucaguguauguggucacacaagcaugaguccggccugcccugggccagcguuaacuuguguccuggagaggaauguagaaguccaugcuccugguucggggggcugggguggaccuucagcucccuauguugcuuuugaggaccuuuccagcccugcccugcccugcccugcccugcccugcccugcccugcccugcccuggggcuucagagaagaccaauuucagcugcuuccugcccagaagggcguacagaaacugccccaugcagagguucccaaaccuggcugcagaucugaacacacagggugggucuuaaagaugcccauucucaggcccuggccccaggaguucuuguugauuuucagacuagggugaagcccggaaaucugcuuauuuacaggcgcccauaggccagaguuuggggaccacugcaggcgccgcugcuugcuugacguccgggaaagcagccccagagcugcuuguuggcuuucuggacucaucacugacagcgccucgccgccaaaacacggguuguuaaaaauccccugguuccucgugauaacccauucacagacaagucccuccuaaaccuauucauaugaccuaaaccuauucauauucucagcuugcaaaaggcagugaguguauggggugggaacagcugcaguaucucagccuuccuuucuccuccugccuggcaccaucugaccucugacauccacgacuccacccccgaccugaccacugcugauggcuuccugcagaucucuugauccugagcuguaguugguuugcauugcauuggcagucacggcccaaggccacccuuccuggaggagugacgagggggcucuugcuggcacagauggcucaggguuguagcuaucaacccaggcccagguauguuagggcaauagagugaacgccagcuggugggcaugggggccucaccucccuuucaucugcaugcuuggucacgcaaaaugcauauuacccagggccuccggagacagcauuaagagugucugaagccccacuugguccccgagacugcauguuaauggggauguuuagccgggugucggugugccuucacuuaagagaguaguuucuuugcugccacugggccgaacucaugaacuuuccagucuggggggauuugaagauugcuuuuuccaaggucagugucccauaaagacugcaccguucaccaugagauuaaugaacacagcagccugcucagccugugacucaccagugucaucccgggccuuuaugacucuguccucagucauucacugagacggguggguugagcagaaagauauuuucuucuugauucuuggcacagcacccgagguucacgauucauagaggauuggcuuuguuuguuuuuugggaagaaccuucuccucccucugcaaacaugcucguuucuuuucagagccuagaggaaggaggagacuuccgaaaggcauguccaccugcccccugggaugagaugcugggugggcccagcgucacccaccaggcaacuuguccuuccuuuccacguggguccacacugccucuccaucuccagggagcucuuccuuaaaaccggcuguugcugaccacuucuucagagcaacuggacagcagguagacagggagcccagaaacccuggguccaggcgaugugucgggcagcacauccuuccacggcugucugaggguagaccgacuagauguggagccuuggcucacugugauguaaacggcccugagaccccaucaggcaggccccuccccaucucugggcugugggauacuugggucagaccagcagaggagcaguagcaggagucugugcccagccgccggcuuaugucaugucacccucccugcaaggugggauuaucacuccccaauaaucacucccacuugauaauuggggaaaccgaggcauggggaggcugacugccuuuccagugacacacuccuaguaagcagcauagauuacuuacugggcauuuugaccccccaccccuugcuaaaaucuuccccagcucugagagcuucagauuccaaagccaagaaugcacucgcugggcugcgugggacagacagcucauuuauaauggaaucuggccuguaaaaguuuaacgaggagcgugugugauaagacgggcuggucuuugaucuuuacugaacgccaaagcccucgcacaagaggagcugcuggcucuggguuuuggagagagccgugguggucagccgagagcaggaggggccagggaguggagcaaaucuugaugugcaggccgaggugggcgugcagugggggaggggcugcggcaggaucgggaugaacuauucgguuccucuccugucccucgggguccccacugucggacauuuccccuccacacccccaguauguagacagaacaggguugaggccggggcucacaucuugccuaugcugcuuauacucuucacauccuugggcuugcuuagccccacaagccucaguggccccaucucuaaaauggggacauaguggcuccccaugugaaacuguugugaggacuagaugggugucuguaaagcauguagaagcacaccugggacauaccgaguggcggagagaccccugcucucaucacugcccugcuaacauuagaaggaaagccaaguuucacugcagacacccugcagggugcugggccagugguguccuauucaguccucccaacacccuguaaggugggggauuuucuccucaauucauagaggcgagaacugggcguucccagaauuuaagaacuucccaagauugcccagcuugugagaucucaccaagccagagcucuucccuaugccgugauuguccucagagaggaaagagagucucgccaugguucucagggcugcaguguguuguuucugucugcagacauggaaacagaacaguaaucaacccaaaggaauuaaucacuaacaguaaaguuucaggcauuggugggguggauuggccuuugagguggggaguccucuuagacugcacauguucagacuguccacucgguggaagcugacgccacugccagaugcauucauuuauucagccaaacucauuguugcuggauuuauuguaucccaagugcugucacuugaggccacuccugccagcccgagucaagguguugcugagggaaaaugugagcagugcccugccccugaggcacugcuuaaaaaggucagaaauugcugcugcccucaagccucugucacugcagccagcacugaugguaugucuggugcccgucaaaaaguacgcuggacaugucaggagccccaucccuccauccccuccuuccaaggacugcaccucugaaauguacacuuggccugugcugcccaaacaaaguagcaagaguucagaguugcuuaacucaguggggaauguucuuaaugcucguuccucugaggacacucacccagggaccaugugugccagccucaugccaggcacuggggauacgggcccaaggaggcacagucuuuuuuaauagaauuuuuauuuguauaaauuuauggggugcaaguccaauuuugugacaugcauagauuuuguagcagugaagucaggacuuuuagaguaucuaucaccugaauagugugcauugcacccacuaauuucucaaacuacaugccccuucuaccuccaggaggcacagucuugcugcccacauagaccccaugaucugguuggggagagggcagaaauuggccaaugacagggugguaugcuggaagaggggguaugggaagcccagagcaccaggaauacaggaacagaaagcgcuuaucagcggggacgcaugaaggccuccccccacgucccagccuuuccccaaccccacccacugggggcccuaccaccuucuucagguugcccuguuccaaugaggggccuccacuuccaggcagacaccagugccacuaaggaggggaaucuuuucaaagcacauacucaugaaggcuugguaaaaaucagcagcacacccaccucgaagaagagauauaugugagcugcucaggauucuccagcuaguuuugacaggcauccaggaaaggaaauuccacacaccacuuuggcaggcugggccagaguuuaagaaucucacuguggaggaguuucuauccagcccgccggccacccaggcccuuucucaucacuaaaacccaggccuccagugaaauauaaugaaaucucucccacuaacgaaggccgcuccccacaaaccccacucccaagacugcacaucuuaucuccuauuuccuuauucccgcccauggcuuuaaacccuugacuuucuggaagauuugguucagcagugcucagcccauggcagcuucuauuacagacaaagucccccuguacucggaggucaguggugcaguucaccuggagagggccuaagcaggaccgacucccccagggccuccuccccggacccagacacauuccugguuccacugcacagaaggaguaaacccaaggcuuccaacaggccccacaccucacuccuccccucccuacccugcuccaccaaugucuucacuuugcuaggaaaaacgucucccugauaauccccuuaucuuuuaugcuuuuuggguuuucuguuugcaaaaacugauaaccuucuuauucugcucccaggggaaaacugauaaagggugagugcaugaaucaacuguuguggaccacguggcuagauugcaaccaaguccaucuguauugccuccuuuguaggcacaauuuuauaacuuaauuucccuaccaaaacaucaguguuuacuuaguaagaaaucugcucuuugucaacugaaaacggugauuucuuuauuacagcucugcauagggagugacagcugaaagcuggccaggucuggugugguguccgggucuuugaugggaacggggugagugcaggucgcauauaugggaugcguguuugcugcagacggggcuagggcuggccuggagggagccuggacaacagauagauguuguggccaagagggcccauggagugaucauguagacgacugagccucagaugauuuccagcagucacacacauucaccaccaccaccagcccugaguuccccaccagcgccagcccuguagccguccugcucccggaaucccuauccacucagccaacuuaaaccagagacuacuucuacccagccauccuuuuaaaaaaaaaauuggucuuauugauuauugaaaacaugcaaaagaacaacaaaaguggccaggugugguggcuuacgccuauaaucccagcacuuugggaggccgaggcagggggaucaccugaggucggaaguucgagaccagccuggccaacauggcgaaaccccgucucuacuaaaaauacaaaaauuagccaggcgugguggugggcaccuguaaucccagcuacuggggaggcugaggcagaagaaucacuugaaccuaggaggcggaaguugcagugagcugagauggcgccauugcacuccagccugggcaagagcgaaacuccaucucagaaaaaaaaaaagaacaacaaaagcauguuuaagauaucugaguaauuaugacauauacacccuuauccccugcucacucuaaggacugaggacaugccagcaccuuugaggucccgugugcuccccaaucuccugccucagguccuccccaucccaccauucuuugggauucagaguuuaucaccccucacaucuuaugacgguuuuaccuugugucugacuccccuaacaauguauuaauucguuuugcuuugucaugcuuuauauacauggaaucauugcagagguauucuucgggaacuugcuuucauacuccacguucuuccgaagauuuuccugcuaauguguagggcucuucauucauuugggcugcuccgaagcagucuauguugacuggcauuugggaugugucuguuuuugcuaauuugaacaugacugcagaaacacuuuuauaccauccucugggccccaagugcgggguuauuuaagguaaaugcaugucugggaauggaaaugcugagucacaguggauucauguucucacccuccuagacauugccagacuucgcccgcugguuuugcuaacacucacucccaccagcagaguuugagagcuggccuugcccuguauccuugugauauccuugccccaucacuuuggaggugauggccucuacauuuuaauuuuugccaaaauggcucuuuucugugauucuaauuuucuguuucccuuauugcuaaugaaccuugaguguucuuucacaugcuuaugggccacuaauguuuccuucuugggaaaugucuguugggcuauuuugcccauuuuucuaugaggucgucuuuuucccauuauuugaauaaguauuuugcacacuaagguuacucauuaugugguuagcaacauguguugugaauauccucucccaguucgugccuggucucuucacugccuugauggcagguuugggugaagagaaguucccauuguaaaauagcucagguagguuaccgacauuucuacuauguuuuucccugcauguucuccucccacccagaugucuggucagaccuucagccucuggacuauagugguuguuccccaauacaacauguccuuauucagcuauucucccaucucagaacaccaggccuauacuacucaccaccuccauuccauucucuuauaagagucugggcacaguucagaugccaccuccugcaggaagcccucucagauugcaccaacagagugggugaauuauuuuccucccaccccucuuccugcuccagcaccuuguauacuguuagaaggcuauagucaguguccauucucucucugugaccccagagguccuggcauggugauucggccaaagcaccagugugaacuaugggauugagggccugugauuuccugagcucguaacuggucuugggaaugccugccaagcagcagcacccugucuuaccaucaccauggcuucaugggcacucagggggucugcugagaucugugcacuuguggauucagaguagaccuugggaauguggggcauagcacuugucagucagguuugcagccaccugcccccucacuaccugggugcaugcggggcccuggccgggucugucucagaaccccagcuccccacaccugcucccucacuaccugggugcauguggggcccuggccaagucggccucagacccccagcuccccaccaucagugccaucagaggcccaugcucaguaaacaucagcugauccgggggagugacguguggacgcagacacagaucagcaaugaaugucugcaaacugcggccucagcucccguacacagagccuccccaugaggacagacugccaccagacacacaggagagugcagauugauaaaagacauggacugcgcuucaguuugaggaagggacaguucuccauuguuuuccaaaagaauuugcuguauggcucuuaaaaaaugcaaauccccuuaguacauuuuggaaaggacuugauuucuagaacuuuuuaaaacaaauguaugggaaacaugguaagcaagcuugccaguguacaguuucaccuacaaaaccaaacaacaaaacucaaaccaacaaacgaaaacccuggggaggagauugaauuccauccagaggagcguucuggagcucuguuucuauuugucgguagagccgaggguggcaggagcuggccuugcucuccagggaggcccugggagagcagacacaugcacgcccuguccuggcaguaagaaguuccaguuuggggaggaagagaugcagggcaagcuuuggggacuccagcuuccuuuccagcaggucagugggcccagaggacgccugcccagcauuucugaggaagugggcaccugguccugagcagcuccgcaacagcaaaaaggucccagugucuccacucuggagcuccguggacccacccauggcccugugauccuggugggugguaggcaucuuggcccaaaggcagggcugguguacacaagccagcgguuccgaggcaggaggaaauggcaugcuggggcugugugcuggguggauucuggcuauggggagucagugaccaugaaauccaggcggcaggggggaaagcccgcuccacagcccugugcacauggggaugggaacgcaggacucagacaccuuccuccacccagcacaggaguuccccuacccugccagccugccucaaagggagcaucuacuggaaccugguuauuccgagcaauaaauaggagcccugcuaagaguuuagucucagaagaacgauggcacuagugacggugaugucugccaccucccuagggccaacucuaggccaaugcaacaugcuuuccaugacgaguucauuuccuggggcugcuguaacacgguaccacgaacucaguggcuucaaacaauagaaauauguucucucgguuucagaggucagaaguccaaaaucaguaucacuggaacaagaucgaggugucaccagggcugugcacccucagagacccccaggggagacucuguccuugccuuucccagcuucuggugcugccaacuuuccuuggcuccuggccauuucccuguagucucugucucccugucgcauggccaucucaucuucugugucucagaucuuacucugcugucuaaagaccccaugauggcauguagggcccacucagguaacccauaaucuccucaucuccaaauccuugucuuaaucacaucugucaaaucccuuuucccaguaaguucuuguucacagguuccggggauagaacauggacauaucucugggagaucucaugagccccccacgugccuucccucugcuccucacaacagauuuguaagaucacugucguaacuguucagagacggcacauacgugcucccaggcaggagugagcugaggugagccgggacccaugucuucugcaguagugucugugcucuucccuggacacgcucccugcuuuauucauucauucauucacucauucguucacgcccucacucauucauucauucauucguucacgcccucuuucauucauucauucauucauucauucacucauucguucacacccucacucacucauucauucauucguucacacccucacucacucauucauucauucguucacgcccucacucacucauucauucauucauucauucagcacacacguauuugagcaugcuguaugucccuggcaugugcggagccaggugcagggccagcguaugaacagaaacggauacaggagacaggaggccugugagcucacagcugaggauaucuggucaucagcugagauggacgugcucaggucagaggaaggagccaccuaacacagaagcaccguaggaggauccugaccuugaccuggggcuagggggcaccuugggugagaggucccugagcuggcaccucugggaggagaacaggaguuaacugggggaagggaugaagaggggaagggcaugacuggaggugcagacaucaaagggcaaagcugugagaggcaagcauggccaaggaccagagaguggcauacaggacacagaggggagaggcaggcccuggccacaugggauuguggccccucgccugcugccacugaggucauaagucacccugagaagcaggcagguggugagauuuguaggcucauauccccaagugacugggccuccuuuucucuucaucagcaacagcuguuggaccagucugggggcauccgggugccuguguucccacccgcugcugccgcuggccucacuguggccaugccccuggugcuuugggacucagcagugcugucuguuaaaugggacaugaaggagcuguuccugccugugucuggccccagccaccagcacagaucuuggagcaaagccaucucuggcaugccaagggugggcuucuccucugacuccaacccccgagugggacagcccgcccugauggcuggugcugagucugggugagucagcagcccucagcuccacauuguucagcuucuccaagcaggcaccgaggcuggggugugggggccccaaucccugcacuuccuucccuuucucucacaccuuaaggaacaugccgguucuugcccccacaccuuggcucaggcggugcucaggccagaugcccuccuuucuccuccccagcccucaaagucuuacuuguuucucaggcagaagcuacacaccguccagguacacaucccccaucauucucacucccagggacagcacccacuccgagggucuggcaugcucgcuuaggcccagccagcugcaugcugaguuacacauggcugugcagagugcucauuaccuugaccuuuuaucucccaccaaaaaucucauggcagcagauggggaaggguccugggauuugaugccgaaagguguggccugggucugcugcacucucugagcugcuuccauuugcucaucugcuagaugagcggggugagcacuaauugagcaccuacuaagugccuggugcuacacugcaugcuuuccaugcuuggcucauccuaccucacagcugccccaccugcaggcaagggauccugaggcucagggcacauagcacugaggcugcaacagcaccaaagccaugauucagaccuagaucugugacuucagaguccagauucugcuuaucaguggggguggcccccucagucugcacugccccagagucaccuuggggaucagcugaaauuaggccugccaggggaccaccaagccaaccuucucgagaacugagacagcgaggguggagccagcacgagccugcaucuggguggaccauuagacaugucagugcccaauccaacuucacaggggcagagaggcuggccuucuacucccacucggccaccuccagcucugcaaccgugggcaagucacaugacuuccuugagucucaguuuccuggucuguaaaauggagauaaugaaaucugccuugcaggcuugcuggauguauugcacguaguaggcguucugcaaaugcugacgacuuugucagcagcagcagcaucccuguggcagcagccacagaguuaacacagcagccaugcagugacaccucaguuuacuuuauccauucucccuuuuccccucuuccuuacuuccauucuuucuuacuuccccuaaccaccaugcugacccuugggccugguccugaaaucccauccaagggcuuugccagggaucucccacuagggagggagggaaagagggaagaggaaggauccugcuaaggagaggccuuuccuggcacugccugcagccuccuggggcaaggacccaaucacagucagcaggccagaaccaacaucgggaagaagcauaggcguccuccacugcagcggagucagccgugaggccgggcuccugcuccuuguugcugcugccgcuggucgcuaacaugugcacagcacacacacacacaaacacacacacacgaggaaaaggggcuuugguugguuguccuacuuacccagaguccccugcuugugccucaugcccagacacagaaggacaugcccagcugcacccuccagccucggccacugugggcaggauguccagggacccucuccuguucugcagguggguggauggacaggcccgagcacuuauggcuggggucugccuugcagggugccaggcccaggaucauucugggcagugggaagcugugugggucaagaaaugucuuagcucacauaacugagaaggccaaggauacuagcuuuagacagagggacucaagucaagaaacuggcucauccucucucagcucugauguucucuguaucaucuuccuucuugggcucuccccugcauggccuccagcagccccacgcuugcacccuacgagcucagcaacccuugcggacagagagaaccaaagacucuagccaaagcugcuguguugggcacaugccuaucuuugaaccgaucacaguacuagcaauauggaauacauugaucaccugggcucaggucauguguccccugcccagagcagcagaaaggaaguggguucaauauagacccagcccaaagcacucugugggcugugcccugccccucaggcauaaccuucucacacacacacacacacacacacacacacacacagcuuugugcuccagccuuucuuugcacacacugcuuccuuuguugguaaugcacuaccucgugaacuccuauucaucccucaagacccagcccuaaugucaccuucucugagaagccuuccugcacacuuccaggcagaguuagagaaucacuccucugcuggagcccuuaucauacugccugguaauuaccugauuucaugggucugccucuuucccccugggcucugagcugccuacaggucccuaggcacagcccuguugggagcgugaagaaauguaagaaggaacaacuggucagaucaggcucagacgagcucugagcuggacugaggggagaaggcaaugcauaggggcaguguacugagcugagcggccugcagaagggcuggcugugccacugguugauugugccaugggagugugugagggugugcacauguguaucugugauguaggagacugugaccaucuuuuaaauugagcucaugcagccagcuccuccucccauccugaagggcgucucuuugagucucugccuagcugucggaauucaaggacuggauggccguggcucacaccaaggccgggccccugcaguacagcaguguggaaauggaagaagaaagggagguugcugcuggggucagccugaaguggugguucagacuucaccaguagucgccuuuccuggugaagucuccauggcucaaucgucugcucacuggcgcuggcaacacugagguaucaugagacccucagcuggggccugggaugggggcaaguguccaagaaagaggggcacuggacccugaaggaccugcugugugguuuggcaaugcuggcguguuucagggcugcugggaagcgcccucaggccccacaugccugugugaugcuggcaguucugccagcucuggcccauuccucuggcuguguuuagucugucaaaaugaccaucucugggaacaugugugccccuggauccuuagcggucaucacaacauagugggguugggggguuccagcucccuacccagaguagggugggauuguaugugaugaccugguaggggugggguggggaccagagacagagaagaagcugaaacgguggggagaaagcucuccugcccucagguacugcccccucccuuauccuguccacacccugagcccugcuuaccaccaaccagugucaucaagaacgcccacuucccugccagggcacaggcaggggcuccagcccagccccaccuggguugguugugguucuaccaccugcuaucugggcacccuuggccaagggaccuagccuaucuggggauguucccauccacaagaugggcauaaagugccuguguugugaauguuuuauuugaauucacaaagaaaauaugugcaugugccccaccgauggcuggcacacagucagcccuacccuggggagauaccagguaagagcacggcugugaucucacuggcccugugcaaaagagacaucucggaaggcuuccuggaggaagugucuagacagucauugauggcuacgauggccagugggccugucucugguauugugugcccuggguuuccaggccagcagacacucuauauuccaaauuggcuuguugcugaggagagaaggaaagggaguuaaugcauauaaacccccuaccaggugcccggcccuggucauuucacaccacccuggugaggcaccagagaggagcagcauucuggcugaggcuacacagccaagcgggaaggauuaggaagccagugcccuugaagggacaggcagugccaggugcagcauccugccccaccuugcugcaucccgagagcauuuguaucugccuccgggggauggcucuguggcucacaucccccucuucaggcccggcacugcagccuucccuggcacaggggaagagcaaggguugcuccguacccuugaguuggaccuguuguggaggcuggccugucucuccacugccccugauagaaucuguucugggguaggauaguggcaucuuccagcuuucugucuggucacaccaagggaacagucaguccuggacagcagugcugugauggggcggguagugccucgaugagggagucccagccugggagugaggcccgcuggagggagcuccugcuugccucucacuggccgcacagcauggagaaugacuccccugucuggaugcagugugcucguggucaagugcagugguugguuccauuuuuccauacccuccugaggggcacacagccggugcuuacuucaugggggcugccaugaggauauaguccaggcaucccugcagagaccccuggaugucccuacagagcccagggccugagagaggaaaaggcugcccugggcuaccccugggcuccugacucccuuggugaugcuugcggugggaagggggagguggagucuaccuuccccaaaugguggcaacugcaccguggaggcggaagucccagcuccuccaugugugacccaggccccaccugccaucuccaggcccagcugccuccauggcagccccagacaguggugugcauguggcugugacaacaccucacuccgggccucucaggggaggcucaccuggccagugggaccugggucaccuuggacagacugggccugcuguguggccucaccauguagcuugaaauccccacgugaucaauggcuaucgcagggggccucagcugugguuggcacaccccacagggcaacccuggugccagggaggcuggcauucccgggaccugaacaagccacguagggccaccggcaucugauuacaggcuacugugaccucaaacccuggccggcauccugcaggcucugggaaccugccgugccuggagugucuggggaggaccgagaagucaggacagaaggcaccuuagcuauucucucagccuguagacacccugcauuuugcugagccacacucagccuuccagaacuuguauccuucagcccaggucugcccccaggagccauagaggcgugauguugucucagagccuucucuucacaacccacccaucccguggcaggaugugagugucauccugcugcagucacaggcuggagcccacaggaccugcccuuguccaggggugcauuagucuggucccacuucuccucucccgggcacacauagcagcccccgccuaggcuaaagcuaucuguuaagcccuccgcauuucaugcaguucccaugcagaggcacccaccucuacaggcaggcugugagugagaacgucuugagguugugacuugugacuuauuccacagucucccucccauugagcucaguggcuggcacacagacauguggcugucacugauucugaagguaccucugagcaccugcaugacgccaguuccaugccaagugcugagcaugcagaagagccucggacaugcccugcucccaggcagagccugggaaccuggcagaugcaccugucagcuugagccuggaacagugcacccuuggggagcagagagaagggauccugagccaagagaaggggcuucagggagggugccaccugcugggcugacagggaugagaaggaguuugccaccacaguauagggugcaggaaggcauuggaggccaaggauugguguaggcaaaaaggcagaagcagguucgugggaucuacaugagcagggcagucacgucugcugaagcuagacaaccaaacugcggaagacucccuccaggccuggcacagcggccucccagggggguguuugugaaacccagaugugaggacaucuggaugucaccuguuuggguccugguuuguacuguacuguaagcccaguuuucaugcacuauugagcaugaucaguaauuaucucugguuugcucagccaacagacaaaucauuuccucccugaaauaaccaguuccagcaguggccuuucacacguccagcaucaauccagugugaagauugggagggccucccgggcaaugcuagguuagcccucaaagugugguucuaacccucuaacagcaguucuccuuucaugacugccugccaugucucuggcacaguuuuggggacuuucauccucacgacaacccuaugaaacagacacuauuaugauccccauuccacagaugaggaaacugaggcucggagagguuacagugugauguggcugggauucuaacccagguuugucugauucuaacacacucucuuuucuuugcacaaugucaaauuauagacuaaagaauaaaaaugaaaucuugguaaaugugguuccuggugacuuagcugugguuuugcagcugcuucaccauaaagucugauucaucuuuaaugagugaguuuuggaguagauuaccucaaaauacaccugcagcugcauagaggccccaggucagcaggccugacauaagggccugaggucacaucgaauggauuccaugacucuuggugggcggacuuggggacaugggggugggcccuggccaugccagcccaagccagcggcaccaagcccaaugcacaccugacuauuggggcaucugagaagggugguucuguuagcgcuaggaggaauuccauggaaggagaacgaggagauauuccaagauuuuaguuagggcucaucaauuucaaaacuugccuugaauccugacccugcggccgagcuggucacaccagcaaccaaccauccaacugaagccagaaacucuccacuugcaggacaucuccugaucccucucuuuuucacauauccuguuagcaguaugagcucuuugcguuuuacccgugguauucguauuuucauauucguuuucauacauguuucuagcaugcaagccugugccuagccccgaggaggcacuggggaagccacagugcaacugugacgugugggcggccugcugugcgugugcuccagcaaguccagucgcgggugcgagguccauucuccagcguggaacuggccggcgggugcacgcaccagcguggagcuuucacucugcauucacugacuaaugcuugagaguucagacuguaauucacagaugaccaggggaaugucgguguagcaaauaauaagugcagguuguucuggaaagucuuuccaggagagacaaggacuguccauguugguuuuggggucuuggugggguucccucuguguccuccuucuuagacggcugcccauugucucugcaggcccccugcccucagcggcagcccugucaucucugacaucuccuugauccggcuuuccccgcacccggcuggcccuggggagucccccuucaacgccccccacccguacgugaacccccacauggagcacuaccuccguucugugcacagcagccccacgcucuccaugaucucugcagccaggggccucagccccgcugauggugaguaggguguggggauggggaggggcagcuagggcacuggggcagggcgcagccagccucucucacgcuaacacugucaacuccucagccuugguccccuugaauggugaccaggcuggcuggcguuccuucacacuacuuccaaacaacaaguuuuuggguuuuaugcucauuaaagagccuuugguaagcacucuuuugcaugcaaaccauauaugaucuauuguaauaauaacaguaagggucuauccagguagguccuguguagcugagaaccacugguuguaaccaaccaaagccugcagaagcugguguuaggaaaggggauguuguguuggagugucucaugcagaaggaaggcggagugggcuggcugcugccugcgucucuguuggaucugccccuugcagguuaacgcaggaggccuccaaguggcagcccaggcccuggggcuccggggaugaagcuguggcauuguguucagaugccugagagagaacauugauuggcccggcucagagaucagauggccaccccggugugacuaauuucagccagaaaagggcagggucacaugguacaaauaugucuuuauauguauaaagcagaucuaaaguuuuacacuucuaguccccacccaccccaccaacagacacaugcaaacacauauuaguaacccggacauuuaggggccagucccaccaugccgucucccugggaagugcacccccauccauagcauggcauggccccgugccgccccugagagcgcuguuagccacucauuguccccauccuugaaagcagccaagugcaacuucucagaauucacgaagcuaagacuugaccucucaggcuagaggacaucugcaacuugaacuucagagccccaugggcagaggcucuaggaaauggggucccagcgagucucuuaucacuaccagcauucuccccgagaggaaugcauccucuuccaacuggugggugugaccacgaguugaagcggaggccuggcucugagaaugugcaggcugggauugcacgaugaaaaggaggcauccaguuuucaaaugugcagaagggcucccugaaucguugacucaucuuccuggcacggagguuugcacuuugccugguccucacaaaagagaaaccaaacaaggcaaauaguuguagccagggggcuugaaaauggcuagcuggaaugugacaccauucugaaauggccccucaagucagaacucagcccugaacucugcgugcguccccuguguggccuugaccaagcuggggugcccugaggccugugcugccucuaugcccagcugcugucuuguuggacagugggcccagcccuauccacaucacuccugaggucccagugcugggauuauaggugugagccaccaugcccagcccaugaugggcugaccaagagugagaggacacaggucagguuccagagucugccuggcucacacuaacacugucaacuccccagccuugguucccucggacagugaccaggcuggcguuccuuccuacuacuccugaacaacggguugauggucacaccuaguauggcagcugaggggugccccccaaaacacagguccauauccuaauccccaaaccuguggguauucccucauuuggaaaagcagucuuugcagaugucauuaaguuaggucucuuaagcugaagagaucaucccagauuauccacacaggcccuaaauccaauaacagguguccuuacaagagacacacugagaaggcagacacauucaugcccgcccagagacacacacagagucacagaggagaaggcuaugugaagucagaggcacagaugggaguaauauggccacaagcaggaagcuggcagccaacagaaacuggaagaggcgggaaaccaucuuccccuugagccucuggagggagugcggcccugccagcaccuuaauuucagauuucuggccuccagaacugugagagaauaaaguucuguuguuuuaacaacaguuaacacaaaguuuaugcugaucuguuacagcauuugcccugggaaacuaauacacaugguaacagggcuuccagugaagagguggaaggaaccuggcugcucucccagggccagggccagagggccaguaaagacgucuacgggaggaaggaacagagcacccuccuggagaugcucaggaagcagagacgcuguauuccacugauugcaguguagcccaugaagagcugggugggcugggcacaguggcucaugccuguaauuggauuuucggaggccaggugggaggaucgcuugagcccaggacuucaagccugcagugagcuaggaucgcaccacugcacuucagccugggcaacagagugagauccugucucuaaaaaaaaauuuuaaaaaggagcuggggguggugagacagagcugccccuggaggagaggccuucgacggauggagugccaugcuaugcaugaguucaagauaaacacugagguagcuccuggaacacccacguacccgcuuacagccccacgacauagcagggaccuggcuaauuugcauggcccugacucccacaggaaguagaccagauacgccaaggccucaucagcccuugggcuacuaagugaccaaggauggcagauuaggcucaagagcagcuggcaggaggucugaauucgaguccugugugcccugcucgguaucagccccagagccugccaugugagguuaggaagcucaucagcgauccgaggcaguguuggccagaccaugugugacuggggacaaaugggaucuccacggaagguuuugagggaagguggguaggcaggaaggaguaggggagggaacuugaggcauggacaggggaggcagaggcugugggcgaucagccuggcuggaggcccggacucuugggagaugcagcaggagauggcaagaaggaggcagaggaggacggcagcuuccauggccuggucuccucucucugccaagugcauaagagagcucuuuuggaauuugucgagacugcuaacagagaggccguagugcacaguggcuaggagcuugcuuccuagauucagacugcccucuuugcacaccuguggacucuugaugggggugcuagguuuccaagcucccauuuguuuccugacaccacccugcugagggccagccucccucagaugcucugaauuucauccucgcugcaucuuuccuaagaccugggcagggcugaccucaggguugaagcagacagccccgaggcucugcgcugcagggauaaggaugugugcaggccaggagcuuuaucuggccaggccuggcgccccggcagcgaucucacccugaauguucaggcacagacugaccuggcccagccgcgugccgcugaagugccucuguuugcaccuucuuuuaacuuugaagacucugcuggacuauggauccuguuggcauggggcuccgggauucugaggggcauggaggcagaguagggagagauuguuuaugagucuaaugaagugguggaguacagaggucggggucuggccuccuucagcagcaacaccgcagcucgugcuggccaagcccaggcccagcacagugcaaacaguggggcagugggggaaaaugccgaggagagaaaccccgacaccaggugugcauuucucucugccuuuuuuuuuuuuuuuuuuuuuuuuuuuuggcaggagaaggcacagccagugccagguucugacggcuucuuucucuccccucugcccacaguggcccaggagcaccuuaaggagaggggacuguuuggccuuccugcuccaggcaccacccccucagacuauuaccaccagaugacccucguggcaggccaccccgcgcccuacggggaccugcugaugcagagcgggggcgcugccagcgcaccccaucuccacgacuaccucaaccccguggacggugagugcuggcccccaggggcugaggauggggcuagcagaucuccucuugaggcugagaaggucacucgcuguuucuuuuggggacaaggacccuuaaggagaggucgggcuguaccccaaugccuuccaggauggcuguccacaggcacugaaucuuuggacaacacuuacugagucaccacaggccaggaggcguuguaagcaucgcagacaccacagcaaacaaagcuggaacuuacagugcaauggggagaaacagaugccaaguagcucuaggaauuacguaugaaaguagccaauuauaaauggaccagggaaacaaagcaggggcggggggagcgagcacugggugaguggggugcaguuuggaauggggaagucagaggaagccucacugggaaguugaaaucuggggggcgagugcuccaggcagaggaaacugcagugcaaagggccugaggcagcagugggccugccaagcucaagaaauagccaggagccagugcuggcagugaggggugggagugggggugaggccagaguuuccagguggggucuugccagccagugcaccucagaagagacuggcuuucacuggagaugaggcugggcagaggagaaaagagagcugacugacucacagaaggaaucuccuuccgugcugaugugagaauugauuugggggcaagacggaggcaggagguccaguugguagagguggggagaaggggccaggucuugggaagaccuugaagguagaaccacaggaugugcucccagcuggaauauagaguugaaagaaagaagggaguugaaguugaccucagggucucgggccugagcauuugaaggauggaguaguaacugagcugggaggcuauagguggggcccucauggaagggagggaagucagguauccuggguagaugaagcuuuuggugccuguuagacacgaaguccuucccacccuccaaaugccauccucacagcugcuuucacagggacaccugugacccucugaccaugagccugcggucagcaaggagcccgucucaaggaauaguggagggaguggaaggcucagcacccccucccaucccccagucagcgccacuccgccugcagguccuggagcccuggccagcggcacacagggaggcagggcagccaguaaagcuggaagccaccacagggaacaggcaggcaccuccugcagagccagccucccggagcccugccugggguggcguuuucacucccugauagcccacggcagggagacaggagccugcagggagaccguccugcaggggcagcccuggugccugcagggccgugcagccuguagcagguuggggugggcuggugggaaaucaugugggaccaggcggggccaugagacucagggugggcugcugccuugcucaccccgacccgcccccagggcucuguuccaggggagcccuucacuucucuaaggccuggcugacaucucgccuccuccaggaagucucucuggaagccuccuccuucccuuuccccugccccccucagucacugggacagcucccuccucuggcugcuccuucacucuuugccuggcccaccucauacuuacagcaaccaccucacauugcuccucagcuaucuugaacaucuccugcuucccaggaaaaguuuugcugagaagagggcggccaaccuccgaggcuggccccucauggauaugguccucgccaggcccuggugggaggccauaacaugccucagugaugccaccagaauuuggucccugugucugucccguucuuccuugccuuucccagcaugguguuuaguccagaauuaagcacaccauccagauguucaacaacaccugucagcucuguaggacauugacgucccucugaguacacacacauccaugugcucuguuccccucuccucucagcagcccuacacggugcucccacaagccacagugaggugucagagauacugagagaaaguugugugcuagacacgcuccuugccaauauuagaaaccaaacagcagcaaccgagugcaugaaggaucaugugcaaauugccacacccgaaugucagcuuccugcaagcaggacccuucuuccaagggccugaggguggcaccaggccaauaggaaaguggacgaggcagagaaaccacggccaagagaggugagaugaggcagguguccccacagggcaggaaaggcuaagccaggcagccgggagucauccagugauuuucagcaugagcgucugugugugcacguguguguacgugcacacgugagagacagugaauuggaaugcagacugccucuguucugugcuuuuaaacacauucuuccauguaauucccuuagccaccuucugaggcuagaaauaugcuccuuacuuuaagaugagcaaaugggcucccagcaucuagcggcuugacccaggccuugcucuguuuguuaccagcaccaucugcccuucccugggcugcaguuuucagcagcacaugcaccugaccaaccaugagcccuggcccaagggagggccagccgggccagguggacuugagcucagcccagagcagcugggccggagccagaggggagaaguaguacagcgagcuccagggcaggccugggucaggccuggcugcacgguguccucccugugguagcugggcucagagguggugacaggacugaagggguguggaguggcaaucccaagcccugcgagcuguguggauuaaacacauugacugagauggcacaugugagccuggcccagugccuggcaucuagcaggugcuggaauaaugcuggugcaggucucuuuccaccaguauaucuuucccucuuuaaauccacucacucuugcaggauucuguaucuucauuguaggcagcucuguccaccugcugccuaagcccaggccccagguucucccagaccuuuuccuugccaucucccauccaucccauccugucccucaggccuccaagaguggcgugucaccccucccgggccagacagugacauaucgcccucguagcacugcuccauggcugcugcucauccagcauccccaucuuuauccucuccgccauccugcgcucagccccugccacuucuagcccccucaggauaaaauccagacuuuagaacccccguccagaggccuuccucuccagcucaucucucuccacugcacacuggucuugccaugcacugccccacaugcagguccccagauaccucccugagcucauuccugcacagaguccugugcacggugcgcuaggccuucuccugagaccccacaagaauccagccccaggccuuucaagccaccaacuagcuccacugcacuagcgggacccaaggcgcccccaacuggaacuggcugggacuucuccuuacguauggccgauggcccgcccugucaggucugggagcacaucuggcaaggagcagguccucuguguuuguugggugagugagugaaugagugaauggcacuuagaaaagacccuggaauggaaagaugcgcuccagcuaaggaaagaagcacucgaggaauguagcuguuggcucacaggggacuggaaggggcuggggagcaacuuugccuuccgggcacucagcauuuggcagccccgggggcugagcaucucugggaagcagcagaggagugcagaggugagcucagcagugggcgcgagagcucccagcccuccagcagcugcugguuaacucaucacaccccacccgcugugccuucuccaccuccgccuugggaacacaucuggcuucaggacauggagguaacggggaagcaucaccagauuccagaguccaccugaggagggauaucaguuucuccagcuccaguauggggugggggugggagcauuuuucuuauccauggauuucaggagcagaugccuucuuucccuuuguucccagucaguuacaauccaagaaaaucagaguaguccaggauuaucuccuauuuuuauugcuacuuaauacauuuuuuccaaaaccaguuucaacuagaaccagaaccuucgcuucaccuuuuaaaaaugcuuuccgcacuuccacuuagcuccgaggccuguguggacgguuacucacguaugucucuaagagacgcugaacacaacaccugggcucucagccaggcggcucgggcuggaccugucuguggggugucccccggccccuccccucccgugaaccaugggagcuggggagguguuuucggugggugccugcuccaugggucugugccagucccucccggaaagcuccagaccacacagcagagaaugugaaugagcguuuccacuagguuucuuuuugcucaaauccucacugagaaaauugugugggccaucccuggcgccagcagugcagcucaggagaccuguggaaggggccuggcucucucugaggaauguguguucacaccaggaagcccccauacacaucaucuugagcaugugagcucugugcaggcgcagggggccuggagagcucauggacagccaaggagaacaggccuucucucucugccuuucucugucguugugucucaugcacacacgcugguugauucggcagguguuuauugggcaccuucuauuuaccaggcucgguucuaggucuagggacgcaacgcaucaugagcagcacacaagcccugccuuccuggugccugagcuccagcgcagcccugugugaguuccugggcgggaccaagaaugccugucccgaccugacgccccucauaccccagccuccuuucucagcaccuucauucauggucccagaggagggagcacuguaggggagagaacuuuccagagguuuugaauguccagccaaggcauggagagggcucugccaggcaagagggcgagcagggagaggugggugggaacuccauguggguccucauccugcagggccuuguccccaguacaccgguuugcaaaccaccagcccaguuuuuaccuuagcugagugccaccugcacaauuguguauuuaguaauauuuuuuaacagacucaccuuuugggguuaaauaaaugguucuucaaauggaacuuuguauuuuuucugaaauggaaaaccuaaucccugucugaagaggauguuccugucucugucuccaucaaaccuaaaguaaccucaucugggccauguguggcccuacauuugggaacacacugcagugguggaagaaaggccagaagcuagagaggccucuacggggcucuugugggauuggaaagccaagcccugcguuccucccagggcacugaggccagggugccggcaggacagagggauuucccaggcucugaugaaaacccacccucccuggucucccaguggugggugaaggcccauuuccucuuguuuuuaaagggguccugauuuacagcaggaagacaggagcgcugcugugugggaaggugauagagaaccagucagggaaccgaggucaucauucugcugagcggcucccuggagagcggagaauucacugguugucacccgggcccuaaaauggaauuuucucauguuaugcuguugaauauuggugauuuaacgacagaacagccacccccucccccuccaccacauugagaagauugagauguuuccgacugaaauguugucuguuuacugcucauacugccuccaagccaugcauuuuauugucauauugacacuaauuuggcucggaugucaccuccauucugacgccuguucuuuaugcugccuguggauccgggggguuuucagaaaccaauuacauugaucaaacccagagaggcaggaagagcugguagaggggcugccagaggcccaagucagacagggaucccuuuccgagacaggaaggggaaccgaggcaaaggaagccacauugcaggucccugcgugagaugguggagcugcuguguacaggcacgggcuaagcggugucuaugggccaucugguaaagccacacagacugucccgccacaccagcuucacgaagccgcuucacaggagccugcagcacagccuguuucucuguguucaucacuuagcuaggccgugguccuggcaacucugagccucgcugcuccacggcccaggcgcuugcuacucccccaucagaggggugagagggcuguggauggcuagguguggggggcauuaagguccucaggucagauuuccuuagagcaucuccucggcaagccagaaaauaucugggugagggaguugggcuaugcagggaacacaucuuagccagugaggauucaggguacccgagccccaccaccaggcugcauccugcuggccuuguauuuuuuccugaaauggaaaaccuaaucccugucugaggaggauguuccugucucugucuccaucaaaccuaaaauaacccagccccgggcugaggauggcaucuggcacagagaaggcuccugggaccaggugccaggaugaugcucuuuccuccugccccucagcccaggcuccugggcacacaggccguggggggauccccagccccgauuccaugcaaguccacccacagguauagaugauauguugguugucagcccauagcaucccuggggugggugcugguagcccaucuucugcaugagacaaccagugauuggcucaaagcuacccaguucagagugugcaagcaggguuggaaccugggucugccugaguccagggccuguucuugcaucuccugcccuuccuacugccucagggaaaacaaugaucucccuccugagcaccuugggauucucuagaauaauucugcuuagauggcaccuugcaaauccugccuggugccucggaguacugucuucaucucucuccuacauggugagcuccaugaggacagggucagaggcuucccugcccagaguccccaugauguccaaucaaugccuggugugcucucagcacuacacgaggggcugauggaucaaugaauaaacaugugaaugagcaacagaaagcgcuagugggugaagcaagguccagaggcaggugguguuggcguccgcccaggugagggugggcagguggccagucacccguggccgaccggcauuaaaacaggcgccuccacagaugaauacuccauguucccggucauaaaucacaggagaaaccaugggaaaugagugccaggcuuuucuuucuauuuaguaauuuaucaagggaagaggcgcauuaauaaacauauuucccaugagaggcggggauaacagagaugaauaucacugucagauuuggccuguuuccucuuguuaggggcacaugagagggugggaauccaaauauuagcggcagauucuuuuuuaaaaaauguguuacgaagauguguguguuucuuacuuuauaucauguuaggugguuuuuccccucacauuaccguauuugccacucaguuuguaaguaauaggagccuuucagagaauucacuccugcaucuuucuuugaguuuccuuugaagcgaggauugacaaggaguggacucaguaaauaaaaacccagaagcugagagggcgccgaaugcaagccgaugagugaaugucuaaugacagcuguguugcugaguggcccaaucaucuuuccuagacuugcugcccuucacuccauuauugacuggaggcucacccugccccuuggaacaguccuccuggcccuugaagaagccacauucauuagcaauuucauuuuggaaugcccgcuggguuuuaggcacuauucuuggcauucuaugugugucuucacaacagcccugcaaagcaagccacacugcccugauuguacagauggggaaagagaggcucaggaaagcuaaguaaaugugcuccaaggaagccacaaagugacaggcuugacagggacaguggcagaggcugugugccucugcaucuugugugugugugugugugcgcgcacgcgcauccaccugggguaugugucuccaccuggggugugugucuccaccugggguguguguguauguguccaccugggguguuuguguguguguccaccugggguguguguguauguguccaccuggguguguguguguccaccuggggugugugugugugucuccaccuggggccccccucccaugcagggggcccucccugugccuuccugccgucauacucccugcccccugagacaccucuccuccucugcacccugggcauaggcccuguggcaggugguuuuggugucccuguaccuugggcaaguuacuuaguguccuguuuugucuucuguaaaaugagcauaacagccccuucuuuaugggacagucgugaagauuaaauuacuuaacacuuuaaaguuugaaggaguccuagcgcaugcgaugauagcauugaguaagugcuguguuuaggugacugugaaucuguucuuucucaacacauccugucugugccaugggucagcccuuggcaccucccacugggcucauggcugugccaccuguauucgaguguuggggauggucaggugggaaaaaggauuugggcuccuaaugcauggugagaaagacaggagcaagcagauaaccacacaguggaugaaagcucacccccacccuuguuuggagagagaggccugagcauagggaagaucugcccaacuccaggaggucagggaaggcaucccaagggaggugaugacucggcugaggucugagcaggcagaggaagcugcacgugcaagucccugagcagguguuauggaggaggggcuggaaggagaccugguggcuggagugaggagauuccacagggccaccgccuaggccuucuuuguaacagcaguggggauuuuuggaaaguuuuggggagagggcagggacaugaucuuauuuccaaguugaaaaucugucuuugcagugagcacuguggauuggacagcuguuagcugagggccccagaaugauccaagcaaguggugggcugugcuagggguggaguuugaaaggagagauuuugagaggcguucacgagcccacacguaagugggcuccauugugguggaggggaggagggaaggccgacucccgggucucccgcuuugccacugcgcaaguagcaggcacgugcuguaggaagagcugguccaggcacagggcaggaguguggggcuggcugugccaaacuggagcugccuugcagacaggaggagaggacgaggaggcagcuggcucugagaaggcucacucuucagagccacugaaagugggaggucgaaaaguguuugugggacgggacguccgccuggcccugggccucugcugaccucucugaagauggacagagaagacacagagucauuagaaaguccagacaucagggcuucuuuggaccuggguucaaauccugccucuguagcucugugaccuugagcaagucacugaccucucaagcauaguugcuuugcugcuuaucugguuugcuuggaggauggugguagcuguuaaaugagucaguggaucuaagcgucacuaaauggugguugucacugggucauuauuugcauaagaauucagaagcaggcauuuauccagauacugcaucagaggagcacgcuccagccaggaugcagaugcugcagcagaggggcacacuccagccaggaugcagaugcugcaacagaggggcacacuccagccaggaugcagaugcugcagcagaggggcacacuccagccaggaugcagaugcugcaacagaggggcacacuccagccgggaugcagaugcuguaacagaggggcauacaccagccaggaugcagaugcugcagcaaaggggcacacuccagccgggaugcagaugcugcagcagaggggcacacuccagccaggaugcaggugcugcagcagaggggcacacuccagccgggaugcagguggugcagcagaggggcacacuccagccgggaugcagaugcugcggcagaggggcacacuccagccgggaugcagaugcugcggcagaggggcacacuccagccgggaugcagaugcugcggcagaggggcacgcuccagccgggaugcagaugcugcggcagaagggcacacuccagccgggaugcagaugcugcggcagaggggcacacuccagccgggaugcaggugcugcggcagaggggcacacuccacccaggaugccccuguuugccguccaggaucccuauuuagagugggugaucacauuugcagugcagccucacagcuggcugggagguagccugcuccaugggccucccugcuucuuucuguccucaggcaggugaccuaggauccuuccugcuguaagagaaagaaggaguugucugagugaguuaccugcucugcccuggccccucuguggggucagagcaagugggcauccccagaagcaacuauggaccgucuucuguguacccacuguagcucugcuuacuaaaauaucuguaagccccagucuucauagcccaauagaauaaacagcgaaagcagaaaguuuagcugacaaggaugucaaaagaaaagaauguucugauuaacuccacuuuuuuuuucaacugggagcuuuccuaacaucacuuaacucuucucguugaaaauaaaguauaccaaguacugggucacaugaccaucucaacuguagccacucuggagagcccaggccaccuccccauccaucaucccacugggucacagcaaccccagagcuggcagggacuuguuuuaugcuggugucauugaugaagaccccaagucugugacagguaaaacaauuugccccaagucaugcagcugacuuauggcuccagcccaggguacccggugugcagcccccacuucaccccacugcaggccacuguuccaguccaggucuccaucccucuacccagagucccuucaucccaggcugcuggcugucuacuccccucuguggccucagacuccccucaucccaugaaagaggcuguuaggagagaaaacccuggaagccccuuucggcccaaugguccuggauguccucuguccucucuaugccuuggagaggugcuucuccugguggccuggcaggaaagagccuccccagggaucccuaggucuccucaggguugcagccaagcuuggggcugggccgggcaugguugccucgaggggccaacauggaucccagggcuugcggcuuguucaguaggugggugcgggcucugcccucacacagccuucuuggggacugguagguguggaguggggggcucagaggcucguaggccaucacccccugcccucggugcuccugcagcuguggagacauaaggaacugccacgugcaugauucagaguggcccuaaggucaguggucaaagccaucaggaaagcuuugggagcacccgccaagaggcuguguguacugugagcaggaggcccauggagccagacccugcagucagggcagccugccuggaggagggggcacccaggaggggucucagcaggucugagcaggcagaagggaggaacgcaguuaucauaagccugggaacagccaagcacagacaugagugugcuugagcaacccccagcaucauuuaugggcaacaccaccagcccauggggaacccggaggccuggaaaggaugggugggcaggggccagcgggacaugagaagaggcugcuccaugcagguguccagaaagucaaggacaggcccaagcauuuacugugcccuaccaugggccaggugcuucucacgcuucgccuaauuuacaccucaugccagcccugguggucagcacuauuagagcccuuuaaaaagaggagacuggcucugagggaucuggacagggcaggaagcuuggcuuguggagagucauccagcaguguugucagaccauuucuaggccaccguuuguucagggcagagaccuagaauccugaugggggcaccgugauggggagcagucuggaaccacaguggaagagccuuugguucuagggugcaggguacucuugucuggggcaagcccucuucccuuccacaguuauguaggugugcgacagcagcuggugagggcugagggcauagccauguguccacacauaugugugcauaugcauguguacacaugucugcgugugggugcacacaaguguuugcaugcaugggugaugugugcaccugcguacaugugugccugcaugcauguggugugcacauucaaagcaacagcuucccagagccucgggcgacuuuagaacugaggaccucaguacgcagaagcaccugccugugucaggaugccucucgcugccauguccucguguccucccugcccuguuacagcaggcugcccaguaggcucuggagagacagccaaaggcccagacauugcgaagagucugggggccgccauccaggccucugcuuggcaaaugcccuaucagggggcacuuuaguggugauuccagguacaacgugaccugugaccuuggagcacuuacuuccauucccucucuuccccauggaauucuccauagcagugggaacaggcaagcuucugccacacacaauagcauggagaaaucuuacaaacugaccauguggaugaaggaggccagauaugaaagaguauuuaaaaauuccauuuacacaaagcucaaaaguaggcaacaagaagcuguguguuagaagccaggauagcagcugcccuugggcuggaagauggagggggccuguggacaauggccaagcacuguuucuugaccuggggcuggcuucccaggugggcuaacuuggugagaggccaccgaacugcucacuuaugauucgugcacacuccugucaugagguaagcauugcuggauuccagcccuggucucugcacccagugguaaauacacuaugcucagugcucauauucacucgcccaaacaccuuacaugcacuucuccaguccucaccacacccugcgcugcucaguccauuuuacagaucaacaaacugaggccgagaggugacauccuucgcccaagagcccacagcuggaaagucggcaaagcuaggauucccauuagaccauccuugcaggcucuuccuaucccccacccacaugucacccccucccccauccccagugaugcugaccugucuuguguugacuaucccacagugucccguuucuccagcccgcgggugacgccccgccugagccgcaagcgggcgcuguccaucuccccacucucagacgccagccuggaccugcagcggaugauccgcaccucacccaacucgcuaguggccuacaucaacaacucccgaagcagcucggcggccagcgguuccuacgggcaucugucagcgggugcccucaggugagccccgccugcaagcagagagcugaggaccagagcugggcugagggcccgguggggaggcgcuggcuuuucagugggcgcuuuugacccgaggagaaagacaggaccuguggcauuugugaauccacauacuugcaccuuuuuuaugaauucaaaaccaauaaugaucaaauugaaaugagcccauaucugaguacaucuucauggaccaggccugucaugaaugacucaaaugugaaaucaaagguguuugaggucaaagaugguuuuccuaguauuucacugaauuugguggagcagccaaguauuggccaaccuuggagaccacacaaaaugugacauugacauggcccaugcucucagcaagccucugggcuggcagcaggccucccucuguagccgcaugguggcacacccaagccucacugacaccagccacccuucucccuucugugcggcucuagucugucugaggacucagaccccagccagcuugacugaaacucacaugccucuccagcaccuccggaagaggccaggaggaguuaggaaugucaggagaguuugucccaacgaccuggagauggaaggaauaacaaguguauuuguuaucuuuugcugccuaacaaauugcuccaacgcauagcaguuuaaaaccacaagcaauuguucucuccccccauuucugagggucaggaauuugagacaggcugagcuccggcucucucagguggccacagucaagcugucagccagugcuucaucccgccgaaggcuugacugggccagaaugcccccucacagcgcucucagcaguguccuuuguuccucaucugugagccucugcuuagggcugcuugaguguccucacaacauggcagacgggucccagcccaccuugcagccuaugaugugagaggaagcuggaggaagccacgaugucuuuuacggcccaaccacaggggucaccaaucuuuccuugguauccugcugugugaagguuggcucuuaugcaaguggugugacagagccuagaagugcaguaagaagaggagaauaaugcaagcuggggggcucagggcaagauuccuggaugagggggcauuggaacaggauucggaggccucauggguuucacguagucagggagcagcgauacagacaugcgucuagguaucacagcaguggagaggccaggguguggggaugagcuggagccuggucccugcugggagccagccugccaggggugaagucuacauccuggggcagaaccugggagcugaucgcagaaggugaguggcagacaguaggaagccacagcugguucuugagugaggaagccacggugaugguggggcuagcaacaugcucaucccuauccccugggcaagguucucucuguccaggaagugucagccuaagagagcucccgaucccccacccccacuuccuugucugcucucuguugcagcccagccuucaccuucccccaccccaucaaccccguggccuaccagcagauucugagccagcagaggggucuggggucagccuuuggacacacaccaccccugauccagcccucacccaccuuccuggcccagcagcccauggcccucaccuccaucaaugccacgcccacccagcucagcagcagcagcaacugucugagugacaccaaccagguaggugggugcaggggccaggauggccacuggguacucaucuggacacaugaggguuguucacugccagcucaugcuaagaacuuguggagggccucuggauuuacgucuggccgcuagggugccuucugggcagaggccacguuacagaaagggugagaccugggcucaguccaugggaagcucccagcuucuugauucugccgucuccuguccaagaagcauaauaaguagauggagaaagccucgauucccagggccuggcaccauggaggcacuccaugcacagcacauagcaugggugggugagugaaucauuauaagacugugcaguuucguuguagaaugugcauuugcagcaggcuuucacacacugccucauucgacccuuccaacgggccuugagcaugccugggcauccuaguacagugccuggcacauccuaggugccauuauuauuuggcaaaugaaguguucuuuuacaauaaggacauggaagggcacaggccuuagcaucagucagaccaucuuugggaucccaacuugccugaaagcagcacaucucuuucccucucgcagccugagcuaacuuaucugcagagugggauuccugaugccuagguggggucacugugcauacaaacaagcucaugugugcagagcccccauaggcucugauccugggagcacugacaacgacaaugccagaggugaagggaccaccccaggccacccaccagcaaauggcaaagccuggauguggcuacacccuuggaaggaagacaggacaccauguccucuagaaguguccucuguuccagaauguccucccucuccaccccagggcuccugguggcuccccagagccuccccacgacaguggcugucagcucuggaaacaucaccugauacuuuagcucuagccccuucuccugaggaacugggcucuggcccccuaugcccugggcuggccaggcccuguucucagacccacaguguccccugcucuggagggcugagaaguugagccuggucagaacaggagcaagggcacccugcauuuuccaaagagaaggucucuuucccauuucccagaagucuuggggaggcggugauggagagauggggguuggcaugcccaggucugggugcucuccuguagcaggacaugugccccuggcaggacugagcuggggacucuauuucugauacuuuaaacacaggguuagcccagauggucugugcggagagauccuagaguuaaaguccaaaaaaauuugggauaucccugcccugccccugaguaacagacuguccucugcacccuuccucagaacaagcagagcagugagucggccgucagcagcaccgucaacccugucgccauucacaagcgcagcaaggucaagaccgagccugagggccugcggccggccuccccucuggcgcugacgcagguaaccugcugccagccgcaccaccuuccuccagcuaggaccaggcuugugggcugccuuggggcuguacccuugguggugaacggauggcuggcuggcugccugcauggaugaaugagugacccagggaggacugggugggaaugcugagcugugacuuucucaccacuguguucccagcacccuggacauacuacauucccaucacacauggugaaugaaugaaugagugaaugaaugaacuucugccuagccaucccucuugucucaggcugcaucugucucucucucgccacaccugaccuguguacagcaccagccacagccuaguugaguugcucacguccccggaauggcccaggcccuucuaggcugcugucgcucuuggaacucuaccccacccuggcuccuucgcugccacuucagcccuuccugauucuccugggugauaggacugagcuccaggcccacacacccagccuagcucaggggucacuucagggcaugugcugugugcacaccugucucccugucugcacucuaagcuuuggagagguggcgcuaugggagaagugccugacuggguuccaugccaccaggguuugugcaagugugcagucacugacacaguauuuuccaaugauucaaugcacauuugagucagugaguggcguggugaggggggaagacaggacaaguucaagcggggagagaagagcggagcagcccacagcccagugcaggccuaccacguggcccagacccugugcugauccuuuuggaaacuuugccacuuauuucuucugcuccaagacagcaugcgggcagcccccacucugggagcaggggccugucuuguaaagggcaugccgugccuguugaccugguaaguaagccccuggucccccaagcccucucaugguggcccagucuucauucauuaccacagaagccgcaucuuggacaccaaggaugcucagggccuccuaucccugucuccccugcaucugccgagcauccuuuaucaaaacugugaaccaucaggcaugcucugggcacuuaauuuucaugaaauauuggcuucuguuaucgucaagcaagcagagagguugaugacaaauucuucuccccuugcugacaccaaagccggucucagcacgaugcaugguuuccacggggccgaccaucaucgggagccaaugaaauugaugaggacggcacauauccagggaagauaaacacgccagaaaggcaaggacagggccggcaggcaggcacugagcaccugggagccccauggccacacgccgguagggcccuaugcccgcccuccaacccuggccggccauacagggccuccugccugcccagccuggcucugcgcacgugucagugcaaggaaagcuguuuaucaugaggagguuguccccccgucgcucagugucccgauucacugaccaaggacucccugacucauuuguaagguggauggcugacuuccaggucuucucaaagaguggagagggugaugggaggcccucugguccacucuccccauggucucaccccaacagcccccagacgaucccauugcuaaagaucuggaaaggaaaugcucccacaccuuccuuugacuugcucccaauguagccccuggagcuauuguacgacauguuguugcuuuccuguugggaacaaguggauucguugaaagguccuuugagaaacaaucaggaacccuucucggaagaggucuuugcagcucuuauggaaagucagguggaguuugagucuccauugacagcagggcguccugaggcuaauuucuuccauucccagaaagggacucagcauuaggacugaaauugugaccugggcagcuaugguaccacucauugaguccccggagccaguggggguuaggccuuuugaguauggggcgagguccuucaucccccugagccugacuauacauguuuuccccagagacuauucugaaagacaacauuuuccugcugguuuuggagagaguuugaagugcgaagcaaucuugguaacaucugccucuuugcuuggcuuugcucccagccuuccuagcagaccaguggaauacuggggaguccuugacagcccuuguaggcccuccguggacuuuccgucccuaccuggaguaugagccucucccugugccccgaccccaggcagguaccuccuaccuguccucauguucucugcucagagggugccccugguuagcaucagugaggguagggauggucuuguggguuaauucucagucuguugccaguuugagagaaaaagacuuuguccuuuuugacgggaauuucagggaccugugaucaggugaaggaauuucagguaccugugaucaggucaaggaaugucucaggggucuuuccuucgccucauuaaaauggccacaugggcccuaauguggucaggggacucaaguccagaccuaggcugccucgagcucacuguguauucauggggagggccucggauccucccuaucguacaagaaugcagaugcccaugcguuagggcuguggcagggaaaacugguuccccacagcacuucgaugaagacaagugugcacuggagaggaaggaggaagggccccaggacaggccaucugacaaggagagcugugggcggggcugaguugaggaaaggagcuaaaaaggcugaugagugugugugugugugugugugugucugcaugcauguguugugugugugcacacacaccuguaacacacacacuugcauccacaccuguaacagcccaggguccuuggcacagaaugcaugggacuaacagcgaccucuuuucagggccaggugucuggacacggcucaugugggugugcccuuccccucucccaggagcagcuggcugaccucaaggaagaucuggacagggaugacuguaagcaggaggcugagguggucaucuaugagaccaacugccacugggaagacugcaccaaggaguacgacacccaggagcagcuggugcauguaagcuuuugaaccccagcagcccgccaaccggggcacggcccaggccaugcaggaugcugagccuuccagggccucuacuagacagaaggggcuggaggaagagacccccagagaugccugggccacauccccugcaagugggaggcauaauuacuuauguguguccugccuguuuuuaagauggcuuccaauacauauguaauacaaacaauuaaaagaaaaaauaaguaaaugagacugucagggaaaagagaacaauaaagugaaaccaggaauagaguuaguauuaaaaaccgagugcuuugagcuauauucuauauacacauuuuuuuuuucugagauuccuaauagccagugcaaagagggaaauacgauuaguuaaaccagccaguaucuacacaauaauaagugaaagaagcuucucccaugaaggaaggaguugauccuuuccuuuuggggacuauucacagauacccaguggauaugggugcaggugggcgucuacacccagaucagagaggagguugcuuaacagugccugaguacugacagcucaggugauuagagaugaccaugggagccggcgagaccuucaggauaugccucuugguccucauuccaaacucucauacugcagcgucccuuauauggcaguuaggggugaugugugcaaugugcagagcagaggcuuggcacgggagacaccuggcuccaaaccuguccccaccacaaccagcugagugguucugagcaagugacuccaccucugugagcuucauuuguuuccuauaaaggggguugaugcuaccccacaggagggucaaucauguuugucagcacuuagugccuugcagacauuccgcaccuagcagcucccuccuuccuccuccugccuguuccccacaccagcccugagugguucucucuucuccauccagagaagaacuuaaauucaagaaagccaccucccaacuccccagcacaugcuccuuggugagugagugucuauaaagaugaacccacuaaauuaguagcucgauugcugggaagagcagacacacacgcacgugcacacacaugcacacacacacaugcacgcgucuccgauucauauucagaagcuguccagaggcgcuugcuucuccccagcucugugaacuuagcauuuaggacacgccgacucccucugcuucuuccacuuaugcaacuugcucacaaauaccguagguuucuuuuguguuggaguuuguccucccaaacacaguucucacccagaaggccagaauuucccagcaaacgaaugcagcuggugaagcagggucuuaucuaaccccuucuggaucucaaacuuaauuuuucaacuuguaccaccucuuugggguaaacaagcccuagauggagcagggaccguggagcugugaguugcagaacaaaucaguuagaugaaaggaggagagagggacagucucucaggccaggggaaggccaaagccagagcaugcagaugaggaugucaaagacgugcucugugauaagugggucagccccaaagagcaggcacggaauuccucagaugaaugcggaggguccccaaacugggaggagggcuuuagccaggggcuucugccugugcccuggacuguccuggagcuauagguggccaccuccaccaggcccuggaaaaagcagaccccuucacccagcucugucugucugucucucucuguuucucucugcucccuggaaagauggauggagcaggcgcacaggcgagcuggagccccuggucgauuauuaacaauuuguugcuaaguaaaccaauaagaaaaaaaugaaagccauugucaggaagcauuuuuaucauuugaaaggcuuuaaaaauggaaagugaggcuaauaugauaagauuucccuggaaguucaaagcgcuggagauuucacaugcuccagcaggggcaucuguacgcgugacaguugggcgagucgcacagggcaugagggccuggcaguuuucugucuucuggggcaaggugcugccagugccugaugcuuggcucuugggacagccucuuuugguggcagaguuccacagcagaauguccagcagaacaauauuacaggccacaaaugccagcuauccauguaauuuacauuuccuaggagugcauuuaaaaguaaaaagaaacaggugaaguuaauuuuaauauuuuuuauccagcccaauauaucugaaauaucauuuagcagguagucaauagaaaagaaaguuauugagauauuguauauucuuuuuuuuccauucuaagucuuugaaacugguguguaguuugcacuucuagcccaucccagcucaggccagccacauuucaagugugcaagagccccacauggggcaaguggucacugcauuagacagugugggucuagagguugugggaggggggcugggaggaagugaagacgggggaggaaacugagaacagaggaggaaggggaggccucuaagaccugaguguccuggccucgccaccaggcuggggaaguaaacccagccuuacccgagauacgcggcaggguuagucgugcugcgcuggcugucccaacucacuugccuggggccguuuucucccaggauaagcuucacacagugcccagagcccaccauuaaggucaguucuggcuccaccacgccgacugccagggcccugugcaggccacugaacucucugugccuuuguggaaaggggacaaagccauuaucucaugggucaaugccaaaaauagagauaagcauguguuauuuuucuauugaaacaaaauauguuauuuacaaaccucugaaacaauaggggcaagcuuaggagaggcuucucaugcacccacuacgggcacguuugccucgcugcgguuagugccuacuguuugcagccugggagcgucaucacaccagagcccaggcugcggugcacaggauggcuuugcccaauauagacggucacuuugaggacugauuggaaaaugcagggcagauaagcggcacgcaguaggccuucauuuaagggcagcuagugaugauucaugaggaggcguggcccggcucguagggguggucuuguugggucaguggucugcguauaguaggugggaugggcaaugaggagcacggucugaacauaauagguguggucagcaggguggauggucugcacacaggucggggagggcugggggggugccggugcagguggucagcugacagcaggggguggucugugggccucuggcccugcuuacccucuucugggcaugucccuccggcagcacaucaacaacgagcacauccacggggagaagaaggaguuugugugccgcuggcaggccugcacgcgggagcagaagcccuucaaggcgcaguacaugcugguggugcacaugcggcgacacacgggcgagaagccccacaagugcacggugaguggccuucuccccacccccgccgcagcaucaagacuggccugucagccaggccggggggaucauguuuggagguggcuggccacaggcacaccuggguggggcagaccacagcaggggcucugggacaggagccuguucccacccugccuguuuggguccuggaggccccucgccucgugccgucccagaccuugauggacuugcucucugggugugagcaucucgguaagcauggcaaaaaugugugggugugucugugauugugaguccaaaggcauaucugcacccugcaguuugcuuggcugggugacgcugggaagagggacagcuccauagugcucugcagagaaaaaaacaucauuggugauucagagcuugagcaaugauggguuaaaaugguugaggguuuuuuuguuuguuuguuuuuugagacagagucucacuuugcuacccaggcagcucauugcagccuccaccuccugggcucaggcaauccucccaccucagccuccugaguagcugggacuacagguacaugccaccaacccagcuaauuuuuguauucuuuuguagagaugggguuuugccauguugcucuugaacuccugggcucaagcagucugccugcaucagccucccaaagugcugggauucgucuugagccacagcucccagcugaguuauuuuuuuuuuaagugagcucaaugauaagaccuuuucuauggucuccuuuagaaggucaacaggauuuaugacuauaguuggagagacuuauuuuuuuaacacacagaaacugcugccccacaaaugcacacgugguuucagcuguagcugaaacaucugggaacuccuuuuugugaauucuuguuucauagauucugagacauacauuuuguuuucaccuuaauaucucugaagucagacugucuuaaaaucagugguguccaggauccaaugaaauaugcuaccuuugcuggcaagucaguuuuuuuauugagaaauagcugacauaccauaaaguucacccuuuucggaaaaugugcaauuuaguuguuuuuaguacauucacagauuuguacaacaaucacuacuaguuaauuucagaacauuuucaucaccccagaaagauacccuguacucauuagcagccacuccuaauucuguccuucccacagccccuccuaauucuguccuucccacagccccuccuaauucuguccuucccacagcccuggacaauuacuaaucugcuuucugucuguauggauuugccuguucuggaaauuucauaaaaacugaaaucauacaauaugugcauuugugucuugcuucuuucaguuaacacguuugcaagguucaccugcguuguagcaugcacgcguacuuucuuucuuuuuguggcugcauaauacuccauuguauggauagaccauguuuuguuuaugcauucaucaguugauggauauuugcauuguauucacuuugaggcuauuaugaauaaugcugcuaugaacaugugcguucauguuuuuauauggacagaacguuuucacuucucuuggguauguguaacuaggaguggaauuggugagucguauggcaguugaggaacugcuagucuguuuuccaaaaacgcugcuccauuuuaccuuuccacccacaaugaaugaggguucugauuucuccaaauccucaccaacacugguuguuaccugucuuuuuuauucuagccauauccuaguggguauaaaguaguauuuuauuguguuuuugauuagcacuucccuaauuagugauuaauaauguuaaacaucuuuucaggugcuuauuggccauuugcguaucuucucuggagaacugucuacccaaauauugcccauuuugaaaccugguugucuuuuugcuguuaaauuguaagaauuuuucauauaucugguuacuagacccuugucagauauaugauuugcaaauaauucucccauucucuggauuuucuuuucauuuccuugauacuuucuuuuagagcacaaaguucuuaauuuugaggcuguacaauuuuuuaauugcuugugcuuuuagcgucauagcuaaggaaccauugccuaauccaaggucacaaaaauuuaccucuauguuuucuucuaagaguuuuauaguuuauauagacuuuuauuuauagaaauauugaauacuggcacucugaaaaauuuaaaaauuaaaaaaagaauauauguguguauagagaguuuuauaauauagcucuuccauugaggucuuugauccauuuggaguuaauuuuuuuuuuuuuugagacagagucucccucugucacccaggcuagagugcaauagugccaucuuggcucacugcaacauccgcaucccagguucaagcgacucuccugccucagccuccggaguagcugggauuacaggcacgcaccacacgccuggcuaauuuuuuguauuuuuaguagagacgggguuucaccaugauggccaggcuggucuugaacuccuaaccucaggugaucccccugccucagccucccaaagugcuaggauuacaggcgugagccaccacgcccaggcuggaguuaaucuuuguacaugguaugagguagggauccaaacuuacucuuuugcaugugauuacgcaguugucugaguccauuugcugaaaaauuguucuuuccauuugaauggucuugguauccuugucaaaaaucaauugaccuuaagugucuggguuucuuucugaacugccaguuauauugccuggaucucuaugucucucuuuaugucaguaccacaugcagucuuuauuacugucaauuuguaggaaguaaauuggggcauaugaguucuccaaauuuguccuccuuuugcaagaugguucuggcucuucaggguucauugcaacaaguuauuuucuuaacauccucaguaguggcaaaccauagcccuuugaugauaugagcugugaguuguggaaacagauaaaaggcguuuggagccaagcaugcucaaucagacuggucaggaauaaaggggaggaugggaggaaugagacagcuccugccggguguacguguccuccugagggcgguuuucauacauccauucaaugcaaccacaguaucuuuggaauagcugcagagcuuccugcaaugaucucuucuuucuccccuuccucccuucuucccucucuccccaccuccuuuccuuccuuccucucucccuugcucccuccuuuccuccuuccguccuuuccaaaaauguuucuugagugccuagaugcuaaauauuaggaagacagcaaugaacaagacagaagauuccugcucuauggagcugguauucuaguaagaaggcuggguaacaaaaugauuaagaucauuauaaaucgagccaagggguauaaaggagagaggauagaguguugugauugagaauaucagaaaaaugcucucagaggagaugaccuaaaagauugagagggagggaccugggccaggaaccggauugggugggggcugcagaaguuuccagccagaggggucgguaguaugcagaggccccaagccagaaagaacuuaguggagucaaagaacugaaaggagaccagcauguccaaagugaagaugaggguggccgacucacucaaggacuugaaggacugaauuuuauucucagcauguuuuagagcacaggacaauucuaaccgagagugguacugggaaacaguucaaagucauaguuuagaguuuaaugauaugggaauaugcugcugauuuaaaaaaauagaguauguaacugaauacuugacauguucccaauuuugguuuuaaagacauguggagaugaauugcagacucaccagaaugaaacuuaccugcgugucagcaguagcagccccugggcgaccggugguuuucauuuuucucuuuguaccuuucagcccuuuccauguuuucaggaaaggaaaguaauauccuuaaaaugcaugcuucugagugcgcugacggguuggagcagagcagagaaggggguggggaggaagcagcagccggccucaagguugggcccccuggggugccuugacugacugaaccgccuccuucuaguucgagggcugcucgaaggccuacucccgccuggagaaccugaagacacaccugcggucccacaccggggagaagccauaugugugugagcacgagggcugcaacaaagccuucuccaacgccucggaccgcgccaagcaccagaaucgcacccacuccaacgagguaccucugcggggcaugcacugggcaugcacacuggggccccacugacgccccauggcuuccaggcaucuguaguccaguagauagccaggugccccaugucccgcccccgccacugaccagcuauacauccucagauacagaccaggacucuuugagaccuagacagaccggucucuuucucuaugccacauccuuuccucuaaaagaugccccgugaggucccauggcauacugacccucucugugccucaauuuccuuaucuccauaauaaauauaauagugcccuccccaaaggccaucaugagguccucgagaguugaaguugaagcagggaaguggcccuucugaucucggaguguuuaacaugcaucugcucccuauuacuuggggcugcugggugggcucugccuccccauccucuagaugaggaaacgaagacucagagaugaagugacuuuccccagugccagagcagugaugaucccucugcagcugugaaaacauccugggucacugcuccccacccccaaauucccuuuccaccacaagcagguguuccacuggggagcagcugccccacugccugagggaagcagagcagugcugucugagcuuggcguuuguugguagcccccuggccuguuggcuugggcagccagcagugacaugcuccagcuguuagcgcugccugggccugccguggcugucagccccagcagauggggcacagagcagccucugucucccuggguaggcagagccccuaucugggcugagagaaccagggagaaagcagggcaagagccgguggcauccuggcccagccacacaauuacugucgcucaggcuuacucggaaauguauguuuuuaaaagcuuagacauauccuggaccccaaagggacuuugcuccaaugcuuguaagaaguuagaggaauuuucaaaggcaucugaaccccucagagucucuauggacaagagccagccuuagaggggagugugugugcacauguguguauguguguuuguaaguguauguuuuucuguagacgugguguguggggugugugugugugugugugugugugugugugugcauguuuaugaguccaggacugagguucggaaauccuggguuuuuucaccccauuacuggaugacuuggaaccuguuccuuugccucccugauccugccuuucuucaucagagaaaucaggggugcuagugcugucagaggguacacugagcucguacacuugcuacuaguacuaaaaaccccacugcccuguucauugagaggcagcauugugauuacacgaggcacauguguccccagcuucuuguggcaggaccccccguggccgugugcuuaacugcaugaacaggugcagacaagccaggcuauggccaggcuccugcauggugccauccacagagcacuggcugcaaauuugacacagcaccuacugacguugccagcugggcucugcugaggggcguggguagcuucaggagaacagggagagcgccccuucagaguugauccucguaccccuauccaugacacaggccugcuucucuccccagaaacccuacaucugcaagaucccaggcugcaccaagagauacacagaccccagcucucuccggaagcaugugaaaacgguccacggcccagaugcccacgucaccaagaagcagcgcaaugacgugcaccuccgcacaccgcugcucaaagagaauggggacagugaggccggcacggagccuggcggcccagagagcaccgaggccagcagcaccagccaggccguggaggacugccugcacgucagagccaucaagaccgagagcuccgggguaagcggagcugggcagcccagccacgcaaggcgacuccauagccgugcccagggccaccccuugccacgguugcgggcucugcccuaaggccccccucuaggggcacagcgauaucccuccucucuccaacuuggcuuucccccuucaccaccuugggccucacauggaaccuaucuuguccaggucccauucugcucugaccaggcuccugcuggguguguggcagcacgcugggugacagggaugccgcccuguacggugggccugcacagggcggggguggccccugcaagucugccuuuccagccagcacccaagugccacugccagcccccacuccucuguccugucucugcauccccaccccucuggcguccacuccuuuuguucuaaccaccuguucuuugucuccaucucuuuuuccugacuguaccuccccuaaggauagacgguacugaggugagccaaggagcugggcaugugugggugggcugggggagugaggguggcuggggagccgguccaugcugcugccuggcagagacucaccugucagucuaggccuccuaggcccaggcaggugggcccggacaggcacacggcagggcacugcagguggggccauuggccuuggcagccggaguggaacuggcagguguggggagcaggggcgccaggcuguaucagggacagagugacagggaggcaugcgucuaggcuacagaagguccugagggucaaacagaaaaauguggguggcgccauggacaacaccuagaaggucccugcucccauuaagccuguguccucaugggaaggaagaucaugccuucccaagaaagcuggaauuuggggccauuuggccuaacaaugagcccagaggugguggugcaucuggugcaagccucaucugggcccagauccgaguucuguggaugucguccgaguggauguuguccgaguucuguggcauucugcacuguguacaugugccaugagcucccugccccacucuaccuaacccagagggaagacuguuuugggguggcccuuuacacaagggcugcaucccacaggucccccuccuggucauccuuucccuuucccacaaccugccccuggccuuuugagaucauccugucugguugaagccaccaagucagcaggcuucauuccucaccucaucaggguacauggcuguuggugggaguguuuaagugccuuccuuugugccauacugggugccuucugcacgcugcgugcuguccacccacccacuaacucugcaccggaaucaguucagguccaucucauaguuggggaagccaagguuaagagaagugaagugacuugaccguuuuaagcaaacagacucaugacgcuuuacgugcuccuccgcaaggcagcuuccuucccucacccucagccccucagggugggcgaggguguggugccugugcaggccuagaggcaggaccagguggaaucugauacccucugagucugagccuucuugccucguccccugcagcugugucaguccagccccggggcccagucguccugcagcagcgagcccucuccucugggcagugcccccaacaaugacaguggcguggagaugccggggacggggcccgggagccugggagaccugacggcacuggaugacacacccccaggggccgacaccucagcccuggcugcccccuccgcugguggccuccagcugcgcaaacacaugaccaccaugcaccgguucgagcagcucaagaaggagaagcucaagucacucaaggauuccugcucaugggccgggccgacuccacacacgcggaacaccaagcugccuccccucccgggaaguggugaguaaaggccugggguuugcagauggggcagaagagagucuggggcagcaccaacuaggcuggcacccaccaagcaccagugcuaucucaccggauuccuacaggaucuuaccagcccaguacagaaaaggaaacugaggcucagagaggugaaaugccuuacccaaaucaauggcaggggugagauuagccaaaggccaugcucuuucaacugcaccauucugaguccuuauaaccccccaaaacaagcagacccugcgcacaucauccucuuccucacccauucauuccuucacugaugaggcacuugcugugggcaccauggcaaaggcccuaggcaggagagccauuuaauuccagucccaaaggagcguaugguuagaaggcugugccaccagauucacacucuacugcagaacgagccagguaccaccaaagccagagcuuaggguagagcugugcagaggaaggagaaagcacauugagcuggggaugagcagggaggacuucauggcggaggcagcacugugcucagucucaagagguguuggccaggcucugagauggaaggcgucuuuaacgagcaugucuuggguacugacucugugccuaggauugugccgggcugcccacuguggucaacacugauguaccaccugcucucacuugaagggaggauuuguugucccaacuuguggggacuacuggcaaauggccuugaacucucagcccccuacagggauguccuggguugcagacagaugccccacccaaggucaccccuucccagcagccccgcaugcaaugacuggucacugcaggaguguaaaggcccagccaucaagaugaggcucagagaggugcccaacucagggcagcacugaagagccauuggggguccugggcucccugugagaucauccugggcucacgucuccucugcccacucuugcagccugucuuuccuuccauggguauggaccucaggguacucccuguaauaaccugcuccuuaaacuccaucucagggacgccuagguggcaccaccuccacagacugugaggguacugugccaggagaccaaccugggccuuccugagcugcucauccccuccucugcguaacucaguccuacggagaggcacauuuaucuacagcuagagaaacugagggccagagaaaggagaauucaaggccagacagauaaugguaaagugaagauagggacuuaggccuccuggcuuccccucgcccacccuuagcaauaagugccaccauuuguuuacauauugcuuuuuccuuccccuuuuuaauugaaaaaccaucugcucacugggcacgguggcccacguaugcccuagcuacuccagagucugaggagggaggaucccuugagcccaggaguucaaggccagccugggaaauccugucucuaaaaagagaaagagagaaagaaagcaugcaucuccugagugcgcuguguugcaagcccucuucucgggcuccaggcccagugcgaugacugagcacggucaaagcaagcagccacccacccuugucccggugcugaccccucugcucucccgcaggcuccauccuggaaaacuucaguggcagugggggcggcgggcccgcggggcugcugccgaacccgcggcugucggagcuguccgcgagcgaggugaccaugcugagccagcugcaggagcgccgcgacagcuccaccagcacggucagcucggccuacaccgugagccgccgcuccuccggcaucucccccuacuucuccagccgccgcuccagcgaggccucgccccugggcgccggccgcccgcacaacgcgagcuccgcugacuccuacgaccccaucuccacggacgcgucgcggcgcucgagcgaggccagccagugcagcggcggcuccgggcugcucaaccucacgccggcgcagcaguacagccugcgggccaaguacgcggcagccacuggcggccccccgcccacuccgcugccgggccuggagcgcaugagccugcggaccaggcuggcgcugcuggacgcgcccgagcgcacgcugcccgccggcugcccacgcccacuggggccgcggcguggcagcgacgggccgaccuauggccacggccacgcgggggcugcgcccgccuucccccacgaggcuccaggcggcggagccaggcgggccagcgacccugugcggcggcccgaugcccugucccugccgcgggugcagcgcuuccacagcacccacaacgugaaccccggcccgcugccgcccugugccgacaggcgaggccuccgccugcagagccacccgagcaccgacggcggccuggcccgcggcgccuacucgccccggccgccuagcaucagcgagaacguggcgauggaggccguggcggcaggaguggacggcgcggggcccgaggccgaccuggggcugccggaggacgaccuggugcuuccagacgacguggugcaguacaucaaggcgcacgccaguggcgcucuggacgagggcaccgggcagguguaucccacggaaagcacuggcuucucugacaaccccagacuacccagcccggggcugcacggccagcgcaggaugguggcugcggacuccaacgugggccccuccgccccuaugcugggaggaugccaguuaggcuuuggggcgcccuccagccugaacaaaaauaacaugccugugcaguggaaugaggugagcuccggcaccguagacgcccuggccagccaggugaagccuccacccuuuccucagggcaaccuggcgguggugcagcagaagccugccuuuggccaguacccgggcuacaguccgcaaggccuacaggcuagcccugggggccuggacagcacgcagccacaccugcagccccgcagcggagcccccucccagggcauccccaggguaaacuacaugcagcagcugcgacagccaguggcaggcagccaguguccuggcaugacuaccacuaugagcccccaugccugcuauggccaaguccacccccagcugagccccagcaccaucaguggggcccucaaccaguucccccaauccugcagcaacaugccagccaagccagggcaucuggggcacccucagcagacagaaguggcaccugaccccaccacgaugggcaaucgccacagggaacuugggguccccgauucagcccuggcuggagugccaccaccucacccaguccagagcuacccacagcagagccaucaccuggcagccuccaugagccaggagggcuaccaccagguccccagccuucugccugcccgccagccuggcuucauggagccccaaacaggcccgauggggguggcuacagcaggcuuuggccuagugcagccccggccuccccucgagcccagccccacuggccgccaccgugggguacgugcugugcagcagcagcuggccuacgccagggccacaggccaugccauggcugccaugccguccagucaggaaacagcagaggcugugcccaagggagcgaugggcaacauggggucggugccuccccagccgccuccgcaggacgcagguggggccccggaccacagcaugcucuacuacuacggccagauccacauguacgaacaggauggaggccuggagaaccucgggagcugccaggucaugcggucccagccaccacagccacaggccugucaggacagcauccagccccagcccuugcccucaccaggggucaaccagguguccagcacuguggacucccagcuccuggaggccccccagauugacuucgaugccaucauggaugauggcgaucacucgaguuuguucucgggugcucugagccccagccuccuccacagccucucccagaacuccucccgccucaccaccccccgaaacuccuugacccugcccuccauccccgcaggcaucagcaacauggcugucggggacaugagcuccaugcucaccagccucgccgaggagagcaaguuccugaacaugaugaccuagaggcccgagcgccuggugcugagugcacccggaggggucaucgcugcccagagccuggggauuccagcugucuugucuuuuuccaaaaaaguguuaaauaggcuugagggguuguugcgcaauggccgcuucagaugacagauguuguaagagaagguuuaugggcauccucucuggucuuuuggauuauuccucagaacaaugaaaaaagucuccauaggacaggaaggaaugcaaaacucauuuacacagugcuuuccagccuuuggugcuuacaggaccgcgcuguuccggcuucuucacggcugacauucggcuaacgagggauuacuuuggccaaaaccuuucaaaggauaugcagaaagaugguagggagcauuuggguuugaaucugaaugcuauacuggauacucugcuccggaaagaugagcuuuuuauucuacuacuuggaaggaaaaggaauuccugguccaccugaauuccucuaugaagccuaacucuugaggucucuaacauaccuugucauagaggaaaagcacagauuauaccuggaugauucaggagcacauucugauuccagguuugguagagcuggcucuucuacuccguaaagccgagucugggacuggcagcccauccaaguguauaugaaugaauaaagcauccaaguauauaugaaugaauaaaguauguaaguaucaccagaaaaaggaaagaaaaaauguacuccuuggggcaagcccagaagcugcccuggccucuccagaccguguuuacaguguuugcauguagaauguagcccuuccugaaaagaagacuuguuucuaaauaccucggggcugcuggagccgcuguggguuagggauggacugaggccucgaggagugagggugcacccggggcccagccucaggcugcccuagggaucucucaguaggaagaggaaguugcguguuuacccaauccuguuucuccaaugcaacguccacccacuuuaccaccaaaaacuccagggccugacggcagcccggucccccagcacucaccagcagcccaguguucuccaccaagccacagugugcaugccugguauccuccggauucccuuccuucugcccgcugagucacugggcagagaaugaugacauguguagguggugugguuggggguggaaaggggaagggguugauccucaggacucugagggagcaucguugaauuuuccuguucagugugaccaagacccaccuggaaauggaauuuggaacuggcuucaggagacaucauuccugaacacacuguagggugaauuggugcaucuuccccaccauacacacacacacacacacacacacacacacacacacacacacaccccaaaccuuuucauggggaauguguggcaaccuugccaaacagcaccacucagagugugacucugacugugaccuuggccuuaaugaggaacuucuuaggagaguuugaggacaaggccaacaucgucaucugggcucgcugcgucccagcacaucaaacucuguccagagacaaggccaacugcaaaugaaagccagggaacauugcuaagggucuguggcucuguggugguguucaucgccuuccugagauaggauuucccuugccagucccaaccuguauauauucuguacagaagacaucccugaauauacuguaggugagucguccagccaaauuuauaucuccaaaacauuuuuagcuuuuucuacaugcuaugaauugagaugacaugcucaacuuguaaauaagucuuuuuguacauuaaaaaaguaauuuuuucauaauuuaucuugucuaucugcuucccccuugacaguaguuaaugagaaccugggcaguaaauuuggugcauucgagcagaaauuaggcuguauuuuuucuuaacagugucaaaauugacuaucccgccuuugccaagaaauguuuaaugcugaggca

SEQ ID NO: 192981 - RNA, 355352 nt, Homo sapiens
cucaaauacacaucaccaaacaaauuuucucuauuauuuggguaggcgugacugguuuucuuaagacuuuuuuguugcaaccucuuagguuaaaaguuucacuaucauuugaaauuggucacaagacuagggaagugcuuucauuauagaacuauuuaauaaauaaguuccccaguuugaagagccagacuuuuaugugaggucaggccaguugaagacauuuacaaagaauuaguuguuuguuauugcucugugaguugcaagaauggaaaaaaaauucuuucuucaauacuuccuuccaggcugagucaucacuagagagugggaagggcagcagcagcagagaauccaaacccuaaagcugauaucacaaaguaccauuucuccaaguugggggcucagaggggagucaucaugagcgauguuaccauugugaaagaagguuggguucagaagagggguaagugcuccgcaaaccaaaaauaauacgguugguaagagugcuagcagugaguggugucuuagaaguugaucuuuuuucugauacuguuaaacugugucaugcuaugucuaguaagagagaaaugauauauuuaacguguguuaggaauuugcuuguuauuaagggauuuuuuuguaauucuugauuuugagcauuuauaaucuaguuaaguuagguuugacuuucugguauguuguguguagcguguuacagaaaguguuguauuuuucuguggugucuacagguucuguaaucuggagagauaucuuuagaaucauuuaauauauguaaaaguacgauccuauaugcauuuaaucacauguaaauauauaaauaagagaauuaagccaguuugaaugguuguaggggaauggcuuaaaguagaaaaggggaaaggguucacccgcaaacucauggauuaaucccauaaauuugguaaguaaaguccugacguaaaaggccaaaugaggacaaggauuuuuuguguguguauguuuauguuuaauuucguauuuuuauuuuucaucaucuagguuuaauacaccuuguucacuccuacuuuagauaaauaacuuaagcacauuauuauuuuuuauuauuaaaggaagaacccuucgauguaaagcgguuuaucaucugugagaucaccugcuuauguggucaauauauuuauuagaaauuuagaguuuagauuaguugcuaggcaacuacuguuuacccacauggccacgucgaguaggaugaggacuguuccauucucagaaccuuuuaguuccuguauaucuacuuuaugguuacaaguucccuccuaauauugauuuuaauauuuuuugaaggucuguaguaaauaccuauccugaaaagcuguugucauaguuaaaugugauuauggauuauuuuuuaaaugagccuuauuaagucguaacuuacauaauaaaauuaagcaauguaaagucauaauuugaugaguuuugccagagauacacaguaguguaacaaacacucugaaaacgauauagugguuauuuucauuaacccgagagguuccuuuguucucccuugcagcccaguccucaucccuuaacccuggcaaccacuuuaucugcuguuacuauaauuuugcuuuucuagaauuucauauaaauggaaucaugcaguacauaguuuuuuuauggcugauuucuuuuacauagcauaauacuguuaauauucauccaugucuuguauaucauuagcuuuuuuuuuaugguugaguaguaguucauggucuggauauaucacaguuuaucuguuaaucacuuguuggacauuugggcugcuucuagcuuuugguuaguacgaauaaagagucuggacauuagagugcaugucuuuguguaauguguuuucauuugucuuggguaauaacuuaggaaugauauugcugggucauaugguaaguguguguuuaacuuuauaagaaguauauguuuaacaaacugcccagcuguuuuccgaugugccugaccauuuguauugucaaguguaauuucuuucaaugucauucuccuguuauaaauuacgaaagcauuuucagauuucagugcuuuauaaaggcuuuuuugauuuacuuuuuaaacguauuuauauuauucuacuuuuuuuggagggggauggcaaaucacuugaaccuuuuugaguuuuacuuuacuaaucucuaaaaucugcuuucacaagaugguuuugaggguuaaaugagaugaugguuguggauuuauuuugacaguucuaacacaauguaagcuguugcuaucuccacauauuuaucaaagguuuaggaugauucuuuagucuguuuaauuaauuauaucuuugaaauaccauaauagaaaguauuuaguccauggacuauagaaaaaaaaaugaauaagaauuugccaucauuuuucuaauaauguguauguguuuauuuugagauguguauguguauguguuucuaauaauguguaugugcuuauuuugagaugaauaguugcauaaacauaaaaauuugaauaacacacaaagguauaaaaugaaaaauaaaaaucucccuaucuuuucuaccuccuuugucagagauaaucauuuuagaacuuuuuuuccuauuuuuaauugucucaucauuaugccaguuuuuuauauaauauacuaaacuuuaaccuucaguaaccuaauaucuccccauugugaaaaauagaaggauuuaacuuuuaauacugauccuaccuucuuccuuuuauuuuuugguugccuuuaugauuaaacuuauagcuguuuaacaguuaacuuuagaguguucagacauugucucuaaacuugccacuuuauaaguuguaaaaaaaaaaaauuagcuuuucuccucaucuuucccuugaauuccucacauucccuuuccaguuuuucaacuguaacauuuauuuuauaugucaagguuuauaauaguuauacuugcugauucugaaaagcaguuaaaauauuacauuauauaaauaauaugacuaaacaaagugguaugaugagauucuuagagagcaaauggauuuauuuuauuuuacuuuaaguucugggauacaugugcagaacgugcagguuuguuacauagguauacaugugccauggugguuugcugcaccugucaaccugucaccuagguuuuaagccccccaugcauuagguccucaugcucucccuuaccuugccccccacccccagcaggcccuggugugugauguuccccuccuuguguccguguguucucauuggagaacaaauggauuucuuacgcucucuuuguacuccagagcugccauacuuuaauuugguuucuaguuuggacuguggcuauuuuuccuggauuuucuuuauuuuuauuuuauuuuauuuuauuuuuugagacggagucucguucugucacccaggcuggaaugcaguggcaugaucucggcucacugcaaccuccgccucccguguucaagugauuccccugccucagccucccgaguagcugggaugccaccaugccaggcuaauuuuuuguauuuucaguagagacgagauuucaccguguuagccagguuggugucgaucuccugacuucgugaucugccugccuuggccucccaaagugcugggauuacaggcgugagccaccgcacccggaccuuuuccuguauuuucuguuuuuuuuuuuuuuuugagauggagucauguucuccgucucaucaacaacaacaacaaaaaauugauauaauaaaguuauaauauaguuauuacuuugaauauuagucuuuuuucguaagacuauaugcaucaauuguuguuaucuccagauauaaucugauuuguacuuuuaaugugaguaaguugcuuuucaguaaauaucuucuuggaaaauaaaaaaagggcugaaagauaaauauucauuauuacguaggauaaaugcuuuccuaaccuugguuauuagugauauauuaauagugauauccuauuuuuuacacuuuucuggacaguugaaaaugauaaguauuaauugagauaacacauuaccauaguauuguugguguuagaaauggcaauaaaagaaacaucacggagcaaacaucaaguaaaguauugucugcguuuuccuccuugauggauccaggacagcuccuuacaacuugguugcacaucagcauaggaggcaucucuguauauauuaaauacuuacuaaaugaucuuacucaaagacgagccuguagguauguucuaggugacucuaaaucucuaaauuggauuucagcacuucucuuaauuuuuucccuuauagcuagugguaauauuugcuaugaagguacuuaguguauuaauaaaguaggaaauuuagccaguuuaaaaggucuaaauuauagaauuaaauaaauugcaauaguauuaauuaagggcuuauuauaauuuauuaacuuucauuugcuuaauaaaauuucauaaaaaccuaaguagucuuuuauaaauguggaaagcuaguuccuugauaauaaguuaaaauauaauguauaacuagucaauucauaauguuacuguuuugagauugucauaaaucuaagaggugauuuuuaucauuaaaagcauuuugaugaaaauguuccaugcucguguuacuuuauucuacuuuuuguauuaguaucuaacaaacugaacuuucauguuguauucucuauguguaaccaguuuuggcuuucaaauaacuuuuucccuuaguuuucuuuguacugacuuuguccuuugaauaauauuuuucuuauauuccaugaaaugguuuauuuagaugaacuacagugucgguauuugguaaugccaggauaaagauuuugugucuaugaguugucucacaagauagcuuaauucugcugagcaaaauauacuuuagcaacauaaagauugugaacuugguuaugcuguaagaugugauucuuguuaucuagucaaauuuaacaaguuguuacagaaaacaauuuacauuuuugaguguuuaucuaaguccaggggucuuuucuucuccuuuauuuugugcaugcauguguuuuuuuuuguucauuuuuuauucacaaaaugacuuuagaaauaaguuauaaaaugauuaggagaaagaaaaugacaguaugauuuccuguuuacuacccagcagcaagcuuuuuccauagagaguaaagagcugugguagugacuguguaaaccacaugguacauuagagaagcucacuuugacuguugagguuauacauggagaguaaacauaagaaaauuaaauuuauuuucuaaugguauugaaacucugagauuuaacuaauguauuuacaauacugugaaauuagcuuuucuuagaguuucaauguauuauuuuugaaaguuucaaccaauagaaccacauggagcaaaccaucaaauaagcuuucauauacauuuugaaguuauuuauagaauuguaaaguugcuguuacacacacacuugcuccuucucaaucaacaaucaaguuuuauguauugauuuuguaaguugaagucucaugaaauucacuuauuaauguuaguuuaaagauuuucuacauagauggucaaguuaucugcgaacauccacaguucugcuuuuuccuuuccaaucuuuaugccucugauuucuuuuucugaucauauuucacuggauaggaccuccaguacauuguugaauaaaagugguaagaguggauauuuugcuuuauugcucaucuuauugggaaagcauuuauuuuaccacuuaaguaucacauuagcuguuccuuuucuguugcugcccuuuaucagguugaaaaaauucccuacuauuccuaguucggagaguuuuuaucaugagugguggucaguuuuuucuaaagauuuuacugcuucuauugaaauggucauuugauuuuuuccuuuuauucucuuaauauggugaauuacuuucauugcuggaauaaauuccauuuggucaugguguauuuaaaaaaauauauuaccaauuuggacuuacugauauuuugcuaaggguuuuuugcauuuacaagaguauugaucuguaaauuucuuuucaguuuugauacagugguuaugcuggauucauaaaauagguugggaagcacuuguuucucauaagguggauuguauuuuuucuucaguguuugacaaaauguaucagugaagccauguggguuggagcuuucuuugugggaagauuuuugaugauaaaugagauuucuuuagauacaaggcuauccauauuuucuauuuccucuugugucauuuuugguaaauuguauuuuuuaaggauuuccuuuucauccaagauguucgucuaaguuacugggugcaaaguuuuuaauauucccuuauccuuauuuuuauuuuuuuaguagagccaagauuugcuccauugcccaggcugaccuugacguccugggcacaagugauccucccaccuuggccuccccgagugcugggauuacaggcucccuuaucuuuugaaugucuguaagaucuuagcgauaucuccuuauuaaauccugauauugguaaauuauauacuugcucucuuuuuuccuuugauaaucuugcuaggaguuuauucauuuuaugaaaucuuuuuuuuuuuuuuuuuugagauggagucucgcucugucaccaagcuggagugcaguggcgcagucucagcucacugcaaccuccgccuccuggauucaaguugauucuccugccucagccuccugaguagcugggauuuacagucaugugccaccaugccuggcuaauuuucuacuuuuaguagagacaggguuucuccauuuuggucaggcuggucuugaauuccugaccucaggugauccacccgccuuggccuuccaaagugcugggauuacaggccugagccacugcacccagccaacuuuuuaaugauuuuuuaaaugauccauuauguggucuuaucauuuggucugucuguauuuuauuuuuuggggguauaguguuauaaauaucuagucaagaugauugguaaugggucauagucuucuaugucuucacugacucguuuuuuuuuuuuccucuaguucugugacucaguguuauagucuccagcuaugauugugaauuuaucuguuucucucuuuaguccuaccuuuuuaauuuuauauauuuugaagcucuauuauuagaggcuuuuuuguuguuauaucuucuugauguauugcuucuuuuauccuuaugaaauguucaccuuuuucucaagugacacucuuuaucuuggaauucaguuugugugauauuaauauaguaacuccugauuuuuuaugauuaguguuugcaucuuguaucuuuucaacuguccuauuauauuuagucuuuguuuuguauuuaaacuguuucucucguugacagcauauguuugggucgugucuuuuuuaaaaaaucuaauuugacaaucuuuaccuuuuaaaugggaguuuuuaggccagucauauuuaauguaauuauugauaugauugaguuuucuguuugugucauguguucuuuguaucuuuucccuauuuuuuugccuuuguuaggauuuaguaucuuuucaguauccuauuuuaucucuccuauuggcuuguuauuuaugugucuuauuuuaaagcaauuuaaaaauuuauaguuaauguuauuguuggugugguugaacuuaggcauacuguuauuuuuuuaaaaaaauaccucucuucauacuuucuuaucuucuuuugaguuaauugaauuuuuuucaguauauuccacuaacaguaugcauucucaacaggagugguaauucuccuauagggcaaucauagguucuuggaaaaggguacagaauauccuuuuauauuacaauuguuuguggcucuccaaucacauuauauaaacagauauaucuuugguauuaaaauuucuugguggggaccgaagugauuuagagggaguuuucuaaagaggcuccuuaggugagccaaggaaaaaccuuugauaaacaguucugucaucauuuuagcuugcauugcuuuuuuagguauuguucuaagguaguggaauacagaauacauguacagguuuguuauauggauaaauaacauguuguagggguuugguauacagauuauuucgucauucagguaauaaacauaguacccuauagguaguuuuaagauccucacuuucucccacucuccacccucaaaauacauccucaguguauacucucuaaaguacaaccagggugauuuugguccccagaggacauuuggcaaugucuggagacauguuugaaaugaugugggggugggauugcuacuggcaucuaguggguagaggccagauaugcugcugaauguucuauaauggacggaauaguaucccauggcaaaaaaauuuccaguucaaaauguuaguagugcugagguugaggaacucuauucuugagauuacaauauucauucuuaauuuauuacagucuauguaggguuaguauuuuacugcuccauauaaaauauaagacucuuccaaugcuauauuuauauuugcccccacuucugagagugccuugugcuguuguucuccuguauaguauaucaccauguuauaaacucuguuauaauguuauauauuuuuugccuuauucauacgucuuuugaaaaagagcaggaaaaguauggucauuuacacuuauauaccuauuuucaguuaaaaaauuuuuuuccuauagauuucauuuucugucugauauuuuuuuucaccugaagaacuuuuccuuagcuuuuuuuuuuaaacuuuuaguuuccagaauacauuauugguuagauguuauauggguaaauugcguguugaggggguuugguauacagauuauuucgucauccggguaauaagcauaguacccuauagguaguuuuaagauccucaccuuucucccacccuccacccucaaaauacacucucaguguauacucucuaaaguacaguguguacucaaauguguacucaauguguacacaaaguacacccucagcguguucuugaaacaucgaguauacauuguccauguguacucaguguuuaccucccauuuacacgugagaacauguaauauuugguuuucuacuccuucauuaguuuacuuagguaauacccuccagcuccauccauguugcugcaaaggacaugaucucauucuuuuuuuauggcugcauaauauuccaugguguguauguaccacauuuucgucugcuguugaugagcauuuagguugauucugugucuuuucuguugucaguagugcugugaugaacauauguguacaugugucuuuaugauacauguaugauuuauauuccuuuggucauauuuucaauaauggaauugcugggucuaaugguaguucuguuuuaaguucuuugagaaauugcugaacugcuuuccacagcggcugaacuaauuuacauucccaccagcuaucaaauuagaauccuguacaauuuaaaaaauccuucaaaaugaagaugagcccagccacaguggcucaaauuagaauccaaacuaucaaauuagaauccuauauacaguuuuaaaaaucguauauguggccggcuaauuuuuaaauuauuuuuuuauagagauggagucucaauauguuguccaggcuggucucaaacuccuggccucaagcgauccucccaccuuuuccucccaaagugcuaggauugcaggugugagccacuguggcugggcucaucuucauuuuugaaggauuuuuuaaauuguauauaggauucuaauuugauaauugugguuuuuuuaucauuuuaaauaugucauuucauuuucuucuggcugccaugguuucugaugaaaagucaccuguuguuauuuugacuugcuguuuccuuauauagucaugugccauugauaugguuaggcuucgugucccuacccaaaucucaucuuaaaaauuguaaucccuacgugucaagggagagaccaggcggagguaauugaaucacgggggcaguuucccccaugcuguucucguguuaucgaguucucaugagaucugaugguuuuauaagggguucuuccccuuuaacucggccuuccugccgcccugugaagaaggugccuucuucccccucaccuuaugccaugauuguaaguuuccugaagccucccuagccaugcugaacuaugagucaauuaaacuucuuuccuuuguuaauuacccagucucuggcagguuuuuuuuguuuguuuguuuuuugauauggagucuugcucuaucacccaggcugaagugcaguggugugaucuuggcucacugccaccuuugccuuucagguacaaacaauucuccugccucagccucugggacuauaggugugugccacugugccuggcuaauuuuuguauuuucauuaagcgacgggguuucaccauguuggccaggcuggucucgaacuccugaccucaggugauccagccaucucagccucccaaagugcuggauuuacaggugugagccacugcgcccggccucaggcaguucuuuauagcaguaugaaaauggacaaauacagccauauaaugauguuuugguccauaacagauugcuaaugaugguggucccauaagauuauaauaccauauuuuuacuguaccuuuucuauguuuagauauguuuagauacacuaauacuuaacauguuucaauugccuacaguauucaguacaguaacgugcuguacugagaucucccucucacuuuccagcuauuuuggcagcucugaacucugucucuucaaacuaguaagacuuucugaguucuagccauuccacucuaguuucaaggaaugggagagcgccuugaguaaaaagccacaucagugcgaaucucauuuguagcucccuucuuuacagucaguuuccuucaauuucugccugcuuuugcagcuuuucuacugccuucaaauugucauucuuuauauuuuauacagaguuuauaauuuuauauauagaaggguuagucugauacaaguuacuauacuacuacuggaagugaaauuuugcuagguauguguuuuaauguauagauacacaaauuuauuuaagcuucaugauucacauacugcuguauuccaauuuaauucuuaaauuaugaggagaagaaguuugugagaaguaggaguacaguuuauaaaaauuuaucagaaauuaugaguacuacaaguuaugagguguaugaaacuaauaguuuaaaccgaguuugaaucacuuaucuagaaagauagcuuuuucuuaagcucauauguagaauuucaaccuagaagugacuuuaaaaguuaucuagucuuuuuuuuuuuuuuuuuuuuuuuuuuuuuuuuuuuuuuuuuuuuaguuuuagggaugagucuuuuuauguugcucaggcugaucuccaacuccuggccuucaggaguccucaugccucggccucccaaaauguugggauuacaggcaggagccacuguugguggccucucuagucuuauauccauucaucugacagauuucaaaacugaggccauauuucaaguuagguauagagccaggauuaguaccugagauuucuuuuuugcugaucuuagauacuucagauuuuguuucuuucuugacguuuaggaauagauugaauuucuucaaaaaauauuuuguaucuuguugggggggaggggcucagaaguuuuggguggaaagauuuaaaauccucugaguauggaaaagggggaguaucuuccaccuuguggaauccucacacugugugaguaauauuauucacugcucuacuucccaguggagaaugcagagaagcuguaccucuugaacuuguguuuucucucuuugaguaacuguuuccauaguuucuauacccuuugacauagagaaacuuucuuuaguuuguguucgcauuuuauaaucaaucacauuaccuuuugaugugugauagcccugcaccuaccacuaauuuucuguguuuuugguuaugcuaguuuuucggcuuggcauguuuuuuccccucugucuuuuuaagugaaaaaucuccuguguccuucaaagccaaauuauuuacccagaucauggucuuacaaaauuagaaugauuucuuuugucuguauaauauugcaacaauuuccugucuugaccuccuuaugacuuucuauugccuuguuauuacauagaucuguuauuucuccuuuccauuguaaccuccuugacagcacugugucuaauacaacuuuauauuuuguacaguuuguaauuuuccuucugaaauacaguucaccauuauuuugagcacgguagucucuuaaucaguaugugauacaaaaauggggaagaaaauaaugauucuagaaguucagauaacaguaugucacagauauuagggcaaggaacuagaacugggacagcugaggcaagguaggaaacacagacuagaucacaguuaugaaagcagccuaauguucaggagagaguuucgguaagggcagcacuggaauucuagaaccauguuguauaucugucaaauuuuuguguagcaaaacagaacugacaggguaggaauugguagauuugacugaaugguuauuccugacaaagauaguggguuguacccugauugucccagaauggacuaguaaauaagguaucuaaauuagguaaguagaauaaaagauugggaauauuguaguuuuuaugguuuggaagauuaaugcguauuuuaaggguaauuuuugcuuuacucuuagaacgguaaaguaccucugauuucaugaaaccuaacuuucuaagccuauaagaagaaucuuuucuacuguguuucuaauggaucacuuaucuuagauauugugggcaacuaaaguugcacuguaucuguuucauuauuuaacagcucugagcacugguggucuuuguuugcccuccugagcaauauaaaacaaguucuguuuuccaguuuauaggccuucggauuuuucgagauugcuauccugucuucccuaaaaucccucuuucuaagcaaagugcucucaauucuuuauuauguuuauaauuauuauaagacacgguuugcagcccucucauacacgguacaguugucccccaguauccacgggggguugguuccaggacuuccuggagauagcaaaaucugcugaugcucaaaucccuuacauaaaaugguguaguauuugcauacaaccugcacacacccuccuguaugcuuuaaaucaucuuuaaauuacuuacauuaccuaauccacugcaaaugccauguaaagauucuauguaagugguuguuacacuguccuguuuagggaauaaugacaagaaaaaagucuguaaguguucaguacagaugauuucuuuuuccugaauauuuuugaucugugguugguugaauccacagaugggaaacccacagauauggagggcugacuguauugguaucuuacuguggaaauagcucaguuugucaauguuucucuuacagcguagugcccagaagugaaucuguuacugcagaugugaucggugcagggaaaaagcacagugagacuguuagccucuucucauagucugucacuguaggggccuucggugcgauuaaaggcuguagccacuuuuucucaguuuuacucuuuaagggaacuuuuauuauguuuugauuauauaaaucauuuauaaagucaguuuauuguccagauguuaccaguuuacauuccuagcacuaauaugugaaggguucuacuuucuuauaccguagccauugcuggguguuacucuuucuaguuuuugccauuguauugcuguuuuauuuuacauuucuuuguuacugagguuuaacguugcuuaaaugaauuauuauucuuguucuuaguuaaguuuuaaauaugaggccuauccuuaaacauguauaaauuuuauguucuuauuuauugguaagagcuuuuuguguauugagaauaccuuuauuugauuaaucuuuuuuguugugaauauuuuucuaguuugaauauaccuuuuaauguuacgguauauuuuugccuuguaaaauuuuuuaguuguuaaguaguuuaauaugucagacuuuucccauucaaggagaccauugaggucauacuuacaaacucuucaccuuuuuccuuugagcaucauuaugaugaaaacauuuuguauuaucuaaguaauauauucuccuuuaaaagagccaagcaguaaauauauaggguaucgugugauuccuuucuuccauauucuuucucagaaauaaccacugccaaguaugucaugccaauauaaagcuaaaauuuuuaagaaguacuuaagaacuagaagaaaaugccaaauuauagguaguauuauccccuugucaagagauucggauugaagagauuaggcagggauaggaagggggauaauuaagaaaaugagacuuuuacacuuuauucuguguaaacauugcaucuuucuguuuugccucacauuacauaaaugauaccguaaucacuuacuaugucuuggagauuuauccaugccaugggaaccuggaacucgaaaaaagugacuaguuugacuuaacuugcucuuagugaaucuauucuuacuucuuguccaucuacaauuucaaaguacaucugaugcuugaaacaagacuagaguuaggggcacagaccaccugcacggucaaaaaugcgcaaaucacuuuugacucccucacaacuuaacuacuaauagcuugcuguugacuggaagccucgcggauaacauaaacaguccauuaacacacauuuuauauauaauguacuguauuuuuacaaugaaguaagagaaaaaauguuauuaagaaaauguauuauuuuucaucaaggggaaguggaucaucauaaaggucuucauccuugaugucuucaagucaaguaggcugaggaggaagagaaaggguugguauugcuaucucaggaguggcugaggcagaagaagcaaauccagguacaaguggagucauucaguuaaacccauguuauuaagggucagcuguaccuauauaugucauuugaguguaaugguuaagaggaugggacugaauuccaaauccuggcuuugccauuuauuagugucugugggcacaauccuuaaucugucuuaaauuucuggucuguaaaauggagaugauaaaagugccuacuuuauauggguauaggaauccaagcucauaaugugugauuagcucuuaucagacugcaugggacauauuaaauaguaaauaacuauuuaauaaucuguagaauauuacuaguuugacaucaacuuuacuaauauuuaguauuuaacucacccauuguuuacuucuauauagacagucgggauacuugcccuuuuaaguuuuguuguuguuguuguuguuguuguuuuuaaaacauucuucagaugcuuuuacauugaucaaaaaucacugaugcugaccggaacucaaagugauaagcuacuugcuaacuaucaauaucaauguuuucauuaugauauuucucuuuggagaagaccaguguaaaagaggaguugaucaguauuccuuuccugucaacugaccuucauguuguacucucuuccucaggcuucaucuuucuuaauuuaaaaauucauguuugucuguaguaauuacaaaaauucauuauaggauuuccaaguucuaauaguugcuuucuagauuuggucuucauuaugauacugcuccuauauuuuucaacacuuuuucuuaaaugaaauaguacuaaagcgacaaguacguacauacauuuuuuuccucucacucaggauuggguaagaccaaauagucauauuuuaauucuuugguuaaacuuuaugauuaaaaaugcuugcuguguaagaauacuaauuuccuuaucuuacacaguuaggagcuaagacauuuccaucuaaaauuccugggucaagaaauagaggcuuaaguguauuuuuuuaauguggaauacaaaccaguagaaaagcuaaaaaugaaaaugaaaguaacaaaaauugggaagaaagggcagaggguaucuuaauuucucaaucuuuauaguaagaagucauuugaugugguuaauaggugauaaaucaagaaacauccacaaugccaaaaauauuaaaaguggcuguuuaugagaaguggaauggagaaugaggucuuguguauaugugguccuguguguaugggaaugguggaagagauacuuuuauuuuugagucuuacaugcuuuuauguacuacugaguuaucacuuucuaccuguauuaguuaauaaaacauccuacaggauuccaguuuauaaagauaaaagcauaguuuuauauguugauauauguauaaaaaugaauuggauggaaauauaccaaaauauaauaagugguuauuucuggguauugaguuuuuuccuuccuuauauuauuuuguauuuuguaaaauuucugaaaugcauguauuuuauuaauuuauauaaaaauuguuaagagaaguuauuuaggacuuccuaacauuuaauuuaauuugucccggguuuaauuuguugucacacuuacuuggcaucagaauguuugcuuuuuguuuguacaauuacuagaacuuuuuuaaauuaaaggaauuguacaucauagucuuugcaugcuuaguaagguuggcauucugcugaaaauaacagaaaaccuagccaacaguaacaacaaaaaaggacauuuucuuuuuuuccacuuaaggguauaggugggcgguuauaguuagcagaucaggauagaaucaucagagauugaagcuaucucugguucaucaccguuagcuuguuugcuuuucauauacuuguugcuucaagguuucaagauggcuguaguaaugggcauuacaucucuguucaaggcagucaaaugggagauggcuggugucagccacacugucccuuauauuaggaaugcaaaagcuuucuccgaagcucgcuaucagacuuacuuuuccagaacuggguuaugugccacuccuagcuguuagaaggugaauauuuggcuuucaauuucuguagcgggagauggcaagaguaaagggguuugguaauugauguuguguuagacaaccagcagucugcuacaaaaaguuuuggcaaauguaacuaauguuuguacuucaguucucaaucagauacccaggagagacaguagccuuucuagaggucagauugaaaauuugacauaccaacauucucuaaaauuuacucuugucggguauuauucugaaauguagccauuuugucugguccuaggaguacuagguuuaugcuccuuucuuuuuuuuuucuuuuuugagaugaagucucacucugucgcccaggauggagugcaguggugccaucuuggcucaguguaaccuuugucucccggguucaagugauucuccugccucagccucccaaguagcugggauuacaggcaccugcuacaacaccuggcuaauuuuuguauuuuuaguagagaugggguuucgccauguuggcuaggcugaccucgaacucuugacuucagguguucugccugccuuggccucccaaagugcuggguuuacaggugugagccaccgcaccuggcuaugcucccuucuuaaaaaaaagauaguuuugguauccugaagugauaaugaauuaugggguacguuugguaaauuauuucaauuaguuuuauuccccuuguagaauccaaauuccuguuuguagccgguaaucugaggauugugaauuuuuaauguaacaagucaauuauauaaggguuuucauuguuguuuuuaaguuacagugugcaaugaaacggauagucacagguuuuacagcuuaugacuccaccucuaccaacccaaauaauggucagccaaaaauauccaaauuacauaguuugaaguauuagguguuacaguuacuuggauugucuuaaagccacauauuuuaaugguuauuaucccuuauuuucuuauuccucugucacugacuccuuuuaaaauacuuuaugaugcagauuugaauaguugucauugugauuuuuuuaaguucugggauucaugugcaggacaugcagguuuguuacauagguaaacgugugccauggugguuugcugcaccugucaacccaucaucuagguauuaagcccaacaugcauuagcuauuuauccugaugcucuuucuccccucaucccugacaggccacaguguguguuguuccacucccuguguccauguguucucauuguucagcucccacuuagaagugagaacaugugguauuugguuuucuguuccuguguuaguuugcugaggauaauggcuuccagcuccauccaugcuccugcaaaggacgugaucuuguuccuuuuuauggcuauauaguauuccaugguguauauguaccacauuuucuuuauucagucuaucauugaugggcauuuggguugauuccaugucuuugcuaucaggaauagugcugcaaugaacauaccugcauguaucuuuaucauagauugauuuauauuccuuuggauauauacccaguaaugggauugcugggucaaaugguauuucugguucuaggucuuugaggaauagccacacuaucuuccacaaugguugaacuaauuugcuuucccaccaaugguguaaaaguguuccucuuucuccacagccucacuagcaucuguuguuucuugacauuuuaauaauugccauucugacuggugugaggugguaucuccuugugauuuugauuugaauuucuugaaugaucagugauauugagcuuuuuuuuuucauguuuguuggcugcauguaugccuucuuuugaaaagugucuguuuauguucuuugcccacuuucgaaugaaguuuuuuuugucuugaaaauuuguuuaaggucuuuguagauucugaauauuagcccuuugucagauggauagauugcaaaaauuuucucccuguacauugucuguucacucugaugauaguuucuuuugcugugcagaagcucuuuaguuuaauuagaucccagucgucaauuuuugcuuuuguugcaauugguuuugauguuuucaucaugaaaaguuugcccaugccuguguccugaauggaauugccuagauuuucuucuagaguuuuuauaguuuuggguuuuauguuuaagucuuuaaaucuguauugaguuaauuuuuguauaugauguaaggaaggggcccaguuucaauuuucugcauauggcuagccaguucuccuagcaccauuuguuaaauagggaauccuuuccccauugcuuguuuuugucagguuugucaaagaucagaugguuauagaccuguggucuuauaucugagauuucuauuuuauuccguuggucuaugugucuguuuugguaccaguaccaugcuguuaugguuucuguagccauguaguauaguuugaagucagguagugugaugccuccagcuuuguucuuuuugcuuaggauuugucuuggcuauucaggcucuuuuuugguuccauaugaauuuuaaaguaguuuuuucuuauuaugugaggaaagucaaugguaguucaaugggaauaguauugaaucuauaaauuauuuuaggcaguaugaccauuuucacgauauugauucuucuuauccaugagcaugggauguuuuuccauuuguuuguguccucucugauuuccuugaguucuccuugaaaagguccuucacuucccuuguuagcucuauuccuauguauuuuguucucuuuguagcaauuaugaaugggaguucauucaugauuuggcucucugcuugucuguuguugguguauaggaaugcuugugauuuuuacacauugauuuuauauccugagacuuugcugaaguugcuuauuagcuuaagaagcuuuugggcugagaugaugggauuuuccagauauagggucaugucaucugcaaacaagacaguuugacuuccucucuuccuguuugaauacacuuaauuucucucgcaugauugccuuggccagaacuuccaauacuauguuaaauaggaauagugggagagggcauccuugucuugugccaguuuucaagggaaauguuuccagcuuuugcccauucaguaagauacuggcugugauuuuaucauaaauggcuuguauuugagcuauguuccauaaauaccuaauuuauugagaguuuuuaacauuaagggauguugaauuuuauuaaaggccuuuucugagucuuuugagauaaucaugugguuuuguuuuuaguucuguugauguaaugaauuauguuuauuaauuugcauauguugaaccagcauugcauccugggaaugaagcugacuugaucguggugaguaagcuuuuugaugugcugcuggauucacuuugccagcguuuuauugaggauuuuugcauuaauguucaucagggauauuggcugaaguuuucuuuuuuuguuucaucucuccuggguuuuggugucagguuguugcuggccucauaaaauaaguuagggagaagucccuccuuuucaauuguugggaauaguuucagaagaagugauacuagcuccucuuuguaccucugguagaauucagcuguaaauccaucugguccugggcuuuuuuugguuaguaugccauuuauuacugccucaauuucagaaccuguauuggucuauuccuggauucagcuucuuccuaguucagucuugggaggguguauguguccaggaauuuauccauuucuucuagauuuucuaguuuauuugcauagagggguuuauaguauucucugaugguaguuuguguuucuguggggucaguggugauguccccuuuaucauuuuuuauugaaucuauuugauucuucucucuuuucuucuuuauuaaucuagcuggcguucuagcuauuuuauuaauuuuuuaaaaaaaccagcuccuggauuaguuuuuuuuuuuuugaaggguuuuuagugucucucucuccuucagcucugcucugaucuugguuacuucuugucuucugcuagcuuugugguuuguuugcucuugguucucuaguucuuuuaguugugauguuagguugucaacuugagaucuuucuaguauuuugauguggucauuuagugcuauaaauuucccucuuaacacugcuuuagcuacaucccagagauucugguacauugucucuuuguuuucauugauuucaaggaacuucuugauuucugccuuaauuucauuauuuacccaggagucauucaggagcaaguuauucaauuuccauguaguugugugguuuugagugaguuucuuaaucuugaguucugauuugauugugcuguugucugagagacuguuaggauuucaguuuuccugcauuugcuuagaaguguuuuacuuccaauuacgugauugauuuuagaguaugugccauguggcaccaagaagaauguauauucuguugucuuuggguggagaguucuacagauaucuaucagguccaguugauccagagcugaguucagguccugaauauccuuguuaauuuucugucuugaugaucuaucuaauauugauggugggguguuaaagucucccacuguuauuauaugggagucuuugucucuuuguaggucucuaagaacuuguuuuaugaaucuugaugcuccuauauuggaugcauauauauuuaggaugguuagcucuuguugauuuaauccuuuuaccauuauguaaugcccuucuuugucuuuuuugaucuuuguugguuuaaagucuguuuugucagaaacuaggauugcaaccucugcuuuuuacugcuuuccauuugcuugguaaauuuuccuccacuccuuuguuuugagcuuaugugugucuuugcccaugagaugggucucuugaauacagcacacugaugggucuugauuguuuaugcagcuagccauucugugucuuuuaauugggacauuuggcccauuuacauuuaagguuaauauuguuauuugugaauuugauucugucaucaugauguuagcuggugguuuugcagacguguugauguagcugcuucauagugucauuggucuuuguauuucaguguauuuuugcaguggcugguaaugguuuuuccuuuucauauuuagucucccuuuaggagcucuugcaaagcaggccugauaguggugaauucucucagcauuugcuuuugugaaaaggauuuuauuuuuccaaacuaagccuaugaagcuuaguuuggcuggacaugaaauucuggguuggaaauuuuuuucuuaauguuguauauugguccccaaucucuuuuagcuuguaggguuucugcugagaagucugcuguuugucugaugggcuucccuuguaggugaccuggccuuucucucuggcugcuuuuaaccuuuuuucuuugaguuuugaccuuggagaaucugaugauuaugugucuugggguugaucuucucauggaguaucuuacugggguucucuggauuuccuggauuugaauguuggucugucuuacuagguuggggaaguucuccuggaugauauccugaaguauauauuccaacuugguuccauuuuccccaucucuuucagguacccuaaucagucauagauuuggucuucuuacauaaucccauaguucucagagguuuucuuuguuccuuuucauuccuuuuucucuaaucuugggaagauagucuucaagcucugaaauucuuuccuccacuuggucucuuuggcuauuuauacuugugguuccauugugaaguucucguguuguguuuuucaguucuauugggucauuauguuucucucuaaacugguuauucugguuaacagcuccugugauguuuuaucaugguucauagcuucuuugcauuggguuugaacaugcuccuucagcucugugaaguuuguuauuacccaccuucugaagccuacuucugucaguucaucuaagcguucgucuaguugagugcccuugcuggagagauguugugaucauuuggaggagaagaggcagucuggcuuuugggguucucaauguuuuuuucguugauucuuucuuaucuucauggguuuauccagcuucgaucuuugaggcugcugaccuuuagauggaauuuuuguggggacuuuuuuguugaugcugcuguuguugcuuucuguuaguuucucuuuuaacaguuagggcugggugugguggcuuacgccuguaaucccagcacuuugggaggccgaggcagguggaucaugagaucaggagaucgagaccauccuggcuaacacagugaaacccugucucuacuaaaaaauacaaaaaauuagcugggcgugguggcaugcgccuguagucccagcuacucaggaggcugaggcaggagaauugcucgaaccugggaggcggagguugcagugagccaagaucgugccacugcacuccagccugggugacagagcaagaccccaucucaaaacaaaacaaaaaaacaggccccucucccguagggcugcugcaguuugcugggggcccguuccagacccugugcguuuggaucccucccacaccuggagaugucaccagagggggcugcagaacagcaaagauggcugccuacuccuuccucugugauuucugucccagaggggcaccgaccugaugccagcaggaaugcuccuauauaaggugucuggcgaccccuguugggggggucucucucagucaggaggcacaagauccaggaccugcuuaaugaaaucguccagcugucccuuggcggaggggaugcacugugcuggggauugucacacuccucuggacuaccuggauuccucagagccagcagggagaaagacuuaagucugcugauccacagagacagcuacugccucuccccgcaggggcugagucccagggagagcagaguuccauuccuaaaccccugcuggaguugcuaaaauuccugcagggaggcccugcccagugaggagggaugggucaggaucuggccugaagaggcagucuggccacagucugccacagccgcuguccuugcuguggagaauuucuccuggguccaaaccguccagucucccuggcaccagcagggaaaaaacggccaacuggagcuacagugcuggcugcugccccuccggagcucagucaucuuaggcagcaggcagcugcagugauggcugcucucccuucccuggggagcuuagucgucuuggacagcaggcagccgcagugaugacgguggccccuuucccugggaauucgguagucuuaggcauucuccaguugagugaccgccaaacaucugcacagcucugcgcuuggcacgcaaggcccugguggcaucggcucaugagggugauauccugaccugacccacggguugcacagaucuguggaaaaaacaugguuuccugggcaggguagcacagucacucacugccucccuuggcugagggugggagcuccccuuucuccauuguggcucccaugugggccauugcaucacccuucuuuuccucacucuccauaggucgcgccaacugccuagucagucccauggagagaaccuggauaucucaaaguugcuggugcaggauucacuggccuuuuuuguucuuggugggagccucuggccacagcgauuucuauuuggccaucuuggcgccugucauugugauuuuuauggacuucugcauaacauauugcugaauaaaauuaucaaauuagacuuguuuaaaaaauuuaagucuuaauuguuuucaucaauuguuggguaaacuuuauguuaaguuuucuuaccaguuagagauacuauauuuauucaacaccaagccauuuuuucuuaguccaaaaaaguguuauugccuuauacuuuugaggaguaaaaaauuguucuuguaaaugagcauguuuguaucuaguuuuuggacaaacuaauuucuuuauuuacuucuagcgaaauaugugccagaaacugggaugugugagauacugagaugaagaaacacuugcccucauggagucuagagucuaguggggaaaaaagacuucaagaugagucaguuuccucauugauaaaauggggguaauaguaccuaucuaccucaugaagguuauugugaggauuaacugaguuaaauuauguaauaaugacuuagaauuuugccagguacauaguaaguguuccauaaauguuggcugcuguuauuauuucugcaaaaucgagauuuguauaaagugcuguggaagugcagacuaagcagggguugacuuucuagaaaguuaggggagugauccaguuuuaaucugcucucaauccuacuucguaguuuccuugugcauaguaaguccucaaaaacuguugaaugaaugaaugaagcaaagaaugagaauauacuuaccuaagugggauuguuaagacagcuucuuuaaacaucuuaaaauagaugucaauaaaauuugaagaugcaauauuacaauuuagcauuuaucuuccaugccugaguuaauucauggauagaauucagaauauuuuuucaaguaaguaaauaauggaagauaguuuaagaaauuaaaaagcuauuacuuucagccagguuuuugaaacaagcuggguuuucagacuguuuguuuguuugcuuauuuauuuauuugagacagagucucacucuaucacccaucuggagugcaguggcacgaucuuggcucacugcaaccucugccuucuagguuaagcaauucuccugucucagccuccucaguagcugggacuacaggcaugugccaccacgccuggcuaauuuuugcauguuuaguagagaugggguuucaccauguuggccaggcuggucacaaacuccugaccucaagugauucgcccaccucaguuucccaaagugcugggauuacaggcgugagccaccacgccuggccucaaacaguuuaaaauauuauuuucuagcagggucuugaaauacaaguaucuuauacuacagacuacagauauuauucauauauuuuggcagugucguguuguuguagaucauuauagcuacaucaguuaccaaugcuguguaauggacuaccccaauguuuauugccuuaaaacaacaauuuaucuuuuuuucaugauucugugguuugaguccaugguucucuuggagaugucaccuagagucauuccuaugggugcacuuagaaggguagcugcacugaacuaaaagaugguagaaugguuuauuccuguauuuggguccuuggugcuugaauguuggcucagagugccucaguucgccuccauguugccucucucuagcaggucauccuggauuacuuuagagcauguuacuaacuucuaagaauggaagccaccaguucuucuaaagacuaguugcagaaguggcagaucauuguuccaauacauuuuacucgugcaacaagucacaagauucaccagcucagauucaagaggaggggaaauggaguccauuuccucauaggaagaaugauaaggaauuuauggccuccuguaauccaccaugguagcauagcaccuuauuaucuuugauuagacauuuguagccuauccuccuuaucugcccuuucucccuuuauaaguuuuauguuuuaucuuuuuucccuuaauuuuccaugaauguuuguaguuugucuucuguuucacugauucagauuucuauucucuugauagaaacuauuucuuucuacgguggauuuuuguucugccuuuguguuguuuuacuuugccuguaugcuuuucuuaucuuuucuaguuuacuagucauguauccuacauuuuagaugccuuuucuugauaucauuuaauuuuaacuuuauguaaucuauuuaaaaauuuuucucagaauauaaauaauaguugcaguaguagaacuaaagguagugucagaaacaguaggguggugccuaccauguuauguuagugacccugugucuuugguuuagggaucuaguggaacaugaccagcuauccccuuuugccugagauacccucagcuuuugaucaucacuacugaguuuuuacauguuuuagugaaacuaugaauuacucaaauguugugauuuaaaauguggaagauaagcuguugauaugcuaguucaaaaagcaauucaaacugcuaugugaccuagaaaaacaccaucuugacucaucuaaagguggaauggccauuaagcugcuauucccaccagaaauggaauuauaagccaaaaacuaucaugaacuuuuccaucauaugagcaagccauaguagaaaccaaguagggucuucugaugacuacaucccuggcuaacauauugucugcaauuucaugacagacccuggugcagaaccaccuagcuaagucacuccuuucccacagaaacuguauaauaaaaccuuauuguauugaaaauacuaauuuuggggguaauuauagcaauagauaauagagauuuugagcagggcacgguggcacacagcuguaaucccagcacuuugggaggcugagguggguggaucacuugagcucaggaguucgagaucagccugggcaagauggugaaaccucaucucuacaacaacaacaacaacaacaacuagcugggugugguggugcacaccuguggucccagcuacuugggagacugaggugggaggaucgcuaucucuaaguucuugagccugggagguggggguugcagugagcuaagauugugcuaaaagugacagaaugagauccugccaaaaaaaaaaaaaagcaauauagauuuugguaucagagugguuuuguuuuguuguaacaaaaauguaguacugucuuuugaauuuggaacuggcuacaagcuugaaggauuuugaaacauuagugaaagcauguagagccuugaguugacuguuaguagaaguuugaguagaaguagaagccuuugagaaggcuuugcucgagggcuuaaaggaaagugagaaaaauauuaacggaaacacgaggaaaggggauccuuguucugugguggcagaaaguuuagcaacucugucaugugcaauaagauggaaaauagaaaaauguaaccuaugaaugaagugaucuagcuaaggagauuucuuaucagaauguugaagaagcuaccugguuucuucuugcuacuuauguauaaaauguaaaaggagagagauaagcaaaaugaaauacuauuaaagaaaaaagagcagggaacuguagggcuugaaaauucccagccucuucguaugaucauugauacuaaaauuaagaaauggguucuagaaaagauccaaucuaggacccucaugggaaaacuugaucuacagaucaagcugaagaugugacuuuaauguccuuuaagaccuuagaaauauccagguguuuugaaguugugacuuuaaaguccuuuaagaucuuagaaagauccaaaguguugccucaaaacaccugcuggauuucagaauugcuaugggucagugacucccacacaccuccuaauuguccuuuguuugaacaggagugcugaucguaguuuugcuaugccuuaugcaucacuggucuugaauuccugacccaacagaaacugugagaucauaaaggcuuauuguuauuuuaaagugcuaaguuuugugguaaucuguuaugcagugauagauagcuaauggagugacaguuaaguugaauuugggaggcugauaagauggcagccuggcaacagaggcagguagugggguugggggagaacauuugaugcagaguaaaaauaagauuugugauuccaaaggucaugaauuguuaggaucaugggaugacuguguaucauuggaagauguaagcucaagaauauucaugaauauguguucuauuaaacauugguaagaagaguuuucugaccaauaauuauuucuaggaacuacaaaauuuuauauguagaaugaggaagaauuuuuuccauuuguuuuauucuuagauuguaaaguuauguuuuuauagcuuauauucucagguuaguuuauuuauauuguaaaaguauuuaaaauaaauguuagauauaauaggguucuauacuuaaucuaaacuaaaucucuucaagauaagccccucuaucaauuuacuaauguuuacagugauuggaaagaagagaauauuacuuucccuuuuaacuuuuuauuuugaagauuuaaaaauauauagaaaagcugaauguauuguguucaugagcacaaaaauauccuuaacauuuugucacauuugcuuuacauauauuuaaaaauuuuauuuugugaccugaucucacucuguugcuuaggcuggaguggaucaaagcuuggugcagccucuaacuccugggcucaagcaauccuccugaaugagccucccagguagcugggacuacaggugugcaccaccaccuggcuaauguuuuaauuuuuaagaguuggggucucacuagauuguccaggcuaaucuugaccuccugggcucaagugauccuccugccuuggccuccaaaaaugcugggaauacaggugugagucacugugcccaguccauauacucuuuaaaauuuuuaauugaaucauuugaauggaagcuguagauaucacuuuaucucuaaguucuucuagcaugaauuuccaagguuaggcuauucauaaucacaguaucauuaacacaacuaagaaaaaucauauuucauaauuaugccuaauaugguaguccauaaaaguuuauaaauuuuuuaaaauccaggguccuuacacuauauuugguuaugucaccugagacuguuuuauucuagaaaauaaaaaucuaacguuauauugcuuucuaugacacugauucuaauuuuuuuuuuauuauguacuuuuuuucuuuuuuuuuuauuuccauaggcguuuggggaacaggugguauuugguuacacaaguaagcucuuuaguggugacuuacgagauuuugguacacccaucacccaagcaauauacacugaacccaauuuugauucuaauuuuuuugaggguuuuauaucacuuguuuugugaauaucccacauucugaauuuguccagcuuuuccucauuguuagauucagguugaaccuuuuuuggugagaauacugcauacaugauacauacuuaaucaagaaggugacugcuggaucucuucacuguaaagauauauuuuucucuuuuuuuuuauacuuuaaguucuaggguacaugugcacaacgugcagguuuguuacauauguauacaugugccauguuggugugcugcacccauuaacucgucauuuacauuagauauaucuccuaaugcuaucccuccccccuccccccaccccacaacaggccccggugugugaugucccccuuccuauguccaaguguucucacuguucaguucccaccuaugccaccuaugagugagaacaugcgauguuugguuuuuugugcuugcgauaguuugcugagaaugaugguuuccagcuucauccaugucccuacaaaggacaugaacucaucauuuuuauggcugcauaguauuccaugguauauauaugccacauuuucuuaauccaaucuaucauuguuggacauuuggguugguuccaggucuuugcuauugugaauagugucgcaauaaacauacgugugcaugugucuuuauagcagcaugauuuauaauccuuuggguauguacccacuaaugggauggcugggucaaaugguauuucuaguucuagaucccugaggaaucgccacacugucuuccacaaugguugaaccaguuuacagugccaccaacaguguaaaaguguuauuucuccacuuccucuccagcaccuguuguuuccugacuuuuuaaugaucgccauucuaacuggugugagaugguaucacauugugauuuugauuugcauuucucugauggccagugaugaugagcauuuuuucaugugucucuuggcugcauaaaugucuucuuuugagaagugucuguucauauccuucacccacuuguugaugggguuguuuguuuuuuucuuguaaauuuguuugaguucuuuguagauucuggauauuaacccuuugucagaugaguagauugcaaaaauuuucugccauucuguagguuggcuguucacucugaugguaguuucuuuugcugugcagaagcucuuuaguuuaauuagaucccauuuguuaauuuuggcuuuuguugccauugcuuuugguguuuuagacaugaaguccuugcccgugccuauguccugaaugguauugcccagguuuucuucuaggguuuuuaugguuuuaggucuaacauuuaagucuuuaauccaucuugaauuaauuuuuguauaagauguaaggaagggauccaguuucagcuuucuacauaugguuagccaguuuucccagcaccauuuauuaaauagggaauccuuuccccauugcuuguuuuugucagguuugucaaagaucagaugguuguagacgugugguauuauuucugagggcucuguucuguuccauuggucuguaucucuguuuugguaccaguaccaugcuguuuugguuacuguagccuuguaguauaauuugaagacagguaguaugaugccuccagcuuuuuucuuuuggcuuaggauugacuuggcaaugcaggcucuuuuuugguuccauauguacuuuaaaguaguuuuuuccaauucuguaaagaaagucauugguagcuugauggggauggcauugaaucuauaaauuaccuugggcaguauggccauuuucacaauauugauucuuccuauccaugagcauggaauguucuuccauuuguuuguauucucucuuauuucguugagcagugguuuguaguucuccuugaaggagguccuucacaucccuuguaaguuggauuccuagguauuuuauucucuuugaagcaaucgugaaugggaguucacucauaauuuggcuguuugucuauuauugguauauaagaaugcuugugauuuuggcacauggauuuuguauccugagacuuugcugaaguuacuuaucagcuuaaggagguuuugggcugagaccaugggguuuucuagauauacaaucaugucaucugcaaauagggacaauuugacuuccucuuuuccuaacugaauacccuuuauuucuuucuccugccugauugccccggcuagaacuuccaacacuauguugaauaggaguggugagagagggcaucccugucuugugccaguuuucaaagggaaugcuuccaguuuuugcccauucaguaugauauuggcuguggguuucucauaaauagcucuuauuauuuugagauacgucccaucaauaccuaauuuauugagaguuuuuagcaugaagggcuguugaauuuuaucaaaggccuuuucugcaucuauugagauaaucaugguuuuugucguuguucuguuuauaugcuggauuacuuuauugauuugcauauguugaaccagccuugcaucccagggaugaagcccacuugaucaugguggauaagcuuuuuaaugugcugcuggauuugguuugccaguauuuuauugaggauuuuugcaucgauguucaucagggauguuggucuaaaauucucuuuuuuuuguugugucucugccaggcuuugguaucaggaugaugcuggccucauaaaaugaguuagggaggauucccucuuuuucuauugauugggauaguuucagaagaaauggugccagcucuuccuuguaccucugguagaauucggcugugaauccgucugguccuggacuuuuuuugguugguaagcuauuaauuauugccucaauuucagagccuguuauugguccuuucagagauucaacuucuuccugguuuagucuugggggaguguaugugucgaggaauuuauccguuucuucuagauuuucuaguuuauuugcauagagguguuuauaguauucucugauaguaguuuguauuucugugagaucgguggugauaucuccuuuaucauguuuuauugugucuauuugauucuucucucuuuucuucuuuauuagucuugcuaguggucuaacaauuuuguugaucuuuucaaaaaaccaucuccuggauucacugauuuuuugaaggguuuuuuaugucucuaucuccuucaguucugcucucaucuuaguuauuuuguugccuucugcuagcuuuugaauguguuugcucuugcuucucuaguucuuuuaauugugaugucaguuuuggaucuuuccugcuuucucuugugggcauuuagugcuauaaauuucccucuacacgcugcuuugaaugugucccagagauucugguauguugugucuuuguucucuugguuucaaagaacaucuuuauuucugccuucauuucguuauguacccaguagucauucaggagcagguuguucaguuuccauguaguugugugauuuugagugaguuucuuaauccugaguucuaguuugguugcacuguggucugagaaacaguuuguuauaauuucuguucuuuuacauuugcugaggagugcuuuacuuccaaguauguggucaauuuuggaauaaguguaguguggugcugagaagaauguauaaucuguugauuugggguggagaguucucuagaugucuauuaggucugcuuggugcagcgcugaguuuaauuccuggauauccuuguuaacuuucugucuuguugaucugucuaauguugacagugggguguuaaacucucccauuauuauugugugggagucuaagucucuuuguaggucucuaaggucuugcuuuaugaaugugggugcuccuguauugggugcauauauauuuaggauaguuagcucuucuuguugaauugaucccuuuaccauuauguaauggccuuguuugucucuuuugaucuuuauugguuuaaagucuguuuuaucagagacuaggauugcagcccuugccuuuuuuuuguuuuccauuugcuugguagaucuuccuccaucccuuuauuuugagccuaugugugucuccgcacaugagauggguuuccugaauacagcacacugaugggucuugacuguuuauccaauuugccagucugugucuuuuaauuggagcauuuagcccauuuacauuuaagguuaauauuguugugugugaauuugauccugucauuaugauguuagcugguuauuuugcucguuaguugauacaguuucuuccuagcauugauggucuuuacaauuuggcauguuuuugcaguggcugguacugguuguuccuuuccauguuuagcgccuccuucaggagcucuuuuagggcagaccugguggugacaaaaucucucagcauuuacuugucuguaaaguauuuuauuucuccuucacuuacgaagcuuaguuuggcuggaugugaaauucuggauugaaaauucuuuucuuuaaguauguugaauauuggcccccacacucuucuggcuuacagaguuucugccgagagaucagcuguuagucugaugggcuucccuuuuguggguaacccgaccuuucucucuggcugcccuuaacauuuuucccuucauuucaacuuuggcgaaucugacaauuaugugucuuggaguugcucuucuugaggaguaucuuuguggcguuuucuguauuuccugaaucugaauguuggccugccuugcuggauuggggaaguucuccuggauaauauccuguagaguguuuuccaacuugguuccauucucccugucacuuucaggugcaccaaucagacguagauuuggucuuuucacauagucccauauuucuuggaagcuuuguucauuucuuuuuauucuuuuuucucuaaacuucucuucucgcuucauuucauucauuugaucuuccaucacugauacccuuucuuccaguugaucgaaucggcuacugaagcuugugcauucgucacguaguucucgugccaugguuuucagcuccaucagguccuuuaaggacuucucugcauugguuauucuaguuagccauucaucuaaucuuuuuucaagguuuuuaacuucuuuguguuggguuccaacuuccuccuuuagcucugagaaguuugauugucugaagccuucugcucucaacucgucaaagucauccuccuuccagcuuuguuccguuccuggugaggagcugcguuccuuuggaggaggagaggugcucugauuuuuagaauuuucaguuuuucugcucuuuuuuuccuaucuuugugguuuuaucugccuuuggucuuugaugauggugacguacagauggguuuuugguguggaugucuuucuauuuguuaguuuuccuucuaacagucaggacccucagcugcaggucuguuggaguuugcuggagguccacuucagacacuguuugccuggguaucauuagcagaggcugcagaacagcaaauauuggugaacagcaaauguugcugccugauuguuccucuggaaguuucgucucagaggggugcccggccgugugaggugucagucugccccuacuggggguugccucccaguuaggcuacucgggggucagggacccacuugaggaggcagucugucuguucucagaucucaagcucugugcugggagaaccacuacugucuuccaagcugucagacagggacauuuaagucugcagaggucucugcugccuuuuguuuggcuaugccuugcccccagagguggagucuacagaggcaggcaggucuccuuuaguuguggugggcuccacccaguucgagcuucccggcugcuuuguuuaccuacucaagccucagcaauggcgggcgccccucccucagccuugcugccgcguugcaguuugaucucagacugcugugcuagcaacgagcgaggcucugugggcauaggacccuccgagccaggcaugggauauaaucuccuggugugccguuugcuaaguccguuggaaaagcgcaguauuagggugggagugacccgauuuuccaggugcuguuugucaccccuucacuuggcuaggaaagggaauucccugacgccuugugcuucccgggugaggugaugccucacccugcuuuggcucacgcuuggugcacugcacccccuguccugcacccacuguccgacaauccccauugagaugaaccugguaccucauuuggaaaugcagaaaucacccgucuucugugucgcucacacugggaucuguagacuguagcuuuuccuauucggccaucuuggaacugcucccuauuuuucucauuuauaaaucugugggaugauuguucccaauagccuuuuaccuccauugaugauauugccugaaucaguuuuuacguuaugaauuauagggaaauugcuuuuuaauggccauauguaauccauauuugagauccauauuugcaaggaaagaugcauuacuaccacugaaagaacccacucuugccuuuucuuuuuaaaaguuaauauauuauuuggaucauggauuugaagguauuugaguuccauguaugcauauuuuccuuaaugaguaauuuugaaaaacugauuuaauuuaaaacaauaaguuaaugacagaucucucagauaguuuuagaacuccuaacaaugagacacaucaaauagcuaugugauauuuauugagacccuacuaagguacaaggaaucacacuagauaauacaauguacuuaacauuaaaaguuguagucugaaaguacuuacccauuuaagaagauaagacacauaugcauguaaagauggaaguauauuuguggcaggaaaccaaaaugcuaaaugacugguguagucaguuaaugcuuuugguauucacaaagcuagcacuuucaacuuugaugcuugcaaagcacugcagguauaugaagugucuugauuaugcuucugacauucugaacugggaccuuucaaguguuuuuuuuccccuaauaaauacuuaccaaguacaugccuaucauguuauagcaacuaaagaaacaaaaagaauaaaacgugcuccuugcaccuggacauaguuauugggugagaugaaaaacauagcaaccuaaaaucauuuaaaaagugcuauaguaaagguaucuacuuagugccaugguucuauagaagggagaacuaggaagucauguucauugggugauggguguguggcaggaaaggcuucacagaggaaggggcauuugagacugauaggaauuuuuuugggugagaagggaagaaggguguucuaggcaauagaaaauaggaagcaugcugaggagugugugugugcaugccaugguuuuagggaagacaagugaugccauuuucagaaaauuugggaguaguccuaauuugggaaggaaaaugguuauucacccuuuuguauguguguuguaauuuugccuuauauuggagaacaacacaguuuuaaugauagauauaauuuuucagagaaagcauauggaaaaugaacauugaagaauggacugaagaaugaauaugagaaacacacacuuuacuaacagggaaugagaggaaaaggagaccucuuuagagaaguccaacagcaagagagcuaaaauggauuauaaugucauugaaccaaugggcaagauuuuacaagaggauagugaaauaacgccacauacagcggugugcaugaggaaaugaaauuaaaggggccauuggauuugacaauaaaagaaauaucaugaauucaguuucagggauuugaggggagggaggaagcuagacuuuuggggaauaagggaagagugaugcuuaaauaccagauuuaaaccauucauuugaaaaaucugucagugaaaaguaggagagcaauaaagugagcagcuugguuaagugaaauauuuuuuuuaaguuagagaaaauuuuuguauaugugauggcagaggggaacgugcuagugugguaggaaauacuauagcuggcagagaaagaauaagauggagugaagguugggaggagaugagaacauaggugaugggguuaaucuuugaaaggaggagaggcaaacucccaguugguccagagggaaggugagcaugagggaugagcagagggaaggaagaauuacugaggaacagaagaggaaaaaagagggaauuucucugugaugguugugauguucucugugaauuuggagaaggcagaaucaucacgguuuuagaacuuccucuucuauuuauguaucccgggagugugaaugaagaaaucucugcccaccuaacauaaccuauaguuggugagugguauggcagaaguuugaaaagccaagggaguaaaguugugguauguucuaccauuagaaaaauguuaauacaaacaaaauaucaggcaauguaacacucuaauacuauuuaaaaaugcaguuauuguacagcaugaugacuacaguuaauguauauuauauucuuuuuuguuuguuuuuuuuuuuugagauggagucuugcucugucacccaggcuggagugcaguggugcgaucucagcucacuacaagcuccaccucccagguucacgccguucuccugccucagccuccugaguagcugggacuacaggugccugccaccacgcccggcuaauuuuuuguauuuuuuaguagagacaggguuucacuguguuagccaggauggucucgaucuucugaccucgugauccauccgccucggccucccaaagugcugggauuacaggcgugagccaccgcauccggccauguauauuguauucuugaaaaaugcagauauaguggauauuaaguguucucaccacaaaaaugauaacuaugugagguaaugcauuuguuagcuagauuuaacuauucuacaauguguauauacuucaaaauaucauguuguaugugguaaauaagugcaauuauugcuaauacauaaagauuuagaauaaccuuauuuaggaacacuaaauguauuacuaguuuaauuuuaaaaguuuuguuacaguaauuuaaaaguauauuuuagauagacaaaaugauuaauugaccuaauuuuaaaauguuucaaauuuugcaguguaguguuauuuuuuaacugagggcuucucucugagacuagucaguacuauuaaaaauuuaagcagcacaaauccaacucaagcagucaagcaaaaaauuaaaagacaguggauauguuagauuaaguaaaugggaguccaagauggacugaucucaggcaugcguggaucuagaacccugaugaugaugucaagggucuucuucugcugugugggcuggcucuguuuccaccugccauggcuucauucucaagcaggcuucuguugugugcuuauagccucagggcaacgucaucacggcucacugucugaaaggaagauagacuccuucucaccaguuauaugguaaauuucagaggugacucuguguuccuccuuaugucaguuuuucaucccuuaauguaucacgguagccaggagucagggggauggcaaacuugauugucuggauccuggguuaugugcucauuucuugaaggaggucacugugguuaugaguugucggggaguaguggcuuuuaacauuuuuggcacauuuccuuucagucuuauguguguguguguguguguguguguguguguguguguguguguguguacauguacgucuuuguucuguaacaaaccaaguugucaaaugaaagccuuguguugaaaucacauuccuuaggaaggaauuagucuuugauugcuuauauaagugagucuucacaacuuuuuuaguuuauguuuucauaaagaugcaguggaagccuuuucuuuuuuauaaguaaaaguguuuuucauguacauaaccuaauauuuuuaaguccuucacaaaaaugaaguaacucuauguggauaacuucaguaguaacaaaaagaaacaaaacaaccauccugucccccacuugccccaccaaccuggauuucuccuugggauuaugaaagcaguaugauggaagagaagguacagcuggcuuuggaggcagauagaucuggacuuuuaauguuguugggaggauuugagauaauuacauagaauccuuaauauaguagugcuaggcucauaauaggugcuugauaagugauaacuguuauuauaauuuuuuaaaaaaaauuauugagacagggucucacucugucacccagguuggagugcgaucauagcgcacugcaaccuugaacuccugggcucaggacauccuccugccacagccucccuaguagcuggaacuacagguguaugcaaccaugccugcuaauuuuuaauuuuuuuguagagauggggucuugcuguguugcccaggugggucuuaaacuccuggccucaagcgauccucccaucuuggcuucugaaagugccaggauuaugggcaugagccacugugccuggccuguuaaaauucuuacugauaagcauugacuuuuuuguuuugcugaaaagcacuggaugugaaugaaguccuggguuuuaguccuaacucuuuugguaaccaacuguaugcaaccaaaauauaaaacuacuugacacacugggccuuuguuuucuugccuguaaaaauaaauggauggauuagaaauuuugucuagcucuaaauuucuacuauuuaauagaguaauuuggguuacacaaaaauauaaaauagaaggaauccuaguauacuguaggaaaauuaaugaucuugguuuugauguaaaaccaagaguuccagcuucucuucccaaacuugcuaaacuuuaagaacaacaauaaugacuggaaaguuuacaguaaaaaugcaucuuauuuauguucaauaaaauuuuguuuugauuagugucccuaaagucucuucuagcuccaauauuugauauuuccuuuccaauaaauucuagccaggaauauuacuuuaaauuauaaauguauagcuauuuucgucacagcugccugucaugguuucguuugcuaccaugucauguagcguagaggggucauauggaacuuuuuguaacagaauuugacucuaccuuaccaguaguuaggcuuaauaguguauuguguuggaguauaccugaggaaagagaaauuaagccagcaaaaaaguauacaaacuuacaaaaaggaaaauucugaccaggcauuuggaaaugagcugcggccuuuggggucuguuaagauuccuacagucaagccggguauuauuuaagaugauugugaaaaccaaaggaaauaauguaugcaaacuuuuuaguguaguauuuuccauauauauuagcccccacuauuguuuuuauccuauaggaauauuuuuccucauaacagauuucaggaacuaacauaagaucagaaagaauaaaauuguaguuugggguuucgguuggccuucuucaguuuuuggauauaagauuccaguagcauccauauaaaaauugcauuagauuuuccauuggauauuugcuguugacuaaauguggcucgauaauuuuugcaggucacuacuauaagacuagugcuucagcuuuuuugaaauaguagauuaaauugguaaauaugcaaaacugcccuugguuuuuugaugcucccuucugcagguucugcuuuauggcuaucaugaucugaauuuguuucuuuauuucuaaguagcucuucuugaacucuguuucaaagaguuucccuaaccucagaauucucacaccuggcugauuggccucuagggaguauucagaaggcagucuuugugcuauuauacuuuuuuguuggcuggauaaacaucaguaguguuuaaaugaaauaauaacccugaaaagauuuuuauuaccgucuuuaaaacuuuauccauggcauggcaaguccuguuucauugaacauuuacauaugaaauacauggguugauggaauuauuaggucaaaaauggcuuuuaaugguuuuuaaguagugaacaagaaaauuugaauuaucuuuuuuucuuuuaaggauuucauucuuuguuacaaucuccauaucucucauaguucagagauaauagaaauuguuuuuaauauucauucauucauucaagaaauguuuauuuaauacucauuaugggauaggcccugaggaauaacauagauaacauaccuuauauuuuaaaaagcuaguagcucauuuuaauuucauuucagaauaacuuuguagcugcaaaauaagacuaguuuaagcuauaaagucaauuagcacaccagugaguuuuggguaggcuagaugguaaacuucaucuuuccaacauacuuagcuuuauuuaacuugauguuucugaaguguuuugaccuauucagccaucaccccuacugaacccacuuucagaaauaauaguuaaguauuugcuagguuuucauuaacuggaacugaacauuauuagguuaauuauaugauauuuauagggcagaaauggugcauaucauuguauuuuauggcuuauccuaacuaguugggugauacugucuuaauuugccuaagguaguucugguuuacucuugucgcuccagugugauuauuauacauaaucucucuuuuuuuuuuuuccucgagacugagucucacucugucgcugggcuggagugcaauggcgcgaucuuggcucacugcaaccucugccuuguggguucaagcaauucuccugccucagccucccgaguagcugggacuacaggugugcgccaccacacccagcuaauguuuguauuuuuaguagagacgggguuucaccauguuggccaggauggucuugaucucuugaccucgugauccgcccaccuuggccuaccaaagugcuggcauuacaggcgugagccacugcaccuggcccauaaucucuuccuuaaaucuuagaagugcccugggugaauuauauggcccucuuauagcuaacacucuuaguuagaaaacauauuaugugccaggcagcauuguaagcauuugauauauauuaacugaggccucacaacagcccuguaagguuggcacugcuuuauccuugauuugcagaugaguagacugagguacagaaaaguuaaguaacuugucuaagguuguacaccuagcaaguaguagggucaggauucaaacacaagcacauuugguccuggaagguauacuccuaaacagugugcuuuucugguacagaugagauugcucaaugaacauguuuaagagaaggaugagaggauagcacucuggagaauacugacauuuaaaagcaaguaaaggaaauagaaacuuggaaauaagacagagaauaagagcuaaaaaaaaaggaacuuuaaguuauagacagaauucaguuacuuggauccccccacuccccaagaauugucuucauccuuuuuuaacuagaaagaaauauuuuucuuuucacuauuuaauaagugccccaaagugcuagauaguuuuccuuugaaauauaguaaaagagcauuuauugaaagcagcuuguuuaugugugcuuuguuuaaaaauuagagacauuuuauuuuuucuuaaguaacagaaaucagacuuucaaaaaagcucuuuaaaccuagacuaacuuauuuaugacaauuuugucauauauuugaaaguuaauuuuaggaaaauuacagagccuuuuaaccacccuauggccagacuucaguguuguucuuuuuauuucuaccucauuucauguugagucuuaacuucgcugucucucuuuaucauccccuaccccuagucugaauguugaagaaugcuaaaguauauuuuauugcuucauugacuaaaacuauguuucuaaaacuaugaauuugcuuaaugagucagcaacuguaacuauaauuaacaguauaguuuuuacaaccauaguuuugugguaaaugugcaguucucagaauuuaaauguaaacguucaaugaaauuaaacaaaacccaaaucuucaugcaauagguaguauauauguauucaguaagggucaccaaacauuaauugagguucuauuaugguuaacuuuucuacuuuguacuuagggauaaaaagaugaguaaaauuguuuccugcauuuuuccccacccauucccuccccauuuucuuucuuuccuaccuuccacagccccauugagugucuacuuaaugugccaagcacacaguauauaaagauauaaagagcucaaggauguaaagauaaaugaggaucuagugccugcccuaguucaguuaucccuuaggaagacagaccaguccuaugucagucagcucagaaaagugcaauaacuguugaagccagggccacacccagucuugucuggguucacuaccccacuuuccacucauacuuuagcgaugaacagaauuuaagucaucuaaaaggaggagcaagauuaaaacagugaaggagguaugaugaguaacagaaaggagcucauuggugacuaaugaaagagcaacugcuguguuaagggguugaugaccauauucgccaguguggaguugaagguuaaggagugaaugggaaaugagaaaguagacuucaaaaaagcuggauguuguggagaggaauagagaaaauuagagguugaacauguaguaagagugagugaauauuuuuuagaauggggagauaaguguguuuguuugcugucuaggagugagcuauagaauuguccaggugagauggaaagauaacagagagaagauaugagaacaaaauccuguaggaaauuagauaauaucaagaacauaaauagaaggccuggcacaaagucucaugccuaugaucccagcacuuugggaggcugaggcaggcagauugcuugagcccaggaguuugagaccagccuguaacauagcgagaccacaucucuacaaaacaaaaaaaaaaaaaaaaaaaaaaaauuaaaaauuagccagguguaguggugcaugccuguagucccagcuaugugggagaucaggaggcugaggugggaggaucgcuugaguccaggaggucaggcugcagugagcaguggucaugccacugcagcacuccagucugggugacacagugagacccugucuuaaaaaaaaaaaaaaaaaaaagggccuggcacaguggcucacgccuguaaucccagcacuuugggaggccuguaaucccagcacuuugggaggccgaggcaggcggaucacgaggucaggagaucgagaccauccuggcuaacauggugaaaccccgucucuacuaaaaauacagaaaauuagacgggugugguggugggcgccuguagucccagcuacuugggaggcugaggcagaagaauggcaugagcccaggagguggagcuuuuagugagccgagaucacaccacugcacuccagccugggugacagagugagacuccaucucaaaaaaaaaaaaagaaaaacuguuuuuugguuuuuuuuuuuguuauccuaacuuuugaauuacuucauaaagaaguuuagugaucuauuugauuauguagaagcucuucugauaguuauacaugcuuaaucauuuaagaauaauuaaaggaacuauauugucauguuaucaggcauuccuuuaugaaaauguuagaaacuccucuuucaucuauaccuuccccacuguuuaacccuccaaucaaaagcacauauucugugguaagaacagagaauaucuauuuuaaaggucauuugugucaaauuguccuaacuagcuguugggauugggaggugcuauuugggucauaaauagcaaguuuucucucccaauaaagcaaugucugagaaucccaagauucucauuuaguagaucuggguugagaccuagaagacaguuaauucauuuagccaccaaauguguauugagugucuuccuauuauauauuuauuaccauauuguguagguaguguuagaagacaucccaggugccuacucuguaacuggcggagagauaauaaacaaacaggauaauuuuauauagugcuaaguucugugaagaaaguauaccaugauaugugccagauaauuaccuggcaggggaaaggagagagagagcuuugcauagagugaucuugggaggugucuuuugaagagauaacucuuauuuuuuaucuugcuuuuuuuuuuaaaaaaguauuuuuuagguuguaguaaaauauauauaacauaaaauuuaccauuuuaaccauuuguaagugcacguuucagcgacaucaaguacaugcacauuguuuugcaaccauucaccaccaucugccuccagaacuuuuuucauguugugaaacugaaacucugcagccauuaaacaguaauuuuuuauuuucucucuccucucagccccuaacaacaaccauucuuucugccuucuuaaauuugacugcuuuagugccucauguaaguggaucguacaguauuugugugacuggcuuauuucacuuagcguaguguuuuccagguucauccaugcuguggcacauguccgcaucuccuuccuucuuaaggcuaaauaacacuccauaauauggauguaccacauuuugucuguccaccuuugaacugagaucugaaaaaugagaaggggccaugcaagaacuagaagaagaacguuacaagcagaggaaagaacaugugcaaaggcccugagauagcaauaaacugguugguggucuaggccaguguugucagaauauauuaauaguagagaaaagugccuggaaagaaugguauuaaaugggaucagagauagacauacauuggccguauuauuuuaggcuuugaaagaccuuggcuuuuaaguggagugagaagcugcuuauuaggaaguuuuaagugggggagugacuuaaucugauuuccauguaacagcaaaagcaaaaaucacccagacugcuguguggacaagcauccuuguggauucuaaugcaagucugugaucggacuuugagaaauacuaauuuaguccuuaagucaguauccugagauagcugauuucaaaagagcucucucagggcuucugaccaaaagugacagauuggcuacaccuguacaucucuucuuauuuccuaaucccugccuaaauggaagaaagaaaucagagacugggagagguuacaacaggagacagaagcugcuauaccucuuucaaauaagcagauggacagguagugacugacuuugcagaggaaucacacaguaccuguaagugcacaaaaauaccuguaagaaaugcaguacuguguuuguccgaagcucccaagagucucagcauuuggaggcaccagauacuaaggaagauaggggucagaaauggagcugaaaacaggggagcuggucggaaaaucuguguacacugacagguggaccccuacgauuuucucccuaugugcccuuguggaugggugagucccuucacuaccaacucccuggccucaggagaacaagguuuauucuuugcaaaauuaaugaagagcugucuggacuuugaaaccaggggccguggauuguugcuugguuuaaaacaaggagaucggccgggcgcgguggcucacgccuguaaucccagcacuuugggaggccgaggcggguggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaccaaaaaaaaaaaacaaaaaaaaaaaacaaggagaucaagggaaaccuacgccugaacuauagaaguguuagcucucuuccucugcucuccuuccagaacugcacagucaagccuguccuauccuucuccuguggaagacugaagauaacagcaucuucagauacugauaggcuuucugcugagaguaccuuaagugaauucuaccagucguuaagcccuguuuucccacacagaucuuucaguuaguucuuuucaggggcuuauucuuaaauaugagcaaacaaucuaacaccauuggucaucugggggaagacuccaacauuaaaaaaaaaaaaaaguagacauagagagguggagagggagugauacuuggaacacugggagaaaacagauaccauaagggaucaaaagaaaacuuuaaaaaucuccaguauuaucagagaagacauguauuuccuuccccacuuaaaugauagugaacacauauaaaagcagaaauccaugaggguaaagagaacgagaugagagaugacagcaggcaaacaacgucaacuaaauauuggaagcugagaaccuggugcgugagugguaacagaauuuagcagagcugagaaagcagaaaguccuaugguguggguaguugugcaaaaacugguauucuuuuaauuaaugaugugcuuugcucuauuuggacugcuggguucuuauuuuugagcaguaugcucucucccaguugaagcuguuaaugggcuguccaccaauggagaaaucagaaugauuaaaauguaguucuuguauuuuuaugguucucuuaagcagucaugcauuauacucuucuucuugugucugagccaacauuucauaggaguagauaacacccauuucugguggcacugacagcaggguugaaaagaauguuauaaaagaaaauaugaauaacauuuaacuuaagaauauguuccaaauuuuguuuguaaaguaguuguuuaaaacuugguaguucuuuuugauauaauguuauaaauggcaguuauccuagaccaaacuuuaaaauauguuucauuagcaauuaaaugggcauuuguaaguucccagggaaaccuaaucacauuguauaguauuuuuuaaugaagaaacacuagcuggguacaguggcuuaugccuguaaucccagcacuuugggaggccaagguagaugaauagcuugaguccagaaguuugagaccagccugggcaacauggugaaaccucaucucuacaaaaaauacagaaaaauuaggugggcaugguggcuugcgccuguagucccagcuaauugggaggcugaagcgagaggaucaccuacgccugggagguugaggcugcagugagcugagccaugaucgugcuacugcacuguacccugggugacagaaugagacccugucucaaaaaaagaaaaaaugcuuuuuaaugguaaaauggcuacauggauuuagauuuagacuugaauucaaguccuacuucuaccauuuuucugcuauguaaccauaaguaaauuucuaauguuucugggucucaguagaaugagaauaauaucuaaucagaggguaguugugaugauuaauggauguuaaaguagaugagcuacucagucgagcuccuagacccuagggagucaauaaauagucgguuuucuucacccuuuuuuuuuuuuuuugagacaguuuugcucuguuguugaggcuggagugcagagugcaguggugcgauuauagcucacugcagccuugaucuccugggcucaaaggauccucccuucuaagccuccugaggagcuagggcuacaggugugcaccauugugucuggcuaauuuuauuuuuuuauagauacaggguuucacuguguugcccaggcuggucuugaaccccuggccucaagagauccucucacuucagccucccauagcaugugggauuauaggugugagcuacugugcccagcuguuguuuucaguuuuacucuucugugguaugugguaagagggagcauuuguuuucuagagccugcagcaugugugggucaguugaaaauguauaaaaauuuugaguuacgcacgguggcuugugccuguaaucccaauacuuugggaggcugaggagggaggacugcuugugccaggaguuuaagacuagccugggcaacauagugagacccugucccuaaaaauauguaaaaaaaauuuuaaaauaaaaauuuugaaaugcaauuugugucuuaaaauucugccuuauuuauuugcaacguguguuucuugucauguauuugcugcuguaugcugguagaaaaagcauagagaguggacucaggcaguccaugcucuagccuccuguucuacucugaacuagaugugugacauuguaagugcugcugcuucacuucggguguuacuccugauuugcacagugaaaaguguuuuauuacaagaugauuucuagaaguuuguuucuguucugacauuagaugaccugugauaugugaagcuuaagacaucuuuuuucauuacuggguuuauacgggguguugaggcuugugauacauuuacuguuauaaauucauuuuaauguguuuggaggacuugagaugauuggagauuauuagauugauagcugauguuuggcuuuauuauuggaaaauaguucuagcuacgaaaccuguuuuugagugaaaguaugcuaggaauggccauugcuuuucuuccuacagagauaagugaucucuugguguuguacacaugaagcucucaccuuuauuuuuaaagucauggauuuuaccuuggcuccuauaaacucuucuccccucccccauguagcuguaagcauuccuacuccuaggaugauuuggaauguguguguuucaaaucauguuuagugauuguaaggcuaaucucagcuuaauuaucacugccaaaggaauccucugacccccagggccagaucauguuguuugcuuucaugguauauuuuucccuuuucauaguccggguuauauauauagauguauaauuccauaauaucuugucagcaaaacuggaagcucugggagggcagugacuguaucucuuuugcugacuuuuaucuauaaugucgggcacaugauuggcagcauuggagacauauuuuugaguuaagugaauaaauuguuuccccacaaauaauaaauuaauagaaauuuaaugguaaaagcucaaaauguuuauuagaaucaugaugguagccuuuguuauuaccagugaauuuaaaaggaaagaauaaccaagguguuuguauaaaugacuuauuauuguuugugcaagaacagugaacguucccuaguacaggaagcagcuuuaaaaaacugcuggcagaacuaagaagucagacuguccuugaccccuagaucaaauguuuuugagccugaguuuccuuaaaucuucuucaguugagaauaaacauuuugacaaaauagaagauuuauucuguuaauuuuuggucuucauaaaccuaacuaaauuugcuaaaacaacaaaaacuuucuaauuuuuacuaguuuuguuuuuuaaaaaguuuguuuccuuuuaagugcauaacacuuuaaaaugagcucagcuguauuagcagauaaacauguugauucauuugguccagagcuacugaaugaagcuugcaggagcacaguuuguucuuuaugccgcccaggggcagaauguuucucuuccucuccuccuuauugagagaaggggacuggaauaagugacuccucuuauuuagguuugccugaauuguugacgagggaagggggcaagauuucuucaccauuuauccuucgucucauuuaaauucuguucauuaacauaaaguauaugcacucauacugugauauacauguugaauuauuagugucauauauuuacaguuuuuacaaaaccauuuuacuuaaugcucugguuugaguaaucuguuguuuaaagguauaaugaaucagaguuguuuuuaggcguauugcguuuuugaggauggacuuaauuuuggaagcaaagagaaguauguucuauccaguggaguggaguugagauaauagguaugcaguucgccucucauacccauuguggguucugcaucugugguucuaucaacugugugucaaaaauacuugagaaaaaaaaaaaagaaugguuacguucauacugaacaugcauagacuuuuuccccuuauuuuccccuaaacaauacagugugacuauuuauauaguaucuacauuguauuagguguuuuaaauaaucuagagaugauuuaaaguacaggccuagcuuguuuuauugcacuuugcuaauacugcauuucuuacaaauugaagauuuguggcaaccuugagucgagccagucuaucagugccauuuuuccaagagcaugugcuuauguugugccucugugucacauuuuggguaauucuugcaguauuucaacuuuuucguuauuauuauaccgguuauggugaccuaugaucagugaucuuugauguuacuguuguaauuguuuuggggcaccacgaaccauuacccaugugaggugaugaacuuaauaaauguguauguucuuaaugauccagcaacuggcuguaccccugucucucucacuccugagacacaacaauauugaaauuaguccagucaguaacccuaaaauggccucuacauguucaagugaaaggaacaaucacacgucucucuggaaaugaaaagcuagaaaugaugaagcauagugaggaagcuauguugaaagccaagacaggcaaaaagcuaguccucuugagccaagugaaugcaaagggaaauuucuugaaggaaaugaaaagugcuauuccagugaacccaugaaugauaagaaagcgaaacagccguauugcugauaaggagaaaguuugaguggucuggguagaucaaaccagccacaacauuucccuaaaccaaagccuaauccagaggcaggcccuaacucucuuuaauucuaugaagagagaugagaaagcugcagaagaaaaguuagaagcuaacagagguugauucaugagguuuaaggaaagaagccgucuccguaacauaaaaaugcaaagugaagcaaucaauguugauguagaagcugcaacaauuuauccagaagaucuagcgaagaucauugaugaaggugguuacacuaaacaauagauuuucaguguagacaaaacacucuucuauuuggugaagaagauguuauccaggacuucauagcuagagagagaagucaaugccugccuucaaagcuucaaaggacagugacuuucuuggucguagcuaaugcagcuggugacuuuaaguugaagucagugcuccuuuaccauuccaaaaauccuaggacccuuaagaauuaugguaaaucuguauucugccugugcucuaucaguggaaaaagagagccuggaagccagcacaucuguucauagcaugguuuacuauuuuaagcuuacuguggagaccuacugcucagaaagauuccuuucaaaauauuacugcucauugacaguggaccuggucacccaagagcucugauagagauggacaaggagaugaauguuguuuucaugccugcuaacacaacauuuauucugcagcccagguaucaaggacuaauuucaacuuucaagucuuauuauuuaagaaauacauuuucuaaggguauggcugcugccauagguagcaauuccucugauggcccugagcaaagucagugaaaaacuuuccggaaaggacucaccauucuagaugccauuaagaacauucaugaaucaugggaggaggucagaauaucagcauuaacaagaguuuggaaaaaguugaauuucaacccucauggaugacuuugagggauucaagacuucaaagaagaaaguaacugcagaugugguagaaauagcaagagaacuagaauuagcaguggagccugaagauggaacugaauuguugcaguauuaugauaaaacauuaauggaugaggaguugcuguuuuuuaucuguuuauuaaaaagauuuuuuuaaagacaaagucucauucuguuaggcuggagcagaauacaguggcacgauccuagcucacugcagccuugaacucccuggcuaaagcgauccucccuucucagccuucuaaguagcuaggaccacagucacacaccacugugccuggcuaauuuuuuaaaaaaauuaucuuuuguacagacagggucuugcuuucuugcccaggcuguuuucgaacuccucgcuucaggcgauccuccugcuuuggccucccagagugcugggaauacaggugugagcuaccaccccuggccaggcauugcuucuuauggaugagcaaaguaggugguuucuugagauggauucuacuccuugagaagaugcugugaacauuguugaaaugacaacaaaaggauuuagaauauuacauaaacuuaauugauacagcaauggcaugaugugagaggauuaacucaaauuuugaagaaaguuuuacuguggauaaauaguaugacacguuacagagauauauuucauaaggaagagucaauugauguggcaaacuuuauugucucauuuuaagaaauugccacagccacucuaaccuucagcaacugccaccccaaucagucagcagccaucaaggcaagaccuucuaccagcaaaaaguuuaugacuugcugaaggcucagaugauccuuaauuaagguaugugcauuuuaaaaucauaaugcuguuacacagaagacuauaguauaguguaaacauaacugucauaugaacugggaauccaaaaaauuuguguuacucacuuuauugugguggucuggaacagaacgugcaaugucucgagguaugccuguauacaggauaauguguguagguuauaugcaaauacuauaccauuugauauaagagacuugaauaucuguggauuuuaguauccuuagugggucccggaaucagucccccccacgaauacccagggauagcugcacucacacauaaugaauuuauaguggaaauucuaugaaauguauauagaguuguuauaauauaccuaggaugaucauugguauuucggaauagcuuuuagaauaugaccaagauacaugacaucuacuauuauauaaaccuguguuuguuucagcauguuuuuuuccuauguuuuguuccauguuagaugucaugaguuugcaaaguauaauaagcuauauucccugccuucaaguagcuuaccauccauguaccauuucccaaaguguacaucauuagcagguagguauuccucaaaaauagauuauugucucugauuaaguuucagagauaccuggauuaaucaaaauugaaaguuuuuuuuuagaauaggguucucaaaugcauacauuagggaauuccagaaagcgacuguauguugcaagguuuuccaagcuuugucgacacacuauuuuuuuucucaugaaacuucuguggugggaucugaggggaauggagguggggaagagaguggcagugguguuuuuaggaagaagauuaauguaggagaggagugggaggaacaccuaggacaguagcuguguaccuggccuagguuccucaguccagaugguagcaagucugaagacagggagagacuucuuccagaagaugaaauucauagaaaccugaggcaaauugguauacucaaaggagcuuugucagacuggagagucuggggugaauugggauaaauauauaguagauaaguauguagaaaacuaaagaaaugagaaacaaauuauuaauugcaagggaaacaaaauguuaugcaggaaaagaaaaguaauuauuguuuacugcuugguucagcucugaauacccuauguaguuauaaugacauaagccucaaauauugaucuaaccaaaguuaggauuguguugagacaucgggggugggaaguguggaggaugccaggaccaggaaacagcuauaucucaaauuuccucaacuggcagucacugaauaaagaaagcuuuugggaaaaggaaauauuggagagggagcugggacuaguuuuucauaacaagccuuguagaucuaguuaauuuaaaaaaaugugcauggguaacauuuauuuuuaccuuuaucagauauuuuucuagaucaaaauuuuuacaauuguuuuagcuucucauugaaauguugucuuacuagguuaaaguuucacguguguaauuggauuugaaaaauguaaauucacuuugucguugccuuuaugauuuagcuacaaagaucuuacuuauggaugagaugaugacuggcaguuauuccacaccaaccacucugggaccaagguuuucuagauuaaccuaauccuacaguccuuuuauucuguguuucccacuccuacauuuuaaacuuuguaucuguauuaugcucuucugugcuuguuagaauacacacuguguucucaggucaguucuuacaugggccucuucuuuuuuuugccuucuuuaauuuccuuuucuucacagcuuuuuuagcaugucaguagcagagcugacuuuauguagugagaagcuacugugugcuucucucuugacccuucuccccaaacauggauggaagggcagaacaagagaccugugggugaguaggaagggcugaggaaugccaucacccuccagcauuucugguucaacagcuucuaaucauuuuuaccaucuccaccgcgcacccccccaccccgugcuuuuaauaacuucaaguuucaugauugacugguuuacuuuuauuugcuuauuacauacuuauuuguuggauucagagcucuuaauuguuaguagaaaugaacuuacuaguuaacuuuugcuaauuuaaguauaaacagaauuaauugaagauauuugugguuucuugagcugauggaaaggccaggcuauuaagauuggggcugcacagcuaggaacaacaauaccaccauuccuaaaauagcuguagaacaacacuuaaauaacugacuauccugcuuuuaaagacugcuauucuuuuuuuacaaacuuguagguugagaaauuuuuacuucuauuuucaauuagaagucuuugggaaaauuaugggaugacuggauuuguguauaucuauaauccagagauaaggaaaaagaggaaacacagauuuucaggagauggaagcauaacuuuguucugcuuugugcuugaauaccucuuuuugaucaggguuagaggauaaccuuaggucagugcauuucccuuguguuuuuguuaacaaaacauaguucagaucccuugauuaaaacccuccacugguuucuugucucaugaagaagaaaaaauccuaacuguucuugaugaucuuuaaggcucagaaugaucuggacagagguauuuaccuugaagcucauaaagcauaggccuuucucacuugcagaguaucuuucugaagcuggacuaaauugguuaaggccacuguacuuuuccacuuugucuucuuuccugucacacacccuauccuuucaggcuguguugggauggacaaaagcaguucuggaguccuaaggagaagaugagugggauauguuucugugaccugcagucauuuuaaaguuuagcuguugcuagcugacuccauguaagaauaccuuccaggaauuugauggcugugcacucuggcagugcagcuggcaugguuauagggugcuuggccgaagguuugcauagcaauaugaacgcauccuacgacacaucuagccaacacuggaagacuguggguaauggacgagaaaccaagauugacuuuuugcaaguuuuuaaaaauaaucuucuuguaacucacaugugaaagaaacaugagagguuuucacaaauucaguaauuugagacauuuacauagcaucaccaauaguugugaagcugaaacuuuaguucuaaacuauaaguaguaaaaaaaaaacguugauucucuauuguaaacaaaagacaacuauuuucuguguucucuguguagaaaauuauauuauaaaauugagguggggcugggcacgguggcucacgccuguaaucccaacacuuugggaggccgaggcgggcagaucgcaaggucaggagaucgagaccauccugacuaacacggugaaaccccgugucuacuaaaaauacaaaaaaaaaaaaaaaauuagcugggcaugguggcuggcgccuguagucccagcuacucacaccugcggcugaggcaggagaauggugugaacccaggaggcggagcuugcagugagccgagauugcaccacugcacuccagccugggcgacaaagcaagacuccaucucaaaaaaaaaaaaaaaaaaauugaguuggacaguggcuuguaccuguaaucccagcuacgggggaggcugaggcaggaggaucacuuaagccgggaguugaaauccagccugggcaauaucgugagacugugucucuacagaaauaauaauaaaaaauagcuaggcgugguggugcacuccuguagucccagcuacucgggaggcugagguaggaggaucccuugagcccaggccuuuguggcugcagugagcuaugauugugccacugcacuccagccuaggggugggagggggagcacaggaggccgugaaggccagcccugcuggcuguggcuacugugcguggaccaagagcaugugcagcaugagggcuaugguggugcccagagagcaguguccagcgugagggagauuguggugccuggagaccuggcaguaucacccggcaugagggagaugcuggugcaccggcuguggaugugagcuugccuggugccagaacucggaggggccagacucuaauuuaguacuuuuuuaugugauuggcaguuucuaaaaauuuguaauuugaugucguuuccuuucuuauucugaauaaauauucaauuuaggaccuaaauuuguuuuuauaguuuuauguuccuuuuuuuuuuugaagagggcuguucccccaauuuuauaagcuuuaaaauuccguuaaaaccuggauugaccccuggguuuccuugucugccuuuuuaaucuugucucauacucacccccucauucccugcagucuaggcacuuucaucuuucuguuccucaaauggauuauguuuguucucaugucaggauuucugcacuugccuggucuccucuuuccuuagcuuuuugaaggauuuuucauuauguacuucucaggacgggugucuucucagagagucuuagaacacccaaucuaaaguaucuuuucucccucccucaucucugucacgucauccauuuuguuuucauagcauuuaucagcaucuuuuuuauuuguuuauauuuuuguuggcugucucugccuuuuagaauauaaguucaguguauuaauaugagagcuguauuguucacugcugucuucccagagucuagaauaauggcuggacuuauuagcauucaacagguauuuuuuggaugaaaaauuacuaaaaagcuggaauuuguacauuuucccauggguuuauuuauaauacuagcauaauuucuuauuguuaauuuuguguuuguguaugguacugcuuucuauuaucaauuguauaaacucguuugaucuuuucugcugaaaauguugacuaaguuauuauuuaccauucauuuugguuaaacauauuuuguuauagacuauucaagcagucagaagacuauagagaagaauaaagugagcacuaaaguacccauguccuagcuuugucguacuuuuucaccagauuuuuuuuaagaauuaaaaauuuuuuaaguuaacuuuucauuuacaaauuuuuaaauuuuuuuuuaaaaauucaccuuaauuaacugaaguuuaugcauucuucucucaucuuacuccucauuuuucccuacuuacccagaguuauaccuaguccagaugaagauauagggugagguacagaaggggccugagcacagaagcuucuguccuguggaguuaggguaugccacccugcuggcacauggaugccaucacuaacccagaaguucuucaagccccaugguuuuggcuuuuauguguagacauaauuaaucaaaucauuggccaucgaugaucaacuccauuucuagcuccucuuuccuucccagagguugagggugaggugaagcugaaaguucuaacccucuaaucaugcuuuauuuagucuuucuagucacuggccauuauccugaaccgaucuagggaccccacucaccaguucacuucauuaauauacaaaggacacucuugucacuccagaaauucuuagaagcucuuguuuuaggaacuggggauugagaccaaauuuauaauaaaagaugcuuuaucacuccuauuacucaggaagcgggaagagcuuuaggagcucugugcuagggacccaggagcuugggaggaagauaaaaauacauauuucuuguaauauuacaauaucacaggcuugaauaccagggugugaggaucauuagaagccaucuuggaggguagcuaccagagucucauauauuuccuuauaaaauaccuaaaguucuuucacauuuacugcuucuuuaauccacccagaaugggguguguaugugugcaugcgugagugcccauacguguauuguguaugguguuaaaggaaucuaaucuuuuauucuuucaaagauacgcuaaucgucccaguuccauuuguuaaauaauucaucagcauuguuccauuuauauauggguuugcuucuggguucucuguacuucucugcuaugaucugaauguuuguccuucccuaccuccccaaauuccuaugucgaaaccuaaucccggauaugauaguguuaagaaaaggggcuuugggugaggugauuaggucaugagggcucugccugcauaaaugggggcaagaagguaccccagugaaguaguuagcuucuucuucuguaugaggacacaacaagaagggugccaucuaugaagaaugggcccuucccaaacauugaauuugcuggugccuuguacuuggacuuccagccuccagaacuaugagaaauaaauaaguuguuuccuauguuuauaagcucccuacuuuaugguauuuuuguuacaguugcccaagcagacuuaagauguuuuccuguagccuauuuuucuauucuuaggccaauaccgcuuuacaaguuuugaucucucuuaggcaagucuccccuuuuuguucuucauguuuggcuugguucucuugucuccaaagggccauuaagagagacuaguuggcuggguguaguggcucacaccuguaaucccagcaccuugagaggcuaaggugggcagaucacuuagcccaggaauuugagaccaggcugaacaacauagcaagacuccacuucuacaaaaaauacaaaaguuagcugggcaugauggugugcacuuguagucccagcugcucagaaggcugagguaggaggauugcuugggcucagaaggucgaggcugcagugagcugugauugugccacugugcagcagccugggugacugagcaagacccugucucaaaaaggaaugauuaaauaaauccaucaauccaugugaauuuuagaauaguuuuccagguuucaucaaaaaucuuguuggaauuuugcuuauuuuaaggaauauaaaaauaugaccuuuuuaacuuaaaaaguaauagauacuuacuaaagguauuagauacauuuaaaaaacuguuaaaaaaauccauaggucugucacucaaacaucaacauuauuguggcauuaggaauccauaaagauuugauauuguaaaagugaaaucaucucugcaacaaaagguauauacuggguaaaaaauaggguuaauauucuuauacaauguguuucuauaaaucauuaagaaaaagauaaaugacccaauagaagaaaggacaaagaaugugaagaggcauucgacagaggagggaaguacaaauggcuaagaacaaauaaaaagaggaggaaaaugugaaguaaaacaaaaugaaccaacgcuuccccauuuuuacagcauuguauaugaaaugaaaaaaguuggagacagucuuaaguacucaccaaaagaugaauggacaaaugcauucauucguacuauggaauucuaaccaaccauuaaaaaaagauuaugugcuaacaugaaagaaugucuacgguuaacuuuaaaaauguaaaguaaaacaaggguuuauauaugugguaucauguuuauaaagaaaauuauauauacauaauuuuuuccauagaaaaaaauuuuagaaggcuguauagcucuauuaacaguaguuaccaagaguguaggaguaugccauagaagagacuuuaacuguauuauuuggauuuuuuaaaaagaauuaugcccuacuuugcaauuaaaacaaauuuaaaacauuuuugguguaauuccucuuaguguuuguuuuuuucccuaggcauaaguuuauuuacuuauuuuuuuaaacaguaguaaucuauagaaaggaacaauuguguucuuaaaauuuuucacucaguggaaggauucauucaaaggaauauuugaaugcaaauuggaguuagaaucaaucuagguuauaauuccagaucuacugaaaauuuuaucuugacauaauucagcccuguauaaaaguuagaacaauuacaaaguuuauaugcucauuacucaaauuuuaacauuuuuccauaguuguauuaucuuucuuuuuuccucuucuuccuuucuucccucuguucccucucuuucuccccuucuguauauauuuuaaauauauuuauauagauuuuaaacauauuuuuaaauacuuaaauauauuuauguucaaauauauagaauuuuuuccugaaccauuuuaggguaaauuugagacaugaugccuccuuuagucuuauauacuuaagugcauguuuccugaaacaaaagugguauccuacauaauuauaguuaccaaaaucaagaaauuaacauugauauaauaugguuaugcagauauugccaauaauugccuuuauagcucucauucuacaaaaaauaaucuugaaucauauguugaauucaauugccaugucuuucuaauaaucuuuaaucaggaggcacaucauauugauuuguccuaguccuaguaauguuaauuuugaucaccugguuacaguaguguuuaccaacuuucuucuucauuauaaaguuauuuuuccuucuuuauaauuaauaggaaucuugucguaugauucuuugagauuaugugaauaucugguugcuccucaaacuuuggcccaccaauuuuggcauccauuuaggguucuuacuugaauacauuauuaaugauuuaugguaguuuucuaauucugacauuccuuuuucauuuuaguuggcuuuuuacuauaaggaggaaauuucuuucucccucgugaauucugucuuacucaauggguuauaaucuuuuacuaucaucauuuauuuugaaaugcuuaaaugauucuagauugggcccaugaaagcacuuucaggccggcuuuuaaauucuuuugacaugucuccaucaauuuuugaggacuugcugggacaacaagauauuccagucucgucauauacuuuccuaccucuagaagcagcucucuagggagcucugguucuucuuaguggaaaauaguauuaacuuuccuuuauuuuuaauucuuuuauuuaccuuuguucuucaugcaguauuuuucuuuuccuuauccuguccugauccauucuauuuuugcaugaauaccguacuguuuuaaucauuuagguuuuguauuuugguuaauuauuuaucuuauuaaauauuucuguguauuugacacuagugagaaaccacucuugcuuguccccuggaaccuuaugaucuccuguuucuuuuugaucuguuugaauguucuucucauucuucuuuugaauucuuccuggaugagauuuuuaaaggguagaguucccuaggauucucuuuuugcucuggaaaaccaggcauugucacugcucagguauugcuggaggagaaucuacacuguaggagucccuacaaacuuuagagacgguuugacaauauauaucaaacuuacaaauguaucuucucguuucuggaaguggauccuauagguaaacuuaggaauguuuguuaugugauauauacaaggugauuccuacaacuauuguguguaacagcaaacgauuugaauaguaucaacaguaauccaaaaaguuuguuaacauuuuucucccuuuuucuauucauaucugcaugaggcuggauuuucuucauauaugccaagacaacauacagcaucagaguagggaaaagcccaaauguccauuaauaggaaauuggcuaaguaaaucaugguacagcaauacaauggaauauuacauagucgaaaaagaaugguaggaugagguccauucagugacaagaaaaaaaaaagaaucggaagaauaguauuuauauggaaaaucauggaaaaaccucaauuuauguaaaggagaggagauaagauguuauaguuguauuugcuuauauugucauaaacucuggaaugaaaaacaacuaauauuuuauccagaaagcaggguuaaacaggcagauggaugggugugaugagacuuuuuacuguauaccuuuuuaacguuugauuuuugacauacacauguacaaucuguuuaauucaguuuuaaaaaaugauuuccaguauaacuuaaaccuaguuuugacacagcacacacuuauacuuuguaccucuaaaccauuggccuacagcacaguauucuuaacacaguauggaaagccuuuugucugucucuauaggaugauacucugcaacuuccagcuucauccuuuacauucuagugacacugaauuucugguaguaguucuccacaugugguacuguuuuauauuuguguaugcuuuaccuguaucuucuucauaucuuuuaagaaucaguuugugucaucuucucugggaagcuggccucaaccuuugcaaggcuuaguugagugauucagucauaauacucuguauaauugucuauuauugcucuuauauugcauuguaaucauuagcuuuuuuauuguacuuagacacagauaaccaaagauuugcuuuaguguauuuuuuucacuguauucccaguagaaaagcauuaauguauguuauuugaugucuuuuucugcaggguaguugcccugccucaaacagcuuauagucuuuaauggagacaugcaggaaugcaacuaacauaagagagaguguacuaagugagguaauaggcaaggucauacuuuuaaaggaagccagucuuugaaaugaaucuuaaagauggucccagaguccagauggaaacauucuaacagggccuauuuaggagccccagauaauguagggguagcuucaguauaaaggauacaugccucaaggugagucagggagaaaaggaaaaacagggacagauugugagaggucuaacauuccagucuaaggaauuugaauuugaauauuaucuugugggugaaguaggauucuuuaaugcuuuugaacgaggaaucaguaucuguacuuucaggaugauuuuaugcuuuguguaaugucuuccaaaaaagaugagagauggggcaccuguuaauauauuuuauauuauaaaguacaguguugaauaugggaucaaaaaaggaacagccagccacauuuccaaaucccauguuuuugaccagauagucccuucaaccuagaauuaugucucauucaagcagugugauucuauucaucucaaguugucauaagaaagacaacuuauauguuacuuccacuagugaucccugauaaauuccuuccaaauguuauuaauaacuguauccuguuuugacugcauuguauuuauuucuguuacaauuuuucucauacccuaccuguuuuacagugcagggguccccaacacccaugcuguggaccaguaccaguccauggccuguuaggacugcccccugccaggccacacggcaggaggugugcauuaccaccugagcuccaccucuugucagauuagcugugguguuagauucucauagggaugcaaacccuauugugaacugugcacgugacagaucuagguugcacucuccuuaugagaauuuaaugauaaauguaaugcacuugcaucauccccaaaccaucuucacuccccaccgcccccgucuccccccaaucccauggaaaaauugucuuccaugaagccggucccuggugccaaaaagguugaggacugcuguuaaaguguuugccuuaaucacaaccacaauugcuuccuccuggaaacccuuguuuuacuuuauuuaacccacucggguaacacuuauuacauuguauuacugucugaugguuuucuguuuauuucaccaaacauuucuuaggugccagaccucaaggaagucauucuuugucaguucauguguuugacuauacuacuugauuauuauuagauauacgaauuccuuaagggcaccuuaucuuuuuuuauugcacuuagcacaacucaugauacauuuaggcacucagacauaucagagacaucagcggaacaguacugguuaaaaguugaguuuaaauucuggcccuaucacuaucucuuggauccacuguagggagguuauuuagucuguguaagcuauaauuuuuucuucuguaaaaugggggaaauaauaguuuccaucugaauuagucuguucaagcugccauaacaaaauuucauagucuagguguuuucucacaguucuggaggcuggauguuugagauaaggugccagcaugaugggguucuggugagggcucucuuucuggcuucuugcugugccucacauaauggagagugagcaagcucuuuugggucucuucugauaagggcacuacucuuaugagggugagggccccacccuccugaacuucaucuaacucuaaucuuuucccaaaggccucauuucaaauaucacacuaggggguuagcguuucaacauacggauuuuguuacagucuuuaguggagacaagcaggauuaauuaauuuauggaaagcaugcagcagugugccucuaacauaaaaaaugucuuauuuaaccugucaucaucaucaucauuuugacuuggccuaaaauuucgcauaugggcuaguggagaaaaauuagaacuaauuuggugauuuugcucuucauugauggaaaguaugugauaacauucauuaagaagggcaauguaggaagaaagagacaguuguaggcaugcuguggagagaugcuuccuucacuguaucaguagagaagaagaugguugucaaccucagguuuauggaugaauccucaguaugcuguaaauagaagaaaagagaugcuuuaguguucuuuauaucuauguggccuuuaaaaugcaguccuuuaauuuguuuuuauucaaaucuuuauuuuuuauuuucuuuucucugauuuaauugauagaucggguuuuucagugagccugggaaagcagaaguaccauuuuuaugucuauaaauaauacuaaauuuauuuugcuggauuuuguaaaguucuguauuaaacauuauggaucuuaaauauauuuugguauuuuaaaauuagaguauaaucaguuucuguucucuagccuuuggauuuagacuuuuucuucucuaaguuaaugaguccaggacugauuuuguuagccuuucuggagcuguuaagaauuccuauucuuucguuuuugguagucauugucuccacauuugcuuuauggaguccucuuugguggaucccacagguggggaggagacacaggauucauaagauggccggugggugagugacuuagaauuuggguuagaacuggccgggcgcaguggcucaugcccguaaucccagcccuuugggaggccgaggugggcagaucacaaggucaggagauugagaccauccuggcuaauaagguaaaaccccaucucuacuaaaaauacaaaaaauuagcugggcgugguggcaggugccuguagucccagcuacuuggguggcugaggcaggagcauggugugaacccaggaggcagagcuugcagugagccgagauugagccauugcauuccagcccaggagacagugugagacucugucucaaaacaaacaaacaaacaaacaaauaauaggaacaaggacgggugcgguagcucacgccuguaaugccaacacucugggaauuugaggcaggaggauugcuugaguucagaagugugagaccauacuggggaacaugacgaaaccucgucuuuacaaaaaauacaaaaauuagcuaggcgugguggcacacaccuguaguccuagcuacucagguggcugaggugggaggauccauugagccugggaggucgaggcugcagaaagccauauuugcaccaaugcauuccagccugggugacagagcaagacccugucucaauaauaauaauaauuggaauacaaugugaaauuuggacauuacauugucuuggugaaaucuguaaauacaauguaaugguuuugaguuuuuuccuuaugugaauuuuauuaauaauuuauauggcagagcuaucaugccaucuguauguacuaggauguuaccaaaauacaugcaguugacaguuugggaaagcauagagcaaauaguauauccuaaguagaucuuuucuuuggcuguagugguuaaaaagauauccuuaaauugugguuuggggcuuuucuuuuuuuuaaacaacaaaaauuucaacucuuaauaaauacuauuuuacuugugauaagaaggcagguaugcuucuggaaccacagaaaucaaacuugagagaaaaaauacaaacaauuauagagagacagucucugauuaacaugaacauaaaauaaccaucaggugacaaaccuuuucacaagaaaaaugaucugugcccaagaucaauuuuauagacauuaacucaaagcugugauuuuauacacaaagcaguauuguagcaaugguauaaacacaggaaaaauucuugugaaaggaguggagccugcaaauguggaacuauguggaaaagggaaaaguuuguaguauguagaacuauggcagguguuuauauuucacaguguaaaaaauaaacuuaaauugauauacugguuuacuaaugaauuuaugaauuuucaaugaauuuauguagagcuuauucuguuagaugggacuaauaguaagaaauacuacaaaguaggaaaaguuugucucuaggacccuuuugugaccuuuuuuuucuugcucuuucacacuccucauguaauggucaccauccauagauccuucucuguucacucuguucaaaagagaucuccaagaccuguaggcuuuguuaaguuaucuuaaaaaugaugaauaaacacacuagaguauugauggauuguuucacauuuaauugggacucuugaaaguccaaacagaauuuucuuaugguaaaauucaaacauugacgucuguuaggggagauauuuauagagaagagaacuuuuugagucugcuccuuaauuuacaaccuguugucaguugggaaggaaauuaacauuguuaaaugcuuauaugcuagugucugggugucugugcuaggucauacacaguauaauuugauucucacaaugagcuugugaguaugacauucuuauucucauuuuauaaaacuuuuuuuuguggggggcgauggggucucacuguguugcccaggcuggggcacagucacuauucacagguguggucauggcucacugcagccuggaacuccugggcucaagcuaucuucccaccucucccuccccaguagcugggacuacagcuuauucaaguuuuauaagagauaaacugaaagaggcauagaaagaugaagugaccuuccuaaagaggucacaguggagguaaaucauuaaaaucaggauuucagauuucaaagcgucuacuuuuaccaccaagccaguauuucauagucauuuuacucuucuguuuuacucauacucggugaacaugacaauaucuuuaauuacccuccagaauuccuuuacaugucucuaaagagaugauucuucaguuucuuuuuguuuuauauauauauauauauauuuuuuauauauauauguuuuuauuauacuuuaaguucuaggguacaugugcacaacgugcagguuuguuacauauguauacaugugccauguuggugugcugcacccauuaacucgccauuuacauuagauauaucuccuaaugcuaucccuccccccuccccccaccccacaacagccccuggugugugauguuccccuuccuguguccaaguguucucauuguucauuucccaccuaugagugagaacaugcgguguuugguuuucuguccuggugauaguuugcugagaaugaugguuuccagcuucauccaugucccuacaaaggacaugaacucauccuuuuuuauggcugcauaguauuccaugguguauaugugccacauuuucuuaauccagucugucauuguuggacauuuggauugguuccaagucuuugcuauugugaguagugccucaauaaacauaugugugcaugugucuuuauagcagcaugauuuauauuccuuuggggauauacccaguaaugggauggcugggucaaaugguauuucuaguucuagaucucugaggaaucgccacacugucuuccacaaugguugaaccaguuuacagugccaccaacaguguaaaaguguuccuguuucuccacauccucuccagcaccuguuguuuccugacuuuuuaaugaucgccauucuaacugaugugagaugauaucucauugugguuuugauuugcaguucucugauggccagugaugaagagcauuuuuucauaugucuuuuggcugcguaacugucuucuuuugagaagugucuguucauauccuuugccuguuuuuuugaugggguuguuuuuuucuuguaaauuuguuugaguucuuuguagauucuggauauuagcccuuugucagaugaguagauugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaagucuuugccuaugccuauguccugaaugguauugcccagguuuucuucuaggguuuuuaugguuuuaggucuaacauuuaagucuuuaauccaucuugaauuaauuuuuguaugaguuguaaggaauggauccaguuucagcuuucuacauauggcuagcuaguuuucccagcaccauuuguuaaauagggaauccuuuccccauuucuuguuuuugucagguuugucaaagaucagaugguuguagaugugugguauuauuucugagggcucuguucuguuccauuggucuguaucucuguuuugguaccaguaccaugcuguuuugguuacuauagccuuguaguauaguuugaagucagguagcauggcauccaguuucuuuuugaaucaccacaugagaccauucugcuugucauugauuagucuuacuugaaccuuuugugguauuuuuagcuaagaguauauagaaaugccuuguuagcagagaugacugacaacuacaauauucaguucuaaauauauuguuagguuuuuguuuuguuuuguuuuuugcagauagcuaacucugaaguuuguacuuagagcaaguaaguauuggcaaguuaugugugaauaauguuuggaauuauuacagcaagaauuaacaaauuucuuguuaucaacacuuuagaauagauguauucaguauuauaagcagucuuaaaauauccauucaacaaagaguuacaaaguacuuacaugugccagggcuauguuagguucugcacagaauagaacauggaaaacacauggucugugcccucaaugagaagguaguuuaggagggaggcaaacaugauguaauuaauagaauacacucuaauaaucauaguaauggagguguguaguaggaagagugggagcaauaggaaaggaauaguuaacugcauuugagggacucugggaaagauucagagaagagguuguaguuucaacugaggcuuaaauauuuugacuacaagaacauucguggucugcuuauacauuuuacauauacaacauuugcacaaacagcauuucccucacauguacauaugaaugcaguauuuagcuugaacaucuagccucuuccuuuuucccugaaaucaugcauuaucauguggauucuccuccccccauauaucuuuuuagaagacuucucucagagcuucucaguuguuucccuuuaguucucugcucuccagcuuuuaaauuucucuggcuuuuggaagcaggcagacucuguuucuacagucuuuaaaacaguaaugaaugaagaaugacaacgguggugggaaauguagaagagaacagaguaauggaacuaggucccugaauauuugaucauuuuugcugucccaaaaauguuuuuuuuuuuuuucuauuuagaauaaucuccaggcuuaaaagugugacuagguaucucucaaacacaaaaugaaguuaagaaacagcugucuggaaaggaacauuguauucugugguauacuauuuucuggcacauuuugguuguaaggcuuuuuggugauacaaaggauuccacucugauugagcuuacauauacaugccuaucucugucuucucauauacaugcagcuucucccagacaggcacauugguggauguuaaagcaauuaguuuuacuugaaaaaaaguaugauacuauggcaagagcucuggauuggaauuaggagacugaaauucagguccuaccuugaccuaugauuaauuuguucucuuugaguuagucaguuaaccucucuuagguuucaguuuuccuguuuauuaaauaaugggauaggauaaugcccucuaaggcuuuuccuaccccagaaauucuaucauuuuacuauugauggaguuggcuguucaacucacaaaucuuuauugagugcuucucaccuucaggcacugugcuaggugcagucaaaaagagacauagaggagagaaguagaucaauggaauauaauugagaauccggaauuuaaaccauacauauauggcuaauugguauucaacaaggauggcaaggcgauucaguguggaagaauagucuucaagaaaugaugaugggacaacccgauuuccacauauaaaagaaugaauuuggacuccuuaccucacaccauguguaaaaauuaaugcaauguguauuaaacaccuaaauuauaagaacuaaaacucuuagaagaaaacauaggggugaaucuuuguaauuuuggauugggcaaugguuuauuacauuugacaccaaaagcacaagcagucaaugaaaaagaaaguauacuucaucaaaauaaaaaacuuguaugucaaaggccgcugucaagaaagugagaaggucuucaggaaacaacaauuuuuaagaaagugaaaagaauagaguaugggagaaaauauuuguaaaucaugaaucugauaagggccuaguauccagaauauauuaaaaauucuuauaucucaacaaugaaaagacaacccaauuaagaaaucugaauagacaauaugaauauuuucuccaaagaagauaaucaaauggccaauaauacaugaaaagaugcucaacgucauuagccaucagagaagugcaaauuaaaaucaugugagauaucaacucaccuauuaggaugucuguaaacaaugauaaacaguguuggugaggauauggagaaauuggaauccccauacgcugcugguagguuuguaaaaugguacagcugcuuuggaaaacagcaguuccucaaaaacuuaaaacauagaguuguaggucucagcagucuacaccuggguguauuucuaaaggcaucaaagucauaugguuguacaaaacuuguaugugaauguuuguaguaguaguauucguaauugccucccaaaccacaaauguccaaucaacuguagaguggauaagcaaauuaugauuauucauaaaauggagcauuauucagacagaaaagaaaugaaauaaccuugaaaagcucggcuaagugaaaaaaacuacacacaaaaggcuacauauuguaugauucauuaauaugaaauauccaaaauaggaaaauccuuagggacagaaagugguuucauggucaggagaugaggggaugagggaauggagaaugacugcuaaugaguucuggauuuauauuuggggcgaugaaaaguucuggaauuaguagugguaguugcacugccuugugaauguaauaaaaacuauggcuuguauacuuuaaaauggcgauuuuuaugguaugugaacuaucgcucucuuuuuuuuuuuuuuuuuguggcggaucacugucuugcccggacuggaguacacaggcgugaucuuugcucacugcaaccucugccuccucgguucaagugauucuccugccucagccuccugaguaggugggauuacaggcgcaugccucuacacccagcucauuuuuguauuuuuaguagagauggaguuucaccauguuggucagguuaguaucgaacuccugaccugugaucugcccaccucugccucccaaagugcugggauuacaggcgugagccaccacgcccggccuauaucucaguuuuuuaaaaguuguggcaccuaacuaaaaugaacuguuuuugauagggauagagaaggguucuguaggaguauacagaaugacauuuugaccuacugugugaaguugacagcaaacuccugaaauaaguaauauuucaacagagaccugaaaaaugaauuggaguuacucaugugaaaaaacuguuagcaauggaaaugaggaaacauguaagaauauaucaguuaaaauuaacagcugaaagccaauuuuagcuguaacagguauaagcuccuacuugugucacuauguaagauuuugucaaagacuuuuugccuuaaguaauguaauuauccauggagaaccauagcaauauaauauuuguuauaaaauauauauauuauauauauguauguauaucuccuagcuucuggggaaaacagggcauuuauuuuuuauuuuuugauucuaaauauuuuuaaauuauaguuuauggcauuuuauaauuuuaaauauucuugaagccagaacuaaauucuagaguuuguuuaugcuuuauuuuuuucccccucucuauauauuuuauaaggcaauuuucuaagcuuugauccuauggaaauuuuaccguuuucauuacuuuugacaguuugagauuaguuucagaacccuguaagcaaauaguaaauauaauuagggaaaauuaaaauauuucuguuuccugguaggcaauaagacauuaagaaaaaaauucagacuuauaccaaaguagaggcaaguauaaucagcacccauguaaucaucaccagcuucaaaaauuuucaacucaugaccaaucuuauuuuaucuauauauccacuuacuccuuuacccacuggguuauuuugaagcaaaucucagauacuguaucauauguaaauuuuuuaucucuaaaugacaaaucuuucaaaaaauauauacuauuggguauuuuuuuaacuugaaaauacuucuuucuugugaaguauuaauuaaaaaguuaucuauuaguggaaauacucuauauaguuuuuuauuugcuuauauauccauucuaauaaauauuagguauguuuauaaaaauaauaaaauugagguuaugagaaugugguucauauauuagucuaugcucaucuuugugauuaauuaugaucaacgaaaccauaggcaugauaaaacucuucucuauagccacugauuaucuccuuuuaucauaaccaauggccuuaacucuguuaugccuucugggugugucuaucauuuaauuuauugauugcccccuccucauugaaacauucaucucccauggcuucccugauguuuggcuuuccuguuucauugcugcauuggacugugcucuuuuacugacauacuuucuuuugauaccuacauaaugugacuauaacccauccuuacucuguucuugagccuuuucugcccucugcaaauucuuagcucuucugcugucauggcuacaaaucuucuuuguguaucagugaauuccagguacuuauuaaaauaacaaaucaaagaacuucucuuuaguguuguaguugaaaaaaacuuccccauggguaugccauugucaucauaaguucagauuuuuaaaaacugagauuaucuucuuuuucauuaauaucaauuuccuuucagcuuuccucuacugacaaaucaccagacuagaaacauucauaucuucuaccuacuucaguccccugugcacgugcuauuaucuucuacuguuaauuauuccuucaaaauacaugcuauuuauguuuucauuuauugccuauucuaggcauuuucuucuucuaggaaacuuuucuucacuacucuaguugccuaaauguucaucucugugauuccauaaagucuauguguucuccacaaucaagauaauauuuuaugugucuuuuccucauuugaauucaagcucuugaguggcugagauuggagauuggggguuguuuauguuugugccauagaacaugagacauuguaauguuuguuaaauguuaauugaacuccuaaucucuuuaccuguauuacugcaauaucuaccuaaggucuugccuuucccuggcagaacauuguguauaaaguaaucuuaauucuuugugaagccaaugaagacaguagauucucuauuaaaguacccuguacauuuccaucauaggacuaauugcaauuuaaaauuauuauuaauuuucuuuuuuauuuucuuucucccccugggauacccucuguaaugguagucuuacacacaguagggccuuaguaaauguuuauugaauaugaauggaugccccuccucaccaguugagagcagugcacauauauguaauacaaauuauuuaacagugauuacaaaccuuaagccuuugcucuauuugcuaccagacugauuuucuaaaauaguguuuuuaaaaguucacucaaacuuacucugugccagacuuacaauaaguuuugagaauacaggcacaaauaaagacauaauuccugcauuuuauggaauuuggaaauaaagaggaagaaaugcuuaaaccucuuuggacaggccaagaaaagcuuuguagaggacaccugauaucuuuaagguucuuuucagccaaaaaauuguauaauucacaggugcccuuuucuguggcaguagguaaaaaccuugguagcugcaaagagaagacagcugccagcaggguauuuuuggcuguuccugaggcugcccucauucugauuaacuugaacguuuacuucggccugaggaguaacuuuguaacuuaaaucuaauuucuuacuaaauagagauuauuuuuagauuauccauuauuuuguuagcagagauaauugaaaggagaauuuaguaauguuuucugugacuuuacugaagccaguucaaacuuuauuguuuaauuuuuguuugguuaacaagggaaucaggagacauuagcacuuccuacuaauaauacaucauauaacuuauuuauccuguuaauuuucucuuucaaucccgcuagaauguaaacucuauaagaagggauuuuuguucuucgcucaauaaauauuugugaaaugaauacuuaggaagucauugguagccuuaccaggguaguuuaaauaaagugguggagauggaagcugguuuacaugguugaggguugccuggguuugcgguucaaaaucaaacaguaauaguaguauuuuuuuuucuuuuccuuuugaaaguuuggugguaaggaagauauuuaugaaaauucucuucuuagucacuucuauuucuuuuuacugcugguaacuuauaaaggcuuuuaaaauuaacaaguccucuuguuucuuuuuaaaauuuaaauaaguuuuauacacauuaaauguauuacuguaagccauauaaucucaaauacuuaggacuuuuuagauuuuuagaauaaguaaaacuuuuagguauuuuucucuuuacccuaaacacagccgugaaaugauguaucaauaagugguuuuggauuauuuuuuaacaucaauaaauaugcaccaaaaguaaauauauguauaaaugaauuuacauuauucagaauucuagaauuagacaucugucuaaugaaugcuguucuaaauguugcuaaaugauuaauaguaauuaaaagguuaaauacaagcuggagaaagcuuugaauuuugaaauguuugcaacagcuaguaaucugacugaugcagacguuuuugucaaaguugaaaaaguuagagcuaauuaauuucuugggagacauaugaugagauuguaggugugauaacauauuugaguaacauaugguaguuauggggcaccuuucuaaugacugagcagccaguuaaauauagacuuuuuugguuuuauuuauuuuauuaccauucuuuguuacuguguauuuuuaaaccaauuuuguuuucuguaauagaggucaguacucgggauuuuaacaauuuauauuuaaaauguuaauaggaauaugguacuucucuuugaaacugaaauaaauuuuagugaaaguuuucuuaaaaauacagcuauuuccuaccaacguauuuguguauuauacuuuuaagauuaaaucaaauguauagggaauuguacucucaguacacaguguuucacugagauuacuauugaaugaguacuuaaaaaauguuacuuuugauacacggcacaaauguauuuuuuucccauaaggauucauuauuugcauuuugacuaauuuucuuccagccccuuuuacuuuauagaguuuuauuucaguuucugaauauuaauaaugacaaaugacaacagauuaaaagggaauuaaaauuauuuuuauaucuguuauuaaaauaguaucuuaacaccuugguagagaaaauuuugacaugagaauuuugcaaauagaggcauaaaguagcgacuuagauguuuuuauuuuuaaaguuuggaauuuuaccaaaauuuauaugauuguaaucuguuguauaagccccaaauuuucugucauucagaaauaucggcagugaaauccgaguucaggguaaaaauguuucuguugugcugcagagccagccacuggaggguguucauguuaacuucguagucucaguauucugcugauuagauugaugaaaaagugaagacuguccauuuacaagucuuuugaaauuaaagcaaaaguacuauucgugucugaaauggaaauaaacagaaaaggaguuuuaaaccuuaaaggaaauaugauauuuaaauucuaaaauuaguaagcaaauaacuuucuuuugcuuuuuacucaaagacacuggucaguaauaacuguaauuuugaauauacuuacaaaauuauaugcaguuaugagguucugauaaguacacaaacaucccaaauuuauuuacuaaacuuuuuugacauuguucuaaucguuuucauuuaaauuugaguaugcuauagaauuuugauguguacaucugcucugugacuccuuccuuauuuuaaaucuguugcaaaauuuuccccaaucaguuggcaugcuuuuaagccaguagugauaaacagauauccaugaagggcugguagagucuuuuguccugaauggguuuugagcucaagccuaaaguaaauauuaaggugaacuuccaagugauucacaguaaagcacuagcuucucauucauugaauauaauugauaaaguuuguauuauuacauaguuaugauaggauuuuaaagacagcaggauucucugaaauauagcuuaccaauuggaaaauuacuuuagugugauguauucugaggcuguaaaguuuauaucauuuuuaauugauaaaauuguucuaaguucuuauuagaaucuugagaaacaaaaauucuacugaguaggcuguuuauucacuuuuuaaaaauguaugcgaauuucaguagaauaaaaugaugauuuagaaauugguuuuaguuuauuaguuaacaguaguaaaauaaacuuuauauuguuuuucuuuauuagaguaauaagccguacaauuuuguauagcuaguaggcaauacuuaauggagaaugaggggauaauuuuucauucaguagaaaaauuugauauuugauuucauaguugaguaauuauacuuagaaauaucaauuuuuugcuuucauaaguuguuaaaauauuuucuacucagauaagucugucuuuaugucauaaaguaaguaaaugacagauaucagauccauaagccaacauuaaaauucacuauaauauacuuggcccuaauccugaaagcucugguucguucuagaaauguuucuggaacagugaguacaugauuuugggagauuagaagauuuacauuuuaaauacagugucaaugaucuuuaccuugccaugcauaaauuguguugccagaugugcuuaggucaauguuuuaaccauucacauauccuguuuauuuuaugaaauuauuucaugagucuugaagugggacuuaugauugaaacgaaggguuugagagaaaguauguuaauagucuuauuaauaguacggaaaacaguccguuuggagcaugaugcgcucugucacauagaaacaguuuuuggaugcuuucauagccaucuguagaggguggaucauugauuauacaucagucagauaaaaaagauaauuuugacauuaucucuucuuccugaaauaccuugcuucugaaaaauguguguuagcuugaucaaauuauuacaaaggaguuucaaaggggguauuuaauaaacauauuacauagcaaauuuauugucuaugauuuuuaguauuuucuguugacauaaauuuaggaacagaugaucagcaaucuaaacagaauaaaugauuauuuuuccccucuaggaaugaaagauaacuuuaauaaacauaauuuaaguauccauuucacaugauuuagucacuaaauacaugccagaaauucuuagacacucagaauuccuaagaagauauuaaacguauucuucagaaauuuggggguaacuguagauguuuuuauucauuuacaguugccagguauccugaccaaaauguguuauuuugacguuuagaaauuguccuagcaucccaauuucuuaugagguacucaguuuggauuagugacagugcaacguugagacaagagagauuccaggauaaaggaaucaaaauucugugccuuuuugcuucaguaagaaaauacuuauuauauuucuuaaaauguguacauauuuuuuaaaguacauucaucuuuccuuaaaaaauuuaacaucauuaaguuaauaguaucucuucccagcuaacaguuacuucuuauuaaauauccaacguggugcuaugggcuuugcuuguaguugucauuuaauguguuuaaaugguuaaggguaaaguaacucaugugagugggaucauacaauauuuuucccuuugugacuggccuauuucauuuagcuuaaugucuuuaggguucacccauuuuguaccaugugucaaaauuucuuuuuuuaagacugaguaauguuccauuguauguauaugccacauauuguuuauccauuuauccauugauggucuuuuaguuuuuauuugugcgaaaaugcauucauuuuuuccauauuuuuaaaggauguuuuuacugaguaagacaguucuaggucaggguuuauuuucuuuuacucacugaagauaagcauuccucugucuaaauuaugauauuuagcuuguccauugagucuuuauuuuuggacaucguauuuuucaguucucaaaauuuguuucucuuccaaauuagacaugucucuuguauaguuuuauauuucacugaggaaaauuucaaguuuggcuucuguuuucuuguacauagaguaaauguaguuguuucauuuacacucugugucugauacuuucaguauuugaagucccugcucuggugucuuggcuuauuagaugcugguuauaaauacuggcugugcugguuauuauucauguuaguuauguuacauaaaggggccacagauacugacccauugcucuaggugaaauacagggcuggguucuugcaagucucuggucacgucuucaucagcugaucaauuacauaaccugguuuuauguguguuucuguuugaggacaucuuauuuaauauuauuuauuaauuaacauugaacucauggccaugaacacuauaacucaugccugaaugaagcuuauuuaaacaaacauuuauucuccauaaggcauaucauagccuucuuuugcugagaaacacuaggugagacuucaacacuauacaugagggccauuaaacugaaaucaccaacaggaagcacaaaaaugugaaaaacauggcacuaaauacugugaaaaggacauuguuuguaauaggagagcugaaggaagaaggcugagugacaccuuguucagccucaugugagaacaugggcaucaguuuauucaaauuuuuuugcugcucuaugccugcaaaugaccccuaaagcacccagauuuuuuaucacaaauaauuuuaggugaguaggugaauuugcaaauacagaauccaugaauaaugaagauuaaauauguuagcugggcauaguauuugaaaauuauuuguagaaauaugaagccuuggguugggcaugguggcucccaugguaaucccagcacuuugggaggcugaagcuggaggaucacuugagacuaggaguucaagacuagccugggcaacauagcaauauccugucuccaugacaaaaaaaaaaaaaaaaaaaaaagccagauauagagguacaugccuguagucccagcuauuugagaggcugagauaggaggaugcuugagcccaggagguugaggcugcagugggcaaaggccacaccaccguacuccugucugggcgacagagugagacccugucucuaaaaagacaaaaugaagccuugaguaaaguuaucuucauuuaauaucugcuggaugccuuggauagcaaucuaggaguagccuaacccaaguuuaaagccuaaaguuuccugguccacucaggugacaugaaucuagggugcagaucugugcaagauuuaguuuauuuuuugguuccccauugacauuaacgaucagccauuugugauuucagcuuaauguggcaauugacuuaucagaguccuaauuuugucuuacauuuuaaauuguucucaguggaguauucaucugaauuauucaaucugauauuuacagaagcagaaccuuccuuuuauccuucuuaauuuuaauuucuccugccuugugauuuucguauuaccaucuccucuuuuuccuucuucuuuccuagguuugugaagcauuuacuacaguuguuauaagauuaaauaacuguucucauuuaaguacauuucuuaaacuuacacuaagaugugaccuucagauugcuuuaauaauguaagaaauaaguucauuuuaaaaagaaaucuggauguuggaacaagaccuugaauuuuuauuuuuuuuuucuuuuuaauucauaauauuauucauuacccaucauguuauuuugggaagguauagcauaaaauaugauuuaguaauuuagcuuucaccuaaguuuuuauuguacuuuaugauauaggacuggcugucaugaaaaaguuaaauuugauggacauucucucaucaaauuuguccuuguauuauuuuauuuuauuuuuaauuuaauuuaauuuaauuuaauuuuauuuuuuggugagacaggguuuuacucuguugcucaggcuggagugcagugcagugguccgaucauagcucacugcagccucgaccuccugggcucaagcucuccucccaccucaguuuccugaguaucugggacuacuggugcacaccaccacgcccagcuaauuuuuguaguuuuuuauagagacgagguuuuggcauuuugcccaggcuggucuugaacuccuggacccaagugauccuccugccuuggccucccaaagugcugggauuacaggcaugagccaccucccuuuauucuguuuuucagggagcagccccacugauccuacuuaacuuaagucagaaugauuuggcucuucugcucagaaaccuccuguagcgucccauaucaguaaaagccgaaaguccuuucaggaaucuauaggacucuagaugagguguccccaacccccagccuguggacaaguacuggucccugaccuguuaggaccugggacacacagcaagaggugagcgagcauuaccaccuaagcuccgccuccugucagaucagaugcgagguuagauucucauaggagugcgaacccuauugugaacucugcaugcgagggaucuagguugcacgcuccuuacuaacucuaacuaaugaaucuaaugaaaucuaaugccugaugaucugaguggaacaguuucagcccgacaccuucucccccuaccucuuccaaggucuauggaaaaauugucuuccaugaaacuggucccuggugccagaaagguuggggacugcugcucuagaugaucuggcuccucauuaccucucugaucucaguuucugcuacuuccugcuucaugcucuuauugcagcuuuuuugucuuccuggaacaugucaggcauuuuccaucuuaaagccuugcuauucccuaugucaagaaaacucuuucccacagguaucuauaucgagcuuccucacaucguuuuaauuuuccuuaaaaguugccgucucaaugagacuucccuugguuacuuuagucuuccccaaaguauuauauucccuccuuugcuauauuuuucuccuagcauuuuucguacuauauaaccuuuuuucucccccauggaaauauaaacuccgugaaagcagugauuuuugucuaccauccucccagugccugucagagagucuggcacuuaauauuugucaagugaauaacaaaugcaugaaauuuauuaccauaaccuauuuaagagcuuuaaguguuaauuagauagcugggugugguggcucaugcccgugaucccagcacuuugggaggccgaggcggguggaucaccugaggucaggaguuagaaaacagucuggccaacauggcgaaacuccgucucuacugaaaauacaaaaaaauuagcuggaugugguggcguguaccuguagucccagcuacucgggaggcugaagcaccagaaucgcuugaaccugagaggcggagguugcagugagccgagauugcgccacuauacuucagccugggugaaagagcaagauuccauaugaaaaaaaaaaaaguauuaauuagauaaaucuguaucaaaaaguaaguagagacugcaaguguaagaacuuugacauugcauuuauuuuuauuuugaaauaauuucaaacuuaaagaaaaguuguaagaauaaugcuuuuucuucuuuaucuuuuuuucugagauggaguuucgcucuuugcugccugggcuggagugcaguggcacgaucuuggcucacugcagccuccgccucccggguucaagcgauucuccugucucagccuccugaguagcagggauuacaggcaccugauaccacgcccagcuaauuuuuguauuuuuaguagagaugggguuucaccauguuggccaggcuggucuugaaguccugaccucaggugauccacccgccucagccucccaaagugcuggguuuacaggcaugagccagugcacugagcacauaaugcuuuuucuaaugaaccauuugagagugagaugcuccuuuacuguugauuacuuuggugcauuuuuguagcauugacaugcucuuauguaaaaagaguauaacuauuaaagcaagauauuaauagugauauaucaaucacuaccaucugaucaucagaccccauucagauuuugccaauucuuucgauaaugucuuucauugcaaaauucuaacccaggaucugugcauuugauugucagggcucuuuacucucuucauguggaauggcuucauagucuuuccuuuuauggcuuuuaugcuuuuaaagauuacaugccaguuauuuuguagagcaucccauaauuagaguuugucuaauguuucuuccugauuagauguagguuauacauuuuuggcagcaaugucacaaaagugauguuuuguucuuauuguauucugaauugauacucaauuuugguuuauuccauuauuacugauguuaacuuugaucaccugaagguagugacuacuaguuuucuccacuguagagguacucuuuuguccuuuguuauuauuuucuaaggagguaauuugagaccauguaaauauuauguuucucuuugacucauuaguuuuagcauuuauugauguuucuugccuaacuuaguugugacuaagaugaaugucaaguggugacuuucuaauuuguuguuucuucaacauucauuaguugggauucucuuauaaggaaacucuccauucauagauucauuauuuauuuuuaucaauaugggcucauggauucuuguuuuauucaacaaaugagucauaguguuuucguauuauguauuuugauauccagauugucucagauguggccagcgggauucccuucaaacuucugugcccuuuaacauguccccaucauucucugagcaccuucuuacucucuggcacaguaagauggucccagcuccgcuugugauaucccugcuucagcccuggaaucagcaguuuuccagagacucuugauucuuuuuuguguggagaaugauauuuagaacccuaaaucuggguaucaauuguguucccuguauugagugucacuguugucaagcucuuucauuaaaaauaaaauuaggaaauaauuguaugacauacucacuuauucuuacgauuucugcaucuguauauuaaaaacugaauuuguauugacauuucaauuucuaucucacaccaaagaguccauucuagcuucauccuuuuuauauuuguaacuuccagugagaaacagggguucaguuaucuacaauauaugacuuauaugguucaucuucuguauauaaccaaucucucaaucaugcuggccacuacuucuuguggucacuuccuugauugggcuugacccuuuucuccuagcuucccccuacaguaccagcagauucuuacuuccuuuggccaugccuaaauacuuaagaaaagaaaggccuucacauuuuaaugcauacuuuggggauucccauaucccaccaaagcuuaugcuuugaucuuuagguggaauugcuuuaugauaaaaggguucuuuuacuguucauuuuggaugauguggaugagucuuagaguuuuauucuggucuuuacaaauaugauuugcuauuuucuaaacuuaucuaaugacuaacuuaaggcuuguuaugauaagauuauaagaaaacacuuuggggaaucuugagaguuuucuuuguaauuauaauuuauaauucuguaacauagagaacaugauuaacaugaagcucuaaauguauccaauaguuuugcuuucuuaucagugaaucuaucaguauacuaguaguaacuggagaauuucaaagauaugcuuacacuuuaaacccucaauuuccagugcuucagguggguuugcacauaugacaagacaggcaaggaguaagaaggagccaguauaagaauuaaaaaggagaccgggcacggcgacuuaugccuguaauccuagcacuuugguggccgaggcgggcagaucacuugggcucaggaguucgagaccacccugggcaacauggcuaaacccugucucuacuaaaaaaaaaaaaaaaaaaauuaaccaggcguggugucgcccgccuguaauccccacugcucuggaggcugaggcaugagaauugcuugaacccaggaggcggagguggcagugagccaagauugugccacugcacuccagccugggggacacagcgagacucugucuccaaaaaaaccaauaauaauuaaaaaggacuugagugauacauuuauuaauuuggcaaauauuuauugaugauuuccuacauaucaagcugcucugcuggaagacuguaagucaaaauaggguucuugacuucauggaaugguuuccucacuucagcauuuuugaacccgaucauucuuccucgucauagcaggcuguccugugcgcuauaagaugauuagcagcaucccuggcuucugcccgugaggucagcugucuccagccuucuuggcaccgggggcugcuuucauggaacacaguuuuucugugaaccuggguggugugugggaggggggacgguuuugggaugaaacuguugcacuucagaccaucagguauuaguuagauucucaaaggaccaugcaaccuagaucccucgcaugcacaguucacaauaggguucgcacuccugugagaaucuguugccacagcugaucugauaggagguggagcucaggugguaaugcucgcucaccugcugcucaccucuugcugcguggccugguuccuaacagccaccauccgcggcccagggguggggacccugcacuugguaacagcaccuccuaucucuccaucccucagcacauuggcaguaaccaagaaugucucuauguguugccaaauguccagugaggguggggagcacaucacuacuccugguuuugaguaccacugcucacaguaaaaucaaaugcagauacaggcauucuacagcuaaucauucaguguaauuaucaacugugguaaaugcuaauuauggaaaguacagagggccaugagacuguaaccaagaaaauaaugacuccauaauaaauuuggaguucagucaaacaaaucaaaguuucccuugaguguauaguagguauuugaugucagaaaagaaacuuaagacauggucuuuuacuuuaaggauaagcuggcuguguaucuuccaaaccaguacccuguugagagugaaagcgugcucuauaauaaggaaacugggaaaauaaauagagaugaggcaaauuguacauaaucuacuuccaggcuuucauuaucuacccagagaauaagaccaguauaugaaacacacagagaauaauucaagacaguauauacauuaagcgcuaaccuaugucacauuauuagaagagaggguucauuguuacuucuccaucuuugcuuuauagaaggcuucaugggaaaagaugggauucuagcccuucaauuuaguucuggagguuugccauaaaauaucucaauguuccuauucaguuauuuuacacucuacuaccuaagccccuaaccuguucaagaguuguguuugacauagcagacaauagagaacaacuggagagucuugaugaggaauauauuaugaugaaaugguuacaacuccuagaagaaacauucauuucucuaccaaccuugaucagcauugagguacaaaagaacaguauuauacaacuaucagauguacauacugaaaggacauuucuuucuuaaaccaaauucuagaaguuuuuuauugaaaacagauuuccuagggucauuuguguguauauauaucuaaggggacauuguuggcuuguuucucuuucaauuuuuaggucaauuuugaagauacuagauuuugagaaacuauguuuaggggaaaggggaagaaacuguaggaaagugaaaaaucguacgcuuuuagguuagugcuaaucugcuuacguaggaacuuucugcauccaaauaccuugcuuuauauucccuagcuuucuuuuuaaaauguugcuuuuacuuuaauuuuuuacacugcuuaagaccccauagauuauacauuuauuuaaguucauagucauggaacuuaauuacuuuuaaaaagguuuaggcauguucuuucacuuacuccuuagaagcaguucgcauucuuuguguugccugugaaaucggauggugauauagggcuuaaauuuugaaauaugggacauuuggagaacuuaaggcaaaucaaaauggcauaacaugauggaggaagcaugaagaccuugugacugguagaaacaacaagaggauguaggaaaagacuauguauugggaaaggggguagaaacuaugccaaaauuccauuugcccacuucagaugucugcuugggacgaagucugugccugggaaaagggaugaaaacuuuaacuuccuuuccccccacacuuucaucccaagagccuagaauuagagcugauuuaaugguacuaacuaguacuguuaaacuaacuaguacuguuaauagaccuuuaugacagcauccucagaguuaacuauuuauauaauuguucucuggagcaaagcauucagaguucccagaagcuacagugaauuucacaccacuuauaaaccaagggacuaccugcaaaguguuucuguuauuuuaaaaucuaaagucuauuugaauuugaaaaaauaaaaugaaaaguugaaaauaccaaaucuaagacuuguguguaauugaaaugagguuguuuuagaaaauuaaauuuggcaagugauuaaugcuuaauaaggaguaauuguuuuaucuauuuuagggaaaaauuaauuuaacaaaccuauuauuaugugaaauuuagguaaugaacaugggcaguacauaauuuccguaacauuuauagcaucgaccacaaaaaggcugaauuagugucaucaaauacaaagaauguucauuucagaaucaaagcuguucggaaagcagugcucaugguuacuauaauuaauucaacauuucaggacuauuuaaaauuguuaugucauaucacuuuaguagauauaccuuucagaugcauauaugccugauuuuggauaaguguauuuuuuguacuuuucaguuuaaaaauuuuuuucuuaguuaaaaauguucucucauuuaaugauuuuugguuuuguaucaaaagcaaagaaacuuucaguuaucucuuaaauaauaaaacagaggucgcccaaccugcacuguuuuggacccuguauacagcauuaacccagcucaacagcuggcugugauuggcuagccaaucagaguaccaauucuguaguguccuccaccuuucccugaagcuaguagaguuuugguugagugggguauaaaugugaauagcagauuagcuaauuaaaaugguccuagauaguuguaggcuccagugcugaaguuccuggaggauaauccaaccucccuaaacucucuugauaccgaagaacucaccuggaauagcuacagccuacuuuucugucccccuccccaccuucccugcaagcucucuuccccugugggcuggguccuguuucagcucuuccaugcaugucucaggaacuguuccuguagacaaagguccauucagcacuagaaugcuuuuuccaggcugcauuucuaaaucugagucccuguguaucuuccagaucaaagugccccucuccccacaacaauggacuagauuugccagggccucauagcagaauauccugucugacucucucuucacuagacuaaggagaaaaaauaacaaaacaaaaaugaagaauuuauuuuaaaagaugaauauagcauuccccccuccccuaaaaagaaaugagcaacuauuacuuacacaaaauguagauacaacuguauuccuuguaggauuacuuauuaaagcuuucuugauacguaaaucuaaauccaagcguuuggcaugaaugucugcuucauuuaucauugccuuggauaugcuuuaaagagucugucacagcuggucuacaaauggauuuuugcacacaccaaaacuugccuuguggcaaauguuuuauaaaaguuguauagaggcuucaaauauuguucuucaugauucuuugcugcuaauuuuccagaaguccuucucuuucagagucuuuuuuuuuuugagaagcauuuaagaaaauuauguugaguuugguguaaauuagaguugugacaaauuauagagcaguuuucacaaguaaaauugggccaguuagcucagaauuagaaaauuaaucuuuuuccaaagcauuaucucacuuucuguguguuuguaguguuuauagacugauaguaucaguaccaacagcuaaaacaaaagucaguuuuuuuucuuuuaaaaaacauuauuucuuuuuaaugaacaguuauugaaguauuggccuuaauuggcuaggugugguggcucauaccuguaaucccagcacuuugggaggccgaggcgggcagaucaccggaggucaggaguuugaggucagccuggccaacacagugaaacuccgucucuacuaaaaauaccaaaauuagccaggugugauggcaggcaccuguagucccagcuacucgagaagcugaagcaggagaaucacuugaacccaggaggcagaguuugcagugaacugagauugugccacugcacuccagccugggcgacaaagggagacucugucucaaaaaaaaaaaaaaaagauuagccuuaaucaacaagcauuuacuaauaacuuaccgguaaagaguaguauauucagauuuaaaacauuuugaagaaaugcccagaaguggaggacaaaggcauugagcuugcuguccuuguaaaauaccgugugugcgugcgugcguguguguguguguguguguguguguauacgugcaugcaugugagaggggagagaaggugggagaaggaggcauacaguaguugcaaguuaacauaauagagaauuuuuaaaaccuuaggacacaucuaaagaugauacaaaauguauguuaaugcaagauaaaauuugguuuauuagggacagugaauuaugauuugaaauaauuggggcaaauuuaaccaaguaggguuaaagcauuacuuugaaggaaaggaggguauuaagcaguacauaauuuugagcuaaauucauaggcaaaucaauuucuauuuagaaacugaagcacuuucuuuauaaaagcaugacuucgccucuuuauuugcucaaguauauaugaggccauauugcauuuagccuauaugagaaggagaagaaagcagagaaggaguuaugagggagauuggaagagaauaaaaagaucacuucacuuuagaugccaagcaagagcaauuauuacagcauuauuucaggauucaaggacaacaaggccuguaaagaggccacugauaaccucauuggugacuuuguggagaucaguaguagugaugguaaauagcaaauuggcaggaguugaagagugaauggauacugaagaaauggagacaguaaucauagauuuuucuucugaguuauuuuuugauaaaaggaaagaaaauagauuacagcaagccaaagaaagaugauuuuuggaugggauguuuugagcauauucauagguugaaggaauggagucaaaauacagagggaaauucagaaagauccaagagagagauucaucauuugacauaaucaaaucuuagaugacaguaaagaugggacacaagaaagagggguuaguucuugaaaacuagaauguauaugacuuccuuuguuauaaguaaaggggguauucugaauguuugaaguagagagcugggaaguugaaguuauucacguuuaaugguuucccugcuuucuaggaaguagggauauuauaaaaugagaaagaugggguugggggagagggguuugaagagggauaaagaagauguggcaugauuccuuuagaaaacaaucaugaucaagucaacuagagaugaaugaaauaauuucccagguuugcaugaauuaugauagauuuauuugguuuaguuucgugauuuaguauagcaguacucagaagaguuccacauaaaauggauuauaucauauaccuaggauggagacugauaagauguguauaaugaaagaaaaaguggauuagaaaaauauagaaugaucagggauuccauagaaugagacaaguagaagggaacuuuucaacugagaaaauagggagagaaugaaggacuagaagugguaaggaaaaggaaggaggaaguucaguagaacugaggaaauuauaauauuagcuuaaaauauuaaaguauucaugcaacagugugugagggccugccauaugcuagguacuguucauuuguauuuacaacagaugaaguaccaaguaguacuucaauggaguugccacuagaugucacucugauucguaugguaaggcuaaccuugacacguacucaagauuggggcuuugaaagucagaccuguauaaacaggcaauuuuuaauagccuaugcagaucaauuauuauccagaaaucuuauucauauaacuaaacuacuuuugagagaauauucucaugagaacaaaaccucucaaauuugaaaacuucaaguuauuaauacuguguuugcauuauugauuuauuuuuauuaucuuaaucacacuaaauaguauuucucagugaacuuuaacauuuucugaaauucuacauuaaaguuugugaauuuauuuucuuuauauuguuuuauuuacuuaucugcugaauugguucugguuuuauagggacuaaugaauuuuuauaagcacuaauaaagcugcuucuuucuaaguggugaagauugugcaugugaacaccaaaguugugaguauaguuuuacacuguguggccuuccuaucaacuagaaggaagaacacugucuauccaacucuuguuuuuuuuuuuaagucccauucuuguuuucuguucaaucaguauagcuuugccucuuuaucuucauguugaaauaaagggucauguuuagaaagcuugucagaauuccugccuauccacaauuuuuuacaacuugguucuuucaaaacucugaacaauuuuggauagcuaugcaauauaaauauuaaaacacaaaaaaccagacacaccagcaaaccauguugauuuccacugaaucauauaaacaauacccaggcaugcuauauguuuuaaaagauauauuuauguuuguguaucuuuuaauuuuuucuucauuugacaggggaaagaugugagauuauacagcauugcuagaaccguugggccuuaguauaaaacaauuuacaggucauuaugguugaaaaagcauagcaucacauuuuuugcaugugcuaugccuagguauauuucagugcuugcuucagacaucguuucauuacugacucuuaccgauccuuguuauucauuaugguguuaaguaauuuuuagccauguuugcaagaaaccuauacuaugucuuaagugaacugucuuacauuuaucccuuuugauuuuuuuuguguuuauggauaaagucaguuuacaauaaguuuaaugugguuuucuaugguaauucccaaugugauacuaagaguuucauuugcaaagguaccuauuuacuaagcauguuguuaggugacauuuuggucuguucauugaagauaucucccuuuaaucucuucauugugucuugggaaagaagucauuuugcuuuggacaagugaacgugaacaugcugcauuuacugggcuguacuggguagaauacaaguacaagagagaaggucaguuacaacuuagcagcaauggcaauguaauuuuacuuuccccaaauuuuguugaagcagucauuaagaauuacacucuauaauaaaaaaagcaugaaaauaugaugcagaaaucuccguuaaugaaauuccucuugaaauuauccucuaauucccuuuuaauucucaaauucacuuugccguauaacuuucaaaaugaaacuucugacauuuuuguuuguucuuggaaaaaguguucauuucuuugcaguuuuacggugaaaauaauauccuauauuucuuuuuaggaauauauuccuuuguugugcuaggaacaguaaguuuauuuagauaauagccaucuacacucucuaucucuaauccccaaaggccuuaaccuccauuaggaauaaauguagauuuuuguuugcuugaaauagcuuccugggcauguaaaaaccccuuugacaucauuauuuaggggcucccauccucccaauggaaucacagccuaauacaaaaacuuugcagcuggugagcucccaaagccccuuuugaugauuguuguuaaacucagcauggcagcuugcaguuguuccuuuccuguacugccccccaccccccauguucauguucuucaugacaauaagaauucuccagagguaaaacacagggcugaaaauuucugaugucuccuucauccucuguuucuucucauucauuuccauucuaagcauauuuauaaaguuuaguggagauuaucaagggaaagauucguucucucucugucucuaauaaacuaauuucuuuaaaaacaaacaauugaauaugaaagcauugaauaugcagagguuaugagaccccucaucuuuucuguagaguauguuaguuucagguacauuagaaaucagagguccuggcugugacuuaguucaaacuuggaaguuucuuaugucauacuguguucuuuauugauaaagugaggggacaaauaacccaagcaagugguaauuaaaugauucauuaacucagugacacacuaauugaccagaaauuuucucuaaaguuuuuguucuaacuuuaacuggcuguaucaaguauaggcuuauguugguauuauuuaggggaaaaaacauuuaucacucaagauaaagcauguuuagcucauugaaauguaaagacagaauacauuuuaauagaacaauuacauaugauaugauuuagauauuaugaaaauaacaaccauaauugagaaagaucuaaaaagaccugggacugauaggcaaguuagaaauggacguuaaauuauugaaaaaaacauacggagacaaacauguuagaaaauaaaguacucccuauguuugaguuuaguaaaauaagcauuaaaauagggcuaaauggaaacagaaacaaagcaaaguaaaaaaucaucgaaugaaccugaaagaucuuuuugauuccacauagggaauuuguuuuuuugaaguuuuugauaccugcauuaaagcugaauuuuagaguuaaugcagauuuugcuacauuaauuuuuuugaaguucugaaugcauugaguuuuggaaacuauuuucaggaugaauacuacggguacugcagaugcucacuuuauauaauuaugugucuugaauuaauuaaauccaacuucaaaggcauguaucggaaauuccuuugcauaauaaaaccuccauuccuagugccagugauaaaaugagcagcagaaugguuuagcagggguguccagucuuuugacuucccugggacacauuggaagaggaauugucuugggccacacgaugagcuaaaaaaaaaucaaaauaaauccuauaauguuuuaagcucgugaauuguguugaggcgcauucaaagcuguucugggcugcauguggccugagggucacagguuggacaagcuugguuuaaagggaauagggacaaauucucauuccagagagcugaguacugacuaauaucaucuauuaccacauacuuuugugacccugggcaaaucacuuuuccuguuuuuguaaaauaaggaggauugaccaaaaucaucucuaaauccauacauguuuuuaguaugcucugaucauuuuaaaauaaauaauuuugacaucauaucucguuuucuuaaaaauugauaugcccaauacucuuauuuuauuuuugagacaggaucucccucuguugcccaggcuggagugcaguggcaugaucauagcucacugcaaccucaaccuccugggcucaaguaauccuuccaccucagccucuugaguagcugggacuguacaggugcacaccaccacgccgggcuaauuuuuaaauuuuccguagaggacgggcuuaccauauugcccaggcuggucuugaacuccugggcucaagugauccucuugccucagccuccccaccccaaaaaaauccugcuaggauuacaggccugagccacugcccccagccuacuuuuauuuuagaacugagagcuucaguaagaucauaacaggaaaauuuaaaaucucccccauuacuuguaaaagaacaucuuuuugagaaauuaaaacaauuuuuuuuuuuuaaugagccaaggacucaugaauacagugaucacaaaugagauccccucauggugaugagaauagccauuucagaaauuaccacugaacauaguaaagaauacuggaacuaauaguuggugguguaaaaugugaucaaucaagagagucuauuucuguuauguauaauaauuuuuuuuuuuuuuuuuuuuuugagacggagucucgcucugucacccaggcuggagugcaggggcgcgaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccacccgccucggccucccaaagugcugggauuacaggcgugagccaccgcgcccggccaauaauuuuuuaagguaaacuuuuucuuaaaguaugagauacauaaaagugaaagaaucauaagaauacggcucuguaaauauucaugaaguaagcacaccauguaacaccuauauuuaaaaaacaauauuaccacuaccuuauaagccuucccuuccucuacccuuacagucacuaugucccaccaagcaaacaggaugacuucuacagcauauauuaguuuugccugcuuuugaguaugaaaucauauggcggcuuuuucaaaauuuuauuugugagauuuauugauguuguuguuuguacuaacaguucauucaggcccauugcuguauuauauuuccacugcaugacuagacccuaguuuaucuguucuauuuuuggauuuguuuuguuuuuacauuuuggcuguaugucuuugggugugcauacauacacauuucuguuggcuauguaccuagaaguggggcugcuggaucauagaacgugcauauguucaacuuuuguagaugcugcuagaugcuuuccuuaaguguuuauucuuuauauuccagcagcaguuuguaaguuucauuuguucuauaucuucaccaacacuuggugauauuguugguagagaugggccucuuccuaugguugcugaggcuggucuuaaacuccuggguguaagcaauccuuccaaagugcugggauuacaggcaugacagguguagcaucaaccuuggccaguaaugugguuuuaauuuguauuccccugauaacuaaugaaguagaacucuuuuucauauauuuacuauucauuuggaguacuaaaaaaauuuuaugacacuugcauuuuaaaauauuaaacuuuccuauguuaagaagggcuguuguaaauuaguuauuuucuaaaacauuuggcauaaucauucagucuaucucuguauuugauaaguugugaaauucuuugaaaauauuuuuuuccuuaauaaaacuauguauuucaaaccauggaauugauuucaaaugcuaccuucugaguguuauuaagacuauuuauucauaguauuuuugaaaacaagacuagaaaaaaugaaguguuuuaaacaaacagugguuuuuccuuccagggaagucuucuccaggaaauuucuuugccaggauggucaagucccuuauauacaaaguuuuucuuccaggguaaaauuauuaggcauuguagaggguauaauuaaaaguugaucugccuaauuuuagguuuaccggccaauuacaaccuuaucauugaacacagaguuuggaagauucuugagcaguauuuuagagcuguuuuugagauggagaccaacuuuucuaugugcuccuacauuuucgagccuuccgugcacuuccuuuggaucuaugugacuaauuucuggccagugaauugggagugaaaauaguaugugucacuuuggccugagucaguuaagagcuaccuccuucugaccucuucuguugcaguggugaacauguacauguucuaaaguuuauguaauaagcuaguguuuguuguugcagucaauguuaaguaaccuaacagaguuucauuuucguaaauggucuacacauuaaaaaaaaaaaaagauacccuggagccccugaaguauuuuuaugcccauaauuuuuugugaggagagugcugcuuuuaaaaaagacuaggguuuggagaauauucuuaugaggagaaaucgguuuaugaugggaaaaugaaaaaggacaaacguuuguuuuaucauucuaccaaaugagaagaaaacuuucacaaaaagaaauguuuaagguuucugauuaucagaguuuuauuuauuuauugagauggagucucgcucugucgcccaggcuggagugcaguggugccgucucgacucacugcaaccuccaccuccuggguucaagugauuauccugccucagccucccaaguagcuggaauuacagacacccagcaccaugcccggcuaauuuuuguauuuuuaguagcgacgggguuucgccauauuggccaggcuggucuugaacuccugaccuuaggugaucgccugccucagcuucccaaagugcugggauuacaggugugaaccaccaugccugaccucugaguauauuuauuauuuacauaaaauccgauucuuuuuauaacauuaaaaugauuuuaacuaguuuugcuuuuuuaaaaaaauuuucaauuuagaaaggugguaacuaucagagaggcauaugacacagacauaguggccccuugguauccacaggggauugguucuaggucccuuguggauaccaaauuccaaggaugcucaagucccuuauauacaaugguguaacauuugcauauauuguucuauuguuauuuuuuacuguuuuuuuuuuuuuuuuuuaauuuucuaucuguaguuguuugaaucuguggaugagaaacucauggguucagaauggccuaucacaaacugaggauuauggaaaaauacuguaguuuacagguauuuuuuugaauacuguuaauacacagauuacucauagucuaauuggaauaaaaauauugagaaaaauaaaguccuuuucauguuuaauuucuaauucuuugcacaaaaguaauuuuuuggaaaagcuguuucuugguuucauuuuagaauucccagcaaccaaaaguaagccugaguuuguaccaagguaggaaguauuuuauguuuuaucaugucugcuagucuuguucuauuaaauuacuuaagcaacuuuuuauuauaggaaauuuggaaaugugagauguuuagcgcaaggaaaugaucuuaaauggaacaaagcugguuaagaaauugaaaugaauaaaaagcauguuaugaaaauaugcaacacucucauugaccuaauuaaaauagcuuauauaagauuauuguuggacuaugucuuauaaacuuacaagggaaaucuugauucccucucuuuaacuccuuauaguuauugccaagauuaauauucuuacauguauauuuuuacaaauauguaugauagaauggucacuguaaaaaaguucuauuuuuaaaaacauuggcaugagaaaaaggugaaugcuucuuaauaaaguauuggaauaauuauuuauuaguguuacuggaaaugggugauucagugucacuuuuuggguaauguggauuuguuuugagagagaaacagagaaacaaggaaacaaaaaucaacaaagacuaacaaaauuucugcccagaauacagguacgugcuugcaugaaacaaagguccuaucaugaaaauacuaaaagucuuugaagaacuaggcuggaguuuauacuguuaguguucuuuauugacgauauauggaacauacaguuauauaugugaugaaguuaacauuaaugauauaaauuucccagauguagggcuaacacuucuucaaaaaucagauuuccagguauuucauagcuugaacaaauauuugaugagaccccuccccugaaauuuuauacccuagaacuuaauaaacaugccuggaaauuuuauguagaugaaggauugggguuucuagaggucauggcauaagucauucuuuccuaccuggccuuuguacaauaccagauacaaaaugaagaguaaagauagaggccagaacguaccuacuaaugauaaaaguccaaguggaggucugaguuugagagccaaaugaccugcugauugaauugcagaaccaggccaacuuuuucaagcacucuucagguaauauaaauaagacagugccauagagcagggaucuuuaugguuuuuguugcaauuguagcuacucugugauugugaugcaagaaaacagccauagacaacagguaagcuaaugaguguuccaauaaaacuuuauuuagaaaaauaggcaucagccuuuuguaguuugcugaucucuugcauagaggaaaaagacacauuugcauuuucugcagccuacuaguuucaacaggaagaaaaggggcccagcagaauccugcauaccaaggauuuuuccucaccaguuuuucaccagauuaaaauacuccaucuuaccagaauuagagggaguaaagggagagaaagaaaccugaaauaauacuaaugagcucuccuuguaagaaggggggcaaacgcuuuucucacaagucccuugacacuagaauuuacucuguuacucagguauacugccuuuccaguggacucaaaagaaccuauaaaacacaaaguauuacuuuguacugcauuuuccaaacuugagagucuaaguguuuuggugcuaauuuuggcguaguuucucucauuuuuugguuagugauaguaaaaccauguaaugagcucccaggaagacccuucucuuccggccacauguguugacaugaggacaugccuuuggccuauuuugggcagcuaagauuacucuguggauugauucauauuuuuugagugccuacaaaauaugaggcauuuugauaaaugcuggggauacaauaaugagcaauagugauccaguucuuacccucacaagagcuugugcuguguaacagaaagggcucuaaaaagaaaaagugauuucuaauuugaaaccugagggacuagcagcacaugccaaaggggacaaaguucagcauguuccgggauuuggggaaagcauuguuuaucuggggaacagaguguaaggggaaaauggagauagauagcugaggcuggaaaaggaggagggagccuagguugcaaaaccuguguaagcacuuggguuuugucagaucagcaggacgugguugaggggcuuuaaagccauaagaugaugugaaugaucucuguuuuugaauauguucagucuagguuagaagaggcaaaaauugaagaccuacauuuguacuguucaacaaaguagccaugggccaaaguggcuguugagcacuugaaagguaacuagugugaugaggagugaguuuuacauuuuuguuaauuuugauuuaaaaauuuaacuuaaaauuuuaaacaauauguuuuccuuuaacuuuaguauuuugauuggacuacauuucacauaaguuauugaaaauuuagagugcgaauugaccuauauuauagguguaaaauucacacuggauuuugaguucaagauauaaaaaacaagaauguaaaauaucucaauuuuuucuaugguuauauguugaaaugaucauauuuuggauauacuugguuaaauauauuauucaguuaaauuuuacucuuucuuuuugcucuuuuauguauggcuuuuagaaaauuuaaaauuacauguaugugucacauuaugugucuuauuggacuacuccggccagauuccaguucagaggcucucauaggaaucuagaugagagaucaccaugaucugugcuaggguuguggcaaaagcauaagguuugagagugaucuaggaaauaaaacauaggauuugccauuugauuaaaugagagauggugaauucguuauaaagaaggaaaagggagccuccaagcacaaaaauacaagaaaauguaugguagcggaauggcagauucagacauguaaacaagcaaaaacaaugcauguuauuuuuuauugacaaacuaaaauaauguaguuaaaacaauauucuucuaccauuggauuuuagcauuuuuaauguuugcuuuuuaguauauacuaccuaauugcuucuuuagaguuacauaguuuugcauuucuuagauuguaacugaacacuaaauuuuacaguguguaaugguuuaccaucuuuauuuccgugucauuaucuguucauccucaacgaguacuaagugggaagugggacuggagacauuuauguauacuuuugagcacauaaauucucuaaacauuuucaaauuugauaauauaaaauuuauuuacauuuucuuuaagaugaagcuuauuccuucuuaaaagaacaaguacuuuauuuacaugugaagguuuacuagacaccucccuaaaguugaagcccuaacaguaucugaugaauguuaaacguuuaauacuuucccccauuguccuccuaagaaauaagaugcauuucuagcuucauuuuccagucucuuaagcuuaugaaaguagucgagacaguuuguugaccccaaagagaccuuuuagucucuggcuuguuagacaacagggucuguagucuucauuggcauucagaucacaggcagccacugggcucagugcaaagccaagcacagcuuuaggauuuagacaaagccacccuggcaaaggaacccaguugucaggguagcuggcuguauuguaaagaacuguugcauaauggagagaccaaguagaacuauuaggaugcaaaugugaaaaaaaugguggagcuaaccugcaaaaacaaacauuucuuuuuuggugaagagucuagucauuguugcuuucuucuguuuuaacuucucugggccagggauguagucggugcaauuugaguauauuaguuaucuucagucauaaugccauccuauauuacuuuaaaaugaacaguuaauuuguaggaagagaccacaguacuucaauguuuuggaaucuuuucauaauuuacaagugcauccuacuuuagucuagaucaauuuuauaugugauuuuuauucuagauuagaugggaaauccuuuuugcuccugauuuuauuucaucugauuuauaacaaaauauuguucuaaucauugccauccaaugacuucucccuguggauucucauaguuguccuauuuauuguagaauuuuuggcucaagaggaaagcuacugaaauccuuaaaacaagaauugcuuuauuuuacuaauaucuuaaggaagucuacccugucccuuuucuccuuuucacuuucuuuuguuuguucaucccuguauugagugcucacuuuuucuuuugcuuucuacuucuucauuaguucuuuucuuucuacuuuucaucuuucuuagcaaaacauuguagaacccacacuuugauaaaugcugugguagggaaagggaauacuaguaagaagaagaagaaggaauaacagaaggggcuccuaaccuggauuuaggagucagggaauaacaauuacacccaugccuuacugagcuguuacuacacgccaagcacuauuuuagguguuuuaccugaauuaaucucauuuaauucucauagcaaccuuaugaggaaagcgcuaucacccccauuuugcagaugaguaugaggcacagagaaauaaagugacuuguccaaacucacauuuuguguaugauagagccaagaaaggcuuucuagaaguuuugagcuugaagcugagauccgaagguagaguaagaguugccugguacacugugaauggaagcagguuaugggaagagggaccagcaaaagugugacagaaaggacucuugcaccuuucuggaagugaaaguagauuaguaggguuugagggauucugugagaaagggacuagugagaaaugaugcuggaaagauugcucuauguucagauaauuuacauauguuauuugugugugacgguucauuuauucagcaaauacuugugucuaugaaaugccaguugcauggcuguuaucuguugggaagguggaaagaaaauagcaauauagggguggcauacaucuggaugaaguuacguggacuuugagguguuuuaaaguagaugaaucuuaagcaaagucuuaguacgucuguuuuguuucaaaucagcauaugccuugacuuucucauuuuguuaggcuuccauuucuuuaucuucgaacuuaguacuugcaaggcuccuaauuucuuuaagauugcuguauaauaccauucacuucauucuuguuuugguuugccuuugaaauagcuuuaagaacaaaauaccucuauagcuguuauuuuucugacuuuuaaaccuuuauugguagggccauucuuuuuucuaauucuugcuucucauuuucuuccaggacuaugauuccuucagccuucuuuaguuccuuucuuucuaguaaauuccauuaacagugggcaucaaguacagccauuuaaggccuuuuauguuuuucuugaccccagguuuuuggaaucugaauguugauuuaucacuaagacaaugauugguaauuguaauuucuaacauugauuacucacuaugguaugugccaggcacuaugcuaauugguuuauauaaaauaaccuaagcuuuagaacaacuuucugugguagguguuaccaaauuauuaucauccaguuuucuagugaaaugggaguuucagagggauuguuauccagguuacacugauaauaaguggcagagccaggauuugaauccauguauuugacuacaaagcauauacuuuuuacccccaucucaagcuuucugucuagcacuugcauuuucuuauuuuuacagauuaaaaaaaguauguggcagaugguuuaggcuaaauauaaccaaagcuaaaugcaucucccccuaaauuacuuaccacuguacuuaauauuuauuuaggauguauuuuguguuuagcacuagcacaaggaagaauaauuuuacuuuuuaauaauauuugaaauacauacuuugaacuucaaauucauucucccauucuauuuauucuuccauggcauugucucaaauaccugucauuggcuucucuccucuacaguuugacccaucaguuggguuuacauuuguuucccacaggugauuguggugagcaugcacccacuuuugcagcuaucuaauaaaaagauggaaauaguuggacaacucauaucaacuaugagaaugacuggugaugacugauaguaagagcuggcuacucaugcuaacguuuguugcuagguauguuacaguagucucuaauaaaaaugguggaaaauguuaugagaggaaacgcaacgaaauauuuuucuggguauaaaguaauguuacaaauugcuuuugguaugaguagccaguuaaaguuucaaauaucauacuuagaugauauuuuuagaaacauguugaaaaauagucauguggugcagaaugauguuucagucaaugauggacugcauauaugacagcgaucccauaagauuauaauggaacuaaaaaauucuuauugccuagugauguaacaucauagcacaaugcauuacguuuuuauggugauggugguguaaaccaaccuauugcauugccaguuuuguacaaaaguguagcacauacaauuauauacaguacauaguacuugauaaugauaauaaaugaccguguuacugguuuauguauuuauuauacuguugucauuucagaguguacucucucugcuuuauuuucuuuuuuaaagguuaacuguaaaacagucucaugcagguccuucaggagguguuacagaagaaggcguuguuauuggagauggcagccccaugcacauuauugcccccaaaagcccuccacugggacaagauguggaggaggacaaugauauugaugauccugaccccguguaggucuaggcuaauauguauguuuauaucuaaguuuuuaacaaaaaagguaaaaaaaauuuaaguagaaaaaagcuuauggaauaaggauauaaagaaaauacuuuuguacagcuguacaguguauuugugcuuuaagcuguguuacugcaagagucaaaaagcuacaaaauuaaacaguuuaugaaguaaaaaaguuauaguaagcugaauuuauuauugaagaaagaaaaauauuuuguuauuguagccuaaguguacgguguuuaugaaguccacaguagucuacaguaauauacuagaccuucauauucacucaccagugauucacccagagucacuucuaguccuacaagccccauucgugguaagugcccuauagaggugugccacuuuuuuuuuuacccuguguacuguauuuuuacuguaccuucucuauguuuagauuugucuagauacacagauaccauuguguuagaacugcguauucaguacaguaacauguucagauuuguagccuaaaaacuagguguuucuaugauguucacucagugaggaaauugccuaaugaugcauuucucagaauguauccccaucauuaagcaaugcaugacuguaauggaguaaugugaccugguauucuuuuuccuuuuuauaguucacacuguauauuuuuaaacaauacuucaguguuucaguuuauuugugaacuuugauuugugcacucauuuacacauucauacauacauugauucacuccuucauaaauacuuuauugaugaaauauuacuuacuggaagugccagugagguacaggagauacagcaguacacagugcugaaauagucacagcccucauggacuugacaguguguuuaucauuggauuggauuuaagagaauuagcuaauuuuuuucuguugagaguucaugccauauuugacuuuuggauuuucugagauuuauauuaauacauuugaaaauuuugguuuuagaauuaggcuaaugguuacaguuguaccucaguuuauugugcuuuguuuaauugcacuuugcacauauugcauuuuguacaaauugaagguuuguggcaacucuguugagcaagucuaucugugucauuuuuuccaacagcauaugcucacuugauuagcauuuuuagcaauaauguuuuuaauuaagauacguacuuuuuaaaagacauaaugcuauugcacauuuaauagacuauaguguaguguaaauauaacuuuuauaugagcugggaaaccagaauuucauauaacuuguuuuauugccauauuuauuguagaggucuguaacugaacccaaaaggucucugagauauaacuuguauauagauuuugauuuggucacuacauauguuuaugauuguuagcuuauacuuauuggcauucugaaauuuuccuuuuuucacuuaauauuguuuuugugcucuguccgugugcaauguaguuacagcuguagcuaaagcuauugguagguuaugccuuuuagcugcuguauaguauuccauuugaauauguagcacuacuuuuuauuuauucuuuaauugauagacuuuuagaauauuuccccuuuuccucuucuagucaguuaauacuacaauaauugaggucucuuaugagucaaaacuuuaaacagcuuugaaagagagcuaucuuuugucucauuaauguaauuuuaaaauagaaguauuugaauuuugccuuuaguauuuuugauauuuggagaaaguuccaguugacuuaguuuaaauggagucuaguuugugugcuuuucauaccuuaccaguaaaaguccugaacuggucauuuuacuuggaguguaugaauuggcauagcacaguacugaacagguaaaaggaaacaaaguauaggaaagcagcuaauuauaguaauugcagcugguuucaaaguacuucuaacaguuugugcauaaugcuuacuugaaagcaucaaaugggugcuaguugugaaauagaacaccuguuuguuguugagcauguguuuaugcagaugauuguuguugucaaagcaccuugauguagaguaguccuguuuacauuuacauucuccccaaaggauuaacaguguucucucaauaaauuugcagucuauucuccucucaaaggcugcuguuuggaggguggugugaaagaggcaacaagugcuugcuaaucacuugaauauacauaauuagcugcagucuggugcacuggauucuuuguagaaccauaacaauacugauuggcaaaugcacauaacaauagaugugucaccauauaguccuugagagugcugguuguuuguucauugguauuuauuacuuauuuuucucaacaugaguuaaauuuuuauuaucaguacacaaacucuuuuccuguucuuuuaaaugaaccaguguguuauauaacaacuccgucaucacuaagaagcaguguuguaaauuucuagacuaccuagagucugaggguauuauuuaaaaacacauuugcuguauuuaguaauuccaaagauugagaaacguccagucagccaccaucucuucccuuugguaggcucagcaagggaguggagaagcuuuuuaauggaagaaagaggcagcuuuagguaugcugugguuggaaggcuguuggcaugggaaagcuggaaguguggguaucuugugugacuggucuggggaacaucuuagcuuuuucuguuugguccuugguugucauugcccaaguccugaccguucugggcucuuggcugcagagcuugugguuugccauccugcguugguugcaaagguuguggcucagaguucugugguuauacaugaucucacuguuguccauuuuauauucagccucucaguggguaguguuguuaagaugaggcgaaauuuauuuagaaaaaauauguaaaucuauaugaggaacaauauuaaguaaauaauguagauggcaugugaauaugacacaaauugugaaggugguaaaugaaauuaggaagaaaggaaaaaccguuacaugguaauuacauaugaggcauuucacugaguguuuucccauuuuauuucauuuuauccucuucaaagcucuauaaguacaauaucauaauccugaaauuauaaaugaagauucugaggguuagugaaguacauugguccaugguugcacagcuaauaaacaggagcuggaauuccaacccagagcuuacugacuugagcuuacugacuuuugacucuaaaaagaggcacaaacuauuaguuuacaaaugugaucauuccaugaacugagaucuuucagugcgucacuucuagugccuucuauuucucuucacagaacacucuuuuuggauaaagaggguuuaaaaaauaaucucucuauugauuuuuaaauagcugcgguggcuagcuuccaagucugcaacuauguacuuccuuguuucaagcuggccucacuauguguguagaggacgccuuggcuuauccuaguuacuguugcuguacugagaccauccaguaagagugacucagagcuugcccauuaccucuucuugccccuuaguucuugcuguauaucaaagcaaguguuuucuaaauucuugcagacucuuuguucucuauugccuuauuauuggugauauugcaugccauuuaucuuaaacguauggaugguagaaaacaugagcugcuacaacaacauaauauauaucuacagcaggcuauuauauauauuuuuugcuuucauuuuggcaugugguagauacuuacauauaagaguuuaugcuaugagcagaaauaaucgaaaugucacgggauccuucaggugucacucugccagccgggaaccauuguggccuguggcgccccugcuugaguuucacucacucccacugugcucguuccacccacucagcccggcaggcugcacucaguucgcccaacccggaucccacgccugaugagggcaaaccaggcucagagcacugaagggugugugagagagcuaacacaggguccggccagcugugguggggcaggcagcucugggugcuggcagaggugccggcuccuugccaggcugcagcuggagcaggcguaccacacguaguuucuggugcaggugcuggugucuggaaaagggggaugcgguggcaccuaaaaacuuggggacgccagcaacugcagagccucaaggagugggucaggcgugcucucucauucucuccacccgcggcucggcgagcagggggagcagguuucagcuuguucagucccaccaccucaccccagccggcggcucccaggcuggcccagcuccacugccacuuccugucacauggggcagcugcccaaugcaggcagaaggcaggaaggcuauaguguuacagcccuggcuugggaaauccugaugucucggcccccagaagugucacugcuuuucacuccugcaguccagcaaaugggagcaugucaccaccacaguuuggugaguuggccaggaaaguguugcagcccuuuucaugcccacuguugggugggucccgaauucugguccuuuguccaggaagaaugagguuacguggacaacuggaaggugagcaagguggagaaguuuuacugaguagcagaacagcucagcagagaggagacccaaagcgggcagcuccuaaggguaguccuuacuuaccuugaguccagcugaagcugggguuuuuaugggcucaaaauggaggaagugugugcugauuggucccugggcaggaggaagugcgugcugagugguccauggguggaccuggaaaaaacaccauuucauuggcugaaaggcguaaaggaaauucucccuccagguuguggauuccagcuagaaggagcagccagguuuucaggcuucaugcugugugugcccugaagguuggguuucacuggggaccugucccaaucugccuaggaauuugucugccuccugccacuaucacaauuuuauuucugaaauacacaaauauuuaaagcuguuaggaaggugucaguagagagacuuggaaaauacaggcaagaugaaaguaaauuauucugguaauaaagugacccauucuuauuagggaaaaugaaaaauauacauaaagaagaacacuguaaucuaucauuuauuguccagagauauuacuaauauuuuaugucuccuuaaucuuuugucuaugcacauauuuuuauuuuuaaaauacaacauuuggaauuuuauaucuugcuuuuuuucucuuaauauuaugaacguuuucccauaucauuaaggacuuuuaauagcauuuuauaauuauuuaccuaacaguucucccugaucauuagacaguuaagauagauuucagaucuuuuuuuaagguagauuuuuaugagugaaauuacuggcucaaaggauaugguuacuuucaugucucuuuauaaucuaugagguacuugauuuuuuuccuggaaaggcuguacccauuuauguucucaccauauucucaugcuuuaaacucagugcauaugcucuuauuuucacuaguauuuugaauuccacccuuuuaaucuuuucaaaaucucaaaucauuaccucucuuguauuaccagucucucccucucugcuuuaucauucacaccggcauauaaaggugcaauaguaucuuccauccuaaaaagaaaagcccccucuugacauauugcuucccauucugcuacugccucuauuucugcuucucuuuuaauaaaauuuuauugcaugguuuguccacacuggcaucuuucauauucucaccuuguaguuaauuuucugcccuaaacucuaguuuauuuggauuucuuacuccucugaagagucuaguaaaaaucauugacauccgcgugaacauuuuucucuuucuuuuucuccaucucuuaauaucauucagcacaaguagcaacucaauucuugaaacccaaccuugguuucuccuaacucauuggcucuuccuuucugaucuuguaucaguucuugauacacuaccugaugccuacuuauuggagggccaugugacuccauggaggacuccuuucccuaaggaaaaacuaaguuucccugaaguccuuuuugucucuaauaacuuuuuaccucuucugggaugucuggcauaugacucuugccuuagaguccauagacugcaaaugaguuugugcuuuuaaugacacguacuuuaaaacucauugaucuuaguuuuauuaagucuuuagauuuuugaaaauuuucuuucaagugguuauucuuugaaaucgugaagaacugacagcauaugaccagacaguuuuucuacaaaagcauugggauugccuguccuguccuaucuguucccauaaaguuuuaggugaaauacaaagguuuaugaucuaaauucacaauugcuaguaugaugcauuagcacaccauaaguucacaguacucuuugcacuauauuccugaaugauuaaaacuuacagcuggcauaguaucaagugcuggcugcccaagugucucccucacaaccuauagauagaguuuauugccugucacagaaagggaguacaccaccugguuagaacuuuggcgguuucuuggagggaagaaagcaaggauaguauguacugagaaucaaaguuugguugagguugagugaauacuggguguguguguguguuugauuaaaauuggaugaugaccauuaugcaacagcaagggauucaaaaaaucuuacauacuguuggggcuuucuauugaaucguugaugcguguuucaggaguuugcugugaugaacaaucaaaccguuugccagggugaggcucucccugaauagucaagucauguuaacguacacugugaguuguuuagggaguugauaguuuuagucuucaaguuguaugugguuucuguuaaacuauuaaugucauaggacuacaacauacuacuucaagcucuuaaaauggcuuucccuuauuuuugagagauguagcugagugcugcuuauagucaggucaauucuuauaaaacaccaacaucccucuaugccuaaauaucaaaucaguguuauaauuauuuuuuuaaacuaagauuauaucaaauuuuuuaguuugauacuuacaaaauaguuaugaugcuuuuuuuucuugguucucuuuuuuucuuugcuagaaagacuuugaacuauaaggauggagguuccuuuucugcagacuuaagaaagaggaugugaaacuuggugucaugaguucuaaauaccucaaguuauuguugcaagaauaggguuuucaguuuugcaauuucagccuauaaauuacaaugaagaguaagaguccuuauaauaauaaacuuuuggggcugggagcaguggcugacaccuguaauccuggcaauuugggaggcugaggugggaggaucauuugaggccaagaguucuagaccuuccugggcaacauagcaagacccuaucuccacaaaaagugaacaaaauuagccacgcaugguagugcaugccugaagucccagcuacuugggaggauugcuugagucaggaggucaaggcuguguugagcugagauuguaccaucgcacuccagccugggcaacagagcaagacccugucucaaucaaucaaucaaucaaucaacuaacuuacuuuugguauuguaugcugauuuaugaagguugaaccuaggauuaaauguugucuuuugucugcccuuuauuuuucuucccuuaacagaugccauguugagcugccuuguccugauuuugacccacaauguguauucagccucagcacuuauuauguagguuaggcuccuuuuaaauguuaauguuucacauuuaugcuugugugaauugcucauuuucugucauaaccuggggguauggaaggaaucuguugaagaccaaggaggugggcuuuaccacaauacugacaucucuucucagcucaggcagggagccuuggcuaggccaccuauugccacugccuaaguagaaggugauuggcagaaucuuaucugcuuugcuuugacuuuucauugccagaguuuguugaaggaugccagauguuugggaaaacaaguuucuuuuugcuuucuaucccuauucuugccaaauucuuaccuguuuuuucaugaggaugcccuggcuugcaagaaaaagcaagaaaaauaaaaacauaaguuugauucuuaauuugagcauucugacccauuuucagcuuuauauauccuugguccauuuuucuuccuguuauuuugacaacucucauggcugugggacugagugcuuguucauagauaaauguuaacuuucuuuuggguugaaaaagagaauauugguugcuaaguugagcaaccacagacugagauuuucagaaaauugacaacuucuuuugagaauuuaccuguuguaaguuauagaaacugaacuuaaauauuaccaaacaaccauauuaaauauuugccauauuuuagauuguucccugcauuaauugaguucacuuuauagguguaaaauauuuuuauauuuaguaagcagaucaaauaauauuaaccccacaacuuuuucccacacguuaaaaaacaccugacucuucauccagauaauuuuuccagauuucaccacuggaauuuacuuauacauccuuuaauaccuaaauaaucagucuuguucugauauuaucugccuuucguaaauaauugaaauggauuuggcuuacauauuggggcguggguuaaccuccaguuggaauucuaaauuuaucaaacuuaagaucuguuaaaaugcccagcaacagaauaauuaaaacagauuugaaaagaugaguagcacccaccagcauacuagacauuaauguuggagguaugaaauuccagacauuaauguuggaggcaugaaauuccagagcugccugcacuaggccuuuaugagaacuaaccuuuuaaaaaggccaguagcuuuccuagucuucuacgaagugccagauagaugagugaauguguauaaacaccuuucuguguguacuuuuuagcuauuacuuugaaaauuguaacaacauauauauugcuuauccauuuugaaucaacugugacaucuuuuagccauguauauguggcauauguauuguuuucauuaaaucgucgaaauuauauaagccaguuaccacuuuucacuaauuuuuuuuggcaaugguauuuuggaagaauuaaauauauuugaacuguauauugaaguagucaaagugaccuucaaaaggaauguaaugaucuuaaauauaauauuuuaucuuauuuaguugucacaaggaccuuauuucugugguuaugcccccgacccuuaacccuugcaaaucuccguaugcagugagcaguguuacugcuggaguauauuauucuugucucugaaguagagacacaaaaaaggcugaguucuguucuguuauucugcuagauuggucacauauuccuggagagugguguuauaauuuuuuuuccugcaucuuugcagauagcacagugcccccauggaauacuucacucacucuagucacuggugaaguccuacucaucaacccuucaaguuauagcucaaguuucaccucuuguaucuugucuucccuugucaccauuugaaaguaaacucuuccuucugaaacugucaacacuuuccagaacuuuucuuacugcccuuauugcaguuucauuucuuuuucucuuuuuuuuuuucuuuaaagacaaggcucgcucugucucugaggcuggaaugcaguggccuuaucauagcucacugcauccucaaacuccugggcucaagcuaaccucccgaguagcuagaacuacgggcaugcaucaucaugccaggcuaauuuaauuuuuuuuuuuuuuuggucuagacaaggucuugcuauguugccgaggcugguccuggacuccuggccucaagugauccuccuaccucagccucccaaaguucugggauuauaggugugagccacugugcccaacccuacuuuuguuucuuguguaccugauuuuucuucuauauuguaggauauuuuauaacaauaguugccuuuucuucaucuuuuuucccucagaaacuggaaaguauuuuguuggccagagaucugaaugauuuaagaaugauuuuaguuuaaaauucaguuuuuucucccaggagauacugagcucuuaaauuaguauuucuuaaagggagggcaauaguccaccuguauuagaacccccuuaauccuugguaaaaguguaguuuuccagaaaaugaaauuagaacuugugggucuggaucccagaagauggaugcauuuguauuaagugccaugguaagucauauuuacacaaaaacugaagauucauucccuuaaauuauuauggaaauaaauaaacauuaagauaccauaagucuuauaauguaggaaaaaauuccuuacuuuugcauuugaaaaaaauaugcuuuugaaaacuaaauuccuuauugauucucuguuuuuggucuugauuacugauuugcucaccuaauaguucucuaauguauguagguuuaaggaacuaaaaauagagauauuacugacugaacuaguuaguauguaaaguagaaaaugguacaacugcauacucaguaacggguaguuuuaccuuuuucuggauucuuuuuuuuuuuuuuccccucaauuuuucuagauuuuggccuaccuuguauuaucuuguuuguuugguguuaacuuuuucuuuugaggacugcagggaugacagucuuguuuuccucuccuguaucacacagcauuguuacaguggcucagaaaagcauuucugaauacuuugaggauuauuuauguuuguuauaaaaugaaauuuguuguuucugacucggaaaauaaggauauaaauuucauaggaaugcauuuuaaaugaaguuucuugagagagacagcuuuaacuugaauuuugcagcagcaucuaaaacgaagccaaugaaaacaccuuuuuuuccccagacagauauuacucugucucucaggcuggagugcacuggugcauuauggcucacuguauccuccacuuccugugcucaagugaucuuccaccucagacucccaaguagcuggaacugcuggcagguuccacuaugcuuggcuaauuuuuuuuuguauuuuuuguagagacaggaucucuacccaagucucaaacucauaugauguccucaagcccucccaccuuggccucccaaagugcugagauuacaugcaugaaucacagugcuuggcgucaguggaaacacuuuacucuugauugugccauuuuccauagggguugguggcuggauuguacuuucuaguugugaaaguaauggugagguaauggcuuugagucuagggaucagauccuucaaucaguaguaauauaagugagaaguauuaauaugacauagugaauuaucuauaauuucuagagaacauuuaacuugcauucuuagaucuggagauggaggaccgguugauucagacuacauuggcuucaaagugauaaauucuauauucaccucuacuaggacauauagaaaaagaaaauagcuuugaaaguauggcucuuucuuucuucuuuuucugaauagugacaggcaucuaugaauagugaugaauucaggaaaacuccuaggcuagacguuaucuugacaguugguggacagaugcuccugauuugagugugagacugagguauucagaaagcacuucaaaacacucuccuaugccagcuaacauuauuuucguuauauugugauugaguuuuuaguugcuuuguaauaaucccucagauaaagggccuggugugagcugggaaaaauguuuaugauuuauuuugagcauaacagcauauagucauuuuuauaaauuguuuuucagaccuuauuauuacuuguaaacuaauguauuaaaacacauauuaacauauuaacaauuucacauugaacauuuuaaaugaaaauaauaaauguuaauguuuaaaugaaaaguggccuugauaauuuugaaaaugggugcccagacuuacugcauuucuugagaaagauuaauugcuuccuagacaggguucuuacggugauaguuguuuuuacauugcucaugucuaauauaauauuugagguauaauuugccaugguauuucuuuuucugaguuaguugauguuuuauugaagacaugaaucauuaugugauucucuccauuuaggaaaaaauuuuccaucuuuuucaguggggauugggcaggucauucucauccaggguucucuaguuuagaauuuguucuucuuagucugaaggaaguuguugacuuuuuauguguauuauaagggccuucuuuaacuucgugcuuuggucugggggugugaugauuacuagaaauggugaaguuaugugaugggggaaaugccuuuuauaaaacaaauuuuggcaauuauguuguuuuccccuuagcauuuuauucauaugcauguacucagaagcaugcacagaauauuuagacauguuaacauuuagauggagcugcuuugauggaacuuuauauuauagaguaaauuuagguuguugcuauuuuaauguauaucuuuuucucugaaguuuuauaguauaauguuucuuuuuuaugauaaccaguucaaauguaagcauaauauaauaaaaccuuaagcucgcagucuaguccuugcaacacgaauauauauagcagaugugucaaaauauaugaauuguucuuaauguuaaacuuuuguucgugagaauaacguaacaccugcugugaccugcuaagcuguguaaauuuuaaugacuguaaaacugaaauguauucauagccaaaauguguuuggaaauuauuuggaaugucuuaugcuuggcuccuuuagagauuuuguuauauaauauguagaaauuuaaaucugcuauaaaaguugaaaauuauuauaacgucuauguuacuuaaaaguuaucuagaaaauuauaauaccuagguuacuuauaucuuuucuuaaaaaaguuaucuguaggguaaucucaccucugaugugccuugccuggaagcaacaggaguguuaucuaauacuacacaaauuuguuuccuuuuagcaguggcauucuuuuaauucuacaaauauuuugauaccuucuaaaaguagguaggauuacauuggcauaguaaauuucccaggguuauuaacuccuuuuucucuccauuauguaaaaaauaguaagaaaauauaagaauuauaaggguacuacuaguuuauauuugguaguauaguaguggaaagggaaugaucccuuuccuccccaucauaaggguuauggccaacacuccuauaacaaaauacagaguaauaagagaaaagcauaacaaaucuguuuaauuauaguuuuacaugacacaggagccuucagagugaagaccccaaacauaugggacaacuauccauuuuucagugcuuagguucagugaaaaauggacagcuauguagaaauaggacuggacaaaaagguuaugaucuaauauuaauagacugcauauaaaaacucaccaagaccugucuguucagauucuucuuggccucucucuuguaauguuucuuccucccagguaugggacaggaccccucugaugagggucuuaugaccuauauuauugggacaaggguaggucagagaauuucuagacagaauuucugucuaggccaguuccuagacagaaaggugaggggaagguuagaguaguaauuguaguuuuuauggcuggcuuuggagaagagagaucuagucuuuauuaucugcuuuggugaggaggaauucuggugucuguacuugcuuugggggagaaugaggggcaagagacaggagggcaggagaagaugagagagauccagguucugaggcugcuucugauaccuuccagugcaaaguacuuugugugcugaagugccauauuuuggaguauuguuuucugagcuccagcauuagcccuauuugccaguagaauaugguguggcaaguacuuuaaaagaaugcuuuacaugcuuauuuucucaagaguauauaccgugagcuuuucggaauaguuggaccaucugggaauacguaaaaaauaaaaggaaaaggacaagagauuauugcauuuugauuggcuccaaauuguauuaacccuuaauauuuaucuacuuuauaauuuuaagauacuaauauuugaggagaucucuuuauucgaauuacugguuuaagauaauauuaugauauuaacaagucucuuuuuuucuccucacaucuuuuagaccagagcagacaggccaagucaggcugagauccuauuuaugauaaaaaucauagaacucuauguaguauugauaaaacacaugaagauuauauuauacuuagcuuuuaauuauauuuugacauuugcucauguuugauuuagaacuuuuuuuuuuuuuuuuuuuuuuacuaugucuuuuggucucaucaaaaagauuuuaagauccuuuuuauuuuggcaaaaauauauguaacaugaaauuuaccauuuuaaccauuuuuaaccauuuuuauuuuuauuuuauuuuuaauuuuuuuugaguuugaguuuuguucuuguugcccaggcuggagugcaauggcacggucuuggcucacugcacccucaccuccuggguucaagugauucuccugccucagccucccgaguugcugggauuacaggcaugugccaccauucuccgggcaauuuuguauuuuuaguagagauggggucaggcuggucuugaccuccugaucucaggugaucugcccaccacagccuuccagagugcugggauuacaggugugaggcaccgcgcccggccaccauuuuuagauauacaguugcuuucauuucuuaugucucucucuuaacaccaagguuauuaaguaaguauuuaagaacauacaagagauguucaguguagcagagauuggccaaauccguuugcgcguaauacaccuacucugcccuagcaccaaucuagacuguuuuuugcagcugucuuggaguuagguguggccauacgacugaguucuggccacucacaugugagcagaauuaacgcaugccuccucuaggcuugggucaugaacaucuguguucaguguucuuucucucuucccuucugauggcagucaugaaaccaaggagauggaagagccucuaaaagggaggauucuagguccuucagucacugccauugaaaggaaacauuguuuugaccuuacaugagccagaaacaaaacuuucauuguaguaaagcacuaaguugucaugauuuaccucucucagcagccagcauuaccuucacugauacacucaacagugauuugaguauguaauuuaguuuacucaaaauauacuucucauuucuuagcaauuggaauugguagucaggaaaacuaaaguugaacugaggagugagaaauuggggugugacuccaguuggaggaagacuugguguggaacucgaugagaugaauaaaagauagaacaauuuggaauguuuuguuagggaauugauacaaaaaacuuaaaguuagcagagaguuaugugaauaaauuagaguaauuuugggaguuguaggaguaggggggcauuaugaaauaagaaaagucucugagaguugggauaggauuuaaacacuaucgguuuuuuuaaaaaggaauuuugccacauuccacaugcagcuugcaaauguuuuugcaaugacugucuugacauaugugauacucagaaaaagguggaauguuuaaaugaauagaacugcauaccuuauauaucuuguuugcugggaguuagauucauuacuugaauaauuucccuaaugagucauucccuuaggggaauuaucccuaagggaauuauccccuuagggaaugacuuaucccaugaaaauaauuggauuauggcuuguuuugugcauauaugaaauccaguuuguuggacuucuacaacaccuaaauauaggugaaauuuaccuuguguuuuggacaugcaaaauauuggauagaauauuuaaaaagaaaaaauucaucaauucauuuugcuagcauuuacucuucauaauugaagcugaggcugggugcgguggcucaugccuguaaucccagcacuuugggaggccgaggcgggcagaucacgaggucaggagaucgagaccauccuggcuaacacggugaaaccccgucucuacugaaaaaaaaaauacaaaaaagaaaauuauccaggcgugguggugagggccuguaaucccagcuguaaggguagcagccucgggaggcugaggcaggagaaucacuugaauccaggaggcagagaucgcagugagccaagaucaugccacugcacuccagccuuggcgacagagagagacugucugaaaaaaaacaaaacaaaacaguagauagguaaaauguuuguggcuuuagauagcuuuuuuuuaaaaaaaacuuuaaagugaagauuuaauaauuauaaauuaaaaauacacuacaugacucacuugauguuuccaauuuucaucuccuauguaaguaacgauacagagaaugcauacaaucguuggcuuguggacauccauguccccaguuguguguauguuggaaaugguuauaagacauggggauuuucuuaccuccuguucauaauugcuucagcuacagaucagauucccuucuaaacaaaugguaagagaccaccucagcugagccuugggugguguuuuaggagcaauugcuacucuacuugaaaaggaaagguccucuguuuucuuaugcauagcauccaauguaaaaugaauguagcucucuucuuugaccuuacucuuauuugcauacuuuaauggguguaaucauagaaauguugcauauucagcauaacuggauucuaacuuauaauuuauuuuaaaaauaaaaguacuguuaaaaggaauuugagauuccaggauuucuuacaaguauaauguacaauguauguuuuaugaucgaaauuagcuggacuugaagucaaaagaacuaguucaauaacaugugucuuaacuugaaaucuugguuuccuaaucuguaaaaucaccaauauacuagaaucuugguguuaaaaguaaccuauggggcaguuugauaccaccuuuaacucagaacucaaauuucuuuuauaacaucuuugauauguggccguccaaugauagggugcucagugucucauucuuuaaucaggugcuuauagcuuugaaacucuugagcauagaauacugaugguaauauuaauaucugacuugucucucauaugaaguaaggagaaugaaagcaaauauuaaaguagcaaguaguaguuauacagugcuuuuuuaacuaaugacaugugggaacuaguuaccauuuguauuaauaauuuuuuaaaaugauaaacuaaauuuuaaaucucugacaaugaccauuggaacccagccuguuuaucagguggagucugccagugcuuccaguauuuuugauacuaccuaguccuugaaaauuaaaaaucuugacccacaauuuaaaagccacuggguaugacucuugggaagacauuucgauuaccuaguauacuaaaagacuuuaauacaaauugaaauuauauggaaguuacuuaaacauuucuaaaguaacacuaaaccacauucuuuaauguauuaugugucauggguagcauugccuggaagagguagcagcaagcugaguuuaugaaggaaaaaaacuucugagugagcuaaggagcugguggguagaguguggaagauggagcagacagacugagauccauccaggccugggaggggaaugggagagagaccagggacagaagccagacuugacacaaucccugaagaagauaaaagaaagugauuuaaucaccuuccagaucuuacuugcaaaagggcuaccuguauucuuuggaugaaguguuaguauuauuagaaugacccauuuuuacuuguguuagcuucaguggaucuuuguuccuuguaacugaaagaguucuaauagagcacuaagguuaaagacaaguaucagggguaaauauuuggcugaggccugcuucugaauacuauucuagacaugaccucuccucuuuucguucuuuuuuccacaacaucauuauaaaauaugaaguaauccuuuuuaauuucuugucuuucugaauuuaaaauucuauguuagguauucucauugcuugauuuguguuuauuauagaaaugaagaguuuguuuuaaacuaugcauuacucgaauuucugcugaggaaguccauauccauauguuagguuuuuugcaucccaaagucuuggauuagguuuugccaucauuguuaguguaucaauagaccacugcauuauuuucuuagugguaugucagucuuugacuuaauauuugcaaguauuuaauaauaccccauacauuauaaauuaaauuguauuugguaccugcuagaucuuaugagaaauuauucacauuuaauaagaaaacagcaacuuguuacuuuuguggcagauaugagcucuuaaaagaugcaacguagguaaauaaaaaugagaauguuuaccagacccacuaggaucauuugguucuguaauucuuauuuaugaacauuuucuuacagcuuuguucuaauuuaauuaucccuauuccccuuuagguaaaggauaucagaauugugauuauaugaagaagaauucuucuuaaaaaucauguauucuuggcaaauauuucuuauuagaagcuuuuaaaacagucuuaauuuuuccuuacagacaaauuuuucugcaguguugucauugauauaaucaaaaugguuucagguaguucagaaauuguugacagacuuaacuaagaaaaacuuuugaucaaaugguguaacaacaccuuuccuggacaaagccaucauuauucuguuaaauuuucagaucuuauauucacaucccauuuacccuaaguauuaucacuaaauggaguauucaguguacacacauauccucaacuugauuuuccuaaauggaaacaauuuuuuuuucuccacuaagaauggcuuuuuauucauaugugauaaaaagauaagucauuugguaacaccuuugaaccuguuuucaaaauaaugaaaaguuucucuucuaaaaauacuuuuuuucuuucccucguuuauuuaacaagaagaguuauuauguaauguuuuucugcagauuuuuagaaaaagaaugaucucucuccacuuuguagagaaugaucccauuuuuuguuuaacaccagauaguaucaugacauuguuaauacaguaggauucacccaguuugaaaguaugcagaaucagacuucuguuguuggucacauauuucucaaucaaaacaucugucuaugucgaaaccaaagucggcccaguauaaugaacuuuuaagacccauguuaauauuuaaaaauauuugguaaacuguaaagcaguauacaaaagugaauauuuuuauccaagguguaaauuggucauauggcccaauaccaguagcauaaagggaagccacuauacuaguagugggugaccaaguuuauuucuguuaagccaaaauggagauuuauuguagaaaauuauuagugguacuuucuggaugaagccauuccuucuuaauguaauuaugcccaauuuccuggguggagucacagucuuucuucuaaagacagauuacuucaagcuuuaguagggacucuuaguucugucuugaacuaacaauaccuuaaaauauucugcuucuucauguccccaaaauauugaucagaaggauacuuguggucaaauggaugcuguagaaauucaaaccagugauuuuacuccacuugaaauuuaaaggauucauaugaguucuaguugaguaugucaguuuuagaacauaguuuauauugaguaaacacagaauauuuuaccuaaaagggucacacagaugucauuacagugaauuuacuucugauuaaacuaaucuuguucccuauauauuuugauauauauugugccaugauaaccaguguacuauuaguguuauuaaagucuuucuucaaauaguagauuuuuauagaauuuugaaguagacaaaauaagucaauuuauguuuagauuuaaaaaaaaugugaaagcuuuucuauauucuccuccccgugccagauaggugcuuggcacagaguacuuaauaacuauuuaauaaaugacagaauuucuuuuccuaaaauuuuuaggacauaugcaaggaaauuucucuugcaucuagguuuacugauguauaugaggaagaguuacaucugcuucagugaaauacaaaauuaaaccaggugaucuuucugaaaaauuauucuuauggugacauaucagaaaucuuaucaacagcuauaguuuauucuguuggaauuuucaaaauacacugugccuuaacuuagaaacacuccaaugaacuuguauucauuaguguuuuguugaguuaaagaaaaaauaucuguacaaaguggacacauuguuuaauuuuguuuugcauuuuacuagauugcagugcaaggccaauaaauuaaaccuaggcaguucucuugcuaauuacacacaacuuaucuugaguaucagauauucaaauccauuuuaugaauaugguagagagaauaacaacuguaaaacaaagcagugugcauguaagugacuguuagcgugcauuucagaaaggauaaaugcucaccauaugguacaauuacuguguccaaguuuucaaauuagcuucucucauccuccuuauuacugucuuuaaaaagagaggaaaaaacccaacaugauuuaucuacucugcagcagaacucuugacgcaaaacagcagcccaguucuguccaguuuuuuuuucccuuagcauaauagaggcugucggacuuuuuuauacuaauuacugugugagccucagaugaacccccuucaauucacagggcuuuguuaagggaggagcugucaaugugucugcccguuugcagcugugcuguggcuuuagcuugcuuaacauuaugcugcuuuuuagacuugacagaagggauuuuuuuuuuuuuuuuuuuuuuuuuuuuauuaaggcaaagcagccuuguagcgaaaugguuuaagcagcugcauuguagggaagcacaaagaaguuauuauugugucuguuuagggggguaggauggagggggagauauucggcugcuguugaugccgauuguugacuugccaucugccagauagggagaagaaaaaaaugacagcuccagcaggguguucaagagguuguuuggagagacgcauaaacaugugcagaugucgaacugaauaauggcuagaacuugagacgguuuaugaugcugcugauguuugugcauauacagaaugaauguauguguggauuugguuaaccaaggguacauacuaauuaucauuguuuuccugcauccccccucccuuauuucguuaauuaguuuagggguuuaauacuuccucuucucucccuuauucaugucuaguuuuagaaagcaacuucuuuaaauggcaauacaaaguuucuuauuucuccguguugaugguagauaaccuguuuggcuaauguuagguguguacugcuaacugccaagaggagcuuuugaugaaggaaucagucaggugauuuggugugaucuuaaugcauacaugaacguuuuaacacuagucggcacauaaacuauuuuaaacugaaucgauuuguuucauagccuaccacuaggggugagguagagaguacccaguuuauuuuguaaguaauuccauaauacuuugaacuuaaaugucguuaguugugaaacaaaguuauauaguaaccuggccuuuuugaucaguacauacucuuuuucucaugguugucauggauucuauaaaugacaagcgugcauuuuuaucaagcauuaaugaguugguuguauauuuccuucugauacauucuugacauuagguguuagagauuugauauaucuggaauguuuucaaaugcugugauaacauuuauauuuagauggaagugagcauguuuacuuaaaugucugguuuauuacuuucaccuuaaauaauugagaagaaacagugaccuuagguaaaaauuuuccauauuacuuauuuucuagaacaccaaaaauuuuuguaacauuucagaaccaaucaauaugaauggaauaacuagaaaacaaaaaagagaagcucugacuuuucuccuuuuuucuuuuuuccgcccaauguggacuuaacauuucaaaaaaaaauauguguggagaauuaaaaagugcuuauguugacuuuuggaacucaugccuuccuaaaacauuuaagguuuuguugcauaauuaucaagcagaaauugcccaaagcaugguugaaaggccaacguacugacagagcuucguguccagaguaaugucuuucugaaagaauuaaaggaagguuaucuguuauuuucugcuuuucauaaagaaauagaggucaggucuaucuagaaaaaacuuucucucucaccgucaguuuuuacucaagugacucuaauccguguuugcugaaaaggcauagaaaaucaucagccaccuugacuuuuccuuugucucauguauuuauuucuuuuauauagguggccgugaauauauccauauuuguguguaggauuauguccauguauuuacaguuucauagucaauccuaauaucccuaccaaguuuggaggcgagcaguaugccauuuuuuaaguagaagguguuuguuauuaaagugagaggguaugguuugucaguggucaggauauuaaugagugacugggaaaagcaagcuuauaccaacuuuuauacacaagcaaacuugcaggucuaugcuuuauuaaugauauguuacuucugauucuuucagagccauuugcuaaaucuuaguaguacaggcaaguauacauauuaaggugauugaaauauuaaaggcagaaugucuuugaaguuacaaagaccagauuuaaauaucacuuaacuuagaugagugaauuuacucauagucacuuaaacuauuuaaaugugaauuucuucaucuuuugaaagaaggaaacaauacuugcuauucaaggaucuugugaaaacaaaaugagauaauauauuuagaaugucuugaaugaauucaguaguagcuguuaguauuuuuauuagguguuaugugcaagucuagagcucuguagcuauuacaauuggaguauuuauauaaugcucugacuaucauagaauaagaauaccaagcuguagaggcuguuugagagaauggucacagauagaagguuguuucuuggaaccuuauguuuauuuagggauauaugauuguuuuauaaauguggagggaaauaaauuauuuaaagaaaauauaaagaaaacaguuggauaaaaguauuucggauguaugguauuagugguuauuuagugaugaugauuucaaauuuuguucuuuuguuuguuuguuuuugagauggagucucacuccgucacccaggcuggagugcaauggcauggucugagcucccugcaaccuccaccuccuggguucaaggguuucaagcgauucuccugccucagccucccgaguagcugggacuacaggcacgugccaccacaccuggcuaauuuuuguauuuuuaguagagacgggguuucacuuuguuggccaggcuugucuguaacuccugaccuugugaaccacccgccuuggccucccaaagugcugggauuacaggcgugagccacugugccuggccagcugauuucacauuuuguucuacaaaauuauuuuucauacuuaaaaaaguaaccucaguuuauuuuggagcugaacuuuucucugcuacggccaguacuuaagcuguauuuggguuauuaucuuuaaaaugagacuuuggaacaccuagcuaaaaauaauauuucuucuccucauggagguuuaaagcauuauuugauugucacaacucuuuauuuugcagaugaagaaacuaauuaagcucacauagggaugaaagugcugagauaagcagaaguguuuucuuagagaaguaaagaggauauggcuuuggucgacaugaggaagucaguaaaccuaaaaguaugauuaauucccauacagauguagguggugguucuuuacauuuuucuuuucaaauuguuuucauccggcauuccacgcuaguaaauauuacugaauaauuuuggaugaugagucaaggguuguuguaccugggagagccaccuaauuuaguauuuaagagucuuucauaggacgggguauagugacuaagaacuucuauuuugguuuaaaagaauaaauugguuacacuagaaaaauaacgcucacuuuugaauggagugcuaguagcuucauauaaggauauuuuaauguuuaauggcacauggugauggaugccaguauuucuagacagauaguuaaguguuacagucuaaauuuauaaacaaauaauuuuuguuguuuuuuauaaaaaacaacuuacaguaccaaagaaguggaaauauccauagccuaugaaauauaucacaaaugaggaugaaacuguaaggacauuuucacaaauaaaugaaaccguacuugguauauuuucaggauaauucagaaaacuucagaaacuucuagcuuuaauguauauuugaauugugccucaucaaaauacugcaugaauagcaauuuuuaaaaauauuggccaguauguugaaaacagaguauuucacugucugacauauuguuuaaggcaucuugcuaaauguuuuggcuuaaauuuuuuaauguguuuuaguucaaaaaaaucugauuaaagauguggguaaacgugguagcacuuuuuagaacagaagaugauuaagauacaaaggcaggaaaagcauaaaucgugaaguuugucuauuuuuuuggccaagcaagucacuuauuugcuugagacuggaacacagcaucaaaguucauaauuuuauacuucuaaggaagaacgcauagaacagcaguuguuguuuccuggcaucuuuuugaagagauauuuaaacguaaguauauauauuuauuauagaaaagaauuuuauaaaaugaccuucauucccuucccugaauuuguaguauguucaacuguuaagcuaguuccuuuuaccuuuugauuuaguaaagaaggauuuuaaauagaauuuaaauuuuuaugaucuuaaaauauccaugauauuauauacuuuaaaaagaauaagacuguuuaguaguucaaauuuuaaaaaucuaauuuauucaaaguuaugcuaaauaauggcauaguuccugaguggagaacuacuauacuuugaauuauagaagcaaggacuuuuuugaaaaaguaaauacaaaaccuaaauaaaacacauuuuuacuaaauggcaaucagugucauccacgugagaucuugcugugucaaaguaaauuugcuguuuaccugcuuguaauaauuuuuaucuuccuucaauagaagcucuuuuuuuuuuucuuuuaaugcuagguuuuguuuuuuuuuuucuauaugggagaaguggugggaccuggaaaguuggauaguuacuaauuaacuuguauguaaaacucugacauaaagauuagcacuuuuuauauucuuaaaguaaaggucuaucauaccacuggauuauauaggguaaguuacucaguguuuuguauauaaaaaaaaaacuuugauaagugaaugcuagaaaacuuuuccuuucugugaaauagcaaaaggaauaaaacacccaguguacauugauugacuuagauucuagaauggauaauccuuaugcuauguaaagauucuuaguguaagaaucaguuaugaaaacucagugagugcuucaacuccacauugccaauuugucauuugcauuauauuucauuaauaaaugagugauuuguaacaaacgaguguauugguauuggcugcuuuuaagaagacacuuuggaacugaauuguuauccuccucaaauuacuuugucuuuacugaaagauuguauauuuagauguccugcaguuuuuaaaaacaaauuauucuacagagagcaaaacaggaacuuagauuauuuaugcaauguaaaauucuuauauacuuuuuuauuuuauuguauuuuggaugacuucagugauacugaugauuccaugcauuuuccuuccugaugccuugguuuuaagaaaaucuuuccuuucaaagucacuggaaacauuugaaaacagcauuauuaugcuuacugagguacagauaaugaugaggaaagaaauauguacguauaaugagcaaauaugcccauuucauuuuaagaaauuuguuuuuauuaguaugauagguaaagauuguuuucugaaauuucuauguguuagguaauacugcccucagagggccaagguaaguaaauucauuuuuaacauugagaagcagcuuuucuauuuauauuaucuauaagcuuucuuuggggaguacucaaaauuauuuauuugaguaauugaauaguguuugauuugugguugcauuucuuugauuuguuguguucuuuuaaaauguuugugcccuucaauucgacgauaucauuuaaacauguucaguucuagucuaagaaaauguuaacaugacuggccauaaauugucaaauuagauggguucauagagaguauaagaaaauuaccuggaaaaguuaagaugauuuuacuuggcgggugcguuuuaguuuuugugucuuugauagcagauauucuaguauucaaaauuauuugaagccacacuuuuuaauauagagcaguauucauuaaaauggaagcauagauucccuucaguuuuaaaaacuuaagcauaaucacaucuuucaaauauaauaugaaucaagaguaauuuacuuugcuguauaugcaguggcuauguauaaauauacuagaaguugaaauacacuuauuccugugcacuuauaaaagcauacguuuuuaaaguagagguaaagaccugauauugaugugugacuuaacacuucuuugaauucagaauauuggggauuagaugaugauuaauuuuuguaauaagaaaggaagaguggggaaggccugaugucaaaauaaugagguguucagcaucaugcuguauauccauguaacaaaccugcacauguaccuucugaaucuaaaauuaaaaaaacccagaauaaugaguuguguccuuuuuucuuuuuguauggaguaacuuucuuauaauuugaaagaaacauugcaauguuuaguaguaaauucaguggaaggcuuuugauuuuuuugcccuauaguuaguuguuauugaauuaagaaagaugauuucugugacaguugguauugucagucuuucacuagagauuucaaugaguuaaacauaagcgacacucaguucauuauucuuaguaaugagggaugaagacaggacauaagcaaagugaauaacaaaaauagaaauuuuauccacaaaaaaucaauaccuccuuugcucagcuaaugugcaauagugauagucuagacaaauuaaagaaauuccauuuuauuuuaaacacucuaguuacuuuuguguagucuaacauauuguacauauuagguacucacuaaaucuccuuugauugguuuccuuagccuuacucugagauguuuuauucaguuaacaaaugcuuacauaaugcuugcagugagcuagauguuguucuacaugcuuuacaaacuuuaauuuauuucuccauuauuauuguccccauuuuccagaagaggaagcugagacccagagagauuaaacagcauucacugucucucacacagcuagugagugacagaacuggcauuugaacccaggcaguccagcuugagagugugcgcucccaaccacucuuugaaucuuaacucuguccuuuacuagcuugucccagugucucagagccucagcauggcucucugugaaaagugagaauacugcagcaccagucucaguguugcugugaagagggcucuguaagugaagccugagcacagugccuggcugaggacauucauguuuccuuuucuuccuugcucuuaccucuucuuccuuucaccacuuaacaugcugugguacaagacucaaucaguacauugucuaaggagaacaaaggagggaagagaggaguuaugaagggcauggauucauccucagaauaguggagcucucgguuugaugcagugccauuuuaggguccauacuacuagacuuuucuuagaggaaaaacuccuugguaagagucuaagauaaaguccuauuaguuuuuauucuguagagcauugauguuaguauaggagugggauggguggguugaaccaccugagaguuuuuucagauggcacagaccaccuccugaugagcaagcacuacagccugccuucucugcaaacucccaguuagugcuguagugaggcaccauuauuguuauuugucauauccaucaggcauguucuaacagaaaaguggauugaaccauacgagguuguguuauagagagacuucucuguuugagagagcuuuucugacaggaguauagucuuuauuucaaauggugguagguuuauuuagucauugaauuaaugguuauugcccaccucugugguaguuucuugcguuauggacucacugcuuccauauuugguauucauuaagguuauuuacugcaguguauaugccauguaugauauuauauuuagauaauauaaggugguaaaaugggaaauauuuacaauaaggaaguuuuaaaguuucugaugaaauuauauuuuuaaauuggucuauauuuauaauaguuuaaaauucuaugacuacuuuuugaaaauggugcaagaaugacuuuguguuaaauccgguguguggaacuggaaacucugcucuaaugcaguaaacagauuuuuaaaaagaaagcucugcuuucacagccuacaagggugcagauguaagcaaaauaauaacuuagcucacacuuaacccagcaggaggcugcguacagauugaguaauucuccacaacauaccuacugcuauguaaacuaaagucaccguuuauucuucauuaaauugccaggaugcuuucuguuggcuaguccguguggaugcuuuguucucugugucuccacccaaugccccugugccuuccuuacucaccuugcuuuucucuuagaguaaaacuggguacuguaacucuauuaagauguuauuguguuuaagagaauaauuuaaaagcaucacuuugguuaaaaauguaauguuuccuaaaaacaaguggaacaaggauuugauuagucaauuuaccgaauaucaugaaacaaauaccagaauacuuaaggguagaugauaauuaugcaguuuucuggaaaacaaaagaaaauuguaaagcagauaaaaguacuaacaaaccaaccauacugagaucuuagagaaguugccauucuaacaucuugugguugguauucaaugcauagguauuuuucucaucaucucaucagcuucaaagcaaaacauggaccccagcuuucuuuaggaagccgauaugaaaacuauacuucauaauauugcuucucggacuuuuggcuaagaugaagugaaaacuguacuuaauguaaaaaugacaaguucaugcauuaugcauuagaaugagaguuucuugacuauaauauacuuuucaaaauaaucaugagggaacauauguggcaaagcagaggaauguggguacaucuggaaagccuuuaagacaucucggaagcacaacacaaaaucacgaaaauuguaaacaccuuccguguggccagcugcaguggcaacauugaccaguccaagagcagacaaacaucucagugacccagaguuuaccgggugaaauaaccauaaagagaaauucagguguuuaaaaaucugaccuuauuaaucaauauuaugcagaaaucagugagaaagacaagaaugggcaauaaucuuaaaaccugaaacguaaagauguguuauuuauuauucuagaugaaaggguaguaaagcuauugccuugcuuuugcuuguguuauugugaggcuucaaggaggaaugcaggaugaugcagugccucaucuuggaaucaacauagcagcaaaucgaagaauccuacgcugauauucuucccagucccuuccccacaguuagacgucaaaccaacaaauaucaucgacuaccuuuuucugaauccacaugagaugcuauuuagaaaugccaaagaauaggggcuauugccauccccaguaugacauucuggaucacuaagaaugguuaaagaaaugggagaaauuuucacuuaaaauuuuaauuagucaacucauccccuuuucuucuccaccucucacagcugccuacuagacuuaaagcuccacgagggcugggacuaugcuuguaucauuuauuaaagcuccaugagggcugggacuaugcuuguaucauuuauugcugccuucuuaguacuuguacauauuuugacacucaccgaguauuuuugauugaauaacuguuagcccguuuuucuuaaaucuaaguaaagauguuuaaaguggcuuuuuugaucuagguggucuugagcagcagcaccuuaaaaugagugagcugggcaggaguucauaaugcuuagacauugcucaauuuucacagacuaucaacacacauccaaagcugguugaugacaaguggucaaagacauugcauagacaucagaauagaauuuaacacuuuucaguugccugagggcaaggaaagaacauguuucaagacucaauaaaagauaaaugauaaccuaaaaauucagguuuuuaggaguuggaaaaucuaaucaauauauguauuuaauaaguaccuauaauaugcaaaaucacuuuaaaaaguuacauuucauauugucccugugcaguugaaaacuuacgcuaguuuauugcaauguagauaauaugaacaaaauucuucaggauauuuuucuuuuucuuuuuuuuuuuuuuuuuugagauggagucuugcuguguugcugagauuggagugcaguggugcaaucucggcucacugcaaccucccgcuuccuggguucaaacaauucuccugccucagccucccgaguagcugggauuauaagggccccgccaccacgcccggcuaauuuuuauauuuuuaguagagacggucuugccauguuggccaggcuggucucugacuccuggccucaagugauccgccugccucagccucccaaagugcugggauuacaggagugagcaaccacgccuggcccaggauuauuuuuaagacaucaauaaaacaugguuaugauaaguugagugagaagcacauuucuuugauucucuaagagacaugaauaggcuuccacucagaacuaauuguacuccucuguauaaaacuguaaucaguaauuuuaaauacugcaaaugucuuauuauauuuauugucaugcauuucuucagcaacuauaauugauuacugauauuuaagauguaucacauaauuauggacuauacaguauuuuuugugcuaauauuuauuuaugaaauccauuaguagaaaagauuuugccauauucuuuuagguaguucauaugugaaaauuuggugucugucaacaggcaacuaaauauuuacuacauugugaaugaugaaauuaaauagauuuuaugcugaaauuaacauuguaucuguuuuugucuuagguaaaaauuggcucaugaagacuuuuauuuaaggaguauugccaaagauaguuucuugaagcauguacauuuauuuuuacugaaaacugccuuuuucugguuuaaagcugcucuuugaaaauucauaaaauguuuauauuuuuaugguacuguacauuuguguguaucauuuauaaaaauucagaagaaucugacuucugcucuuuucuuuggaagacuaguuuaccccucugauauccugauauucaaaagaacuaaaaguauuagucaaauuaauacuguguuuagauguuggauaaccucuucauuuccuuacauaaaauacauguuuuauauaccugacacuagccaaagagacuuaaaaaauucaucguugccucauuuauguaaauacuucugaauaagugcaguacugauuaguagaacauuuaaugugugguuuguaguuggauuauaaauuauauuaucauaagugguauuaguauuaguaucacuugcuaacaaccaaaucaaauacuugaaauaugucagguaauguucuaagggcuuuuuacauuauguccuuacaaaaacccuuugguggauaaaaacuaugauuucuguuuuucagaugaggacccugagauguaaagagguuagguucaugcaucuaauaaaugaugugauuaggauucaaacccaagcugugugacuccagaguccuugcucuuaaccauuacauuguucugccuggagcauuuuaaugaugagguugagugggaaagaaacugaaggcuaauuugagaaguuuguugaccucguauugaucacaacaauuuguuguaccuuuuguuacacaacauagcauugguuuaaauuaaaauuucuuuuauucugaaaaugugaccacaugcuuuucacauugacaguauggccagcuuuuuuuuuuuuuuuuuugcauaaauucuauggcucucucccucuguaaauaauaaagauugcgaaagagguuauuuuuucauuaacgcaugcauuaaguauagauguaaucuauacauuuuuuucuucagagauguauaaggacaaauaaucauacaugguaaaaacuuugugacuuugcuugugauuaaacaugaaaauuaaauauuuaaaauacagcauucugaggaaagcugagcuuauacuuguuuuagcuuuaugauaaaacaguaacaucuauuccugacauacaugugaggaugcucccaccgucuuccuuaugcagugauuagcuuugaagacuauguuacaacaaguuugagugagcauugguaucuuaaaaagcuagcaccuguaucggaaaauuagaauuuuuguuuguuaugcaacucuugauaauuagggucuuuuuuuuuuuuuuuugcauuuuuucuuagguaagaagcauauuuuuaaaauggugauuguguuguuucuaauuaaauucuaaaugaacuaaaugaauuucaaaugaauuuuaugggauuugugaaaaauagugcuaugguuuuauagauuucuuuucaauuggauuguaucuauauuuguuuaguuacaucucagugaaucuacccgauuguguuuuuagcauaguccaugacaguugaagguagagaugaguauuucugcaguauucucaaccaguacccagcucacuucacaucuuucuaccuuucaugaaguuagaauuagaacuagguucuggaacacaauguagccuuaaaaagguaucagauauucaucaacaugaucuauuugugaggucacaaggcugaauuauuucugaagaucuuuuccauuugcaugucugaacaaaucuagauauuccuuaguuauucuagaugaaagacuauuugcacauuuuaaucaaucacuguuuaguccagagauguacacuucuagcuucugccuuggcgcuuacgacuucagcuuuuacacuuacgacuuaagcuuuuaaaaaaucaaaaugugauucucaguagaguguugaugaauaaugaaauaaaauguuuauauauggacuaauuuagguugaagauuauuaaguaaaaauacaguuuguuguuaucaggugaaugguaggaagugaacacugucaacuuuuuggugagcucugguuugagaguauauaauucaugauaaagaugauuuauuugaauauccuauccagaucuuuuagguggaaagugagcaugagucuaaacucauaccaggucccaucucagguuguuauuaaagacuaagccuggccgggcgcaguggcucacgccuguaaucccaccacuuugggaugccaaggcagguggaucaugaggucaagggaucgagaccauccuggccaacauggugaaacccugucucuacuaaaaauacaaaaaaugggugggugugguggugcgcaccuguaaucccagcuacucgggaggcugaggcaggagaaucgcuugaaccugggaggcagagguugcagugagccaagauugcaccacuacacuccagccuggugacagagcaagacugugucucaaaaaaaaaaaaaaaauagacuaagccugagguccaaaauaaugcaguauuuuuacucagcuguggaaauucaggauguuuucuauggucaaaauuuacucaaaaucauugagaucguuuguuuuaacuacagggaauaaguuauuaagugaaguaagaaagguggcaaagguccagaaucugaaguuauuaggacuaaguaaaaccaugaauucuagcaaacaguuucuuccacccucauaauuuacaaguaggauucucuaccauuuacaguaguaauguggauuuuccucuuugcauucagaaggugcuaacugaaucuguacauguccuaugccaagaacucaaugaguaaguaguaguuuuuagcucuguuagcaagccauuggucauaguguuuaggagcuguauuuccuaggacugcugucacaaauuaauaaaaaguggguggcauaaaacaacagaaauuuauucugccacaauucuggaggccagaaguuagaaaucaaggugucagcagguucacacucacugagaaggcuccaggggagaacccacuuguugucucuucuugcuucugguggcucuaggugcuccuuggcuuuuggcccauaguuccaaucuuugcuucuguggccacguucccccuuccuuuucucuguguguucaguuuacucuuaaaaggacauuuguaauuggauuuagggcuuaccuagauaauucuccaggggaaaaguccaucuucucagaauccuuaauuguuaaucacauguguugccauauaaaguaauagucauucuuuuuuaccauaagguaauauucacagguuccugggauuagggugcguacaucauucgaggguccaccacucaccucacuaccagaagccaguauaccagaauccuugcugggaaauguauuuguuuugguauugauaacagcauacuucaacauagguauagcuuccagcaaaagagugugagaaagaaguggaagcacccaugaagauuauauauauauauauauauauauauauauauauauauauauauauauaguggaagagguuggguuggaagucuuaaccaguugugacugcagugcuugcugaagguuuaucuugacgauacauuuacuauuuggauguauauugguggguguccauugaacaaucucuuugggauacuugguacaucauaaaugcuucuuuuuugacaagacuuuccauuuuaaccagguuguguuuuaaauugguuaaaaccuaugggccauaaacauaaaaguaugaugcaauuuggguuugaugcaucauguguaaacuuagaugcaaauucuguguuuaaaauaaaagauugacuuuuagcaguccgucuuaaaaggauugguggcagggaguguacuuuguucuggguacuuagccucauaaaagcuaggacuuucuguccauauuuuagaacaaccugacaacacgugccuuaucugaacucacacugccucaacuucugagcuagagaugaaaguguucaguuccuuuucgaacagcuaggcaccugaaaucugguauaauacuggaauuaagcucuauuaaguugucuuuuuuuuuuuuuuugguccagccucuguaacaaauuaauaaugaaugcauucuaagcaucuucucagaaaguuaauucauauuauaggugaaaaaugacaagaaaauagauuuaguagucuuuauuggaaguuugagaucuacuucuggcuuaguaucacaguauaauuguugauuaaccaaaucaauuuaaaauuauuuaaaaaguuugugagaaauaauacuuuuuuaaggaagaagggaaauucuuuaaaauuuuucuucuaugugagugaguacaucacuaucuugguauacuguauuacguuugaaggaugcauaauacauuuauuuuuaaauagcuuuuuggcaaccagaaguccugcuauagaucauagaaaauauuuuaaaaguuuaaaaaucugcuuaauaaaaaagauacaagauuuauauaaugauguuuuuguguuuuucaucugaggauguacauagagggaaauuaugcuuagaaaugaaaauuugauuucuuuuaauuuuacauuucuugaauaaguguauucaguacuauuuuaaaagaagaagaaaugguguuauuccguguuuucuuuuguauuuuucaaauggaucugauucauuuuauuuuugguauaauuauuaaacuauugugauuuaccuuuacagaguuacagcauauuguaccaguauaaaucucuuauugcuguacaacaacauuugaagucuaaauaugucauuaauuggagaauuaauaccuaaugauuuugaauuuuauauaggaauaaaugaaauggaaaaauaaaauaagagcaauuaaggaauuauuuuauuuuucaacgugggaauuguguauuaggcauucuaguuuuauaaauugccuuauuaagucaugugcuuauuaauauuagggccgucuuuuuucaguaaaauaaagugaagagcaucacuuuuuuuucuuuuuucuuuaaauuucuuuuuugcccuuacauacuuauguggaggauacugaucuacguauccucuauuuauucauuuguuuaauaaaucaugauugagcauuaaguggugggcaccagcuugggcauguagaguauuaucaccucaaggaaaacaacugacaguauaugcugucacugauggaaauugagcuuuuaagcaaagauuaaauuugggaaaacagaucucucguuaugagcuugucagcuuuccaauguuuacuuuuuucaugagacugguauugauaacaaaugugauuguauaaugaaaugugucaacauuaggaagaucagcauagcacgauaagccaggguuuucuaugugaccaaugcauaauguuauaaaauuauagacaguguuaaagauucauucaaaguccaguauagaucaauggauuuucacauaauaguacagaaaguucauuguuaaaaguuucaaguucuacauugcaacuaaccuuuuagaaacuaacccuuguugaauucugguguaguaucaaagaaugauauccauaacuaucugaauauuuuucccuuuuucagcuucauaucucuuugagccagauuuuuucccccuaaauuuaaaccaaaacaacauacugcagcaggauguugaaggcaggaacagcuaagaaaauuaagcugucuucuauuaagccagacauuaaauagauuuguaaaaauggaaagcagugcuggucuuugcauuuuucuuucuuuaaagaaaauaguuauuuuuuauaaaaauauguuauuuguuauauguaauaaauuuauuuucaagugaaguaaaacauuuauaaaaucuauuuucaauuucgaauaaaguaaacauagauaaaaaucuacauaauuuguuggugcucuaaguaauauuuaaggauauaaagagauucuaagaaguuuaagaauugcugauucagaggaaugauuccacaucugaaauacauguuggggugagauugcccuuuauaguaaaagauuuggauuacauuuuaugguaagagacuggacuuuacaguaagcaguaaggagucacaggauauuuugagcagaaaagugauaaagugguacacacaagauuaaucuggaggugauagauacauuaggauggaaguggggaauguguagaguggggaaaaacaguauuaacagaagaguagauauaacguauuaaggguucaguugauugggcucaaucagagagacuugugauggcaguauugaccuaacugugauaaggaggggaaccuucagauguuggguuugaguuugggucacaagaagaagcugauuuguagggaaaauugaacuguuugcaauuuuuuuguacuucuuugccuaagcauuugagauuuaaucagcagguagaaauaaccaguagagaacugaaucaauaccagauagccuucuagcucuuguagcaucauggagcaccucuguugcuuaaaauuagaaguuguccuuuaguagguaagcaaauuguaauguaguugcuaaaaauguguauuuugguggcuaggugguaccuuauguuaaguucuaauaaaguauacauuuauugacuauuauguucuugacacuguaccauauauuaauaguuacuauguuuguguaugugugaguuugcguaucguugaaagcccuguuaacccauguucuuucguuuucuuaaguacagcauugcaaaaagguuauuuuucuaugaagaacaauaaaauguugcuuaaacaaguuacagucaagauuuauuaaugaaaauagacuuuuuucuuucuuuuuugaaaaaaaaaagacacaauuaguggaagagaaacaucuauuucuugccucucuuaugauaaauguuuuuaauggaaauucauugauacuguguggaugauuuaccaaggcuuuuuaaaacagcugaaaauaugcucuaacaaccaucugauaaaaugaaaaacugaacaaaauguguacucagaugauucucugaaggaauaauggugcaaaugaauuaucaaagugugaaaucauuaaaaacaaaacauguuuggguuuuuauugaaucuuaauuguaggcuuauguauuuucuuuuguaagcuaaguuaaaagaaaauugaguaacuaaauuuuuggaggccaguguuguaggacauauauuguaccauaauuuauuuuuugcauaaaagcugcuguucauuuuuuucagcauuaacaugcgugcuuuccucauguaggagaauauauaaaaaacuggaggccaagauacuuccuuuugaagacagauggcucauucauaggauauaaagagaaaccucaagauguggauuuaccuuauccccucaacaacuuuucaguggcaaguaaguuaauuauaauuguugauucaucuuguauuuauuuauuuuuaugauuuuaugugucagauaucuuaggcuauaugagaaaccugugaaaaaguuuggguuuauauuuaauagagaaauuuucagcuuugauagaauuucagucccuuagcauagagguuaucgauaacauuuggucuuauacaaugcaauagaguuuaauauuuuuauguagaacuugaaugugauaaauauaauuccccaaauacauacuucaaguuuuuguuuauaacauaaaaacaaggaccuuugaacuugguuguuagauuuagcaugauuauaagauguugugguacuuaaugcacuuuaaucaguuuccugucauaaucuuagcucuuuugauugugugaugagaaacaggugauuuauauuagaaaucaucuucuggggagauuuuauguucguaguuaaauuuuucuuccuuacaaauaucuaacaaaaauguuuaaaacuuacuuagaaauuuuguauuugcaugaacauagcacaaaauaaacugaaagaugacaaugaugauaaugacaaugauuauuauuguuauguuauuaccaggcucuuccaacucuucaaauauauugauuaaucaauuagagaaucuuuguguuaauuuagaaguaaaguguuuuaaauuacgcuaaguuaaacuugccuaagaucuagcucgucuguauuauuaagcuaaaaucuuuaacgagacaauauccuuaauuuugauuuugguuauauguuaucuauuagccauauuugggaaaaaaagauacaagggaaauuugaagcuaaaaaaugcaauaauauaacaaaaaauucaagaaaauaagucuuugaauguuacaaauuucauuuuaccauuauaaaagccgugaucuuuuuuuacuccuauuguuuaauucagguuagcccuuauuaguggguuagaauggcuacuguauuuuuuuuaagaaaaagauaaaacaauaaaccaaaggguuaaaagauuugugaagucauuugaacgauauggauacuaacuuaaaaaaaaaagcuuucucuguuuauauuaguggauucuuaauauagauauuuuuuaaaugagaucacuaugaaguguguguguuaguuaaggaaaacaucuuuuuucccaccaaaaugcucauuagauaauaaugguuuucuuucaauagaaaauuauuuuuuaaacccuauugucaacugaaauaauauauuguauuuuguauugacuuaagaacagauuuucauuuuaaagacuuuuugagugaacauuugcuuuaaagugauagaaauuagcuuuuagaacauaagcagcauacauuaucuaaaugcccuaccuaaagccaguguagcuuuuuaguuuauccauuuuaccagcaaauguuauugguuuuucugaaauaauuuauaaaaguacagaauucuuguaucugcugaucaaaaugcagcauuuuuugaccuuaugaaauuucacaccccaacgaguuuuaaagacauacuguaugucacagucugccaacaucugcuccaacacuuccacuggcagaggcugaaauaaaugcugcacucuuggggaaggauccuauuuagugacugacagucagcuuauuuauccaugaaauaaauacuaucugacaucuguaaucuuguauaaucaaguagcuguagguaguugacucaaacuaacaaguaaguuguagguuggcuccuuaguuuuaaaaaguauuaguaacauggaucuuacucuaaauaaauuuuuagaaauugauuauuacuaaagcuugacuuaccgcaaucuucaauucuguaauaacaguuaugugaggaaagaaugagucuacugaaauggauacuagcugaagaaguaguucaaauuccaaccuggccgcaagcugcaaguaauaggaccuugggcagauuauucucugaaacucugaucuuuauguaguuucuucaucagcauguuagaaacauuuggauucaguggauuuguaaggcccuuuuugucccugacauucugugauucugugggguggacuuugagcagguccuugaagagugaguaggaguuaagcaaauuaaaacagagaagaagaauauuccaggcagagggcaaugaagaaugucuuuaugaggaauuaaggaaggaacaauuggugcaagagaggguuacuucaccauugcuuuuuccuuugcccuagcccccuuuaguacauuuuuaaaaagauaauuuuacaagguauuucuaagguauguugggaaauguuauauauauauauauauauauauauauauauauauauauauauauauauaucaaauuguagcuaccaaagggauauauauaucccucauuuuucugauaauuaaagauauuacuucauauuuaaucaauauggguuuuaaugaaauuuuaccaaaauaggcuuuuuauuuauaugaaaagaacagaguaugagaacuguaaagggguuugagaacuuccaaucuuaauuaaauuuugaauugcuucccuccugauuuaaauuuuucaaaaagauaguguuauacucauuguuuccacuucguaucccacugcagucuagcuuccucccuuacucacuugauugaaacuacuuauaauaaauuauugagugaccacuuaauugcuaauguaggggaaaagaaauaucuuuucuuaccauuucagguucauggcugaggcuccuauaacaaaaggaagauuaacaagagaaaaacacacaaauuuaaguaauaaaacuuuuaugugacaaugcagccuuuggaauugaagacccaaaaaaacacauaaauuuuuuuuuuuuuagacagucucacucugucccccgggcuggagugcaauggcaugaucuuggcucacugcaaccuccgccuuccggguucaagugauucuccugccucagccucccaaguagcugggaucauaggcgcacaccaccaugccuggcuaauuuuuguauuuuuuuuuuaguagagaugggguuucaccauguuggccaggcuggucucaaacucgugaccucaggugauccaccugccuuagccucccaaagugcuggaauuacaggcaugagccaccaugccuggccaaacuuguguauuuuuauguuuagggaugaugaagagguggauagucauaaggacuaagggcuuauaaugguaauaaacugaagggaacuuaguaaggcuuguuugucagauucuuuucucugucccugugucuucaggaauaaggauauuccuucccucuggguauaguaugggcaucucucauauggggaucuuaugaccuauuucaggggaaggucaaaaaauucuugcuaaguuuuaugaccugucucacgugagaaggaugagaggaagguaagaauggccuuccugcuuuugcuguuuucucaaaugcuaaggugcuaucuuuugggagaucaugucaugaacccugucaguaagucuaguagacaucuuucaguucuuauuuuuccuggauuuauaucugggcugcauuuuauacuguugaucaccaucuccuuuuugaccacucccacuguguucugggauauaccucuuuccuguuccccccuaccccuuaggcuaaugcacaguucugguauuuaacaggguucugguugaagacccuucacacuuuguacuuucucuugggcggacacguugacuuuugggguuucaguugcaaccuugugugcagcuuacucccacacuuaaaucucuaggcuaggccucucuccugagcauuagguuacucuguucaauuggcugcuggacaucucuaccuagauauuuuuugaccagguacguccuaagauaaacucaagauaauuuugucuauuucuuccuuuguacucaguaucugaguucugucucugccugaucaaaaacauggauccuuuccaugccuuuuuuuucuccuucacaucuuuaccccacucccaauccauuucuaguccugcugauucugcauauuucuugaaccuaugauccuuuucuauaaucaccccagaaugaggccucaucauaucugcuguagauucuuaacuagcuucucuguuucuaguuuguaccacucauacucuuucuucacgcggguaucaaaguggucuuucuaaaauuauaucauaacuaugccauuccccugugaaagcccugccuuggaucaucauugccuacuggauaaaguucagcuuucuuaauacaucauagaucucuucaaucuggccucuacuuucaacucuugcaggaucucucuucugcucuacaauuauguaucagcaauacugaacuguuuauaauucccuguacaaccuaugcugcuuuuccacucugaggcuuuguuuaugcuguucccuucgauuggaauguccuuugguccucuauuugccuggauacuuuucuaagacuuaauucagauuuuaauucccaucccuauuccuugcuaaauuaguccucucugcccuucuuaaaucuauuaucuucugcuguuaacacauuguuucuugguuaucuuguuccugugcaugucucauucacugaucaguaaguuauuuuaggggaaagagcuuagucuuauuuaucuuauaucuccuagugcuuguauuuuaugacuuaacuuuuuaagugaacaucugaaacaucuagucgagauuucucuuuuuuuaggugagaaaaaugaagccuuuagaaauucagugaucuuuuuaagguugccuuacuagguaguaguaguuaaguaucaagaauaaaacucaagugucucgacuaucacauaaauauuacuccccucccccaccccuauauuauaacauuuccccuagauuuauggugaugagaccugauuuggggccccauuuccagcacuuaaauuacuagguauccuuugacauggagaauggaaacuccacaaggccuguagaauguggauagcaauauuugacguucacccuucuuuggguggaucacauaagaacuauuaauauauaggugccaauguagugcuguagaaauguaaguaaaaauaagguuuuucaagcauaguacaucucuaaucacaauuaugguuugauggauuucuaaggauuguagauugagauauauacaagaaacaugcacuuuaaaaaauaauauaggauacauacauugucucagggcugcauuuuauuuuacuuugaguaaaacaguuugucuguccaggagucauggucuugcuaacauuuugacaauuuguaugaaccucucuugaguuuacuagcuugcucaguuccagagugggaguaguucccacauggaggacgugugcauuugccccuaugucuugggcuuauccuacuucugaucaauuccuucuuauucucuguggugggaugggagaagugccagccuguguccuaagaagccucuccuagaauucuaccuuauucuaugcugcaaauauugucccacccugacaauaugcuuuucuucucugaaaccuuucuucagucccuucuuaaaaaauagguuauuucugcauuuauaagcacaauuuuaaaagaugaaauauuuacucuuuuuuuucuuuuuucuuuaaguuuuuuguuuuuuaagacaagaucucacucugucacccaggcuggaguacaguggcacaauuacagcucucuguagccucaaucucccaagcuuaagugauccucccaccucagcauccugaguauuggggacuacagcugcaugccaccucaucuggccaguuuuuuguagagacaggguuucaccauuuuguucaggcuggucuugaacugggcucaucaagugauccacaccuuggccucccaaagugcuagaauuauaggcaugagcuacugugcaugaccaaaguauuuacucucuaaccgacuuuucucucucucuuugcaaguaagggaauuaugggacuuaaaccuacuaacaaacaucuuuaucucaucccagaugcuuggguggcuaagguggaaggaucguuugagaccggccugggcaacauagaaggacccugucucuuuaaaaaaaaaaaaaaaaaaaaaaucuuugaauaaauauuauauacagagauuuuaaauauguagaaaaaucaguugauuccuauuaauacuucuaguggacauacauggggauagagaaaaagcuuaugacuugauucuuagucuuguguaacagauaauacaaccuagaauaauaaccuuguaauucuagaaaaacuacagacuauguaaauauauacuauauaaauguacaugaauuaugagagaucauaauaauucaccuucgaaguguugauugaucauuauacccauaccugauagugaaaggaauauauaauaaaauuuuuauauguaagaauuugucauugacuauggaagacauucacauagaacauauagcagugggaggaaaaauaggauuaauugccaaaaugaauucuguagaaaguagcugcuguagaaguugagagaagcaauagguaaguguuggcgagguugacugagaauuuacucaggagaugggguuaacaugagcccugaagaagaggauuugauuauguuuuuguaagacagaggacagucucagguuaacaacauaagcaaacaaaugaaggcaaguauuaaggaguagcuuguuuugugaaugguauaggcaauauccuagauggauggagaauuuaugcuggaggaaaaaaaaaagcucagauuagagaguuaguaaucagauuauggaaagucuuaaauaucaaugugaugaaauuuuugaacauccgguuuccaaaucaguauucaauuuuuuuaaaaggauguaccugguuauagugugcaguggaggggauacauccuuaaacaaacaggcugcgagucagucagcaagauacaguuuaguccucauccuuuucagucuuacugcuaccauccuagcucagugcuucaucacuuccuuucuggauuauguuaagucuccugaucaaguucuuaccuucaaauauuaucuuuucuggaauauuuggaaacaaugcauaaaauagauucaucuccaaaaaaaguuccuuugcaaauaccguucuccuugcuuagaaaaauuucagauguucuccauuuuugacaaggaaaagcugaauuauuuuuuaauauauauccacaauuaaacacuugcccaaauaauaacuguguuuauagccuauaucuuuucauucuuuuuuuucuguuacucuuuaauguucuauacauuuucuuuuugacauacauugcuauauucuggucagguuuaauuacauacaaaauuccuaacccuguguuuguuuuuaaugauuuuuagaucauuuaaucauuuuaucacuugaagauuuggugcuuucuuuuuuuucuugauuuacuuuauuuaaaaaacauuuuuaauugauacauauuagauguacauauuuucggguacaugugauuauuugauacauucauauaaugaaaucaagguaauugauaaauccaucaccuuagauacuuguuuuuuucuuuaugcuaucaaauuuuuagacaaauggaaaguuauaucuguuaacagguguaucccacuguaaggaauagcugccuuaucuuaagaagugaauuaccguaaauuuaaucaaauuuugcuucucgcuucuauuuucauagguaguguuauguucagauauuugcagaauuuaaccuuaaaccaaguuuagaauugggaauggagaaaaccuuuguaaaaauuauuuuaaaaugagaucauuuuuaagaaaacuauaauguaacaaugucacauauuuccuucuucaggcuccaauucaaaucauacuccaauuugaaaagaacaaaaauuccacaaaacguucauucuuuccuacuuuuuccuuacguuguacaacaaauguggaaagaaaaaaaaaacagaaaaaguguaucccaucuuaaugaaaaugacugcggcagucaagaguuucaaauccagcugccaggggugaaagcaacccucugcaucucugaaagauuucaucaguguuaucuccuuuauaaucauaacuuuucauguguaucaucugaguuucuuauuaaauaaucucacuauuuuaauaguuccuucauuauaacacuacaggugaucugaucagauuucuguuuuagagccugcuuccucuucuuuaguagcuuccacgaucucccagccuuuuccugauuuguauucccaagccaaucauuuuaguuacagucuuuacuuucugagccucuuuuaucagaauauaaggaaugggggggcuuauuuagaaucaaagggaaugguaaacuuguagaagacagugaccaugcauacucauuuuaaaaaugucccacagcauuuauuacaauaucugguauacuggaacaucauuggacuuguagucagaagaccugacuuugggacuagguucuacugcuuuacuagcuaugugaucuugggcaaaucacauaacuucucugauuuucauuuugcucaucuuugaacaauggagcuaaugauaccuucuucacaggcuuacagugaggaucaagugagaucauauagccgagugguguggcucacgccuguaaucccagaacuuugggaggcugagguggguggaucacuugaggucaggaauuugagagcagccuggccaacaugaugaaacccccaucucuacuaaaaauacaaagauuagcugggcuugguggggcacaccuauagucccagcuacugggcugaagcaggagaauugcuugaacccgggagguggaaguugcagugagccaagaccaugccacuguacucaagccuuggcgacagagcaagacuuugucucaaaaaaaaaaaaaaaaaaaaaaaaaaaaaaaaaauauauauauauauauauauaugaaaacaauuuguauguuguaaaaugcuauccaaauaguauuaacguaagauagaagguacuuaguaauguuugcugaauuaacuggcaaucauuccuccuuuagcuaaauuacauuggagugaggaggaaaccacuuuacugagcuuucuuuaaagagucuuaaagguuuuagagaacuugcuuacaacagucuguugcaguugaggccaaauacuauuguuugguuggaggaaaauuucuaguuucauuucaugccuaggacuuugauuagucagggcuauucuuucuuaaugacuaaacagagugagguacauucccaaacccugcuuauggccuccuucuggccaaaaaagaagacaucacuauggcuaaagaaguaacaccuaauucugugaagaaagucaaugguagcuugauggggauagcauugaaccuauaaauuacuuugggcaguauggccauuuucacgauauugauccuuucuauccaugagcauggaauguuuuuccauuuguuuguguccucucuuauuuccuugagcagugguuuguagccuuccgugaagagguccuucacaucccuuguaaguuguauuccuagguauuuuguucucuuuguagcaauugugaauaggaguucacucaugauuuggcucucuguuugucuguuauuguuguauaggaaugcuugugauuuuugcacauugauuuuguauccugagacuuuacugaaguugcuuaucagcuuaaggagauuggggcugagaagaagggguuuucuaaauauacaaucauggcaucugcaaacagagauaauuugacuuccucucuuccuauuugaauccccuuuauuucuuuaucuugccugauuucccuagccagaacuuccaauacuauguugaauaggaguggugagagagggcauccuugucuugugcugguuuucaaagggaaugccaagaaagagcccauauagccaaaacaauccuaagccaaaagaacaaagcuggaggcaucacgcuaccugacuucauacuauacuacaaggcuacaguaacaaaaacagcgugcuacugguaccaaaacagacauguagaccaauggaacacaacagaggccucagaaauaacaccacacaucuacagucaucugaucuuugacaaaccugacaaaaacaagcaauggggaaaggauucucuuauuuaauaaaugguguugggaaaacuggcuagccauaugcagaaaacugaaacuggaccccuuccuuacacuuuaugcacaaauuaacucaagauggauuaaagacuuaaaugugagaccaaaaaccauaaaaacccuaaaacuguaaaaccauaaaaacccuggaagaaaaccuaggcaauaauauucaggacauagguaugggcaaagacuucaugucuaaaacaccaaaagcaauggcaacaaaagccaaaauugacaaacgggauuuaauuaaacuaaagagauucugcacagcaaaagaaacuaucauuagagugaacaggcagccuacagaaugggagaaaauuuucgcaaucuauccaccugucaaagggcuaauauccagaaucuacaaggaacuuaaacaaaucuacaggaaaaaaguaccccaucaaaaagugggcaaaggauaugaacaaacacuaugcaaaagaagacauuuauguggccaaccaacauaugaaaaaaagcucaucaucacuggucauuagagaaaugcaaaucaaaacacaaugagauaccaucccacgccaguuagaauggugaucauuaaaaagucaggaaacaacagaugcugaagaggauguggagaaauaggaaugcuuuuacacuauuggugggaguguaaauuaguucaaccguuguggaagacaguguggcgauuccucaaggaucuagaacuagaaauaccauuugacccagcaauuccauuacuggguauacacccaaaggauuauaaaucauuuugcuauaaagacacaugcacacguauguuuauugcagcccuauucacaauagcaaagacuuggaaccaacccaaaugaccaucagugauagacuggaugaagaaaauguggcacauacauaccauggaauacuaugcagccauaagaaaggaugaguucauguccuuugcagggacauggaugaaucuggaaaccaucauucugagcaaacucucacaggaacagauaaccaaacaccgcauguucucauucauaagugggaguugaacagugagaacacagggacacagggaggggaacaucacacaccggggcauguugagagauugggggcuaggggagggauagcauuaggagaaauaccuaauguagaugacagguugaugggugcagcaaaccaccauggcacguguauaccuauguaacaaaccugcacguucugcacauguaccccagaacuuaaaaguauaauaaaaaaaaguaaaaaacauuuauacaaaaaaaaguauucaauuaacauauauugauugcuaaaaaaaaaauaaauaagaucuaacaccauuggaucagagacaagaguuugggugagggcaaggggaacgggguauagaccaaauucuucaaacccugggcuuuggaagacaaagcugcugcaggcugagaaagaccugugugacuguuguuauucccuuuuuagucagaaguuguuuuuucuuaaaguaauaaaauccuucaguauuuuucugacugguugaagaggauccuauccauuggaggaaaaauuaaagguacuuugcuuccuagauuacugcuuuauugagagguggaggaugcaauggggauuguuuuuaaaggaaggcaggcaaguaguuaucagcuucaauaguuuauacugaggacauagaagagauuccagcaugaccaccuuccuuuauuccuuucuuuuucccucuuuccuuuccucuguaucugccuuccccccuuucugucucacucaacuuuuucgaaggucagcaaucaacuauuacuuguugauaggugcuuaaguaagggaauacccuacauauaauuaguaucacucaauuauuuuuaaauacuuaggacuccuuccuugauuuucuuuucuagccaucucaaauaacaaccauuugcaccuacuguguuuugaaguuuucuaccuuguguguauguguuugacuuaaaguaacacaauuuggaaacauaggagucaucaaaauuaauauuuaaauauauuuuuuaggaagucuaaauuguaaugaauauuuaggaaguuuuuauugaggguuauuauguucucaacauuguaccagguacugaggggaaaaaagaaggaaauaaggaaaccaaccuuucuuugagcguuacuauguaucaagcccuuucacauauguuuucucauuuuaucuucacaacaacacugugagguaaguauuaugcuccccauuuuaaaggaacucagagugguuauaugacuugcuuaggccacuguuuggcaaauggcagagcccacagcaugaacccaugucuaacagagugaaccuagaguuuuguguucauuuucuuauuccacagauacaagaucuagcccuuggcuuuaaagaauuuauagucuaguagcaaaaauaugccacagacccuugggauugguauuuugagauguuuuauggcuaaguuuugaagggaguuuugcaauuaauacaugcaguuacaauuuaggaaaaagagguaucauuaaagacagaaucaucaagaaaagcuucuuuggacauugagauuguuuggagaaauaguaagauuucaaaagauaaaguuacuuuccagguaacaagaauagcauuaauuugaaaaauuauuucugagaaacuuuggcugaauuucuuuucaucuugucaaaguaaguggguaugaaaucuucagaaaugaaugaaagcuccagaugguauguuauguccuuaucccuguauagagugaaaaauaucaaaugaggaaaaagaauaaaugauaggaauaaauauggcguuugaaauacuuagcagaaugcccuaaucaugucagacauuguuuucucagggccacaguuaggcacuagcuacccuguuuguuagcuuaccucguguuuuauuuguaguuucuguaguaacauugcuguucaucuuuucuccugguagaauauaaaauaauuuuacugacaaauaaauacuccauuuuaaaauccuaccuacagaguuuuuaaaauuuaagcuaaaaagguuauaaacuguagcuuggaaggugguacauuaucucuuuauauauuuauuuuuuaaaaauuugccuucuuguauguagggaaguuggaguauuguggaugggaaguggagggugggguaggaggaucaccaccugcagccugcgugugauaaggcaacuguaguguauuuacuguauaauuuuuuuaugaccuuauuaaacguauagauuauuuugguuaaguugaauguagauaacuauuugauuuacuuguugaauuuuuuuuuuagugugucauuuuaaacuuaaauuuauaguuucuagaaagaggauugugcguaacuaguuuuugaaauuguaauuagaaagaugauuguuugcccauuauauuugguguuuuaaucucauuuuauaauuaauacaucggaaauuaggagggcaauuaaggaaguaaaggaagaaaauuaacauuuuuaaagagccugcuuuuuacaagguguuuuauuuguguaauugcauuuugucaucacaugaaaaacaugaaauaaauauuauuacuuaaaggaaaaaaaacuagauaaugaaucugagaccuagagagacugaaaaacuugcccagaaccucaaagcaaguacguggcagaacugugauuugaacucuaacaccugguuugaaugcauuuaaucauauaugguguucagagaugacagcucucuucaaguaauacgucgucagcacccauagaacuuucgugcuaugccacguaucacccaguggguuaauaguggacucucauuguugucaggaguuguauuauauauaauagcgagacuucuuucugcuagagcaaaggaacaaauauagaugucguagauggguggcugauaaauuugauagaguuuuauuauguaauguugagccagucgcuuaaccauacugggacucagaauuuugucaucuguagagugagggaguuagagugaaggaucucuaaaguccuuucuucuaauucuaaauucagugguuugccuaucagcagcagauaauuauuucuugaaauauugaguauauuguggaguaguauaguaauaaauuaccacuuguugaguaccuucugccucguauuuuacauacauauauauauguacauacauacacauauauguguguguuaguaagauauauuuaauguuacuaacaucuuuggaggacaaacagucuauuuuauagcuggagaaacuagguucauggaauuucccaguggcaaggaauucuuucagagauggagcugggagauaaaccugcagcuuucaaguuuccagaccagugcuuuuuccauauuccuacuuaacuaauggaucucugacuaccuuacaguagggccuugaggugagagguuuuccagugugggcaauucagaagauauggguuuuccaugccucuagacuagucugucugucuguaucauggaucagaucuugucauucuugacuaauacaugaagauguauuugagaacuuuuggauaauuccauuuagggaaacagcagcuuaauguagaugauucacuaguaugugaagauuucagcauugcuuuuccaacuaagucauagaagccauaggggagacacugauuuuuuuuagaggcagaaucaucugaauauuugcaguaaguuauauaaucauugcauuuuuaacaaguugaacuugagggacauguuuuguugcuuccucugaguugauacaugcuaaauuauuggcuuucugauuuuuucaccccuauaucuuuauuuuaauuuaaaagcguuuauuauacuuugaguaaaguuaaaugaggccuaaggccacauugggaggaagaaccuuuaagccuuggaauuuaggaaagauacagaggcguucuuuuggguuggaaauaauacauaaucaagcagaugcuaaugaaaaaaugaaaugcaggggaagagaaaagagacuagggugccuguuuggaaguuuuauagaggagaguacauugccccuuuauuacaauaauguuucugaacuauaauaaggucuuucauugcaaguucagcuuuuuucauucauuuguuuugugcucugcuuccucuguuacuaauugucagcacaauagucuuccaacuaugaagucucaguguccuuuuggaccaauuugucauugucuuucucccucaccccccaacccaugcacucagaaucuauuacuaugguugcauuuuuagacauuuuuaauguuuuaaaauggcacugcuuuugaaaccugccagaauaguucaugauaacugaaucauccaaccagcaacaguuauugcuuccaaaagcacacugauaaaguuucugucucuauaggguguucuuauaagauaauuaaaaauaaacauguaauaaucuuuacagcacuauuucauaugcauuguuuccuuugaacuucacguuaguccuguguaacauuuuguuaaaauauuuuuguuaaacaguauuauuuacagauuuacuguuugccucauaaauuguuugauauuucuaugccucuaggaaguuccaucucucuucuuuaccuauugaugggucuuuauuuuuauagacagauuauuuuauuaugacuaaggaaucagcaaaguuggcuuagacugacaagccugaauaaauucugauauuagacuccaggcaacuuuaguuacauguuaauucauguuagguuuuuaacauuuuggccaaugaacacuuuaaauguguucucagccuuguuccaauaaucugauacugacagaaagacauuauuuaaauauaacuucuauaaagaaguccugaagcaguguaauauuacuugacaacuuaucugucacuuacagaacuuugucuuaugugaucagagcuuguuggugcuuuuacauauaaugucaaugaagauggcaguuauuuuuaaugcaugaauacuaaauaaaagauuggucaguuuucucugggagaaaacauauuucaguucucuaucaccuguuuguaucaauuuauucacauaaaacuagaaagugaaauacaguugacccuugagcaaugcaaaguuuaggggcuucaacccuuguguagucaaacauccuuguucuaacuuuugacucccccaaacuuagcuaccaauauccuacuguugcccagaagcuuuaccaauaaacaguuaauugauacauauuuuguguauuacaugcacuauauacuguauucuuauaauguaagcaagagaaaauguuauuaagaaaaucauaaggaagagaaaauauauuugcuauucauuaaguggaaguggaucauaaaggucuucauccucauugucuucuuguugaguaggcugaggaggaggagaaagagaaggcguuagucuuucugucucggguggcagagaugaagagauguggagcggguggaaggagaaggcaggagagauaggcacauuugguguacuauuauugaaaaaaauccauguauaaguggaauugugccguucagaccuguauuuuccaagaguugacuguguauaaacguuauuagaaagaaagaaaacuuuacuuccuuucauaaacaaccaacauccauccuaaaaacaguaugugauacaaaaagagacaugaauuuagagcuagaaaaccuggauuugagacucaguuuuaccacauuaauggcuugaugauuuugaauaagugauuuagacauuaaauagcuuccuuuuuaaaaaauuugugaacuggaaaugaccauacuuuagaacucagcugagaggauuaagugaggaauaauguaugugaaaucuuaauguagugaaucaacugauaauaugcuaagauaauuacuuaguaguuacuauuuaaaaaauaaauuuuggagaaagauauaauagaaagcaaaauuuuccuacugauuuaaauuggcagagauuuaagaugagauuuuccccccauucuucuagagaucagugaaggagcugauucuuuuacuuuacuucauauagcuugcuaucuaucaaaccagauuuuaaaaugaaguguuuuuauuguuuuuguuguuguuguuguugcuguaguaaauacccaagaggccuuuuuaugucugugguuggaaccaucuuucaaagccaggcuaacuuauuuggaguuagaauuccugaaggcaaagaaaacacaucuauaccuuccccuuaaaguuuaaagaaguuagagagugcuuuccaaagaggugguauucugauaaugacugauaggcuaucucuauauuugacuuuuuuuguuuguuugagacaagagucuugcucuguugcccaggcuggaguggaauggcgcgaucucggcucacugcaaccuccgccucccagauucaagcaauucuccugccucagccucccaagcagaugggauuacaggcacccgccaccacgcccagcuaauuuuuuguauuuuuaguagagaugggguuucuccauguuguccaggcuggucucgaacuccugaccucagguaauccacccgccucagucucccaaagugcugggauuacaggcaugagccaccgcaccuacccucuauaguugauuuuaauggaauuacuugauuuguuuauaauccuccacaauucauuguuuauuuggacagugcuuuacucuggauaaguagaccuaccuuuuuauuuuucuccaagggggaaaaauccuuuauucuuuacaucuacuccuuucaccuuuuccuguggaaaaaaaaauaucucaaguauuagagcuguugcuccaaaaucaaaaauaugauuaggauucaaaaauaucuauuuuuugaaaaguauguuuuuugaaaaauauauuuuuucauauauaugaaauauauaaauauacauuuuaugagaaaaaaauaaguugugagaaauuauauuguuucugaaauguuuccugaagcuuuuccuagaauucagucuguaugugcuuagauuuugaugaauagaaaagaacuaugagaaguauuccaaauucccugaaacuuaaggaguuccacucaaaacagucaaauaaaucacagcauaugaugaaguaccaccauaugggauacaaauaaguguaguagaucuucagggauagagaguaugaguuggaauaagagaagaucuugagugacuagaaucuaaguaaaaaggaagggaguaugugucaggugagagaaacagcaugaguuguuaaauccugaaguuaauaauaaucagauaauuuuuaggggacagugaagagacauguuuauuagcagaaaguacuuauaguuuggcagugaggaauacaguuugaaacuuuuuguuuuaauuaauggggcuuccuuaugaauagcuuugaaagucaggcuaagaaauguauuugaacauuguccugcagacaggaaaauauuuuugaagagaaugacauacaguuuaagaauuuggguaggacucaucuuacuaguaguauguaggacaacuuagggagaaggguagaaaagggagaccaccuaagaggucauuucagugaugaggauuuugauaguaaguucccggguugggugucagcaguggacaaaaaaaggaugauuccaagagucauaacgaacaaacuguuaacaugaauguugguggcuuagccaugagggcugaaagagaaggacgagccagagaugacugaggaaguguuucuugggugauuaggaagaugauauggaaauaaaauagaaaaacuguacugguauaguaauuuucaacuuggaagcugaaacaaacaaaaacaaaacccuuuuggauaucuugaggaugaggcaguauagggcaucaaaggagaugcuaguuuugccauauggggauggagcuugaugagaagggccgugacugaagaagcagguuugagagucaucagacaucaggugucagucgaugcagagcuacuggggagccuaucuauaauuaaauccaaaguccuuaccaacucauugaagaucuuucuaaccucaucuccuaccuuuuuuccuaacuuacuugacuccaauuacacugggcuucuugcuguuucacaaauccaucuguggaaucccuccagcugugagucugcacuuaauguucauucuguguaacuuacucuucccgaagguaaucugcauuggccucucauuucauuagagacacccuuuuaaauuaaucuuucgaaaauaguaucaccucccguucacuucaacucguugaccugccuuauuuuucuucauauuguuuauaagcaccuacuauguuauaaauuaauuguuuugcuuguuuauuguuugacuacucauccccucaguaaaauauaagcuuuauggaaaauaggcaccuuguuuuguucacugcuauucagugccuagguuacuggcugauauacuguggguaccuaacaaauauuguguaauuaaugucuagauuuacuaugggaaaaaaugucaaaaauaaaagcauaacagaaaggucugagccuuuggaagguaaaggucugagccucuacuuuggaaguagaggcccuaagaaaaacuaaugaaugguaugggaugguaguaaaaccaggcaagucagugucauggaggucaaggaaaagggacucaaaggauagggagccaagaacaucaaaugcugcaaagaaaugaaaaugagaacaaggaaaauauaucugauaaaaaggagacugcaguagagugguggaaaccagaauuuagcuaauugguuaaggcauggguaacaaaggccagccuuguagauuauuuugagugauuuaccagcaaaacgaaggagaggaauggggcaguuagcgggaagaggagcagcauuuaauacaagugcuuuaaagagugacuuugaggcuggauguaguggcucacgccuguaauccuagcacuuugggaaguggaggcgggcugaucaccugaggucaggaguuugagaccagccuggcuaacauggugaaaccccgucucuacuaaaaauacaaaaaauuagcugggcgugguaguaugcgccuguaaucccaguuacucaggaggcugaggcaggagaauggcgugagcccaggaggcagagguugcagugagccgagauugugccacugcacuccaucauggaugacaaagcaaggcuccaucucaaaaaaaaagugacuuugaaucugcaucuuggucuuuguauauguuuauuguuuauuucacugugguauguaugcacugauaagcuacuuugaagauacgugaguagaaauugucucauugguacagauggaaaucucgaggcauuuaaguuguaaguuacuucuaagugggaccuaugcaauugguacauauggacauaaagauggaaauaauagacacugcggacuccaaaaaggagaagggugggacaaggaccagaaaacuaccuauugaguacuauguucauuauuugggugaugaguucacuagaagcccauaucucagcuuuauacaauacacccauguaacaaaccugcacaucuacuucaugaauugaaaauuuuuuuaaaagcuguaucacaaucacaucuaauaaaacuaaucuuuaguauuaccaaguacaaauucauauucagauuucccacuuguugccuaaaacugguuuguuuagaccagaaugcauuaaggaggaccacgcauugcauuugguuuuuauaaaucuuuuaagucccuacuaguccagcagaguauuagacuaccuuccucaccccucuuuuggguacauucacuuauuaaagagacuacuucauuuguccugugaaaguucugucuuauggaauucucugaucguuucuacgaggugucauuuaacuuuuccucuaccucuguauuuacuguaaaaggaaguuagaucuaaggauuccaucagauucauauucagaauuuuuaucaagauuguuuccuucgugagucuguguacuucauauugcguuaugucaagagguaccuaguauuugguugaccagcucuuaguaaugcuaucauuguucacuggguuacgguggugacagugucaucucuucauuauaaacuaaguuucucucaugugguuaccagauaaucugugguuugacauguuggcacuaugcaauauuuagucuuaauuaguuauuuaccaaaugauuuuaccauuggugauuuuugccugaauuaauuauuuuauuagggguagauuaucuuuuagguauuuuuuaacaugauuucaauuagccaaggcacagauaaauuggggcaguauguuagucauucuguuuauuuauuugagaccagcccuguuuaggcauaguaccagaaaucaaauaguauggaccuuccccuaagggaauuuucaaucuaauguacauucuuguugaauuguuuaaaaauuuuguuaucaaaucccaguuucaucauguuucaaauauaaauagcuuuucuuaaaaauagaccgggcacaguggcucacgccuguaaucccagcacuuugguaggcugagguggguggaucacgaggucaagagaccgagaccauccugaccaacaugaugaaaccccaucccuacuaaaaauacaaaacuuagcugggccuaguggcgcacgccuguaguccucgcuacuccggaggcugaggcaggagaauugcuugaaacccgggaggcggagguugcagugagccgagaucgcgccacugcacuccagccuggugaaagagcaagacucugucuaaaaaaaaaaaaaaaaaaaaaaucucauaauuauuuuucagauuuuaccauguuauguaaugaaugguuaaauauccuguguacaucugaguaauuuacuucuguuucaugcauuaugacuauaaauaaacugcuuauucugguguaugaguacaauggaguuuuaugccacuauuaaauauaaugauguagaucuuuauuuacugaaauggaaaauauccaaaacauauaauaucaucaauaauggucucauuuuuguuucuaaaaagugcuuagaauaggucuaaaaauguauguauucaaacacuaauaaugguuauaacugaaugguaggauuaugaguauuuuuauuuugccuauacuuauguauguauuuuucuguauuaagcauggaugauuuauacagugaaaguaaaucaagaaauauguuugaaaaccaucuugcccacacaacaauuugaauucaguaaugucaccaaacuguauacuuaaaaugguuaaaaugguacauuucauguuauguauauuuuacuacauuuuuaaaaagcccauggcuauuauacugcaaaaaccaaaaucaaagccaaaaaaccaacaugccuaauuccuugaguccacuagauguuugcaugccucuuauaauucuuuuaguaaaugccuuaugucauuuuuauauuuuaacuauugucucaaaaugaccacaguacguuuauuuggaauuucaaguaggcagaaaguaugccaagaacaguuguuccagaagacucuugagguguauguuuguuuaauuagaggcaggauucggugggcaaacaagacagagaaauguugauggggaaaauauuggcucuguaagugugcuuuugguaaaugguaguaucuguagugaccauauucaaagaagaaaaauguguuaggagaaguucacauuaacauaucgugacuucaaauucaacucaaguucauaaauaguauuucauguuaauuccaaaguggugguuuaugauaauuaaaaugucacaauuuggaauguggaugaugaagugaaaaacaucuucuagagggaaauguaauguuaguaauccagucugacucccauuauuuauugaaccccuuguauuauggaaucaaauguaagaacuuugucuucucuccuauuugcuuauguggagagagauauguugaguuugggugauaaaacgcaaaugguucagacaaaaauaacuagcaaugcggagcuggauugaugugagucugcagaucacuuuuccauuauuaguaauugaacuuuuuuuaaucauuaacuucauugguauuggagaaugugagagccagcagugaaagaacccaaaggcucucuugccuuccuuucugcuauccuuaccacuuucuuucccuucagcuucucauucuaaaccgccucccguuacuccuaccuggagaaacgagaugucaaggaucagcauccugcuaggggauaacccucauuccuguccaucccuauacuguggagagaaccagaggcaaacacauuggagcccucucccgcucaaacacuguuaucaguugaaacuuauccuggauuugcuuauaugagaaaaagugucauagaugggagaagggccaagcacggggaagguguagagaagguauagaagagggaacagacauuccuauggcuuugacagaugauuacugauuuuuaaggcauuuuuccuagcaguguauucucuucagaagagcaugggauugggauugagauagacuuggaauaaauccuuauauaaugacucacaguuguguguuuuggggcaaguuauuuagcuugccugagucuuguaaauuugcucauuuagaaaauggaagauaauaacaccuuuuagguuuuuccuuuggauuaaaugaauaacauuuaugcaccacucuuugugcagugcuuggaacguagugaucacucaacaguuaucugcugcuggaaugcucucuaccaggacaccugccucaccuaagucaccuuccgcucauuggauuaaaugaaucucuuaaagguugauguauugagucuuaaauagguguuaugcuuuuuugccccuagugaaaacauuaaacaaaagauagaaaugcuuuuuguccccuucagagaaccuccaugguguaucauauuuuuaagaccugaaaaauaaauuugguuuauggucaucauaacucacagccagcauuauuucauuaugugauuuaauaaaaaauggaaucuggccggaugcaguggcucacgccuguaaucccagcgcuuugggaggccgaggugggcggaucaugaggucaggaaaucgagagaccauccuggcuaacacagugaaaccccgucucuacuaaaaauacaaaaaaauuagcuggauguggugguggccaccuguagucccagcuacucaggaggcugaggcaggagaauggcaugaacccgggagguggagcuugcaugagccgagauugcgccacugcacuccagccugggcaacagagcgagacuccgucucaaaaaaaaaaaaaaaaaaggaaucuauuauuaugccuucguuuuucacauuggauguuauuuuagaaagaauaaaauuaguguuuaaauggcuaaagagguugguugaaauuaaaccuuuaaacauuuuaaucuaaacagaugaucucuaaaaauuuuuuuuuugguguauguauuucuuggucugacauguugcagucucucuaauuggguuucagguuugcagaguaauuacagcuuuguacagacuuugucaucuguggcucagaaugguguaaaguaagcagaacauuuaaaauucagcuugugguucauguugcucaguagaguuuaacuaguguauaacuaucuaauauaaguaacaguguaacaaauaacacugagaaguagauguuauaauaagaguuagcuaccuggcauuuuguauaagcacauuuacuuuacugaugcauauuaaaugauucuaaaaaucguagauaaucauuugguuaauagcuuuuuagaaucucuauccaaaguuucuacuucugauuuuuaaaauuuaaauugcccuaccuugcguugggaaucuuuacguaaccaaaaggcaaauauucuucuaaagaaguauuggcuaauccauuuauuaaccaccauuuccuuuaagaaucauguguuucugauuccuuauugcgaacaugcaagaacucaaaaguuuuucuauuuacucgaucacugguuuuaacaugguaauuuagaguuuuaacuuuuuugaauuuggauucagcuuuuuaaauuacauuuguuuuguacagcaacaaaccauaagacauugugauauucucuugguagugauccaacuaccacuugaacaucuugguguagagaugaaauguguuuguagaguauuucauacugagaccuaaaaaauauagguuuauuucuauuauacuguuuauuuguaauuacacguaacauuauuuuuguuggacuagaggguucacaggaccugauuaaacccuuuauagcauaaaugaaauacuacuuuauaauuacauggguagaaugaucaguaguaugguguguaccaugagcucauagaguuuccuacucauuuuugugugcccagcauuuugcauagugcuuggcccauaacugacauuucauauaugucauuugguucaugaauacuuagcaaguuuaguaagaacagugaaguugugcauaacuacuuagucauuauguuacuauuuuaauauuuuuccaaaccacucuauacauaaauacagguauuuuauucuuuucuaagccauuccuuuucagugaucugcuugagaaugguaauuauaguaauaucuuuuauuguuuuuagcagccuuauaaauuauaguaauugauauuuggaaucuuauaacagcacuucgaguagcuucuaaaagucuaguguugagaaguucuuuaaauuauagcauuuaaacuucauuuagguauaguguugaaaauaugcuuuuaauucaugauagugcuuuuaaagaugauaaaccugagggcuuagauauaaaguacuuucaaaaggaucacacagcugauuguguuagagccuggauuugaauuucuuucugauugcagaguccauuaucuuaauuaccuuauaucaccauaaugggaaccugaaguaaaacugaaauagugaaccucagaccgggcauucuuucuuugcuucugugcuguauuucucuguaccccauaguauuucucuugggcacgccccucauuuaagugucuguccuccauucuuuacguuuaaagccagccaaucaguugcccaaucaggguauuuauuguauacuccuauguccugucacuguccuaggugcuauaagaagaacugugcacacaauuccuaacuuuuaaguaauauagcuagugaauuacuggcuggaaauuuaauagggcuuuugaaaagaaggauauggggaggaacaguuggcuucaaagagaaucagacugaugggcagagucagucauaggaauugguuggcucuuuauuaguauaaauuaguauaaugucuuugguauuuuaaaacuuaagucuuucaaaugaacaauauuuuugcuuauuuuuuguggaauauauauuuuguguuuuuuaacuuucauauuucaaaaaaugucaugcugcuauacaaaguugaauugugauauaauagauuuuaugaccuauugauucuaccaccuuuucauugucuugcacauccccagguucucacuuuccuccauacccauuuuaaguuucuuaguugaguaucauaaucacucccuugccuugcauucuuuauucuuuucugucuucuugcuuugacaaacuuacuugguuaaaguacagccuugcuuaaauucauuacucuauguuccucaccuguacacaugcagcugaauauaucuggguauaucugggagaaaauacacaaccaugaucucuguuauuaguuuaaauucuucauuauuaaauucagguugguccuucauccuucucggcagucaugguuggucuccuuagccuauuuguacuuugauuuucccagagugcuauuucauaucuuuuuuucuucaaagccugauggauccuuuugcaacguuauucccgaugacuuuauauccuaauucacugaaaaaaacagaagcagugagaaaauaauuucuaccagcuuuuacuugcuucuguacuccuaauugcauuugggcccuuauaucuucucuuuuauuuuauuacuaaacuauuuauacuccugauuagagcuaccccuuuacuuguccaguaaauuuaaucccuucuugcuuauauagguacauugcuuuagaaauuaucuuuugguagcaucaaaauuaccuucuuuguuggauuauuacuaucagaauucauuuggaaaauguuuauugaguaccuacuaugugucuggcauaguucuaagugcuaagaauauaugaauggagcuuacaaucuaguugaaaagacaauaagcaaaaaagauacuaaaaaacuucauaucaaauguuagaaaaugguaacaugcuauggaaaauaaaaaauagagcagguaagagaagauggagggagaguccuagguaaggggugcagauugcaguauuaaauaggaugucuaagagagcagcugugcgggugugugaggggggaaagaauguuaggcagagggcaaaaagcucuaaagcagaaagaguguagugcauuguugaggaaaugcagggaagccaggguggcuggcagagcagccugaaagagaguacuaaggaaguaggucagaaacuucaguggggucagugggagggucagaucacguaggacaccugcugaucacuuaaaggccuuacucaucuauucuuagugaacugaaacacugcagaacuuuuuugcagaucuucauuuuaagaagauuucuggcugcuguguugagaacagacugcagugaggggcagggaaaagcuauucuaaguuuuuuggaaucaucaggugagagacaaugauggcuuagucugagguaguggagguggugagaaguuaucagaagcugguuauguuuuuaaaguagaaacaccaagauuugcaggaggagugaaugugaugucagggaagagaggacuccaagggaauucuuggguuuucagcuugggcaauugaaaggauggaggugucaugugagauagaggaagccacaguagagguuggcagaagaaggagcaggguugagagaggucaagaguucacguucggacauguucagaugucucccagagcacaguuucugucuuuaacuuacauagucacucagcaucucuaaauaggaagaaucuugucuuagggcagccgggagguuuaggcauugggcacacagaaucugaaguagaauuauagcaguggaaaaccaguuacgaauggucucccacuuacaguaguucaugguaacgaugucuuacuuuaccgugcuccugacagcaguacacacucaauggagauuguauuucaaauuuuggauuuuugucuuuuccugggguagugauuugcugugugauacucccuagugaugcugggcagcagcagcaaaucacagcuugcagucagccacgugaucacaacaugcacaguagauacucuacaguguacuguguugccagcauuuuucuggaugcucuuaguuuuuguguuuucucaucucaucaugucgacaaaacacccaucuauguguaauauucaauacuuuacuacaaaacaggcuuuguguuggaugauuuuuguccaacucuaggcuaauggaaguguucugagcauguuucaaguagguuaggcuaaucuaugauguuggguagucuagguguauuaaaugcauuuuugccuuauaauauuucugacuuacgaugguuguauuggaauguaacacagucauaagucgaggagcaccuguaaugacaaauaguaccaguaucaaaaaggaagaucaguuuauguuucagccugggugauggaaaauuaugaaagccaggaggaggaaugaauuuuagggggaaaauacugaguuugguuuuaggggugguccaguaauucaaccagguagaaauauucacuauguguuuagacacgugugucuuaaaguagaacugcaaggugaaaaaaguuuggauuuugauauugguaaacugagagaugauugcugaaaacauguaaacuguuagaaaacuaagcagagacccuugggugaaugauuucucucaguguaaagggccaauaaagagcuaaucuggggcuggauacgguggaucaagcccguaaucccagcacuuugggaggccgaggcgggcggaucacuugaggucaggaguucgagaucagcuuggccaacauggugaaaccccaucucuacuaaaauuagaaaaauaagcugggcaugguggugcacgccuguaaucacagcaacuuggguggcugaggcaugacaaucacuugaacccagcaggcagagguuacggugagccgagaucgcgccacugcacuccagccugggugacagagcgagacugucucaaacaaacaaacaaacaaaaacacagcuaaucugaguaaagaauuggaacuauaaagagauagaaauggcaguugauaguugcuaaugauggagauaggacacagcagauaagcacugagaaaagacuugaaguuuucaacggagauaaauuaguuucuuccaaaagagcagagucagcagacaacccuacccuauuuuuucuugguguccaauaccauuuauccuuuaaagcccagcucagauguaugccaaauaauaguuaauguuuguugaaagcuuauaggucucauauuaugcuaauauuagaugaacuuauuauuaauuccuacaucaauucuaugauguagauacuguuucccacuuaacuguugaagacuagcgaguuuaauuaauuuguccaaguuuguguaguuaaugguacgaaaaaauaauugaaucuacgcacaccagugucagagaauccauacuuuaggcucauguuuguugacaucuuccuaguuauucaguaacagaauuuaaucauguuuagagugacuggcucuuggggcaguggauacuaagaguuacaggcaguuuauauugucaaaaagcuuauaaucuagguaaggauaagugauauuugucauuuucuuaaaaugauaaguaauacuguaagauagucuaugguaagugacacaugagggauaugguaauaaguaaagagaauagagaggaugaaauggucagucuagggcgagguguuauggaagguuucauggaaggaauaauauuugaucuggaccuucaaggaucaguacuauugugacugcaggugaugcauauggauagagguaaaauaagugaggaaaguauuucagauagcaagaacagcuggagcaaaggcauaaauaaaugaaagaguuaagauguguguuuggggaaaauuauauaguccaguugaggugguuaauguggccagaaugggugaaggauuggaaaggaagacuaaggucaggcuguaaauaaucuugaguggagaaccauagaaagcugugaguucgcacuggguuuuguuuaaaauagaacucuguaguucucaauuauuuacuucuuguuuuaaauauauccauauuuaaagaaacauuuuauuuuauucuuagaaugccaguuaaugaaaacagaacgaccaaagccaaacacauuuauaaucagaugucuccaguggacuacuguuauagagagaacauuucauguagauacuccagaggaaagguaagaaauucacuuguuuucauuuugugaaaaagcaacacucaaucuaaagauguauuuguaucugacuuuauuauuuguaaauauauauaaauauauuuuuuuaaaugcuauagucucuaaauucuugcuucuggcauaauacaugaauaacaguggcuuacaaaauaauauuuaauauaucagaaccucugggcaugcuagaagauauacuuucagagaaacagaacauuuaaagguuaaaauauaaauuuaaaaagacauuuuuggccuggcgcgguggcucacgccuguaaucccagcacucugggaggcugaggcagguggaucacaaggucaggagaucgagacuauccuggcugacaaggugaaacccugucgcuacuaaaaaaacacacacacaaaaaaucagccaggcgugguggcgggcgccuguagucccagcuacucaggaggcugaggcaggagaauggcaugaacccaggagguggagcuugcagugagccgagauugcgccacugcacuccagccugggcgacagagcgagacucugucucaaaaaaaaaaaaaaaaaaaaaaaaaaaaagacauuuuuauagccaaacuaccuuuuuuaaaaaauuguauaauugauuguauucauacuugaaauuccaaggcuagugauaguaaaagauuucaaguaacaugccauucuaaauuaguuguaaguggcugucuggagcacuaaguugcuaaggauucugagauugggucuaaggagcgggagagaggauuaauuagcauugacugucauuauuacuaaaguggguagugacaacacuguaguaaccaacucaucaacuucaucagguccacauuuuuauccuccugaucuaucaguuuuuacaaccacuucccaauucuauaucugcucacucugauacugaguuagguccagugaccacagucacaaaaccaccauccugcacauguuauuauauuugauccuaaucagcaacuuugugaaguuaaaucuuauuagccuuauuuuccaaaugaauacacaaaguuuuaacagucuugucuaaaauuuuaauaaaagcaaaaugguaaaguauuauuuuaauaacacuuuugaucaguagaguaaaugguaauguaugauugauuaagaaauauagaaaagaguuaagcacugauaauauuuucuuuugugcacuuccaaucuuacuaugugcagacguaauuaggccuuucauauagauacaguucuggguauggguccccgaacucuuacccugccugcacacccuccccucccugcacugccucccuccccgcacacccuccccuccccaccauugauccugggccuuuucucccuugauaauuaauacugagcuuucaauuuguugauauguccacccauaauccauaaucacuaaguugggcuaauuccuauguaucuuuucagaucugagcuuaaaauguuauuuuuccuacaaaaccucugacucuaauagacuaggcagguuccccugcuagguacuuagauauuuuucuuuguaccuuuucuaucaaucauauuauaacuguaauccuuguuugccauucucacuaaacuugaagauucuugacagcaaagaugauggcuuccuugcucauuuaaaacaucuuuugcacauaguccauggcccaacacaguauuuauugacuggcuggaugaaugguacuuuucccaugucaauauauauucuuugaaaauguuauucuuaguggauuuuuaacaucuguugaagcacaauucauuuugccauuuguguuuacaaagcuggauuucugucagaucuuaagacucuaaaauccucugcuguuccuguaauaauauacuacucuucugaacaaucaguuuucauuugcauuuauaacuauaagaaaaaacaguauuaauacaaaugaaaaacagcauacucauauuugccauugguaugugcauuucuauauaccucuagaaucugguguuuggacauucuauaugacuugauuuuuuuuucuaaauuuuuauuuuauuuuauuuauuauuauuauacuuuaaguuucaggguacaugugcacaaugugcagguuaguuacauauguauacaugugccaugcuggugcgcugcacccacuaacucgucaucuagcauuagauauaucucccaaugcuaucccuccccccuccccccaccccacaacaguccccagagugugauguuccccuuccuguguccauguguucucauuguucaguucccaccuaugagugagaauaugugguguuugguuuuuuguccuugcgauaguuuacugagaaugaugauuuccaauuucauccaugucccuacaaaggacaugaacucaucauuuuuuauggcugcauaguauuccaugguguauuuaugccacauuuucuucauccagucuaucauuguuggacauuuggguugguuccaagucuuugcuauugugaauagugccacaauaaacauacaugugcaugugucuuuauagcagcaugauuuauaguccuuuggguauauacccaguuaugggauggcugggucaaaugguauuucuaguucuaggucccugaggaauggccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcucuuugucagaugaguagguugugaaaauuuucucccauuuuguagguugccuguucacucugaugguaguuucuuuugcugugcagaagcucuuuaguuuaauuagaucccauuugucaauuuuggcuuuuguugccauugcuuuuuguguuuuagacaugaaguccuugcccuugccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcgucauuucugagggcccuguucuguuccauugaucuauaucucuguuuugguaccaguaccaugcuguuuugguuacuguagccuuguaguguaguuugaagucagguagcaugaugccuccagcuuuguucuuuuggcuuaggauugacuuggcaaugcaggcucuuuuuugguuccauauguacuuuaaaguaguuuuuuccaauucugugaagaaagucauugguagcuugauggggauggcauugaaucuguaaauuaccuugggcaguauggccguuuucacgauauugauucuuccuacccaugagcauggaauguucuuccauuuguuuguauccucuuuuauuucuuugagcaguguuuuguaguucuccuugaagagguccuucacaucccuuguaaguuggauuccuagguauuuuauucucuuugaagcaguugugaaugggaguucacucaugauuuggcucucugucuguuguugguguauaagaaugcuugugauuucuguacauugauuuuguauccugagacuuugcugaaguugcuuaucagcuuaaggagauuuugggcugagacagugggguuuucuagauauacaaucaugucaucugcaaacagggacaauuugacuuccucuuuuccugauugaauacccuuuauuuccuucuucugccuaauugcccuggccacaacuuccaacacuauguugaacaggaguggugagagagggcaucccugucuugugccaguuuucaaagagaaugcuuccaguuuuugcccauucaguaugauauuggcuguggguuuguuauagauagcucuuauuauuuugagauacaucccaucaauaccuaauuuauugagaguuguuagcaugaaggguuguugaauuuugucaaaggccuuuucugcaucuauugagauaaucaugugguuuuuuucuuugguucuguuuauaugcuggauuacguuuauugauuugcguauauugaaccagccuugcaucccagggaugaagcccacuugaucaugguggauaagcuuuuugaugugcugcuggauucgauaucaccacagaucccacagaaauacaaacuacccucagagaauacuacaaacaccucuacgcaaauaaacuagaaaaucuagaagaaauggauaaauuccucgacacauacacucucccaagacuaaaccaggaagaaguugaaucucugaauagaccaauaacaggagcugaaauuguggcaauaaucaauagcuuaccaacgaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccuggcagagacacaaccaaaaaagagaauuuuagaccaauauccuugaugaacauugauacaaaaauccucaauaaaauaguggcaaacugaaucuauaugacuuuaguguaauaucauugaagacuuagagaggguuagugugaguuagaaaaacucucuauuuuuaauauucugcccagucuaaaauuuuuaccugucauaaacuaaaucuguauaucucucaccugucuuauauuuauuucaguacaugauauaaggguggacucuauuuuuuucucaauggcgagcccaucaucucaucuccauuuauuagauaauccauuuuuuucucacugauuguggauaacacauauacauauuugcgcuuuuaggauuuagucuuuuuuuccccuuugaccuuucuguacucuagcauuaacaccacauggccuuaauuagagaaacuauaaaauuuuuaacuguuaauauagcaacauaucccuuauuuuuuuuaacaaaaauguucuuagcuacauuagugcauucuuuuaaaaaauuaugguaaaaauuacauaaugugaaauccucuuucauuuuuaaggguauaauagaguauuguuaacuaugugcauauuauuguacagcagaucucuagaacguuuucaucuggcaugacugaaccucuguucccauugaacaguagcucuccauucccauacccccagccccuggaaaccaccguucuacuuucugcuucugugaauucgacuacuuuagacacaucacauaaguggaaucauacaguguuuguccuguuacugucuuacuucccuuaguauaaugucuucaaaguuaauccauguuacagcauauuagaggauuuucuucuuuuuuaaggcugaauaauauuccauuguauguauauaacacaauugccuucuuucuuuuuuuuuugagacaaggucuugcucugucagccaggcuguagugcaguggugugaucauggcuuacugcagccuggaacucaggcccaagggauccucccagcuuagccuccccaguagcugggacuacagccacacacgcaacuaaguuaauuuuuuuuuuuuuuuuuuuuuguagagacaagguuucucuguguugccagggcuugucuggaacuccuggccucaagcaauacuccucccucggcuggaauuacaggcaugagccacacugccggccaauacauuuucuuuauucauucaucugcugauggauauuuagauuguuuccaccucuuggcuauugcgaauagugcaacaaugagcaugagagggcagauauuuguuuaaguuccucauuucacuuuguuugaauaaauauccagaaaugugauugcugguucauuugguaguucuacuuuuaaguuuuugaagaaucuucauacuguuuucuguagcagcuacguuauuuuacauucccaacaauaguguacaagguuuuaauuucuccacauccuugcugacacuuacuuauuuauuuuuuauguuguuguuuuuuuaaaaacaacagccauacuagcagguguaaggugauauuucaucgugguuuugauuuguacuucccugauaauuuguaaugcuaagcauuuuucaaauaccuguguaucauuuguaugucuacuuugaagaaaugucuauucaagucuuuugccaaguuuuuacuuguguuucuguuuuuuguuuucgcuacugaguuauaggaguucccuauacauuuugaauauuaagcccuuaucagacauaugguuuggaaauauauucucucauucuguaguuuucuguuuuguucuguuguuugcugugcagaagcuuuuuauuuugauauacuucuacucaucuauuacugcuuuugucagcaucaagaaaucauuucuaaagaccaaauuaugaagcuuuucuccugugguuuuuuccuaggaguuuguaguuucaugucuuauauuuauucuuugauccauuuugaguugguuuugugugugguguaaaauaaggcuccacuuuuguucuuuugcauguugauacccaguuuucucagcagcauuauauuuccacauuguguuaguugugacgcccuugucaaagaucauuugacuguauauauauaugguuuuauuaccugggcucucuguucuguuccauuagucuauaugucuuuaugccaguaccaaucuguuuuaauuacugaagcuuuagaaugcauuuugaagucaggagguaugaagcccucagcuuuuugcuuucucaagauuguuucagcuguuugggauucuuuaugguuuccauacgaauuuuaggauuuuuuuuuucuguuuccgcaaaaaugcuguaggauuuugaaaaggauugcauugaaucuguagcuuacuuugugguguugacaucuuaacaauauuaaaccuuucagugcaugaacaugggaugucuuuccauuuauuugugucuccuuucauuucuuucagcaauguuuuguaguuuucaguguacaaaucuuucaccuucuugguuaaguuuauuccuaaaguacuuuauucuuuuuuaugcuuuuguaaaugggauuugccuuagucccuuugggcugcuacaacaaacuaucauaaacugaguagcuuauaaacaauagaaauuuauuucuuacaguucuggaggccagguguuuaaguucaaggugcuggcaaauucagugucuagagagggcccucuucacgguucauagaaggugucuuuccccuguauugucaccuaguaaaagugccaaaggaacucucugaggacuuuucuauaaaugcacuaauuuaaucuaugaguucuaucaugaccucaugaaggcccacuuccuaauaccaucaccuuugggguuaaguaacccaaaacauuuauucuuuguagaccuaguaucugcagacaauaacaauuuuaucucuucauuucugauaguuuuauguauuauuucuguguguuuuaaagcaauguuuaauaauuuugaucauagcacauauaccuuuuuucuuaauuuauuggauacaccacuaauuuacuguuaaauaugauuuguauauguacuuuauuaugcugcacaugaccauccacaauauagacaaaggucauuuuucuuucuuaacagcuaacuacuuucacugucacaaccauggccacgacacucacacucacauacagagacacaugugcaugcgcacacguaugccucgcccccaacauguuccagauacauugaacuccuuguuguuucccaaguacuaaugcuauacugugcucuuacauuaccuguagcucuuuccuucuugcccuuuugucccuacugcuaggaacaccucguauccuuugcuugucucuugcucauccugguaaguaccaauucauuuuucacaucuacauucaagaauuaccuuucuuuuuggguccccaucacaaacuuuuauuauuguuagaacaccacuguacuuagcguauacuuguaucauuuuacccauaacauuuuauuauacuuccccacaauaccaaggcucccccaucagacuguaaguucuuccuaagccauuccuuuuuuaaacuuuaguagcacacauguauuagacauuuaauuaaauauuuauuaguaaguaacuaaucaguuggugaaaauugauuuuuguaugaaguaguauauguacuuuuaaaagauuaauguacuuguuucauaggggucuccauucuguuuuucaaauuaauuacauuuuuaaacauuauuuaggaauaaaaagauuggaugcccucuuucaauuagucagguacuuuggccugauacuuuuuugcaggaauuacccccccacacccccccgccacacccucaccaaaugguguaggguuauaguuuaaguaucaugaauuauggugaauuauguaauuugggucaguaguccagcuaacuaccacuagugaagcuggaaaagacuuuuguuuguuuuuguuuuuuaaaaagacaccagagagcugauaaggcuaagauuuauugggccaaaacuguauugaagaaagaaacccagacagugaaccuacuuuuccuuuuggguuaccugcuaguucuugaagugguauuggagauggagagauuuugaguagcucccagagcugggagugauauuuuggaaucuaggaucugccaaagaggagacaugguaaaccacuacauuuugguauugguagcuuaaaggacuguacccuguaagaaagaguaaacuggaaauagauuugcuuugagaggauugacauauaacuauaaauuauuucaguccugaaauugagugaaggugauucaacuuugcuaguuuucuaggagcuugcuaaaagcaaauguaaacucacucuaacagaagauuauaucuuccuagaccucacauuaccucaguuuucauguguuguguccaggacuuguuaaaaaaugaguacacaaaaauucaacacuauguggccaaaauaauagaggaaaaaaaaacagacaauagaaucauauucauaggaacucuagauaaaagaacuauacauuaauuaguauguucaaguauguuaaaauuguuugauucuacagagggaaaguauaaaaaagaaacaaauggauaauagcuuucauuuguaaucaagguaaaauuaaaaagaaagagccccauagaaauucuaaaauugaaaacaaaacauuuggaauuaugaguucuagcagauggcuuuaauagcaaacuagaccucacauuagagaaaauuagcgaacucaaaaauacgucagaacagaacguuuauagugaaacaugcaaagauaagaggauagaaaauaaaaauaauuaagaauagaauguaagauaaaaacaaugcggugagcaugucuuacauauauauaacuggagccuuagaaggagaggagagaauagagcaaaaaguauuugaaaauauaaugauugaaauuuuuuaaaaaauaguuaaagauaccaaaccauaguuucaaaaguccuauaaaucucaaguaggaaaaauaugaagaaaaucccuaaucucauuagacuauuaaaaaacaaagauagugggaaaauccccaauguagacagagaaaaaaauguuugcuuucagagcagcagcauguagaccaaaagauaaugucaauaugugggauggaauaauaaugaaauauaauugaauaauguucccaaauaauggaauauuuccaaagaugaugaaaugauauccccaaaguucugaaagaaaaugagugcuaagaaacaacuauuuuccaugaauaaaaguaaaaugaaaauauuuucaguaaaaaauugaaagaggcugggcauugugucuuaugccuauaaucccagcaccuuggaaggcugaggcaggaggaucacuugagcccaggagcucaagaccagccugggcaacauagugagauccugucucuacucccuucacccuccaauaauuugauaagauuugucacuagcacaccuauaauaacuaaccuaguauucuuuggacacaauaagaauaaucucaggaggauaaguacagaauggaaugaaaaacaaaaugcuuaaauaaaccaauaaauaaaaguaagcauugauuuuuaaauaauuuauguuguguuuuaauuauauaagugaaaaauaucugaaguaauauaaauugagauccugacaaaaauggaguuaauuuuuugugagguugcuguauuuucugguaagaguuaaaaguauggacauuuuagacuuugcaaagucaaaguuaaauauuauaauuuaaguuacaauuacuaaaaagacagugagaguaugauggcuaccaggcuaauuggaggagaaauggaauuagaaauuauucuggcauauauuacauaaguggaccauguaaagcuaaggauauauauaaaaauaauugcaaaaaaagacgacugaaaagccaacaggaaaauuaaaauggaauucugaaaaagugcaaaauaauuuaaaaaacaggcaggaaaggagaaaaagauaaagauacagguugaaaauaaauagauugaaaaagauugaucauggaaacaguaagcauaagaagaauggauugccguauuauaucauuucaaauuaaauguauuaccauagauuacuaggauacuuuauaaugagaaaaguuucuguugaacaggaugauauagcagucaucaacacauguaacagaauuaaagggauaaaaaugggcaauuucacaaccauauuuggagauuuaaaaauucucagcacuugguagaggagcuacacaaaaaacuagcuaaggcauagaauaacauugucaaccaccuugauauaccuaguauuuauagaacacuacacucaaaaguggcagaagagacguuauuuucaaguaagcaugguacauugaucaggauggaacauauucuuaucaggauaaugcaguccucauaaaaugaguuagggaggauucccucuuuuucuauuguuuggaauaguuucagaaggaaugggaccagcuccucuuuguaccucugguagaauucagcugugaauccaucugguccuggacuuuuugugguugguaggcuguuaauugcugccugaauuucagaacuuguuguuggucuauucagggauucaacuucuccuugguuuagucuugggagguuguauguguccaggaauuuauccauuucuucuagauuuucuaguuuauuugcauagagauguuuauaguauucucugaugguaguuuguauuucugugggauugacggugauauccccuuuaucauuuuuuauugugucuauuugauuuuucucucuucuuuauuagucuggcuagaggucuaucuauuuuguugaucuuuucaaaaaaccagcuccuggauucauugauuuuuuuuuugaaggguuuuuucaugucucuuucucccacuauuauugugugggagucuaagucucuuuguaggucucuaagaacuugcuuuaugaaucugggugcuccuguguuggaugcgucuauauuuaggauaguuagcucuuuuuguugcaucgaucccuuuaccauuauguaaugccuuucuuugucucuuaugaucuuuguugguuuaaagucuguuuuaucagagauuaggauugcaacuccugcuuuuuuuuuuuuuuuuuuuuuugcuuucuauuugcuugguaaauauuccuucuucccuuuauuuugagccugugugugucuuugcaugagagauggaucuccugaauacagcacauugauggaucuugacucuuuauccaauuugccagucugugucuugucauuggggcauuuagcccauuuacauuuaagguuaguauugucacaugugaauuugaugcuuuaugaugcuagcugguuaguuugaccauuaguugaugcaguuucuucauaguguugauggucuuuucaauuuagcauguuuuugcaguggcugguaucaguuguuccuuugcguguuuagugcccuguaguggugacaaaaccucucagcauuugcuugucuguaaagcauucuauuucuccuucacuuacgaagcuuaguuuggcuggauaugaaauucuggguugaaaauucuuuucuugccuguaauuccagcacuaugggaggccaaggcggguggaucaccugaggucaggaguucgagaucagccuggccaacauggcaaaaccccaacucuaccagaaauacaaaaaaauuagccaagcaugggggcagacaccuguacuccuagcuacuugggauucugaggcagacaaucucuugaacccaggaggcagagguugcagugagccaagauugcacuacugcacugcagccugggugacagagugagacuccgucucagaaaaaaaaaaaaaaaaagaauucuuuucucuaaggauguugaguauuggcccccacucucuucuggcuuguaggguuucugcagagagauccgcuguuagucugaugagcuucccuuugugggaaacccuaccuuucucucuggcugcccucaacauuuuuuccuacauuuugacuuuggugaaaccuggcagagacgcaacaaaaaaggaaaaugucaggccaguaucccugaugaacaucuaugcaaaaauccucaguaaaauacuggcaaacugaauccagcagcacaucagaaagcuuauccaccacgaucaagucagcuucaucccugggaugcaaggcuggugcaacauacacaaaucaauaaacguaauccaucacauaaacagaaccaaugacaaaaaccacaugauuaucucaauagaugcagaaaaggcuuucaacaaaacucaacuccccuucaugcuaaaaacucucaauaaacuaaguaucgauggaauguaucucaaaauaauaacagcuauuuaagacaaacuuacagcaaauaucauacugaaugggcaaaaacuggaagcauucccuuugaaaacuggcacaauacaaggaugcccccucucaccacuccuauucaacauaguauugaaaguucuggccagggaaaucagguaagagaaagaaauaaaggauauucaaauaggaagagaggaagucaaauugucucuguuugcagaugacaugaucguauguuuagaaaaccccguugucucagccccaaaucuccuuaagcugauaugcaacuucggcaaagucucaggauacaaaaucaaggugcaaaaaucacaagcauuccuauacaccaauaauaaacagccaaaccaugagugaacucccauucacaauugcugcaaagagcuuaaaguaccuaggaauccaaauuacaagguaugugaaggaccucuucaaggagaacuacaaaccacugcucaaggaaauaagaggacacaaacaaauggaaaaacaacccgugcucauggauaggaagaaucaauaucaagaaaauggucauacugcccaaaguaauuuauagguucagugcuauccccaucaagcuaccauugacuuuuuucacagaacuggaaaaaacuacuuuaaacuucauauggaaccaaaaaauagcccgcauagccaagacaauccugagcaaaaagaacaaagcuggaggcaucaugcugccugacuucaaacuauacuacaaggcuacaguaacaaaaacagcaugcuacuaguaccaaaacagagauacagaccaauggaacagaacagaggccucagaaauaauaccacacaucuacaaccaucugaucuuugauaaaccugacaaaaagcaauggggaaaggauccccuauuuaauaaaugguguugggaaaacuggcuagccauaugcagaaaacugaaacugaccccuuacugacaccuuauacaaaaaucaacccaagauggauuaaagacuuaaauguaagaccuaaaaccauaaaaacccuagaagaaaaccuaggcaguaccauucaggacauaggcaugggcaaagacuucaugucuaaaacaccaaaagcaauggcaacaaaagcgaaaauugacaaaugggauuuaauuaaacuaaagagcuucugcacagcaaaagaaacuaucaucagagagaacaggcagccuacagaaugggagaaaauuuuugcaaucuauucgucugacaaagggcuaauauccagaaucuacaaagaacuuaaacaaauuuauaagaagaaaacaaccccaucaaaaagugggcaaaggauaugaacagacacuucucaaaagacauuuaugcagccaacaaauguaugaaaaaaugcucaucaucacuggucauuagagaaaugcaaaucaaaacacaaugagauaccaucucacaccaguuagaauggcaaucauuaaaaagucaggaaacaacagaugcuggagaggauauggagaaauaggaaugcuauuacacuauuggugggaguguaaauuaguucaaccauuguggaagacaguguggccauuccucaaggaucuagaacuagaaauaccauuugaccuagcaaucccauuaguggguauauacccaaaggauuauaaaucauucuaccauaaagacacaugcacacguauguuuauugcggcacuauucacaauagcaaagacuuggaaccaacccaaauguccaucagugauagacgggauaaaaaaagugugguacauauacaccauggaauacuaugcagccauaaaaaaggaugaguucauguccuuugcaggcacauggaugaagcuggaaaccaucauucucaaccaacuaucacaagaauagaaaaccaaacaucccauguucucauucauaagugggaguugaacaaugagaacacauggacacagggaggggaacaucacauacuggggccugucagggaguugggggcuaggggagggauagcauuagcagaaauaaccuaauauaggugacggauugaugggcacagcaaaccgccaugacacauguauacccauguaagaaaacugcacauucugcacauguaccccagaacuuaaaguguguauguauguguguauguguauauauauauacacauaacauauauauauacacacacacacacccaacauacacacacacacacacacacacacacacacacacacacacacacauauacacauaacauauucuuggucauaaaauaauucugaguacauuuuggaagaugaaaguuauaugguguauguucuguaauccacagaauuaauuagaaaucaauaacaguaagacaauagaugucaauuacuggaaauuaacauaauuuuuuauaaucauugggucaaaaaacucacaagagccauuagaaaauaauuuuaaaugaacaauaaugaaaauaauacauaucaaaauuugugggguguagcuaaaugaaugcuuagaaggaaauuuguagccuuaaauaccuguauuugaaaagaagaaauuucucacaucguuaacuuaagcuuguaucuuaagaaaccagaaaaauaaaccaaaagaaaacagaaacaacagcaaucagaaauuagugaaauagaaaacagaaaaauaguagagaauaauuaauaaaaccaaaaguacucuuugaaaaaaauuaauagaauugaaaaacguuuugggguauuguuaaaggaaaaagagggaagacacaaauuacugacauccaagaaaacauuagaaaacccaauaucaaugaauggaagugaauuaguaauuaagaaccuuuccucaaagguuccaagcccagacagccuuauuggugcguucugucaaacauuuaaguuagaaauuugaccaauccucuacaagcuguuugagaaaauaaugagaagggaguacuucucaacuuauuuuauaaggccacugucacccucauuucagaaaucagacagaacuauuuuaagaaaagacaacuauagcccaauacacuugugaacauaugcagaauuucuuaacaaaguaucaacaaauuaaacaauagguaaaaagcauaaaagcuuaaguuauguggccaaauggagcuucucccaagaauucaaaguuguguuaacaucuggaaacuauuaagcuaauuucaccauauuaauaugauaaaguuaaaaaucugugugaucauuuuauagagauacagaaaaagaauuugacaguuuuauuuucuuuuucuuuucuuuucuuuuuuuuuuuuuuagacggagucuugcucugucacccucacuggagugccauggugugauuucagcucacugcaaccuccauuuccuggguucaagugauucucaugucucagucucccgaguagcugggauuacaggcuccugccagcacauccagcuaauuuuuguauuuuuuguagagacgagguuucaccauguuggccaggcuggucuugaacuccugaccucagguaauccgcccaccucagucucccaaagugcugggaucacaggcaugagccacugcaccuggccuacauuugacaaaaauucaacaaacuuucauuaaaaauaugcagauggcuagaaauagaauagaacuuaguugauuaaguaaauguuauauagaagaucuacaacuuacauaauauucaagggggaugaaaacaauguuauuccuaacuugugaaacaaagcauguaugcugcuguuuacuuucauuuaacuuuguacugcaggucugaucuagggcaauaaagcaagaaaaagauguaaaaagcauacggauuggaaacaaguaaagcugcucuuguuugcauaccacaugguugcauguguagaaaaugcagaaaaauaagagugacuggaacuaauaaaugaauuuaauaaaguugcaguauacaaagucaauauacaaaaaucaauuguauuuuuaaauacuaauaaguacaauuagaaagugaaauaaaacccuccacaauagcauaaaagaacagucuugugucacuuaaugacagugauacguuuugagaaacaugucauuaggaacauuguguaaacauacuacuuggacaaaccuagaugguauagcccaccccauaccuaggcuauuugguguagccuguugcucacaguuuacaaaccuguacagcauguuaguguacugaauacuauagacaauuguaaugcaaugguaaguauuuauguaucuaaacauauaagcauaggaaggguacaguaaaaauacaguguaauaaucuuaggggacugccaucguauaugcaguccaucauugacugaaacauuguuauguggugcaugauuguauguaggaauaaauucaguuaaagaugugaaagaucuuuacacagaaaauuacaaacauugcauugggaaauuaaagaccuguauaaauguagagcuauaccauguucauggauuggaagauuuaaaugauuacgaugguaguuuucccaaaauucaucuauagauuuaauguaauuccagucaaaauccaaauagacuuuaagaaguagacaagcugauuuuaaaauucacauggaaaaauaaugauccuuggucugauaaccaaaugucaaaaaauaaaugcuugauauaaaugcuccugagacugauuguucaaacuacaagcuguauccuuuuuuuuaauuuuuucuaagaaauuuacuaugaucuggaaacaaugaaagguuuuggcuuugaaaaccuuuccuuggaaugucuguuggaccucauagaaaucuucaggaugucaaugauggacuuaaaauagcuaagcaaaacacuucuaaaaacugcagcaaacuuuuagggggucaacuuaauaguuaggauuggccaagugcggugguucauggcuguaaucccagcacuuugggaggccauggcggauggaucacuugaggucaggaguucgagaccagccuggccaacauggugaaaccccgucucuacuaaaaauacaaaaauuagucaggcauugugucacacgccuguaaucccggcuacucaggaggcugagacaggagaaucacuugaacccacgagguggagguugcagugagcugagaucaugcuauugaacuccagcuugggcaacagagugagaccguuuccaaaaaaaaaaaaguaggauauauauauguacagacaaauaaaauuuaacuuuucauguaaaugauuuuaacucgaguuuucaacaauuuuuuucuucucuuuuuuucuuuaacauacuuccaaaaaaugcuacuacagacuuuaggcauguggugaaugaaaugcucuuaggauuauuuucacuuuggggugauggugagaguguaugcuuaucuguguugaguguguuugaucucugaauagauuuuauuuguauugauuucauaguuuauaaaaggaaaauauuuaaaucauuuaccaucuucuauuaaugggaaauuuuacucauuuuuauagggaagaauggacagaagcuauccaggcuguagcagacagacugcagaggcaagaagaggagagaaugaauuguaguccaacuucacaaauugauaauauaggagaggaagagauggaugccucuacaacccaucauaaaagaaagguagaaaauaauaacuuauucccagcacagcauucauuugucuggaagaaacauauuaaaagcuaccauuugcagaaagaugucagccaguuuucuuacgauauguaaauauauuggugggucuuauucacaugaaucugaaauaccuguuguuguuuaaaaccaaauaggugaacauuguuucagugauccagcacuuuagcacugaaugcugauagggcucaugugugacugaugugccaucacacuacuuuauaauuugcauuuuuuccuuauuauuuuuaauacaauuuuagaaacuuuguaauaaaauguuuucccugaugauuuguucuuuuccauuucgcauuucguauucucccgaaaagcacgagcaguaauggcucggauguacuuccugauuggugcccucagucauaguaaagucagcaggaaagugaacaaucuuggaaacaauaacucuuauuuaauggcugcuucugagucaguagggaaauagacuuuuccuucucucaguguuccagcauaauaaguacgaauuuauauuuuuaugagcaauauaaauuuuuucauugcaauagaaaauugaaaagcaauuuccuuauuacaaaaaugauauuuucaugauuaaagauagagguguugagauaagcuugccauuuaucacuuuagaauauguuugauuuaauagguuguaaauuaaucuucagggaggaaaacacaaauuuucaagguauuauccaugaaauuugguauuagcacagugauuaagaacucuuuggagauagacugccugaguucauauccucccuuuuccacguuaaacuuguggacuuggugaaguuacacacucacaacauaaaguuaauuauccuuuccuuaugugaauaagaauaauauucuauacuugaucugggccaaaugucugagaucccuuucugucuucauuguagauuucuacucuguuuguuuguugaacugaaucccucuuuucuuuuacgucaauuuaaucugccuuguuccuccaucauugcaaaaagaaaaacaaagucuagcuacacccaccuaccuacucagagauaagaaagcuucuuuuguacauguguaaauuauuucauuuaaaaugaaaugaagaauaguguaaaucugauaugguuaaguauuugaaccccaaauucaaaauaccucuauggauuuuucuuuuuggagacucaguuggaguaaaaaauucuaagagaagauguuuuagagugauguuuauguuuaauuaucuuuauguggacaaagaauaguagcuaacuuuaauagcuaauauuuauugagcacguauuacauaaacacuuuaaacauuuuuuuuuucauuuugaacuucaacuauaaguuaaguaccauuauuauuccuguuuuauaguuaagggaaauaaaggauggaaggauuaagaaauuuuccccuuaauuacacacagggugggagccaguacuuaaccccaggcaguaagaucugaacuccucccuuucuagcacuagguugugauaguaaaguucuacugguuuuuucaagaauuuacaagcuuuauuaucaauugaaauuaacuaauauccaaaugucauauaaggacaacaguuuuucauaauauuuugagaaacagaguauagucauaagagaauaucugcauaauuuuguuucuaauauaacuucauuauaagcauaaaaauuauagagauuagagaggcucaagauauaugaaccaagaaaaagaaauaagcuguauauugacguguuacaguauacaauuaaaagaucuuauauguuugaaguucuguuaacuuuuuugaaauaauuuaaaauaguucuaaauuacugcagaaguuagugcagaaaaagaacauuuguaccacuacuaacuccauaacgguccuaaugacuuagccucaagugguaaaauauuacugucauuuucauaagauaaaugauucuagaacuauacccuuauguauaucaauuaucaugcaaagaauugcagaaguuuggauuauuuuuaagacuauaaccacacauugugaaauaagaauauuauucuaauaauuuauaggauacauuuccuucuuuaauuuuugccaaauggcaauaggauuaaaagaauagguacugauuaugauggcuauggugacaguugucagacugcuauuucuugcaugaaauaggguucguuaccucccuuagugguggauuaucgccacagugucugcucugccaguuaaaaacucaauuggaaaggaaggauguuggguguaaagaggcaagggccucacagacagauuuaagugcucuucuuuguuugaauuaaaagaaaaugugguucuauguuuuaauuaaaagauagcguuucagaggaauuugcuuagagaacccagaagugccuaaucuuggucagccaagcuaccauucuuguaugccuugucaaguaugugaaggggcauagcauaaaaggauaaaaagccaagugagagucaaaauucugcuuaauuuuuaacagacuagcauaagcuucucugggaucaacuggcuauaaucucaugauuuacguuuaaaguauaagcagugccuccugcuuucccacuaaguuugacuccaguucuugggauuguaucaccuaauuccuggcuguaguaacucauaccaguggccaguauccagagaaaaagagaaggaaaaaaagaacaauggccagaccugcugaaaucucaugaucucacacugcaugaaucugcuuauuuaaaagggagaagcgacguaaccaauguagaaguugacuaauaacauuagcuccaccucuucccgugagaaagagcaccaggagaagugggcagagauggaggcaaaggagugaacuucgucagagcucuuuuccucuuucuacuuacuugguuuugcuguuacauuguaaauguaucuggaauuuaucuuuuuuugaccaaauaugcuaauacugugguauucuuggaaguucuuuauguuccucauugauuauauguuuauuuuuaaucuaauuugugggcuagacagugucuuauauucuggugugccugauuugaacacauuuauuaagcauuuguuauauaugcccauguaucucuuuaccuaaaacagccacguaaacauguaaagggaagaguguaacuguaaaguauuuccccaauaaauucuuaagaucaggcuuuggaggaggauuauuuuucuggagaguauucauacuccuauauuuuuauuaaagacuuacuguggcugggcgugguggcucacgccuguaaucccagcacuuugggaggccaaggugggcggaucacaaggucaggagaucgagaccauccuggcuaacacggugaaaccccgucucuacuaaaaauacaaaaaauuaaccaggcgugguggcgggcgccuguagucccagcuacucgggaggcugaggcaggagaaugucgugaucucaggaggcagagcuugcagugagccgagaucgugccacugcacucuagccugggcgacagagcgagacuccgucucaaaacaaacaaacaaacaaaaaaaaggacuuacuguaucuuuuuccauaacaucauccagaagaccaaaacauuuuguaauaguguacauuucauuuguaaagacuacacaauuacuguguauaccauucugaccaugagcauuugauagcaaaaauaccuuuuuaauuuccugaaguucugucaaaauagaugggaaaucuguuucugauuuuaucacauacagugcuuuuuaacuaauaguaauuuccauguaaauucccuuuuuuuuaaagauugagagucaaacugacaagcugugaaguucagugaaggcugucauacuuuuuuuuuagccucauuguuccuaagaauugcaauuuuacuauuuacuuauuuauuuauuuucauuugagacaaggucucacuccuaucacuuaggcuggagugcaguggcacaaucgugacucacugcagccuuaacuucacaggcucagguaauucucccaacucagccucccagguagcugggacuacagacaccugccacugcacuuggcuaauuuuuguauuuuuuuguagagacaggguuuugccauguugcccaggcuggucucaaacucaugcacucaagugauccaccugccuuggucuuucaaauugugggauuacaggugugagccaccacgcccagccaagaauaaggauugcaauucuuaaggaauauaguaauauuuuauaauuaaauauuguuuucaacugaaaaugucauaaagcauuuuacagauuguuuucuaauuuuuaccccccaauaauucaauuucauuuucuaugauauuuaauaauaaggcacagcaaguauuauuuucuagugcuuuuaaauaaaaaaaugaggaacauacuguccaaaugaaacuuugagcaauaaauugacacucuggccugguuaugaaaauaauguuucugaguuacuugccauguguauuaggguucucuagagggacagaauuaauaauauauauauauauauguguguauauauguaugugugugugugugcguguguguguguguguauauauauauauauacacacacacauauauauggaguuuauuaaggaguauuaaacacacgaucacaagguuccacaauaggccaucugcaaacugaggagcaaggaagccaguuugagucccagugcugaagaacuuggaguugauguucgagggcaggaagccuccagcacagcagaaagacguaggcugggaggcuaagccagucuagccuuuucauguuuuucugccugcuuuauauucuagccacacuggcagcugauuagauggugcccacccggcuuaaggguggguaugccuuucccagcccacugacucaaauauuaaucuccuuuggcaacacccucacagauacacccaggaucaauauuuugcaucuuucaauacaaucaaauugacacucaguauuaacccucacgcuguggaacaaacuaccucaaauuuaaugucuuaaaacaauagccauguaaauaucucaugauuuuguaguuugggccacucuguuggucuugcaugcauggcucucaaucagcugccuacagcuuauacaugggugggcuggaaaauccaacaaaaccuuccuuaugugucuggggccuuggugcugacuguuggcuauggugucuugguucuccuccacuuggucucucucucggagugguaauuuaucuuccagggucucuccacauggccucucucuccagcaggauaauauggacuaacugacagcauuagagcuggcuuucuagagcuuuccaagagagagaacgcauaaacugccaggcuuaaaggcuuugucuguuacuggcauaguaucaguuugaucauauucuguguucaaagcaagauacaggguuagcccggggagagagaaaguugacuccaccccuucaugggaagaguggaaugugcauacagggagaaaugggaauuuguggcagccaucuuugcagacuaccuagcacaaauagcuuguuauguaguauucccugauuuuuucugcucuauuaaugcaauuaaaucuaauauuaccuguuauuuguucaaaugacacuagcugauuuacuauauuugauauuuagagcuacauguuugauuuuuaguugaauuaauauaucuuauuauuuucccugcuaucucuuugcuacuuuaucuuugaacuagagauauuauugaauguaagacacuuuaauuugacauuuggggaaaauuauaaaaaauaugagcagcaaaaaauguugaaagugaacguaggcauuucuaaaauuuuaagaauuuuuauguaauauacaugagagauauugggauguaguuuucuugcauuguuuuccucucauuuugguauugucaaaaaauugggguucagccugggagaccacauggguucuuggcuucacacaagaaggaauucaagagcaaacaacagaauaaagugaaagcaaguuuauuaagaaaguaaaagaaugaaaggguggcuacuccauaggcagagcagcccugauggcuacugguuggcuauuuuugugguuauuuuuuaaucauaugcuaaacaagggguggauuacuccugaguuuucuggugaaggggcagggaauucccagaacugacaguuucccccguuuucagaccauacaggguaacuucccgauaugucauggcauuuguaaacugucauggcacugaugggagguuccuuuggcaugauaauauauuauaaugaauguauaaugagcaguggggacaaccggaggucacuuucaucaccaucuugguuuugguggguuuugacuggcuucuuuacuguauccuguuuuaccagcagggucuuugugaccugcaucuugugaaaggagaccugccaaacuccuaucucaguaucaggaugaugcuugucucagaaugaaugagaaguauuccucauuuuaauuuucagaaagaauuuguauaaaauuggugucauuucuuguuuaaaugucuguagaauucaccagugaaaccaucugggccuggaguuuucuuugaugaaagguauuuaaccacagacucaauuuuucuuaauaaauaugggguuaucaaguuaucuguuucuuucaaagaaagagcuuucaaagcuugagacuuucaagcaauuuguucauuucaucaaaggugucaauuuuauugucaaaaugccauuuauaauagucucuuacguuucuuuuaauaucuguagaaucuguagugaugccaccucugucauuccugauauugguaauuugugucuucucuauuuuucugaccaaccuggccagaggcuuaucaauuuuuauugaucuuuuagaacuagcuuuugguuucacugauuuuuucucuacucuuuuucuuucuuuuaaaaauuuaauugauuucugcucugaucuguaucauuuucuucuaacucuuuuggguuaacuugcuuuuuuuuuaaguuuguuaagguggaaacugaaacaauugauuugaaauauuucucacguuuacuuuagauaaaugauaaacagaaaaaaaaaguuauaaaaggcacuaaaauuuucagugacuuguaauuucaagauaaaacccaaauacuuauuugauauuuauaaaccucuaaacugaguuuaaauuuauguaaacugaucauauacaauuaccuucucuucucuucaaaaaccuauuaauaugaaaguaaaggaauuucaaaaggaggcaaguccacaaaaaugaaaagcugggucggggaggggcauuagggcacaaaugccuucaaaaguuuggaaguuucuggaagaauguugauagagcagagcaggaaaagaguacauagaggggacuguagagaacaaguggcacgugugacuggcaaaauccucaggauuaccugacuuaagaaagagaagugaaacugaaaacaggcacauuaauuaaagauauucuucuuagagcucccuuccuugcuguucugaauugcauaaaguacucucucaggaauaacaacugcuuucuuugauuuauuuuaacugaaguauacgagguucucgacauuucuuauaaauauauccuauaucucucucuuucuuggauuuuaucuuuauuuugcuagaguaaauucucagauagcuccuuccaaagcacugcuuuuuuaggcauauuuggaaauguuuguguggaacauuuuugauuaucacauuuucuggggguagcagcacuacuaaauccuugaaaacuugaguccuuaaaaaugagugaaaauaauuuuuuuccuccuuugcccuuuuacacaacugauaauuucgcugaggaauucuagguucaaaaucauuuucuccaacaucugagaacugcuuaaauuauuuucagcauccaugguugcuaaugagacagccaaugccagucugauucuuuuucauuuaaaugugcuuauaaauugguaaaauuugguuuugaguggauauugcaaacacauauauauaugcuaacaaauaaauugcaucaaauacuucauauuauauuuuuuaauuuguauuuuucagacaaugaaugauuuugacuauuugaaacuacuagguaaaggcacuuuugggaaaguuauuuugguucgagagaaggcaaguggaaaauacuaugcuaugaagauucugaagaaagaagucauuauugcaaagguaacugauuuauuaaaguugauuacuaaauuuuuguuugcagugugcauguguuugugggcucaugaauuuacaugcuaauguaugcaaauuccauuaaacaaccaaaauaugguuguagacuacugcuacaguaauuuuuguguauuaauauuuguaauuuuuaaaguuuucagacauucauaauauuuguauauuauauacuaaagcuauucucuuaaggaaauagaaauguuuauguuugcauguuugggagaauguuuugugaucuauaucauaauuauacuaggauugcuuuuuaauaauuucuccuaucguucugaauuucuuauuaagauugacuaguguagaugauuuuuacucauaaauucuaaagcuuauauaacauugaauggaaaaacauccuaaauagauuugaaaauacuagaauggugaaauuaaaauaaauuauuuuaggaagacuuacuucccacccccauaccuuuauucagcuuagaccuuuuuaaauaaauaacauguuaaugaugucaguucucacucagaguucugaacaaaaucccaauucccucaggagauacacuuuacaaauugguccaugcuuuaagucuuacuuaauucaacaaaugacauaaauuacuguuauacuuuauggacuacuucaacuuccaguuauuugcuacuauaguuuccucaucuggaguguauugccccuuacacuuugugaaacuuuguuucccugucuuuguacauuuguuuugaccucaacuccuuuacaagucaaugccccuauuggaaagaacauuggcuuuggaaucauacacaccuagguucacuacucaccuaauagucuuuaacaaccaguacuuuuuaaagcaguacuuuggggaaguacuggucucuuaggggcauuuggaaauguuuauggggggcacauauuugcuuaucacaguaacugaggaggagggguacuucugacaguuaccagguagaagccgaaugugcucaauaucuugcaguguguugggcaaccaaucagagccuuaguuuuuuucauuuaaauugguauaauaaaaccucuggacaggaauauuuugaggauugggauauguaagguauuuagcauccuagcuggcacuuauuauuaauuaagcugauauuuucugggagguaguauaaugucagguagguuuugcugcuuaguaagugauccaacuuuuuaugccuuuauuuucuuaucuacagaguggggcuaauaguaguaccugccucauaugguuauuuucaggguuaaaugaauagauaaauauaauaguacaugccaucaguauuaaauaaacuuaacaaauuaaauuacaaaucaaaugaaauuaaaauaugcuauuguuauaaauauuugcuauaauuauuauuacuauuauuacuaccuacuguguauuauuacuaccuacuguguaucaagcaucaguaaauaucuauuccauucuguuuuuucuuuuauauauuagccucacuuguaucccauuauuuaauuucuguucaucagacuggggaauauccuauuagacacugucuuaucucacuacuuacacuuuucugaguaacuguacagaacuacguauauuucacaaaugauagacuauucugauugaaguagugccuugcugcuuucucccaacaaaucuauuuaucguuucuugaaagaaaauaugcucauuuauagcaagaugauuaacacuaugaagauuuggagugugacaagaccugggguuugguuccugcugugcccuucucagagcaacauaucagggaagaaaugauuuugauaucuuuuuacuggugauguuaauuuugauugcuugacuacaguggugucuacuguguuucuucacuuuaaaguugcuauuuuuuccauucauaaguaaucaguaucuuagaggaaauacucugggacuauauaaauaaccuauuuuuucuuaaacuuuuagguacuaauuuuaacacccauaucaguggauuuugcccauaauaauuauuacuguuguguucuaauggugauuuucuauuucccucauuccuuauacauuuauucuuaguuaagcuaaggguuuaucaauuuuguuaaucuuuucaaagaaccaacuuuuggcuuuguugacuuuucuuuguuuuaucugucuuugcuuuaaucuuuauuuuuuuuuccuacugcuugcuuuggguuaauuuauuuuuuuccuaguuccuuaaguuauaaaguuagauuguugauuugcaaucucucuuauuuaguauaagcauuuauggcuuuaaauuucucccuuagcacuguuuuuguggcaucccauaaauuuuagucugucguauuuuuguuuucauucaucucaaaguauuucuaauuuccuuugucauugauugugucuguuguuuaauuucuacaaauuugggaauuuucuuguuuucuuuauauucuaacuucauguuguaguuggagaagauacuuuguauuugucuuuuaaaguuuauugagacuuuauuuguaauccaacauaugaucuauccuggagaacguccccuaugcacuugaaaagacuguagauucuguuguuagguagaguauuuuguguauauuuaauagagcauuuuguguauaugucuuagauuuaguugcuuuauugaguugucgaagucuuccguugccuuacuucuuucuuucugguuguuguauucaucauugagaguguaggguauugaaaucuccaacuauuauuguaaaauggucauugcuuucugcaguucuuucaauuuuugccucauauauuuugauggucuuguuauuagguauguaaguguuuauuauuguuauaucuugcuguauuaacuuuuauuaauaauaucuuuuuuugguguuuucuggccuuuucauuuaaagucuauuuugucugauauuaauauagccaccccuuuucucuuuugguuacuauggcaguacccccuuuagcugcaguuuugcuuuucaugguuugaguuacccccaaucaaccacagccuaaauauagaugaguauaguaaaauaagauauuuugagagagagaccauaugcaucacaauaacuuguaucacaauauauuguuauaaguuuucuauuuuauuauuguuguuaauuuacuuuuaauaguagcuguuaaucuacuuuuaauauccauuuauaaaggaugugccuaauuuacaaauuaaacuuuaucuuagguaguauguguaggaaaaaaacacaguauaugcaguuggcucucuguauuccauauccauggauucaaccaauguggauuuaaaauacucaaaaauaauaauacaagaauaaaaauauuaaaaauuaaaaaaccaauguauuguaacagcuauuuacauaacauuuacauuauaucugauaugauaacuaaucuagagaugauuuaaaguauaugggaagaugugcauagauuauaugcaaauacuaugcuauuugauacuagggaagugagcauuuguggauuuuguuaucugcagggggauuuugaaaccaaucccccauggauaucaaggaaugacuuuauagaguuugguacuauccaugguuuuaggcaaauaccagggucucaaaacauauccuccacuaauaaggggaacugcuauauuuucauguaauaauuuuuucucuuucacuuuuacccaguuuguggcuuuuggagacagcauggaauuggaucauucuuauuguuuguuuaaucgacuuucccaaucucuuucuuuugauuggagaguuuaguccauuuauguuuaaagugagucgugauaaggacugacuucgguccuuuugcuauuuauuuucuauaugccucauugcuuuuugucccuccuuuucuacauaaaugccuucuuuuguguuuaauugauuuuuuagugaaacauuuuaauucucuugucauuuccuguuguguauauucuauagcuauuuucuuuguauagguuauauuuaauauccugaaguuauaguacuguaauuuaaauuuauaccaccuuaacuuuaauaacccucaaaaacuccacuucuuuacaauucuguccuuacuccuuucaauuguuggugucuuuaaauugcaucuuuaugcauuguguguccaaaaacaagacuacuaauuuuuuaauguaugagucucuuuaaucauguagaaagcaaaaagugguauuacaacacaaacuuacaguaauacuagcuuuuauauuuuuuuguguauuuagcuuuaccagaucuuuaauucuucaucugacuuuaagugacugucuaauguccuuauauuuaaaccugaaggguuuaauauaacucacuauagcuuuucuuguaugacagguccagugcuaaugaacucccucaguuucuguuuaccuagaaaugucuugauaccucccucauuuuuugaaagauaguuuugcuggauucuugcuuuaguuuuuuuccuucagcacuuugaauguaucaaccaauugccuucuggccuucaauguuucugaugagaaaucuucgauaaucuuauuagggugcccuuguauuugaugauaagcaagcaaaacagacucauugcuaauauggaaaaaguucgaguggucuugauagaaguucaaaccagcugcaacauucccuuaagccaaagccuaauccagagcaaggccuuaauucucccaauucugugaagggugagagaaguaaggaagcugcagaagaacaguuggaagcuaggaaagguuggcgugugagguuuaaggaaagacaccaucucuauagccuaaaagugcaaugugaaaccacaagugcugacacagaagcugcagcaaguuauccagauaucuagcuaaauaauuggugaagaugacuacacgaaaccacagauuuuccauguaguugaacuuaggacuuccuuagaaaggagaagucauugccuggcucuaaagcuuccaagggcagauugacucucucaguaguggcuaugcaguuggugacuuuaaguugaagccauugcuccuuuaccauuucaaaaauccuagggcccuuaagaauuaugguaacucuacacugccuguucucuuaucaguaaagcaacaaagcuuggaugacaagcacaucugcuuacaguauguuuuacugaauauuuuaggcccgcuguggagaccuccucagaaaaaaagauuacuuuuuaaauauuacugcucauugacaaugcaccagauauacaaaagcucugauggagauauacaaggagaugaauguuguuuucaugccugcuaacccagcgucaguucugcagcucauuaucaacguccauucugcagcccauuauuucaacuuucaagucuuauuauuuaagaaauacauuuuguaauagacaguaauuacugccauagauaguaauuccucugcugauagauccaaggaaacuuaauugaaaaccuuuugggaaagauucaccauucuagaugccuugaaaaacauucagucuucaugaauguucauggaaggaggucagaauaucaacauuaauaggaguguguaagaaguugauuccaaucuucauggaugaguuugagggguucaagacuccaguggaggaaauaacugcagaggugguagaaauagcaagagaacuagaauuagcaguggagccugaagauaggacuaaauuuuaucaggcccaugaugaaacaugaacaaaugaggauuugcuucuuauggaugagcaaagaaacugguuucuugagauaggaucuacucuuugagaagaugccaugaacauugcugaaauaacagcaaaggauuuagaaaauuacauaaacuuaguugauaaagcaguggcagguugugaaaggauugacuccgauugugaagaaaguugugcuguggauaagcagcauggcaugcgaaagagaaagccuuucuuggaagagaaagucaauaugggaaacuucauuguuuucucauuuuaagaaauugccacgcugggcaugguggcucaugucuguaaucccagcacuuugggaggccaaagcaggcagaucgcuugaggucagggguucaagaccagccuggccaauauggugaaaccuugucucuacuaaaaauacaaaaauuaguugggugugauggcaggugccuguaaucccagcuacuugggaggcugaggcaugagaauugcuugaauaccaagaucgugccacugcacuccagccugggugccagagcaagacuucgucucaaaaaaaagaaagaaauugccacacccacucucaccuuuggcaacugccacccugaucacucagcagccaucaacgucaagagaagaccuucugccagcaaaaagauaacaacuugcugagggcucagaugacccuuagccuuuuuuggcagucaaguauuuuuaaauuaagguauauacauuucuuuagacauagugcuguuacacacuuaauagacuacaguauagugcaguguaaacauaacuuauaugcacugggacaccacaaaguuagugugacucguuuuauugcaauacuuuuguugugguggucuggaacaaaaccugacguaugccuguauggaaaaaaaaaaaagaggcuauuugguugagacaugaaacauugguucuugagaagcccaggucuauugauguagaguaaccuuuccuucauuacaggucugaccauacuauuugauugucccaugaauaauauucauuuacuuacaccauuggaaacaccaaauuggcguucaguuuuuaggauuuaucaauagacaaagcaccgaagacuuaaguauaguuacagaacagacugaaaauguuauaaacccugucaguguaaaagaaaugguauaguugauggaugucagcugaaagcauguuauaauuuuuuuuuuaaaaaaaagcaagaaugaauuggaggccagagacagggugauggagccaccaggguugcaaaggcagagguugauggagccaccaugggccuagaggacagaaauacaaauuacugaggauuaguuacagaccuugaaaucgaauuucccuugcuggguuuagaacuugcuuggaaucagugauguuuuuauuucuuccaauuucucccuuucugagugggaauaucuguccuaggccuuuucuaccauuguauuuuggaagcagauaacuuguuuucuagugugagagguccacagauuuagaggaauuuugccccaggguggauuaugcauagagucucacccauuccugauuuggguuauaacacuugggacuuuugagcugaugauauuuaaaugagauuuuggacuuugacuugauacugcacugguugagacuucuggggauauuggcuguaaaguauggcguaugggcuauaaaguacauucuuuggucugaagacauguaacuuggugggggugcaguaccuucuguuccagucaucuuacgguauuuugagcuuuuguaucuaccauuggguaugcaaagcccaauccacuguaaacgucuauuuccaagaauuaccauuuauagcuuccuggggauaguggcaguagcucaguguaguguauuugccaacuauauaugggaguggggggacuuuuuucuggggaauauaugccauagucaucugcagucucuuucucccuuucuggcagacaggauggcucuuucuggaauuuugugcaucagaggguacaagaggaauauaucaauggccagcccaucucugucugcauugcugcauaucucccauaucuuuuuuauuuuuauuuuuggagacaaagucucacucagucgcccaggcuggagugcaguggcgcgaucucggcucacugcaagccccgccuccuggguucacgccauucuccugccucagccuccugaguagcugggacuacaggugcccaccaccacgccuggcuaauuuuuuguacuuuuaguagagacgggguuucaccauguuagccaggauggucucggucuccugaccucaugauccacccgccuuggccucccaaagugcugggauuacaggcaugagccacugugcccggccaauaucucccauaucuacuuauuuuggggacccagauagccaccucaaacaagcaugcugggacauccacuugcugguuccagucaucuccugauccugaaagaaguucuuuugaugaccaucaacauguccuacuuuaauucaccccuuaaauucccauaaugauucucauagagccaugccucauuaaucacccauccauuuauuauuuauuuuguuuacuuauuuauuuuugagauggaguuuugcucuuguugcccaggcuggaaugcaauggugcaaacucagcucacugcaaccucugccucccaggugcaagagauucuccugccucagccucccaaguagcugagauuacaggcauucaccaccacaccuggcuaacuuuuuguauuuaguagaggcgggguuucaccauguuggucaggcuggucucaaacuccugaccucaggugauccaccugccucggccucccaaagugcugggauuacaggcgugagccaccaugccuggcacauccauuuaauagucuaguuuuucacugccugucagccugaccauauggccaggcaaauggccacagcccauucauggguguacauccacacaugaagguuauguuuguuuaguucauccaucauugcaaggagaacaauguacaauugagcccuuugagcugauuuguuguucuuucaucaguuucacaucagucaguuauagugugacagccuuccaaacaggaugcuggcugauuaccuuugaacugcuaucaucuguaaaacaagccacuuuuugguggucagugagagcucuuuguaagacacuagcauuugaacaguaggauguggcaauaggaucugguagcuuuacagaugguuccaaaguugaucuggaagaaaagaggaggccaagcgugaugacucauggcugcagucucaacacuuugggaggccaaggcaggagaaucgcaugaguccaggaguucagacucagacucagccugggcaacauagugagacucccaucucuacaaaaaauaaaaauuagccaggugugguggcaugccucuggugauaccagcuacucauuuggcugagaugcgggauugcuugagccugggaggucaaggcugcagugaguugugauugcccccacuguauucagccugguugacacaaagugagacccugucucaaaaaaaaaaagguuuucuucuauugaauaugguaagugucuucuugcauuccucagcacauucccguuaagccauuuucauuuuguuauugguacucguuagaguguuucucugacauuacccaagacauggauauuuuagguuuuaggauuauguuauguccuucagucauaaagacaguugcaguuaaugcccgggagcaaaccaauaaucgucucucuaaugauguguucuauacuuucuugucuggcccauggucccagugguuacugcuggacagcauucaugggcuuuuugccauaagcuccagucugaguugcagauacuucuaaaaucauaucugaguguauaucguaaggacccaaaggcauuaauugagccacugcaacuuagauaauagccugcuguuguuuagguuuccauucauauguguccuuucagguaguuuuacggauuggauuuagcacuaguccccagauacagaauuuuucuucgcaaaacucaagcaaaccagcugcagugaaugcugcuuguuuacuuucaugguuauguaauaagagcaauuuaauuuuaguugccuguagaauguuaugggugguuccugcccagguuauucguaagaauuucacaguuugguuagacccugggguauuugcuggauuuauccuccagccugugguauuccugugagccaccacuauuuucaaguuagcccuagcuuguucuuagguuucugauaccgucauaaugucaucaguguaguauauuauuguauucuggaccuguaucaagucagaaucccuucgaaacaaauuauaaugguaagcugauaaaugcagauaaaccugcagcacugcaguaaguauaaauugggaucauucccacuagaaggcaaagugcaguuguuuuuuuccugagauugggaccaagaaaaaaguauuuucaagaucaaucaguaugucucucucucuuuuuuuuuuuuuaauugaaacagggucucacuauguuguccaggcuagucuuacacuccuggacucaagugauccuccugccuuggccucccaaagugcugggauuacaggugugagccacuaugucuggcugaguaugucucuuuuagauuguuuuauuuugagaacuucugaaaccaugucagagacugcugaugcuguagaugauacuauauuauucaagucuugauuaucugcugugaguuuucaugaauaauucaccuuuuucaugcacgacacagaacuuguugguaacagcacuccagugucgaacaugucauuaauucaugugcuaaaucucuuuugguccaccaugauacuguuucaaauuaacaaccuaugugagcuggggaaguugcacagauucucauuuagccuguucugacugaagggaaaacuaacaagcuuucugcaguauaguagcugaaguuuucccuggucaaacaucauauccuuccccaaaacauauucagguaauguggaugcaaguacuuccaagauucauucaaacauacuaauuuucauccaaauuuuaauuuaauccuaucagccauuucauccucauauccugucuuucuaguuauugccucugcuaggauuuuaccaauagguuuuggaaucagaggcacugaauucuaugucaggaaccccuggaagguuucuuuuuuaccuucuauuguaccuacaggugugcauauggccuucagucccuacuaggagauuaguuaaaagaaagcccugguucugugucaguccucauccugauuaauuugguagcccaucaccucugaugauuugaacugagguucuucauugucauuuuugcuucccagcuuggugcauucuuugaaauuagggugcauagaguguuuguuuagggcccuucaguguugggggacuaagaggcgcucccauugguaaaccuaacuucugauagugcagcauuaagaccuuuguguuaacaucaguguccauuuuauucaucccaucucuuaguaaccguuuaaaacuucauccugcuugggacuucguugacuaucuguuuuguguuacccauucacuugugauucagucuuauuuucuuagcaucuguaagacccauauuaagaagcugagacaacaaaucugacacauuucuuggaccauugauagauuuugcagcaguuauaucagaugccugccuagcggggccccuucagucacaguauuuaccaugauuuaaagggcauauuaaggaugaacaaacauccugaugaccaugaaguuaauccagcaugguuugcauaugcagcuuaccagcuaugucaucuauggaggagugccacuuggcauuuaaaggaggggaaggaccauuucccuuuucaggguaaacaaauuuuacaguggcuuuuacccaguccaccagacuagcugucccuuuaggaacaaucuauuguguguuuggaucauguacaacaauccaugauuguucaguaauaagguuccugcaucaaccccaagcagacuucuucauucugcaacauucagaaucaaagauacugcucccaaguuagucacucucacaaucuauuuucuuaaauguuuuucaggaacccgaugaauaccaguucacaaggcaagauaacuccuucacacauaaccccugcuuccaguacugucuugguuuugucacccaccauuuggacaauguuccugguggucaaaggccauagauauacugucuguuuuuuucagcauaauuuuccauuggguuuauccuggaggcuaacagccauagcucaagcuaaccaaaauccaagcuuuuugagcaucaggauuuccuuaacacucucucuuacuuucauuuuagcuguuuuaaaauacagcagacugggccaggcgcaguggcucacauugguaaucccaguacguugggaggccaagucgggcagaucacuugaggccaggaguuugagaccagccugaccaacauggugaaacccugucuccacuaaaaauacagaaaauuagcuuggcuugguggcaugcgucuguaaucccagcuacuugaggggcugaggcaggagaaucacuggaacccaggaggcagagguugcagugaucugagaucaugccacuguacuccagccugggagacacagcgagacucccucucaaaaaaaaaaaaaaaaaaaaaaaaacacaaacugcaguggcaauaagaccagcagcuccucacuucugucucuaaaguggggaaagggcaaggguggaggaggcuuucuguaauaccuggaagcugaccgacagaacuuugaugaguacaugaaggcucuagggaugggcuuugucacuaggcaggugggaaauguggacaaaccaagagugauuaucagucaagaagaagacaaaagguggugaucaggauucaaaguauguucaagaacacagagguuaguuuccaucugggagaagaguuugaugaaaccacuacagaugacagaaacugcaaguuuguuguuagucuggacagagacaaacucauucacauacagaaaugggaugacaaagaaacauauuuuauaagagaaauuaaguauggugaaaugguuaugacuuacuuuuggugaugaugugguugccguucaccacuauaagaaggcauaaaaauguucaugauuuggagcuggaagagcucuuuaguuuuccucuuuacucaagucucagugcuauccugcuguuacaguaugguugauuaaaugguuauucuugguguggagguggaaaauggugauuuaagaguuuguuauuccaagcaguuagccuaauuuuaaccuggaaguuuaucauguuuuauaauuaaauuuuugucuuaaaaaaaguggauacauuuuauaauuuccuuugaaaugcaaaucaaauuggaauaaaaaucuuacauguggggaaaaaaguacacguuaccaguggauuguguauuuagcuuguuucucaucauuuugcauuucuuuauguauccagugaucuaaguccuugagauuuuggucugucauuucuaaauuccauugacaacuucuauauguaguaacagcacaguacagcugccgucucaugccauuggugacuguauacccauuuaggcaucagaguuugucauugucugcccugucauucuuccuuuuuugaaacaauguuuuugccaugcuuuaaugaguccuacuuaugauggcaacugugucagcugucccuaagaccacucucaggcucagugagucaugacucacaagacucagaaaagacucaugguuauuguuuaugauagugaaaaguacagauuaaaaucagcaaagggaaaaccacauagagcaaaauccuggagaaaccaagugcaagcuuuaagguaucuucuuccaguggagucacauggaugauguggugaaaucaaggaucuccagagagacagacacaaucggauacauauacauauaugagagagaauucacugggaaauuggcucaugugauuauggagguugaaaauucccaagacaggccaucuggaagcuggagaccuugggaugcugguaacguaucuccguccaaguucccugggaagcugaugguguaauucuuagucugaggcuaagggccaggaaccuggguuuuggugggaaacuagggaguugcugguauaaagccuggaguccaaaugucagagagccuagaguucugauguccaaggacaggagaagaggaguguccccauuccaggagagugccuuuucuuugcuuuuuuggguccuauuugggcucuuaguugauuggauggugucugcucacauugugggugaauauuucucacucaguccaucaauucacauuccagucuccucuggaaacacagaaacagcuauuaguaaugcuuuaccaguucucuagguauuccuuaauccagucaaguugacacauaagugcaucugugaugguuaauuuuaauucucccaguagugaaguguugucaacuaaagaagcuuaccugagccuugguguccaggguuuuuauuggaagucagucacauaggcaagcaguaccuucaugacugcccugagaugcucagauuccaaccucucagagcaaaaucaggcacgaaguauuaaucaugcauccuguuguuugcauaaacuaucuagucaaacugguaccauguggcccaagaucuccagcauacaaaaauacucugaccaggcagaauauuucagaggcucagaauucauuucccaggaguuggccaacggcgccaguucugaagacugacuuuuuugggaauguguagaguuugggcaacccaggccugauguguuacccuuuuucugcacguaaguccauuaaaauaacccaaugcguuugcuugauuacuggcaucucuuuuuccuuggacucuuaaguucuuacugguggaucuuaacugaaaucucuuaacgugaucagccaguuacuuuguucucuucuuucauauucuuuugaaccucuguauuaaacauugcaucaacgauugugguuuauuguaggaagcagauaaugguuugaucugcuauaccuucaucaacugucauuguucuauugggaguaugauuucagugauuuauguucuagaguuauuucauguaguucguguagcuucuauucuucagcagcaugcaccaagguuauucguuauuuacuaguucauucacucauuauuucaauaaauauaugucgaacaccuaauuauuugcuagguacugcucuaggcacugggaccauuugaacgaauaaaacugacaaacuccucuccuuugggaaauuuuauucaagucagcaauuagagaauaaauaauacacauaauaaauaaaccauagaguauguaauaaacuaauccauacuuacagagaaaaguggaguagggaaauaaggaauaaugaugguagcgauuuuggggacuuaaugcaguuuuaaauagcaugacuauggaaggccucacugaaaggugaaauuucagcaagcauuugaaggagaucaggaagcaaguccuuuagauauuuugaaggaagaauguuccagcaaggggaaauagcaauugagaaggcccugaggagggagcuuacuuagcacauucuaacacauucuuugaauagcuaggagucuagcaugguguggaacaagaaugguguaggauguuuguaaggauauuggcuuuuacugugaaugaagugggaagccuuuggaaauuuuuaugccguguaguuacacagucuaguuuucaguaucacuuuggcugcaguguugacaauagacuguggauuggaagcagauaguuugcuaauugcagcaguaaucuagauaauugaugauaguggcuuguacuaggguaguagcaauggagguagugaugauaaugagaccuuggguguauuuugaugaagaaccaacaggauugcuugacagauugaauguagaguaugagugggaaaaaaaaggaguuggagaucauuguuaagauguuuggucuaagcaacugaaagcaugguauugccauucacuacauugaaguugacugcaggagaaacuuuucaaggggagauuuggaauuagguuuuagauaugucaaauuugcuauuuuuguuagauacuccaguuuaugucacugauuauacauccaugccaaauaggcauuuuuuaaguuuaggaaagaagucuagauuugagguauaaauuuggaagucugucagcauauauccuguauuagagccauagucugaaugaguuuaccaaaggaagaguguacccagugaagagaauucugaggacugaguccuggagaugcuuacagaauaaggguuucagagcaaaggaagcagcaaaugagacugcggaaagacaaccacugaagaggaggaagaugaagagauuaggauguccugggacccaaaagaagaacacguuuucaggaggaaggagugaucaaauguguuaaauguuacguuuauggcuucucuucugaguaggaaguaagaucgcauuuugaaagugugaacgagugaggcugagauaaagagagacaaauaaaugaaaagcuccugugcuuggaagucagcacagaccuggguucuagucuuagcuuaguagcuugacuagguaaggguuaguguguacauuuaaguauaccuaccaggcaaggaagaaggccugggaaagauuugaaacaaccauccugagaaauugaagagugaccuaaguagcgauggaugaaagaggccucagaagauucagcugaguuuuuagggagauuccaaugguguuagucaauauguuuguguaaauuuaucuuuagaugugaaauauagaguuaagaggguagagaugaacuugucccaauaccgcguaugagagaggcagaagaaagacuggaguccaaagugauuauaucaugauggaagucaaaggaguucauuuggccuucaucuaaggaauauuuggaacuggagcaucaagaacaaaguaucaaacacaauacucgagaaaggcgcaauaauguuuguaguuaacagagaacaacggugcuuucaucuccaucaaggugagaaaucuucaaaaaaaggaauagaaaucaaggaacagaagacagucugacagcuggagaauggaagaaguauuagaagucauuaucugggccagugcucaaguuuucaagaaacaaaaguuagaacccaaaauuuagagcuugauaagugugacaugucuccucuggcaggaaaaaaaaaaguauacauugcuaacauauggcuuguugagacaguggaaaaguaaauaauaaucacugguaaucauuguuuaauuuguaaaagugugucauaucacuacucaucagggaaaugcaaaucaaaaccacaaugugauaucaucuguauuaguucauucucacacugguauaaagaacugcccaagauuggguaauuuauaaagaaaagagguuuaauugacucacaguucugcauggcuggggaggcuucaggaaacuuacagucaugauggaagggggaagaggcaugucuugugugguaucaggcgaagaaagggcgagugugugaagaggaacugucagacacuuauaaaaccaucagagcuccuaagaauucacucacuaucacaagaacagcgugggggacacugcccccugaucccagucaccucccagcaggucucucccucgacauguagggauuauggggauuacaauucaagaugagacuuggguggauaccuaaccauaucaucaucucaccccaguuacaaugacuuuuaucaaaaaaacaaaaaaaucacagaugcuaaagggaacucuccuaugcuguuggugggaauguaaaucaguauaaccacuauagaaaaccauaugaaaguuccucaaaaacuaaaaauagaacuaccauauauauauccaaaacaaaggaaaucaucauaucggggagacaucuacacccuuagguuuauugcagcacuauucacaacagccaaaauauguaaucaaccuaagugcccaucaaugaaugaaaggauaaaugcgauauauguacagaguggaauauuacuuagccauaaaaagaaugaaaucacguuaucugcagcaacauugauggaaauggaacccauuauguuaagugaaauaagccaggcacagaaagacaaauauugcacauuuuuguucuuaugugggagcuaaaaaacgggauugcaucaagauagacaguagauugguuguuccuagaggcugggaaugguagggggauggggagauggaguugauuaauagguacagaaguacaguuguaauaagaccuaguguuagauaguucaguagggcgacuauaguuaacaaccaccuacuguguauuuuaaaauagcuggaagagaagaauuugaaugucuccagcauaaagaaaaguuaaagguuggaggugaugaauauccccauuacccuaauuuggucauuacacauauggaaugugucaaaacaacacauguaccccgaaaauguauacaacuauuauguaucgaaaaaacaugugccaaaguaacauuucucuacccucuucccguuucucccaccugauucgugucuuccucuaggucucauuuauagcucuggguggauggaggaaaugguuuagacggaaugugucuugauuucaacuagacuuguggucaauuuggagaaaauaaugugagcagaguaccuagugaaguagauaguagguuguuugaagaugggaggcaguuuugugaaguagaaaugaccuuuacuauugaacuuagaugugggaucaguuggugcagggauuaaaggagaugacacucaugguguucuugaucauuaaggguagaaauuuucuuuuucuccucuuguuugcccucuccuacaccucauucccucaaauaaccuaauuaccacaaaacaucgagagggucaaaugaaaggagaacuuuagaucguguguaauagagggugaaugauaaauuggagaggauugggaaaauaaaauauuaaaaagacuauucuucugccugaagaaauaaaaucccauucccccuaauucuucuaugaaagaaauuagauuuaaaaguucauuauuuacuauuuuaccauggauaaauauauguaaauuuguauuucaaaagcuuuuccaugaaaaaaauacauuguauccccaagcauuucuagaacucuucauaauuaugaucaacagauggauuuuuuaaaaggcaucacauuguuuuagucacuguuuuacuacuguuauuuuuaacuuuuuguuuugacauguugcuuuuaacuguaauuaaaaauuauuagcaucuguguuuacuuuuuagcuugcgcauaccuuaucuucauagcagaaacuaauuaguaugugaaauacaguaccauuaaauaugcauuaaugggaagaaauucuaaucugaucagcuguaaaauauguuagaaaauacauuuugguauguacaugguguucauuccaguuccauucucauaacaaauacuguuuuugcuuuugccuccauacgucuuuacuugguuccuuggauguggucagauuacaaauuuaggggguagaaaagucuucccucaugaaaguuacuaagugauuuagaaaaauaacuauuaugcgugauaagccuguuuuaacaaaauagaauguaauaccccacugaaaauauucaaagcacuagaauaucuuuucuauuucuaaauaaauuucauacauacuuuucucuagucuuuuccuaauuucuugacccagaucacuuaacaucuuaaaccacaacagguagauguuaucuucugugaauuucuuucugaacugccuauuaaaaugucugugauucacucucauguuggaggcauguaacuuuuauauuagcacuguuaacuuuauaucucagaacuauccccuuuuucuuuuuccgcugccaccauaguaguccaagccauccucacuucucucuugggguuauguaaugcuuuccuaauugauccuucuuagaagaacgugaguagacuuucacaaacaugucacccccaccccaucacuuucucuaugucccacaccaucacaauacccaacuuacacucuaccaauagcauugguucucccuuacagccccguugacaauaguggauaaccuccacuuuuuccuuaauaucacuuaucagaaagaguaauuauuuaaguuggauaauuuacuuguuuguguuuuccacuagccuaugaacucugugagcaaugggaucuuauuuuuuuuauuaaguuaccuuauaccagcacuguucuuaccaauuagugagugcacaucagcaguuuuuuuuuuaagugaauggacuugguucaguauaucacaaaauagccacuuguauaaugcuuaauuauguauuucauauucccucugugaugcucauuaacuguaguauccccuucucugguuuuucccauuaacacugaucaccauguaaguagaacuaaagcuccaugagagcagagaauuuugucuauuuguucaguguccugucucugaugugcagacgaauacccagaagauacuuguugcauauguguugaagaagucgguggguggguggguggguggauggaugaaugaacucuugcacacuugacaucuuggaauucuuuccuaugauacacaauucaguucaauagacauuuauuagguaucugcuguaugcuuaccauuauguuaggcacaguguauauggaaaucaguaaguucuggugucauuucugcuucugauuuauuuuguuuuacaauguuugcuauucuaauuaacuuaggaacuauaguacgauaugacauuggcuuucaaauugagcacuuaaaacugacuccuauaaaacaaauaagacugagaugauuucauguuuaugcuuuccuucacucguuguuaauuauacuuucuguucagacacaauugaucuuaccuucuuugaaugguugugggaucuuagcuucuuugauuaaucuaguuaucauuaucuuucgaguuuaaggucaaauauuuuuauaaagauaacaaauauaaugcaguguccugauguuuugcuuuucaugucuuucuuccaucuaauuuugauuuucugacaguguuaagaaauugauucagcaagggcuuuauuuaagaucuugccagaagugaagaacagagaugcuguguucguuucagcaguugucuuccuuucguuucuucuuuaagauaguguuacuuuugaaauaugaaacauuaucuccaguucuccauauguugaagaaaacacuaguuugcuuuugauaucaauaugagauuuaugcccaaaguuggggaaaacauucuuaguuuauuuuugguuugaaauauacuuacauuuuaaaaugaucaccuacaguaggaggguugugagcuuuuuuuuuuuuuuuuuuuuuuuuuaagaaaagcacauuaaaccuguagucucuggagcuaagcuaugaggacaaaaaagcaaaagaaggauacaguggacuuuggggaguugggggaaaggauggaagcagggugaggcauaaaagacuacacauuggguacagcauaugcuucucaggugaugggugcaccaaaaucucagaaaucaccacuaaagaacuuauucauguaacaccaccugcuccccaaaaaccuauugaaauaaaaaaaaauguguaacacccacgcccccaaccaaaggaaaaaaaacaaccuguagucucugcuacuugggagucugaagcgggaggauuccuugauccucaggaguuugagcucagccugggcaacauagcaagacccuaucucuaaaaaaauaaauaaggaagcauauaaggcugggcauggugccucacaucuguaaucccagcuacucaggaggcugaggcaggaguaaugcuugaguccaggaguucaagguuacagugagcugugauuguaccacuguacucuauccugggcaacagagcaagaacuuggcuuuaaaaauuaagacgcaaauuaaaaagccacaagcagaaagguauauauuuuuauacucuguuccuuucuauuucuaaaauguguaauuuagaacuaaauauugcauguguauucuguguucuaauaacuaauuuauuuaaaguaggagacuuuuaaauucuuugauauuuauugggaaauauauccuuucaucccccugaauaaaauguauuacaaacauggagauauuaaauuaccucaugcagaaauauuaguugauaaauuguucccuucaaggaggaaagcucaauauuuaauuuucugugucccugauaauuuucugacugauuuuuguaucauuauugauauacuuugauuaaguaugagugaauuuauaugaacuuauacaaucaucugaauuaaaucauuaauuugaguuuuuuuguauuuugguggagagaaugcugagugguaaaggaagcaugccacuguguuuuaaaauccuuuucaaucucugggcuuaaccucuuccaauuuuagagaaauagugaaauuauuauuaucagugcucaaaacauauauugaagguuugcuuuuuuucuuuuguaggaugaaguggcacacacucuaacugaaagcagaguauuaaagaacacuagacaucccuuuuuaacaguaagugacuagaggacagauguuauaaucguaacauuugaaauuuaaggaauuuuauguuagaaauuaaauugugaaaaauacuauucauuuagauaucucauuuucuuuguggaaagaacguaagucaaauuucuuauaacuuauuagaauguauggauuuuuacaguguguaugcauugauaauuccucccauuaugcauuuauuacuuuuuugagaauuuuuuuucucccaugaaucucuugccauuaaaaacaaaaacaaaccauagaguuaauacauuaccucuggcauuuuaaggagacuauugaggaaauggcugauuuuuaaaaauuucuuaaauguaaagauuuuauguuuguuuuauuggcuucugauaaauaucuuaaugaucagaagcauuucuucaaauauggaaggcagaaauguuuaucgaauauauuuuauagaaaugagacuucuuugagggauagaguacuuuaagaaauaugggaaugcuaaauacauuagaggugggauaagccaugcuacguuuuuuucacuagacaaaguauaaacugauuauaugguaugccuacaacuuaguugucuugaaagaaacuggauuuuuuaguucuguucuuagauuccuuguaauauagggauaauugguaaaguuucuguauuuucuugguuccaaugaacuauauugagaugaaaaauaauagcuagacuuuccaaaguggaacccuuuacacuguuuggaauaucugaaauagacauuuucagagcugucaguagauaccuagacuuacuuugcuaccuuuuuugguguguuuauugucuaguguaauaagauagcauuuggguauuuuuuaauaaccuauauauaaccuacaaaauuauauaaaccaacucuguuagguuggguucuguugugcacucaauaugcaaaaagugauguugucauuguauuagaaaccugaguguaacaaccguagcuacauuccuaaggaacuucaacuaguguaauuuguuggccacgcugugagguugcauggaugagaaccuugaguacuaaugcagcuucaaaucaauggcaaauuagauugagaagugcuuguugcaauuaaguuuacuuuuacuugaaauuuuaauuuuaguuuuucuuguaauaauaccuauugugaacuaaacauuuguuuuauguuucucauaaacucuuaagcacuuuuaaguaguaaauaaacucuuaaacaauaacaauucuuuucaucuuucaugcuuacuauuucuauguguucuauuuuuaguacuauuauaauuauaagaauacaggauuauaauguaacauuuuuucuuuuuuuuauuucaaguccuugaaauauuccuuccagacaaaagaccguuuguguuuugugauggaauauguuaaugggggcgaggugagucaagaaguaaauccaguauuugcaugguaguauuuucauuauuuuaaaaacauuacuuaaaauacaaguuacaauauagcaguucuccauuucuugauaggaauuuauguagcucuuaauacuauugaacaaaugggagcgaaauuauuucugaugagauguaaugauuguuuuuauauaacuacauuuauauguuggaaagcauaaucauauucuucuuuuuccuguguuuuuaaauguaaaaaguuuuaacagaaguaugauuuuugaaaucauguuauuaaauuuugaaaaccagaaauacaagauuuauuguuucacaaaguuucuuuucaaguaggcugugaacauggucaaaaguuauuuuacccauucuaaacucaguggaacaauaguccaugggcacauuauggcugaguuuucucuucuuuauaguagaguacuaugacuauauauauauauauguguguguguguauguauauaugaggguguauauauauguguauauguguauauauauguauguauauauguauauguauauauauggguggguauauauguguguguguguguguguguguguauauauauauauauauauaauuuuuuuuuuuuuuuuuuugagauggaguuucgcucugucgucaggcuggagugcagcagcacaaucuaagcuuacuaccaccucugccucccggguucaagcgauucuccugccucagccccccgaguaguugagacuacaggcgcgcaccgccacacccagcuaauuuuuguauuuuuaguagagaugggguuucaccauguuggccaggauggucucgaucuccugaccuugugauccaucugccucagccucccaaagugcugggauuacaggcgugagccaccacgccgggccuaccaugacuauauuuaagagacugacaauauuuuggagauaaauuuaauauuuuuauuagcacauuucacucauuccuuuauuccuucuccuuucucuuccuugguuuugaucacagucaaugugagggaaaaguaaauuuacuggaaaagcuaacuggaaauauuuuuauugugggcuuucugaaauaaauuuaauuauuaaauagggucuuguuugugucucaugaacuuaaaauauucuuauuuuccaaaauaaauaauuaaauauccuuuauggaauuuuuuuccuguagaauuaucugauuugcaggaauucguuuguugcaaaacuucauucauucagggcuugcaugguggcucagacuuguaaucccagcaguuggggaggcugaggcggguggaucacuugagcucaggaguuugagaccggccugggcaacauaguggaagcuugucucuacaaaaaauaaaaaaauuaccuggacaugguggcacacacccagcuccuguacucccagcuacugaggagcugaggcgggaggaucacuugagccugggaggucaaggcugcagugagccauggucaugccacugcacuucagccugggugacagagcauuaccuggucucaaauaaaaaaaaaaaaaucaaaacccaaaacuuaauucauuaauuugguaaacacauuuugagugccuaggcaguauggguuuaugaaaauguguuaagauauuauccuugcugugaaggaguauauaacuucccuuaguguauuacaaauuagaaugcauagugaaagaccuaacuucuaauaaagucauaaaagaaaaugcuuuauggaugaucuagcacuuagaguaggcuuaaugagauuucacccagggaauugauguaagaaguuguuucaggcagagaggaugggaugggcagaaucacugguggaugauaggacaagauaauuaaauaauaauaacccaggaauacagaacugggcccuugcaguaagaugucugagaaaauacgaagaaaauggauguuguggaacuguaggauugguacaucuuuuuuuuuuugagauggggucuggcucugucauucaggcuggauuguaguggugccaucucugcucacugcaacuuccaccuccuaagcuuaagcuauccucccaucacagccuccuguguaacugggacuacaggcaugcaucaccaugccuggcuaauuucuguauuuuuuuguagagauaggguuuugccauguugccuaggcuggucuugaacuguuggccucaagugaugcacccacgucagccuuucacagggcugggauuacagacgugagccaucacaccuggccauauuguuacaucuuaaugaccaauuaauuagaucuugguagaaacaaaaagguacaaugaaaagugauuuuugguuggaauuugggagccuuagcagauacagugcaauuaugaagaacauguuaaccuuauaaauuugguuuugaaacaguuuuucguaagcuuuuaaaguaauguauguguggaacuaugauggagaguggauaaagagucaaaacuguggaugcaguuuuggcagccauucccauaaagauuauaauuuaaguuauggggguggaaaugaaauugaugaaaccucuuacaucaguaucuaucaaaauuuaaaaugcgcuuauacuuggacucagcaauuucauuucuaagaauuuauccuacagacguacagaugcaccacagaaugauauauagauaaguauacucauugcagcauuguagcauuuuaaaugagcauucguaaggagucugcuuaaauaaaguuacauucaugcaguggaaucucuauauccaucugaaagaaugagacagcccaauaugggcauuaauagaaguuaaaaaaacuaggugcagacgaguauaaagcauacuucuguuguguuaaaauaaaauuagaccguaaacauguguauauauguuugucuauugaucgaguaucucugaaauuaugcacuggguauuagugcuugucuuugggaaaauaaacugaguggccagggauaagauaggaggaagacuuuucauuuauguauuuuucaguaucuuuuguguuuugugccacauacauguauuaucuaauaguugaaaguagacagacaaauaaaugguuggaugaauggaugaccaagggaaacaguaagacagauaaaacaguccgcagacaaaaacuuggaaaaacacuauuaaaugucucucuuuuuuaaacgguauuguguguucaugucuauaguaacaauuuucacauuguuuuacaauuaccuauuuacuugucugucuuucccaucaaaguguuagcuuucuaagaggcuuguucacgguauaacccuagcaucuuauucacugcuuguacauaguuggugcuucacaaauauucauuggauuauuugaaugaauaagugaacaaauggaugaacauucccucagggauuagggauaagagaaguuagcuaaaagggguaaaauaggaacuacugaggaguaggaagaaaaauagaaauugauguaguauacaguuuauuuuguuaaaaaagcugaaaguguaaauuuaggagaggauaucuuuuuauuucaaaaauacauauguauuaagucuuuguggaaggcacucugguagauaucuagggcauagaaaucugaauuaaacauagaucuugcccucaaagaguuuauagucuacuggagaaaggguacaaaaauaauacuaagugugaaauaauuaucacuucuaucauaacagauagauagauggugggacuuuggugggaugagggaaagcuuccuagagggcgcuaccuggcaucugcacuucuuuucuaaacccggaguacuuaaagauuaauuaauugaugauuauugaaaaaaauuuuacacuaaaagcagauuuucagauuagccagaugauuuucuuuagcauuaauacuccuacauuauuuuucuuguucagcauaucuuuguuuuucuucagaauuucuguuuuggauugggcuauagauaaguauuauuuaauauuuugaagcaagugaacugauucucuagggucucacuccaucacccugucuggaguacagugguacaaucucggcucacugcaacuucugccuccugggcucaagcaguccucaugccucagucucccgaguagcuaggauuauaggugugcaccaccacacuuggcuaauuuuuguauuuuuaguagaaacgggguuuggccauguuggccaggcuagucuugaacuccugaccucaagugaucugcccaccucggccucccuguaugugguguauaauuuuaacaugcguagguaauuacaguguugguacacacacacacacacacacacacacacacacagaaaaugaaaaguuauuuauauuuaauaacuuuaguaggaaauagaauuuuauauauuuaaccucacaauuuuuuuuuuuuuagauuaucagauguauuuuaaaauaguuauuuaguucuuggaguauaguaggauuauuucaauucuugauuuaucaugacuggggaggaaaucuaugcuugauguguuuauccuuguggcaacuuguuuaauuuugguuuugcuuuggguucaccuugccauuuaugcugcccagggaugccuuauaaaaaugcagaaaacgaccaggcgucguggcucacaccuguaaucccagcacuuugggaggcugaggcgggcagaucacgaggucaggaguucgagaccagccuggccaacgugaugaaaccccaucucuacuaaaaauacaaaaaauuagccgggcauggugguggaugcuuguaaucccagcuccuugggaggcuaaggcaggagaauugcuugaacccaggaggcggagggugcagugagccaagaucacgccacugaacuccagccugggugacagagcaagacuccgucucaaaaaaaaaaaaaaaaaaaaaaaaaaagcaaaaaacuuaauuacuguagaaaaaguauuaaacauaguaguuauauuuuugaaauagguuuaaaguaagggaaacaauaaacacacguaaacaauucacacuagcacaauccacacauauaccaagacucagccagugggguaggaucuguauggcaucuaaggacuugagcgugagaauacuggccuuuuguaagcaagcucugguaaguucauaauaccaaaauggcagcacacucaaaucuuuuuauaucaaguuuuugcccuaagaugagcuccuuuaguggccucgcugaaauaacuagcccaauuuuuacucaauuuaugcuuauuguucacugauuuuuaauuaacaauagcaucuucuucuuagucuaugcucuagaaaguuuaccuugaauuauaauuugaguuagggguuuagcaugcucuugauuaugcuugugauuuuuauguguuugucaauauaagucacaugccauguagcaauguugaagucaaugauggauagcacaaugguaguccgauaagacaaacaugcacagguuuguagccuaggagcaauaagcuauaccauauagcccagguguguaguaggcuauguugucuagguuuguguaagucacucugugauguucacacaaugaugaaauugccuguauuaguucucacacugcugaaaagaacugccccagacgggguaauuuauaaaggaaagagguuuaauugacucacaguuccgcagggcuggggaguccucaggaaacuuacaaucaugguggaaggggaagcaaacauguccuucuucacauggugacaggaagaagugcugagcaaagggggaaaagcuucuuauaaaaccgucuugugagaacucgcugacaaucacaagaaucacauagugguaaccacccccauaauuaaauuacgcaccagggcccucccaugacauggggauuuugggagcuacaauucaagaugagauuuggguggggacacaaacuauaucauucugcuccuggccccucccaaaucucauauccucacauuucaaaacacaaucaugccuuuccaacagucccuuaaagucuuaauucauuucagcaauaucccaaaaguccaaguucaaagucucaucugagacaaggcaagucucuucugacuaugagccuguaaagucaaaagcaaguuaguuacuuccuagauacaauggggguacaggcauuggguaaauacacccauuccaaaugggagaaauuggccaaaacaaaggagcuguaggccccaugcaagucuaaaguccaauagugcagucauuaaaccuuaaaguuccaaaaugaucuccuuuaacuccgugucugacauccagaucaugcugaugcaagaggugggcuccuauggccuugagcagcaccaccccuguggcuuuguaggguacaucccuccucccagcuacuuucaugggcugguguugagugucuguggcuuuuccaggugcacugugcaagcugucaguagauuaccguucuggggucuggaggacagugacccucuucucacagcuccacuaggcagugccccaguggggacucugugugggggcuacaacaccacauuucccuucugcagugcccuagcagagguucuccaugaggacucugccccugcagcagacuggucauccaaguguuuccacacauccucugaaaucuagguggagguucccaaaccuuaauucuugucuucugcacaccagcaggaccaacaccacauggaagcugccaaugcuuggggcuugcacccucugaagcaauggccugagcuguacauuggucccuuuuagccacagcugggacugaagcaguugggaugcagggcaccaugucccaaggcugcacagagccggguuggggggcccugcuuuugggcccuggcccuggcccacaaaacuguuuuucccuccuaggccucugggccuaugaugggaggggcugcugcaaaggucucugaaaugcccugaagacauuuucuccuuugucuuggugauuaacaucuggcuccuuguuacuuaugccaacuuuugcagugggcuugaauuucuccccacaaaauggguuuuucuuuucuauuguauugucaggcugcaaauuuugcaaacuuuucuucuccgcguucucuucaaugcuuugccacuuagaaauuuccuccaccagauacccccaaaucaucuccuucaaguucaaaguuccuuagaucucuagggcaggggcaaaaugccaccauucucuuugguaaagcauagcaagagucaccuuuacuccacuuaccaguaaguuccucgucuucaucugaggccaccucagccuggacuuuauuguccauaucacugucagcauuuuggucaaagcuauucaacaagucucuaggaaguuccaaacuuucucacguuuuucugucuucuuuugagcccuccauacuguuccagccuugccuguuaccugguuggaaagcuguuuuuacauuuuuggguaucuuuacagcagcaccacacucucugugguaccaauguacuguauuaguccauucucuguucucaugcugcugugaacugcccgagacuggguaauuuauaaaggaaagagguuuaauugacucaguucugcagggcuggggagaccuuaggaaaccuacaaucguggugaaaggggaagcaaacauguccuucuucacauaggagcaggagagagaagugcuaagcaaaggaggaaaagccccuuauaaaaccaucagauuucaucagaacucacucacuaucagcagaacagcauggagauaaccagcccugugauucaauuaccuuccaguggaucccucccacaacacauugggauuaugggaacuacaguucaagaugagauuugggugggaacacagccaaaccauaucugccuaccagcaaguuucucaggccauaucccaguuguuaaguaaugcaugacuguauuuggagcacuaaaaauuuuugaugaaagugaauugugaaagaaauguuggcugugaaaaaucagcccuaacuucuuacggucguauugguacaauggaauuucaucauaguugcauguaauuuauaugaauucaaagaagugggcucaauaagauauagcugagauagacaaguugauuuaaaugaugugauuauucugcucuuuuucucaauuucucaaugaguguauuuacagagugaccuuaggaugagagauauaaauuugcuauucuuuacuccuuguuacuuccuacuuuccaugcauagagcuucauggaauauaaacucugguguuuuaaaauacaaaacuuacauaaaaugucauugagugcauuguaacugcagguguucauuuaaagaaacuauuuucuggccaggccugguggcucaugccuguaauucuggugcuuugggcagcugagauaggaggauugcuugaggccaggaguuugagaccagccuggcgaacauggugagaucccgugucaaaaaaaaaaaaaaguuagccauguauggugauguguaccuguaguccuaguaaauuaaucaggaaagcugaggugggaaguucacuugagccgaggaacucaggguuauagugagccaugguugugcuacugcacuccagcgugggcaacagagugagacccugucucuaaagaaaauaaaagaaaaaagacuauauuauuguaccaaagauagaaaacuguccuggguuuaacuaugucgagagaugacaguauguuggucuccaguguaauaccguucuaaggaauguuugggagugauuugauuauuuuugauaccuuauggauuaacuuuauaaucuaguacauuaucauucaucuauuaaauaaugagcaacuucugugggcuagaccucagaagauucauaaauaaggaaaacauacuauuuuuccuuugaugagugacuuacuggggagauagaugagaaaauacuuguauacacugcagugacaugguugcucugauaauacugguuacugugcauggagagaaugagcacuuuaaugaaccugaggagcagaggaaaggaaagcaaagggugccagaguaggaaacucuucuuaaaaagugguugcuaggcuaagacguaagaauaacuauacauuauaucacuaagguugggaaggagagcauuccuacacagguaaaauggcauguguagaguacacaggagcagacagguucccccacccaccgaauauagcacaguguggauaaugcauagaguucugcagaggaaagccagagagucugcacagguagucagaaucacauuaagacagaucuucacucucaagucauuuagaugaaggcaguggagcaucauggaagaauuucuuugggggaaauguuuagaaagaauacuuggcaguauagagguugaaguagagaggacaaaaguggaagcaaggaaaauacuugggagguugcugcaguuagaagguuuucaguaauucacuuauaaaaaugauaagguugucggaugugguggcucaugcuuggaaucucagcacuaugggaggcugagguggguggaucaccugaggccaggaguuugagaccagccugaccaacauggagaaaccccgucuguacuaaaaauacaaaauuagccaggccugguggcgcaugccuguaaucccagcuacuugggaggcugaggcaggagaauugcuugaaccugggagguggagauugcagugagccuagauugcaccauugugcuccagccugggcaacaagagcaaaacuccaucucaaaaaaaaaaaaaaaaaagauuauuaauugaagcaguguuagaaggaagcaaauucuaguaauauuuaguuauuagaaucaccaggauuuaaugaauaaauaugcagagaaguaucauaugauuuccuguuugcugcuuggggaauuguggauacuggaguauuuauaaaaauagaaaacacagggagaagaaugaguucuuaagcagaucaugcuauauuugaggcaccuaguguggcagccaaggaguggggagaguuaaaucagagauacaaauaggcaucaugagcaguguuaaaacccaggaagugaggaaauauccaaugugaggaaaguauguacaguuagaacaucaguggccaaggauggugccuggaaaugccagaguaaggcaugcuguagacacagcuguagaugcagugagacuagugcacagguguagaggcagagagaagccuaaggaggauccugggcaggaggagccagacaagagaagccuuagaaguuaaggagagauuagguacaacagaguauauuaaauacuguacaaugauaacugagaauuguccauuggauuugccaucuaauaguuccuauggagacuaccagggauucuuccuuuucugguuugguacaagguaugcaccuuggcuguaguacagaauguaaaaggguugguuuggagcccaguagaacaagguuguaagagugaguucagugcaauuucaguggggcauuuguagaacugauuguaaaaucucucuaauaauaugaccaaucacacugcuaauauauccaggcagcucucuuuuuauuccuuaaauguuacuaaauuuacaugagaagcagaaaaauauccugggagaauaaaguagacaaaauugacuaaggagguguuuuuguuuucuuugguuuaggaagucucuacuuaggacuuguuuccaaaaucuuacucauagcuucauuuauuucaggcuuauuuguuggaccucugcaaaucucucucaagucugaaguuuccugaaguuaaagauucauuaggggaguaaaggaaaaucauuguguagaaaugcuauucaucugauaaauucuucacauuccucuauuuucuuuauguagguuguaaugaagcuaacaguuucaguuauguacuacuauuuuuguccauacuuaguucauuguaaacucuauauuaauuucuuugauaacauguauuugauuuuuuugcaauacggcuuucagguucuugccauucuugagauucucaugcuuauucagauuucucauuuggcuggcauuuuguuaucagugaaccaaaauuaucucauuuuaaauucacauaagacaaaagcaccaguagucaguauucuaguucuccuuacuaauuuacggaggugugaucugggugauuuuuaaauuaauuuaauuaucauuucauauucauagugaugauuuuuaaaauuuuacaaaguuuucagguauauaaacaucuuuauugucaggugucugacaagcuaauuucuuugcuaacuauuuuaguuauuaauauauuauguagguuguaucagaauuuuguuuuucacccaaugcuuuuucaaaauucccaagucaagaaggaugcauuacaauguuuacauuagcaucuaaaggcaauguaaagucgggaagcauuuuuaguauauaauuucauaauucaaagacauuuuuaaaaaaugaaugguuaaaccaguaucucacugcauuaaauguaauugaaugcauugaauuuaguuauuaggagauguuauuacaagccucaacauguaacaugcuugcuuacaaaucuaaaaucucagaucaaguggcuggaacugcaggggccugccaggcaucuggguauuuacaugauuccuuuccaugugguuauggcagagcauggccauuucaagguagucaaacuucuuacacaaaggcuggcuuaccacagaguggguauuucaagggagggaaaacagaagaagcaacauauguauaauuggaaacccugaggaggaaaaagagggcagugacacaaaacaguauuuaaauaucaaaaacuauaaucugaaaacauacuuacaggcuuuuguguucuccauuuuucacuuagcauaauacuuuuaaaauuuauagauacuguuccauauaucaguaguuuguuucuuuuuauggcuuugcuccguugugugauguacagucauauguuuauauaguugccccuggauagacguuuggguucuuuacauuuugggccuauuagaauaaaagcucgugaauauuccaguacaaaucugugugugaauauauauuuuuaaucuucuuggguaaauacauagaaaugcaauuucugugucauuuguuaugaucaacuucauuaaaaacugcagacucuuuucaaaaucagccauaccauuuugcauucccaggauguuacuugacaacaucaccacacuuggcaugguagucuuuuuaaauuuuacucauucugguggauguauagugguauuuuuuagcuucaauuugaauuucucaaauaacuaaugauauugaacuucuuuucuuauucugauuugccauuuauacaucaucuuuuuugaaguaucuuaaaaucuuuugucuguuuuaaaaauuagguuguugucuuaauauugaguugucagauuuauuuauuucauguaagggcuuuaucauauauauauuuuauaaauauuuucucccauuuuauaguuugucuuuucauuucauaaugggaaauuguuccaaaauacacuuuuguuguaaucuauuguaaucagcauuuuaaugcauaguuagcauucaguaaaauuaaucaauuuugacuguacaauuuagugaguuuugacagcuguauaaagcaguuucccaucaccacaaucaugaucuagaauguuucuuucacaacagagccucgcaugucucuuuaaagucaauucucuccccucacucucacccugaaaaccacugauaggcuuuccaaccaguaugaagggcagacuucuaaauuagaggaaacacaauucauugauuauuuucucuuaugauuuguacauuuuguuuuuaaaacaucuuuuucuaacugaaguuuguuaagauuuuuuucuaaagucaaagcuagaccuguugggugguggcaggucggggagauuuucuuuuaugcuuucuucuagaaguguuaauaguuuuagcucuugcauuuaggucuaugagccauuucaaguuaauuuuaauguauacugcuacauaagggucauguuucauuuguuucuugcaaagugauaucuaacuguuccagcauauuuguugaaaagacugucuuucucccauugaaugauuugguacccuugucaaaaaucagucauauaugugugggucgauuucuggacucugcauucuguuguauuggucuauaucuauccugaaaccuauaccacacugucuucacuaugccacacacuuacuuuagaauaaguguuaaaaucaggcagcuugaaucuuucaauuuugauauucuuuuuaaauuugguuuugcuauccaauuuccuuugcauuuccacauaaauuauagaguaagcuuguugaauucuacauaaaagccuccuggauuuuaauugugauuguguuaaaucuguugaucaauuuggggagaauugacaguuucacaguguugucuucugauucauaaauaugguauauguuuucccauuauuuaagucuuuaauuucuuucaacaauauuauguaguuuuuaguguacaggucuugaaaguuuuaaaaauuuauccuuagggauacuuuauaauuauuuuauguuuuuaaguuauaaaugguuuaucagucauuauuaaaaauuucaauuuguaguugauucuugcuaauauauagacauacaguugauguuuacuuauuagccauacuaauauuaguuuuaguagucuuuuauuguaaauauauuggauuucucuauguagaugaucaugucaggugagaacaaagacaguuuuacugcuauuuucuaauauguguacauuuccuugccuuauuaaacuauccaggauguuuagaacaguguuaaagagcaggauaagagcaaauauccuugcuuuauaccuaauuuuagggcagaagcauucauacugucaccauuaaccauguuguuagcuguagauuuuucguagaugcucuuuauuaaaaguugaagaauuucuauuaguaauuugaugaguuuaaauaaucuuaguuugauuagcucugcuucuuuguucuuauggugguagcuuuaggguuuagaauauguaucuuuucucaucacgguagacuuucaaacaauaugcugugucacuuuaccuguacuguaagaaccuuauaacagcauacgucuauuuucuuaccuucuaucugaaccuuaaaaggcauacaucuguuucccugccuucugucuuuugugcaguuguucucagacauuuuacuuccauguauuuuuuaaccuuuacaauacacuguuuuugccuuaagcaauuaucuuuaaaauaauuuuuaauagaaaaaauguuuuauauucauaaaguagucauuuuaaguguucucuuuuccuuuguguugguauacauuuucaucuauuacauuuuccuuuugcauaaaaacuuccuuuagcauuuguuuuuguagugcaggucugauagccguaacuuuuguuagcuuuuauuugugugagaaaaucugcauuuugucuuaagauguuucccuuucuuuaaaacaguuuugcugaguuaauaacaaauuauaaauaauuuguacauauuuaaaguguacaaucugauaacuuuugacccaugaaaucaucaccacgauaaaaauaacauccccacaaauguucuccuauacaggagauuuuaggaggaaaggugcauuugaacuaaaucuucaagaacagguauguuccccaaauaagauuagcucauucaaucaaaaguauguauuaaaugcuuacugcguucgcuaggaugaauaaaacagucaugauuucuagaaggagaugcauauuauaaaauaauaaaacaaaauaaacccaauaaauauaauggcaacagagugcuguaguaugagagagaaugauggagaaccuacuauaaauuuaguuaucucuuugaggaaguaguguuagguugacauuugaaggguaugugggaaggaacuuccugugcucugaugagagaagccuguugagcaugagacuuuagggcacggcuguagaugcagucaucuuuuugcaaggaugggcugaauaccuguucacuuacuaaaccgugggaguacagcuacacucuagugcaguuccuguuaggcuauuaugagagagaguuauggagaaaauuucuuccuaauagaaugaugaaauaugcuuguauauuuaguaguuugaguuaaugcauuuuacauuacuguauuccuauagcauggcuaagcuuaacaauaaaaaaaaacuauguagucuuugccuuuauaaaggaacuuaacuugauaaagauaagcucccuauuuuagcagcaaauaauucacuuuccuuuuugaacaaagauaagauuauucaacuauuauauaugauuuuuaauacuuccaaugaaaauauuuuaccucaaaaaccuuaaggaugauuuuucuuauaauuuuuugagagguauuucugaauuuaauuuuauuuuuugcaauacauauuuaugaagaauauaauaugugucauauacuaggcauggugcugaagaugcaaagauaugguguacugucauaauuuucucauuuuccuaugccuuugccaagaaaaaaauagagcauuaaauuuauaauaagcauaaaucaguacauuaauuauuaguacauuuauuugaaaccuuugaauaauuuuuuucuauugcaaaagugauaauguacauucauuacagagaacuucaaaaagccaaaaaaauuauuuuaauucugucaaaaaaguucuuauugaaugcugcuuucuucaaggcaggcacuguacuaugugcuuaguauacuacaugagcaagacagauggucucugcauuuaagaagggcauaggccaggcccaguggcucaugcccagcacuuugggaggccaaggcaggaggaucacuugaacccaagaguucaagaccagccugagcaacauagggagacccuguaucuaccaaaauaguuaaaaauuagccaggugugguagccagugccugugcucccagcuacucgagagacugaagugggaagauugagugagcccaagagguugaggcugcagugagccaucaugcgacugcacuucagccuuggcaacagagugagacccugucaccaaaacaaaacaaaacaaaacaaaaaugcauaguauucuggggaauggauauuaaauaauuacaaguauuuuuugagguaugaaacagaagauaaaaaccacucuaaaucuuaccaucuagaaauaauugcuaauaccguguuaauauauuuuccacuguuuauacuguacacauauuuucaauuuuaucauuuuaaaauauguuacuuguugccuacuaauuauguagauacacuuuaacuuauuaaaaccuucccaaaucauugaacguuuagguuguuuucauuuuuuagucaacuuaaguauaauuuacauauaaugaaaugaacucauuuuaaguauaugauuagaugacuucugacaaacauauauaugcauguagcccccaucacaauaaaaauauaaaacauucucauugccucaaaaaguucugccaugccucuuugcagucagucuucccuguacccauaguacauccacacguggcccuagguagccauuggucugcuuucagacacuaaagauuugauucaucuuuuuaaaaaugucacagaaaugaacucauacaauauauacugucuuguaucuacuucuuucauucugcguaauguuuuuugagauuguuaacuuuguugcauuucucagucauuuauuucuuuuauugugaagucauuauccuuugcacagcuauaccaccauuuguuaaucucucccacuggugacguacaugcggauuaauaccagucauugccuaauaugaauaaagcugauaggccuguuucuuuucucuuuaauuaauacugaagaguaugauuguuggauuuaugguaagcauaugcuuacauuuuacaaaaauuuaaaacuguugugucauuuuacagucucagcauuaauguaaugagaauuuuagguguucugcacccucaccagugcuugcuguggucagugguuuucauuuuagucauucuaacgagugugugggaguauguuacugugguuuuaaguugcguuucucuuaugacuaaugauaggaaaugucuucacucagacuuuuugccauugcauauacuuuugugaccugucuauucaaauauuucaccuauuauucgguuguucaucuucuuacugaauuauaggaguucuuuggauguucugguuacaaauaguuugccaaauauuuguauuacaaaugguuucuuccagacuguagcuugccuuuucauuuucucagugaugucuuuugaggaacagacguuuuuaauuuugaugucuuauuuaucaauucuugccuuuuaugguuuucacuuuuuuuguguacuguccaagaaauguuuguguaccccaggucacacaucuuucuccuauuuguuaugugucacgugcuauauaauaaguuucugucaacagugggccauguauaugacaauaccauaagauuauaauguagcugaaaaauucauauugccuagugauguaaauguuguaagucauacugcagugcauuacucacauguuuuggugaugcugguguaagcaaaccugugcugccgguuguguagaaacauagcacaugcaguuagauacauaauacuugauugugauaguacaugacuguguuacuucuuuauuuuauauauuguacuuuucauuguuucuuaaaguguauuacuuucacuuauuuaaaaaaaaauagguaacuguaaaacagcaucagguggguccuucaggugauauuccaaaagaaggcauuguuagcguaggagaugacuacucgaugccugcuccgaaagaccuuacagugggacaggauguggagguggaagacagugauacugaugauccugacuguguagguuuaggcuaacguauaugcuguguuuucauuuuuaaccaaaaguuaaagacguuaaaaaaaauagaaaaauauuuauaaagauguaaagaaacaauauuuuuguauagcuguacaauguguucauauuuuaaacuguuauaaaagagucaaggcguuuuuaaaaauuuuaaaguguauaaagugaaaaaguuauagaaagcaaagguuaacucauuacugaagaaaaaaauaauuuuaauuauuuuauacauuauacaguguucauagucuacaguaaucaccuaggccuucauauucacucgccacucacucacucaaagcagcuuccaguccuacaaguuucauucaugguauuauaaaugcaauagacagguauaucguuuuuaaaucuucuauaucauauuuuuacuguacuuuucuagauguguuuagaugugcaaauaucauuguguuacaccugccuagaguauucaguaggguaacaugcuguacaggucuguaccuagaaguaguaggcuaugccauuuagguuuauguaaguaaacccuaggauguugucacaaugaugaaauugucuaauugcacauuucucagaauguauccccaucauuaagcagugcaugacuguauuuucuucuaaaacuuuuuaaguuguaccuauuacauguauaggucugugauccauuuuaauuuuuauguaugcugugagcuaagaguugagguucauuuuuuucccccuacagacaucuuguucuuucacuaucuuucauugaaagggcuguccuuuagucagacaugggggcuuauaccuguaaucccagcacuuugggaggcugaggcaggaagaccacuuauguccaggaguucgagaccagccugggcaacacagcaggacccugucucuacaaaauaaaaaauuuaaaaaauuagccuggacugguggugcaaggcagaauugggagcauugcuugagcccaagagguugaugcugcagugauccauguucauaccacugcauugcagacuggacaacacagcaagacccugucucugauugugugacuuggguaccucuguugaaaaucaguuugucacacauaugggucuguuucugcacugucuuauucuguuuaauugaucuuugaguuucucuuuacaucaguaccacgcuaacuugauaauuguugcuuugggaguauauuuugaaauagagaaaaacuuuguucuuuuuucagaauuguuuugacucuucuguguccucugcauuuucauauaaauuuauuaucaugucaauuuuuacaaaaaagucugcuguaacuuugauuaugauugcauuuaauccauaaaucuauuuaagaauauugagucuucuaauccauggacacacacucuguuugcuuauggauuucucuaaugucuauugaaacacuguaguuuuaguguauagguuuguauaauuuuucaauuuuucuuuaccuauuccaauuuuuucccauuuacaauuguuugcuguuagcauauaagaauauaguugguuuuuauauauuaaccuuguauuccauggccuuccuaagcucacuuauuaguucuagaaacccuuuuucuaaauuucuuugaaaugucuauguagauagucuugcucuuuguaaauaauagcaguuuuacuuccauucuuguuuguauggcauguauauauuugucuguuuaauugucuaucugucuaugcaucuuucacugccugugacugcuagugcaguguugaacaaaaguagcgaacauuguguuuuuguucccugucucggaaaagauuaagucuuuuauuauuaagugugauguuagucauaaguuuuucauauauaccuuuuauuagguuaaguucucuccuauuccuagaauauuuuaccaucaguggacauugacuuuucuuuaaagguuuuugugccuccauugaggugaucauaugguuguuuauuuagacacggagucucacucugucgccuaggcagaagugcaguggcgugaucucagcucacugcagcuuccagguuuauucccagguuuaagugauucuccugccucagccucccaagcagcugggacuacaggugcccaccacugcacccagcuaauuuuuguauuuuuauuagaguugggguuucacuauguuagcuagauugcucucgaacucuuacccucaagugauccacgcaccuaggccucccaaagugcugggauuacagacacugugcccggcuuucuuuuuaguuuguacauuugauaaauuacauugacauucaaauguuaagccagucuucauucuugagauuaaccaucuuuuagucauaauguauuaucauccuuauauguuguuggaauugaauuagagaaguuuuguuaaguuuuuacaucuaugauuuugagggauauugaucuguacucaucuuuucauguaauaguucugucugguuuuguauuguggcaaugcuggccucaugcaacguguuaacaacuguucucguauuuucugggaguguuucuauaaaauuguaauuauuucuucuuuaaaggggugguggaauucaucaguaacuuuugggagcuccaguuuuuauugugggaugacgguuaacuauaaacucguauuuaacuuuuuuucccauuuuguguuccgcuuagauuauaccauuucacauacauccuaagauccuuucacugguauacuuuuauuuccuccuucaagccuuuguacuguuguuacaauacauuuuacauuuguauguguuauaaaugccacuaugcauuauuauuuuuguuuuaaaccagugauuaucuuuuaaggaaauuuaaaacagaagaaaaauuaauuucuguucccugacacaguuacuauuuccaauauuuucuguccuguggguagauccuguuuuccauguggugucauuuuccuucauucugaaacauuuucuugaacaauuucuaguucagugucucugguggugaguucucuaaccuacaugucugauaauggcuuuauuuuccucucauuuuuggaaagauauuuagcuauguaugaaauucuaauuugccauuuuuacauuucauuacuauaaaaaugucacuguacuuucuucuggcuuauacaguuucugucaagaagucugcuuuguuccucugugcuucaugugucuuuuuuucuguggucgcuguuaagcuuuucuguuuauuacuuccuuucagcuauugauuaugaugugccuugguaugguuuccuucacaguucuuuggcuuaggguuuuuuguuuguuuguuuguuuuuugucuuuuuuuuuuuugagacggagucucgcucugucgcccaggcuggagugcagugacgugaucugggcucacugcaagcuccgccuccuggguucacgccauucuccugccucagccuccagaguagcugggacuacaggcuccugccaccaagcccagcuaauuuuuuguauuuuuaguagcgacgggguuucaccauguuagccaggauggucucgaucuccugaccucgugauccgcccagcuuggccucccaaagugcugggauuacacgugugagcuaccgugccuggccaggcuuaggguguuuuaagccuuguggaucuauaagcauauaguuuucauucaauuuggaaaauuuuugaauauuguucuguaaguauuuuguuacucauuucucuuguuccauccugagaaucuacuuauuuacauguuagacaucuugauguuaucccacuguuuacuaauguucucuucuuuuuuucagucuuuucucugucuuuaauuuuggguuuuucccccugugucuuuaaguuuacuaauacuuucuucuccagugucuaguaacaucuaguauauuuuuuauuucagacauuuucaucucuugaaguuugauuugggacuuuuuuuuucaucuucaucuuaugugcuucccucuaccuuuugaacuuuuauauuuucaacagcuauuuuuuauauuuucaacggcuaauuuauuaugguauucguguaauuauaucuuaugugucauuuucucagucuguuucuauucauugauuagucuccugauuauagguuauuauuuuccuguuucuuuuuauguccguuaauuuuuuauuggaugccagacauugaauuuuacauugucagaugcuggaaguuuggggauuaaaaaauauauuuaggcauuauucuuauguauaaacaguaugauccuaucagugcuugcuuuuaagcuuaguaagacuggucuggaauauccuuugcucuagcacuaacacggcugcacuauugaggcaguauuuuuuuaaaacucuguuagaugccauaguuuuuaggagaucuuucuauuuugccaugugagaacaugaaauauuuuugccuuucuguuagccuggugauuguuucaucugguccuuuucaguggcucuuuccguagcuuuuccccacauacaggugcugcucaaugagacuccgaggcaauccauuguagaucucucgagcucugucuuugguacugucuucugucuaguuaccugucucaugaauucuagauaccuuggucuccccagucucugaacucaguaucauuaaaucaaggauccucguaggcucuuuuuguuuuguuuuguuuuccucucccuguguuacagccuggacauuguuucuagguauccagcuggaguaaucauaacuaucaccuuauucauuucccuuuucuccugggcaacuguagaucugugcauuuaguuauuuauccaauuuuagaaaauuucagccauucuuuuucaaaugucuuucuccuuucaguaauuuauauuacacauguguuagauucauugauacuguccaacaggucacugaggcuuuuuuuucccaguuguaauuuauaucgauucuuuagcuaugauuucacauucagaaguccuuucucuuucagugucgaaucuguuaauuccaucuagugaauuuuuuauuuuagauguuguuuguuuuaucucuacagucucauuuguuucuauuucccuuuaucucuucuuuauguucauguacuauuuugaagucaguaucuauuaauuccaucaucucugauuuuuagguauguuucuaaugacugauuuuucucuugguuauaggucauauuuucuugcaucuugucauguuuaguaaacguugauuggaugcuaaaucauuuguucuuggggguuucuuuuuuuaauuuauuucuucuuggcuuuauugagguauaaugaacaaauaaaauuguauaaauuuuagguauacaguguagugauuugauacguguauguauugugaaaggauugccacaauugaauuagugaauacgucugucaccuaucaguuaccuuugucugugugugaugagaauaccuaagaccuacucucuuagcaaauuuuaaauauacaguacaguaucauuaacuauagucaugaugcuguacauuaaauccccagaacuuacccguaacuggaaguuuguaccauuugacaaguaucuccccauuuuacuuaccucccuaccccagcuccuggcaaccaucauucuacuuucuguuucugugaguuugauucuuuuagauuccccauauaaguggaucauacaguauuugucaucccugacuuauuuuacuuaacauaaugcccuugagguucauccauguugucacaaaugguaggacuuccuucuuuuuauggcugaauaauauuccauuguauaaauauaccacauuuucauuauccauuuaucugcugauagauguugcuucuucauauccaagaaaucuauauauauagaguguuuccauucuuggaauagagauaccugcaguccugccuuaauuacagugaauaaugcuacaguguaugugggaguacagauaucuauuugaaauauugaugucauuuccuucagauagauauauauaccuagaagugagauugcaggauuaugugauaguucuauuuuucguuucuuauggagccuccauacuguuuuccauaauggcuauaccaauuuacauucccaccaacagugcacaaggguucccuuuucuccacauccucaccagcacuugcuaucucaucuuuuuuauaauagccauccuaacaggugugugguaauaucucauugugguuuugauuugcauuucucuguugacuagugaucuaucuugagcaccuuuucauguaucugcuggccacguguauauuuucuuugaaaaguauauucagguccuuucccuauuuuuugaucagauuuuuuuucuuuuuucuuuuuuuuucuuuuuuuuuuuuuuuuuugagauggaguuuugcucguguugccuagguuggagugcaguggcacaaucucggcucacugcaaccucugccucccggguucaagcgauucuccugccucagcuuuccgaguagcugggauuacaggugccugccaccacgccuggcugauuuuuguauuuuuaguagagacgggguuucaccauguuggucaggcuggucucaaauuccugaccucaugauccauccuccucagccucucaaagugcugggauugcaggcgugagccacugugcccagccgaguuuuguauauauuugggauauugaccucuuaucagauauauuauuugcaaguauuuucucccauuccauagguuuuugacucuguugauuguuuucuuugcuucacauaagcaaagagauaaauaguagucccaccuauuuaucucugccuuuguugcuugugcuuuuggugucauauccaagaaauacuugccaagaccaauaucaaggagguuuuuuugguauguuuucuucuaggaguuuuauaguuucaggucuuacguuuaaguuuuuaauccauuuugaguugguuuuuugauaugaugaaagauaagacuccauuacauucuuuugcauguguauauccaguuuuccuagcacuauuuauugaagagauuguucuuucucccuuauguauuuucaguacccuugucaaauguuuguugaccauauaggcauggauuuauuuuuggcuuuugauucucuuccauugauuagauaauuugaguuuuacgugaguuacuggauuuuguuuucuucugucagaguguuaguuuuuauucuggaaggcaguauuuacaaauaugauugauauuucaguauugauguuagcuuuguucguguaaguucagguuucacucugacucuugagauaucuacugaaugccugagaguucaguaaugacucuucucugacugccuaaaaauugaaugucucucagcucugcgugagcucuaagagcuacuacauauuuacagcuuuccuuuccuucucugcuuguccucauaaaguuaaacccuacacaugcauugcuuaguauucaacugcagacucaacugugcagauucuguauagcuuccuccucauuaguguucuguccugcaaaugccaucuaccucaucauccucaaaaucugauguuuaucuuuucagcagugaaacccuugaauuagguuugugauuuuucuuccucaauaaugugucagaaagugcccccagacaaaagguggauaaucauauggcucaccucauuuguuucuguuguaacagguaccaucgucaugcacuuccucuuguccaguaucuaaugagaguucuuuuauauauuugcucaguuuucaucuucuguuuuagauaugcccaucaaauguuuagggcaguuggguaaguucaguccuguugacuuuucacucauauauucugguucuuaacuaguaguuaacuaaaaaauauaaaaaauuugaaauuuaaaauacuaaaaaaucugaaauuuaucguauuauauugugagguaaaaaucuaauuuuucuucaaccugguuggaaggccguuuucacauuuuucucaauguauauacuucugaaaauauccuuguguagaagauggcuucuauauuuuuauguauguauguauguauuuauguauguauuuuugagacggagucuugcccugucaccugggcuggagugcaguggugcagucucggcuuacugcaagcuccaccucccggguucaaccaauucuugugccucagccuccugaguagcugggauuacagcgcccgccaccaugcccagcuauuuuugugugcuuuugguagggacgggguuucgcuguguugccagggcugguuucgaauucuugagcucaggcaaucugccagucucggccucccaaagugcuaggauuacaggcgugagccacuguacccagcguauauuuuuauuuuuuaaggaaauuucuaggagagcaacuaccgaacuuuaaaaauuaucuugcuaucuauugccagauuguuuugcaaagacugucuguuuacauacuagccaccaguguauaaagaugcuuaucucaccucacuuucacugacaauacuaauuuuucauaaauuuaaaauugcccuuuuuuaaguuuugucucuguuacauugauuauuacaagguggccuauguucauauacauuaauaauuuguagcccucucagguuaauuguaccuuuacccaauuuuuuguguuuuagucuuuuaauuuuuuuuuauauuaagaauaugagcuuugucacauguuauaaauacuccauuuuauuucuaucuuugcuacuuuauauggcuaaaucuacuggauuuucccuucauuauuccauuucuuuuuuauuuuuuucaacuuuuauuuuaaauucaagaagguacuugugcagguuuguuaccuggguauauggccaugaugcugagguuuggcauacaaaugaucccaugaucagguacugagcaugguacccaacaguuaauuuuuccacccuuuuuaaccccuccccuccucuaguaguuuccaguuucuauaguuaccauauuuauguccaugaguaccaauugauuagcuccuacuuauaagcaagagcaagcaguauuugguuuucuguuccuguguuaauucacuccggauaauggccuccagcugcauccauguugcugcaaaggaccggauuuuguucuuuuuacgacugcauaguauuccauggcauauauauauauacaccacauuuucuuaauccggucuauccaugucuuugcuguugugaauaguucugcaaugaacaugcaagugccugugucuacuuuauagaacaauuuguuuucuuuuggguacacacucaguaaugugauugcugggucaaaugguagcuuuauuuuaaguucuuugaaaaaucucagaauugguuuccauaguggcugaauuaauguacauucccaccaacaguguuacaagcauccccuuuucucugcagccuugucaacauguuauuguacuauuagaccgauuauuguuugacauuuuaauggcagccauucugacugguaugagaugauaucucauugugguuuugauuuacauuucccugaagauuagugaugugcagcauuuuucauauuugguggcugcuuguaugucuucuuuugagaaaugucuguucaugucauuugcucauuuuuuauuggguuacuuguguuuagcuuguucaauuguuuaacuuucuuauacacuuuggauauuagaccuuugucagauaguuuaugaauauuuuaucccauucuguagguuuacccuguugauaguuucuuuugcuguacagauucucuuuaguguaauuaggucucacuugucgauuuuugguuuuguucaauugcuaucgaggacuuagucauauaauuuuuuccagugccaaugucaagaaugguguuucuuagauuuucuucuaggauucuuauaguuugagguuuuacguuuaaaucuuuaaccaauauugaguuaauuuuuguauaugguaaaagauagggguccaguuucauuccucugcguauggcucaccagcugucgaagcaccauauauugaauaaggaguccuuuccccauugcuuauuuuugucagccuugccaaagauuagauuauuguagguggcuggcuuuauuucugggcucucuauuauguuccauuggccuuugugucuguuuuuuuacaguaccaugcuguuuugguugcuguagcuuuauaguaugguucgaaggcagguaauuugauaccucuagcuuucuucuuuuugauuaggauugcuuuggcuauucuggcucuuuuuugguuucuuguuaauuuuguaguuuuuuuuuuccaguucugugaaaaaugauguugguaguuugguagguauagccuugaaucuguagauugcuuugggcagggaaauauggcuauuuuacugauauugauucuuccagucccugagcauggaacguuuuuucauuuguuugugucauguaugauuucuuuuaacggugucuuguaguucuccuuguaaugaucuuuuaccuucuugguuagauguauuccuggauuuuuuuguguguguggcuauuguaaaugauuuggcucucagcuuggauguuaucaguauauagaaaugcuacugauuuuuguacauugauuuucucuccugaaaccuugcaaaaaucauuuaucaguucuaauagccuuuugguggagcccuuaggguuuccugaguaucgaaucauuaucaguaaagagagauaguuauacuuuuucuuugccuauuaggaugccuuuuuauuucuuucuuuuaccugauuuucucuggcuagcacucuccacuaauauauugacuaggaguggugagagggggcauccauaucuuguuccaguucucaaggggaaugcuuccaguuuuugccuguucaguaugauguuggcuguggguuugucauagauggugcuuauuauuuucagguauguuccuuugaugccuaguuuguugaggguuuuuaucauaaagugauguuggauuucauugaaagcuaauuugguuuauguggugaaucacauuuauugauuuguauauguugaaccacccuugcaucccaggaaugaugccuacuugaucauggugaauuaacuuuuugauguguuuuucaauucaguuugcuaguauuuuguugaggauuuuugcaccuguguucaucagggauauaguccugugauuuucuuucuucauugugucuuugccagguuuugguaucaggauguuacuggcuuuguaaaaucauuuuuuuggaauaguuucaguagaauuuauaccaccucuuccuuguaccuuacauagaauucaacugugaauccgucuuguuugggacuuuuuugguugguagguuuuuuuuauuacugacucaguuuuggaacucgauauuagucuguacagugugucaauuuguuccucauucagucuugguaaauuguguguuuccaggaauuuauccauuuccucuagauuuucuuguuuguauguauagacacauagccucugaggaccuuucguauuccugugggauaaguuguaauguaaucuuugucauuucuaauugugguuauuuauaucuucucucuuuuccuuuguuaaucucacuagcagucuagcaaucuucuuuauccuuucaaagaaccaacuuuuggcuucaucauuucauuauguggauuuuuaggucuuaauuucguuccauucugcucugauuuuaguuauuuuuuuuucuucugcuagcuuauggguuaguuuguucuuguuuuccugguuccucuagaugugauguuagaguauuaauuugagaucuuucuaauguuuugagguaggcauuuagugcuuucaacuuuccucuuaacacugcuuuugcugcgucccuggaauuuugguguguuguguaccuauuuucauuuauuucaaauacuauuuuuauuucugccuugauuuuguuguuuacccagaagacauucaggagcaaguuguuuaauuuucauguaacuguaugguuuugagauaccuucuugguauugauuucuguuuuuauuccacugugguccaagauuaugguuaguaugauuucaggguuuuuuuguuuguuuuucuuuuucuuuuucuuuuuuuuuucuuuuuuuuuuuuuuuugagacuuacuuuaaggacgagcauguggucagucuuggaguauuguuccaugugcaccugagaagaauguauguucuguggcugauggguagaguauucuguagauguuuuucagguucaguuggucaaguguugaguuuaaguccagaaugugugacuuuucugccugaaugaucucacucaugcuaguaggguguugaagucccccacuauuauuguguugcugucuaugucuuuuuguagaucuaguaguacuuguuuuaugacucuggguucuccaauauugggugcauacauauaugugagauauauauauggaagauauauguguguguguguguguguauauauauauauauauauauauauacacacacauauacauggaagagagagauauauauauggaauauauauacauacuggaagagagagagagauauauauauauauggaagauauauaugugauaguuaagucuucuuguugaauugagcccuuuaucauuauguaauacucuucuuugucuuuuuuuuuuuuaacugcuguuaguuugaagucuguuuuaucagaugaaagaauagugauuccugcucuuuuuuguuuuccauuagugugguagcucuuucuccaaaccuuuacuuugagccuauaggugucauuauauauaagaugggucucuugaagacaagccagauggaugagucuuguuuuuuuauccaacaugccacucugugccuuuuaagugagguguuuagaccauuuacauucaaagcuaauacuguuaugugauguuuugauccuaucaugaaguuauuagcugguugccuuacacuuucuaguguguguuuuugcuuuauagggucugugggcuauguacuuacaugcauuuuugugguagcauuuauuuuucuuucauuuccauauuuagaauucccuuaaggaucucucauaaggcuggucuaguuguaacaaauuccuuugugcuuguuugucuggaaaagauuuuacuucuuauucacuuaugaagcuugguuuggcagguuaugaaauucuugguuggaauuucuuuuuuuuuuuuuuuuuuuuuuuugagaaagcuaaaaauagguccccagucucuccuggcugguaagguuucugcugagaaguugacgguuggccugaugacauucccucugaucugcccuuuuucucuagcugccuuuaagauuuuuuuuucuuuaguguugaccuuggacagucuggugauaauauccuuagugauguuuauuuugcauaguaucucacaguuguacucuggauuucuuguaucuggauaucugucucccuaacaagauuaccaaaguuuucuugaguuauuuccucaaauauauuuuccacauuguuaacuuuuucuucuucucucucaggaauaccaguaauuuguagguuuuaucacuuucuguaauuccauauuucuugaagacuuuauucauuuuuuaaaauuauuuuuucuuuauuuuugucugacuggauuaguuuaaaauacuggucuucaggcucugcaagucuuucuucugcuugggccggucuauuguuaaagcuuucaguuguauuuugaaauuccuuaugugaauuuuuucaauuccagaaagucugauugauuucucuuaaagaugcuuauuucuuccuucauuuccuggauuacuuuagaaguuuuuuuuuguugauuuucaacuuugucuuggaucucauugggcuuacugcaaucccuacuuugaauucuuuaucugucauuucugaguuuccauuuugguuagggaccauuucuguagagcuagugugauccuuuggugguaucacuacauucagauuuuucauagugcuggaauucuuacgcugcuuuuuucuuaucuggagacccuaacacuuguaacuucuguaauuauuuucaugcagguaggauuuuuucuuucuuuuucuuucccuauaauguuauuauauauuuuuuucuccuuucccuuuucuuccccucccuucagaaugugacuauagagaauucuggguagggucuuugacuuuguuucuuuaguccucugugcugcuuuuggccaauuuuauuuugggcuguggcauuugaccugcaagccuguagauggcacuuagagguaagagcuaacugcagccaacauggcuuaguguauaccuugauacuuguuuacuggcagaagcucuuuguugccacaggcuauggccaauucauggaauguaccauggucugagcucacugcccagccccagggucaggggguuggcagagggcaggaauggcagggccagaccugacagguccaccuacagguccccugaugacagacacaggcacuagugccgagggagaaugcaguggguggccaccaagggcccagagaugugccuaguaguguagcugggaaaccuccucagccccaaguucucugcacagggauaggggauggucuaaacuucuaguccaggagaguaggugcucaagaugccuagagcauggagcagagacccccugcacuaagaucucugcauaggagggguggggugacucaaacuccagaagcaggcaaggaggugcucugaaugccuagggaucuuccuggguauggagcagagagagcucugcuucaccauaacguuauguccaggaggagugcgguggcucaggcuacucaacuaggcaaaugguuacucuggaugccagagaugugcuuggagauggagcagcaagggcccuacugcaccacaaucucaggagaacagaguggguuacccggcaauggcacaugcgaaucuguuccagguugccaagcugaacgugacugcaaguuuugcagcccaggagaaacugcagcuguagcggcucuccugcugccccaggcuugaaaguggggaaagcacaauucuagcccuguuguugggguacuuuccacaguuuugacugugaagccccuaucccauuccagagcagguguuuugaucucugguccaagacugacaugccugugcagccacacugcugggucaccaaggaauggcugaguuuuuaugugcccaaauuuaaaacauuguccugcucuuuuucccgggucuggaaaaaugccuucagcuuuuuccgucacagugacuccaggccacuccccaaguuagcuccaggacugggagaaacaaagugcucucccuuggccuagguugcuuggauccccaguggaagggugagucacagagggaggcuccuugccucucucaugcacuggggcuucacuuaacuuuuaucagcuggaugccgucaguggggcuguuugcuggccuucuccucucugggaucuggaguguacgucaugauuccaguagauuccuguuuuccuucuugaauuaaagcucacagaguuuaucuuuaucugcuaucuugcuauguccaaguggcugaggcgugcagaaagccucuaacccacccucuuggggaaaagcaaaaagucuauuucuuccauuucuuuuaugcuuagaaaauucuucuucaucuugagacuagauaaccacuuacacauauuuucuaguuuuuuaauuuuauauuggacuaauacauauaaauuuuauuuuguuaugaggugaaaauuaaauuuuauguuucuucagaguuaauuauuguugcacuauuugucauuuuccuguauacuuuaucauauauugucauguucaaguauucuguauuaaauuuuuauaaccuaaaauaaccuguuccuugcuucauuauuucuuugguguuucauuuguguaccuauuccauaugaauuguaguuauauaagucaauuucuuuagacaaaccuuuuucuugaaggcacuauuuaauauguugcacagaaaccuucugguucaauaauaccuuggcucaccucauccauuuuuuuaaaggaaugguguauuauuucuaccuucacauucucuuuucagcccaccuaaauaugacaacuuaccuuugaaaaguaacagaugaccuaauuccuaaguacagcaaauguuccugucuuucugaaacuuuauuuucccuucacuucuuguagucuugcuuccuuuuuuuauaucucuuaguauuccaucugaauguccuguucugcuuuuuucuguccuauguauaguaguacccuaagauucugccuucacuuaucuuuucaguuuuuacugaauuccuagacuauucuuugcuuucucagucuuaacaauauccuuucuaugaaugauucccauaucuaccuucaugaacuugcaaagcuguguuaucaaaugccuauuuagauaucagcaugucaaaauaaaacccauugcuccucuguccccauucccauucuuuuccuuuauaucagcaucuacucagucagccauagagaaaccucaacaucguugauuucucccuugacccaagugguaaaagcuaguucccucuggaauauugauucucuuuauaugucuguuacuacuaccuuagcugaugucccucagaagcucucugcaagcucaaauauaacuucugauauuuccaaacaugcuuauucuuugaaugucuuuucugcuuuauaauaauuaccguaacuuuaguagaaaaguuuauguaucuggcucuuguaaccagauagugauguccuugcagauugguacgguuuucucucauugugucugcagcuuuucauaacaguggugaucaguaacuuuuuuguuguacuuuaaaaauuguuuagcagucuguagucucaggcauuuuuaguugauucucucauugcuacccgaauugccuuuuuaacauuaugcuaauuauuuuauuuuauuuuuaaguuccaggguacaugugcaggaugugcagguuuguuacauagguaaaugugugccauggugguuugcugcaccuaucaacccaucacuuaaguauuaagcucagcaugcauuagccauuuuuccugaugaucucccucccuuggcucugccccacaagcccuaauguguggugguguucucccugugcccauguauucucauuguucagcucccacuuaugagugagaacaagcgguguuugguuuucuguuccugcguuaguuugcuuaggauaauggcuuccagcuccauucaugucccugcagaggacaugagcucauuccuuuuuauggccgcauaguauuucuuggguuauauguaccacauuuucuuuauccaucuaucauugaugggcacuuggguugauuccaugacuuugcuauugugauagugcugcagugaacauaugcaugcacguaucuuuguaguagaaugauuuguauuccuuuggguauauacccaguaaugaaauugcugggucaaaggguauuucugguucugugucuuacagcaauugccacacuugucuuccacaguggcugaacucauuuacauucccaccagcauuguaaaaguguucccaucucucuguagccccacuagcaucuauuguuucaugauuuuuuaauaaucacuauucugacuagugugagaugcuauuucauugugguuuugauuugcauccucuaaugaucagugguguugagcuuuuuuucauguguuuguuggucacauaaaugucuucuuuugagaagugucugcucauguccuuugcccacuuuugaauggggauuuuuuuuucuuguaaauuuguuuaaguuccuuguagacucuggauauuagaccuuugucagauggcuagguugcaaaaauuuucucccauucuguagguugucuguucacucugaugguaguuucuuuugcugugcagaagcucuuuaauuagaucccacuugucaauuauugcuuuuguuguaauugcuuuugauguugucaucaugaaacauugcccguaccuauguccugaaugguauugccuagauuuuauucuagguuuuuuauaguuugggguuuuacauuugucuuuaaucaaucuugaguuaauuuuuguauaagguauaaggaagggguccaguuucaguuuucuuuauauggcuagcuaguucucccaacaccauuuauuaaauagggagugcuggccagaugcaguggcucaugccuguaaucccagcgcuuugagaggcugaagugggcagaucacuugaggucaggaguuugagaccagccuggccaacauggugaaaccccaucucuacuaaaaauauaaaaauuagcccagugugguagcacaugccuguaaucucagcuacucaggaggcugaggcaggagaauugcuugaacuugugagguagagguuucugugagccaagaucaugccacugcacuccagccugggugacagagugagacucugucucaaucauucaaucaagcaaucaaucaauaggauguccuucccuauugcuuguuuuugucagguuuguuaaaaaucaaauaguuguagauauuuggucuuauuucugaguucucuauucuguuccauugguuuaugugucuguuuuuguuaccaguaccaugcuguuuugguuacuauagccuuguaauauaguuugaagucagguagugugauggcuccagcuuuguucuuuuugcuuaggauugucuuggcucuguggguucuuuuuuggucccaugugaauuuuaaaauaguuuuuuucuaauucugugaagaauuuccaugguaguuuauugugaauagcauugaaucuauaaauuacuuuggccaguauggccauuuucccaauauugauucuucauauucauuagccuggaauguuuucccauuugucuguguucucucuuauuuccuugagccguaguuuguaguuuuccuugaagagguccuucacuucccuuguuagcuguauuucuagguauuuuauucucuuuguggcaguugugaaugagaguucauaaaugauuugguucucuguuguuguuguauaggaaugcuuaugacuuuugcacauugauuuucuauccugagccuuugcugaauuugcuuaucaacuuaagcuuuuggacugagaggaugggauuuucuagauacaggaucaugucaucugcaaacaaagacaauuuuacuuccucucuuccuauuugaaugcucuuuauuuuuuucucuugccugauugcccuggccagcauuuccaauacuauguugaguaggaguggugagagagggcauccuugucuugugcugguuuucaaggagaaugcuucuggauuuugcccauucagugugauauuugcuguggguuugucauaaauagcucuuauuauuuugauguauguuccuucaauaucuaguuuacugagaauuuuuaacaugaagcgauguugaauuuuuuugaaggccuuuucugugucuauugagauaaucacgugguuuuuguguuuaguucuguuuauauuaugaauuacauucauugauuugcauauguggauccaaauuaugcuaauuuuuaagcuaaaauucuuucauacuuauuaucuacagaaaaaaaauucaugcucuugucauguuaguaaagauccuaaccaaucugaucucaucuuuuuuuuccagaaguccuauuauuucucugauuauauauuauuuuuuggcuacauguguucccuacauguguuuucuugccauugcuauuuuuccucuuuaguauuaaugcuuucuaaauuuuuauuaaucaccuacuaugugcagguacuguccuaggcuguguuggaaauacaaauggauaaaacuugaguagcacuuuuuuggagauuuuucccuuaaauuuuccauuaugaaaaaccuauucuucaaaacuuagguaaagcuuuuucuuaucuaucaagucuccuuacaugaugccagcacagauuaaucccucuuugccuucaaaguacuuuuaauaucugaguuauaaaauguuaucacaacccucuuuuuuuaaaaaucaauaccuguguccucuucauucauauugcuuaauggcaggaauugucuuuuguuuaaaccacuuuauugaguuaugauugauauacaaaaugcuguauauauuuaaucggaacaacuugauggguuuggaguuaaguguauacucaugagaauguuaccgcacucaaugcuuggaaucauaagagauucugucuuaucacuguauucccucuuucucuucuccagugcccagcagugacuuuaaaauaauugauacucacuaaaugaaugcugaauugaaaaguugguucagagccaaaguagaaacugagaaggauuagccagagaguuaggaggcaaaucaggagagagucauauuaccaaagcccagaaauguguuucaagaaagagggcaguaggugauguccuaagcuucagauuuggaagaagcagugcagacuguaaauagauuauuggauuuggcgauuaagagguuguugguuaucuuaacaaguuccauaaaguaguaaggguacacaucagauagcagacugagaaguaaauucuuacccuuaaauauaauuuuuagcugauauauuuauagaaauuggcuggcagacacauugaagauacauagucuaaauaaagaucuagaaucuugcauauauuauaucgauuuagggaggauccauauuuuuuguaaaguuaaaugaguggguaaguaggcuugacauucuuuuaagaaaauuuagaaaccuaaucacuauuuucaucucauuagaagacuacugcaacuccacauagagaucacacgaucuuuucaucaaaguuagugauauuuugcauggcagaaauuauuuuaaccuggaaaacauggcuccuucuacuuucuauccuuguuaggcugguaauacauugauaauauauaucuaacuauaugaaaugaaugaauuuuuuaaaauaucccugaguaauuguauaaaugacuugauuuuucacauacuguauuugauuauuuggaagacauacuuaacauuucuguaaucagaaugccuuuuagaauagaucauguguuauaguuuuaacugacaaccuuuuuuaccuugguguuuuauaaaaugaugaugcagucccaauucguagcauaugagauuugauaaaauacaguaauauaguaggaagcauuaaaguuuagagacugcaaaauauuuuaguuuuaauauaauuauuguugugcuacacuuuuuggggcuauaggugauauuuucucucucucucuguuuacuaugccaaugggucaugcauaaagcuuaucuuauaauaugcuguuaagugaaggugggggugggaauggggaagaaugaauuuauagggaaccuguuuuauguuacuugaaauaaugacuuugguguaugcagaacaaaucuuaguuaaccauaauuuucaccaauuuuguagaaacauuaugagucaaugauccauguaagggaaaaauuucugaucuugcagucaaggguacauuggcugauugguucauuuuuuucacagacauguauuguguaucuauuaauaaccaugauaccuggcaauauacucagcacuguaaacaaucuuucauuguucugagcauguuucaacaacaaagauuaauagucaauucacagugccugaaaccugcucuuucuucauguauguuguccaauugagauaauauuuguaguuucuuuaaugaagaaguggccuauuggagagccguguacuuggucacaguaagcacccagugaauguuuguugacuaucgaaugguauauguuuuaagagguugacuaggaaauggaugggcuuauaguuuuagugauaauaugagaaaggacuggcauuguagcuaauuauuauugaaaauagaauauacauugagaacugcaauaggaauaauggauguuucucaguucauuuugggcauuacuaaaauaaauuaaaaacauaaaaccuuaaaguuucucaccauagaaaaugucaaauuauuuucuauuuucaauaauaauuugacuuugaaaauauuuuuagagauaucaugauuaaucaaaaauuguagaauauaacaaguucgcguaaaucaguuucagcaaauugacagucuugucuuugaaaucaaauaauuaagugaaaauauaucugugcuuguguucauuuauuuuaguaauaucucaauaccuaauccuugaagagugaagcaacaguauagugagggggaaacugcaaucugaugaugcauaccuuuuuccucugguaacugaagguuaaauggguagcaagcagaaugccuuaaacaagauugguauauugauuaaaacgcugauuuaacagcucgcaguuuccccuuggaaaccuggaaaagauaagccagcugcugucuaagagugcucaguguccacugagaguacacuaucuaucaucacaauauggugaugagagguguuuuauguuuguguuaauuucccccacuaaaucaguaauuauuacaauccugucccugcuguuuacccugcagcuguuuuuccauuugucgagagagcggguguucucugaggaccgcacacguuucuauggugcagaaauugucucugccuuggacuaucuacauuccggaaagauuguguaccgugaucucaagguaaaaaaaaaaaaaaaguaaucaaaauuuguuuuugcagagacuauagggacaaacauaaaguaauuacaaaguuauacaguuuugagaaaagcagauuuaguugggaaaaaagcacuauguuuaaaaauuuaguucacuacauuugaaggaaauuuuauucacuaacauguauguaguugauuuaugugugaguuuuugauuugcaaagcaauuucugcccgacugcuuggaucaaauaaaaauguuaaacgugauuaagucaaauaaauucacaaguuacacuuaaaacaaguuuuauuauguuuacagaaauguuuuaugaagaaacauaguaagacuauuggaaggaacauauucauuuugauuuuagcauuaacuuugggugguuuuaaauaccugaagcauuuuaauauaauaaccauuuauuaaugugccucguguuuuauuuaugaaagcacucuauuuuuucuguugguaauaguguuuugacugcuguaaguuccauuaugaugagacccuuaggguagcucaggauuggcaaacuuucuauaaagggcagauaaaauaauuuaggcuuugcuguucguguauagucucuuuuguaaacuacucaacuccaucauuguaggguaaaagcagccucagauaguauguaaaugaauauguuuggcuauguuccaguaaacaaaauaggcgaugggcucaauuuaguccacagguugucauuuguugaucccuggaguaacucauacaagguaauaguaauucucaugacaguguuaugaauuagguuggcgacauuaaaggaauuuguaccacgacacauuuugaauaaauucuagauguuagucuuucuuuuguaagaagcaaauuguguauaaaauuugacacagaauugccuuauugaucaaauacuauuucauguaacguaaugauugguagaaacagaaguuacaugaggcuuuuaugaaauucuguuuuguuugaaaugagguauauagaagcuauaagauguuguauguaggaagaacugaacuauguaccuauaaaacaucuagaucagagaugaccaacugucuaagugccaaaaugggcuaaagauuaauacaaauuaauaguuugauuguauuuagccugaaucuuuuuauaacuaggaauguggcagaauucagcauucauguaucugcauggccagauaauccuauacugucuaaaugucuuaaauaucaauuucuuuaaaggaauuaguuauguggcaugacaaaauguguuaacuuuccaaauauacuuagaaguaguuagcucugcucuuccugaguccacuucucguauucccacuacauguuuuaugaauccuauuuguaggggugaaaaggggaaggauagaagcauggaggcuuagauuuaaggaaauuauaacaauuuugaaguaauagguaacauccagaaagcuuaaauucaaaagauugaauuauuagccuaaagacugcuaaagaaaagaauguucauuugauugcaguauugauuauggucuuggucaguauuucuucuuuaaucauuucucaucaaaugaaucaacauauugaggguauguguguguguguuuucagauggagucucgcucugucgccaggcuggagugcaguggugccaucuuggcucacugcaaccuccaacucccugguucuggcgauucuccugccucagccuccugaguagcugggauuacaggcaugugccaccacgcccagcuaauuuuuguauuuuuaguagagacaggguuucacggaguuggccaggauagucucgaucuccugaccucgugaccgccugccucgaccuuccaaaaugcugggauuacaggcaugagccaccaugcccagccaacauauugguauauugaagcucauuaaaugaguuccacugccccauucuuucugaugauggaauuagacuaaauuugucaaacugcaauauaaaguaccuacuuuauauaugaauaucagucaauuaguuaccacgugcacaguucaccaaguuuacuagacaauuaaguggucucugcucccugaguuuauuucuuaaaaaauauagccuuaacuuaaagaccuaaguauauaguuagcauaggacagaaacuguaaagguacaccuagaaaaauccauguaacauaagaaaucaaacauccaaaacuuacacacauguuauuuguauccacaguaacaggauuauuuauaauacaaugacauauuuuagguaagaucacagaaauuuugagcuggucuuuaauuuauaggugaucuccuucaaaccuagaagccuaguaaaugacuuacuaaaaguaaugaccuaaguugauagcagucaggguuuuuggaacucaugaauccuagcuccuuauugaauguucuugucacuauaucauucugacuucuagaguugaaaugaaauuauagaggggggaugcauuggauuaacuuugggaaaucuuuguaagccuaaacuucaaauuaaacugcagaagguaagagaaugaguguuucaaauauauuuauaccagauguauuaaagaacauuaucaugaacugauuuagguacccacuuugaucagucucagauuugucucuguucucauuacuaauaaccuugacuuuguucaaaugcaaauccaauugcuaugccuacaguagcagcacuucucaaguaaauccauacccguuugccgcugucucauucacauuggaggcagagccuucuuuuaugugcagguuaacuuaagauauuuuuaucaguuccuguuuccuaauaaauuaguguuuauagcaacagaaaaauuguugaagccuuuguuguacuuuagaaaguaaguucauuuaauuugucaauacacaucauguaaugaaguuuuauuuuuauuaaggacccaaauuccuugugauuacuuaaggaaaacugcuguugcuucaugauugcccaaaauuucgaagaaaucucuucaaagacuucuucaguaguccaaauuauauguuaaaaucuucuuuucugcuuagcucuuauuuuacaaauacaaccaaugaccauggccaucuaagcacagcguaggcugaacagggacauuugcaaaggugaauauaacuauauuggaaaucauuaagaauuaauuucuugcuaguuuaugggagaaaauaauacauaaguuguugcuauuuccuauuuguagaacaccuaaucuuguuuuccaccuaaugugagaauaguuaaccauuuacaguauuaauaugagaaagcaccaaauaaauuuagguacuuucuaacacucaguaauggcacgaagggguggcuucagagaguuuuaucauagcccuccucguccucaucagcucccuaauguucacuucaaauaaaugcaguuuggguggggaaagcaugcuugcuuugcuugcugagcuucaagacacuuuccccagcucccacuucuaacuagauggucacuggauuucccccuauauagaaaucuuaagccacugcucuucauuccuuccacuucuaaaauaaaauuguacugguauuggacuauguaccuuauucguaauaaauuuguaaauagccuggcaaccuauuuggggucuguuuacaugaugaguccuuuucuggauucagagguugaagugaagaaacguuuuucuuuuggaauuucagcauuccauggucauucaguuucugcagguuagcuugugacauuuuggcacuggaugcccguaaacuuaaacuugcaaugugcagaguaggaauuccuuacuaccuucuugggccugagugagucuuggugccuaaaacugaguuugauguaugugggcuaaaaugugguguaagagugaguaacaggaauuguuuauuucuauugcugcaguagucaucggagcccuuaggaacugcuauuuucauuccuuuguuuaaucacaaugucagucguuuaauuaaaaugauaccauauauaugguguuuuuaaacuuucaaauauuuagucuggccuacauucaagccuagcuucucagacugggugcuacaaacagguuacaaccaugccucggccugcaaaguguucagagaagcuuccaggccagugaguucuggcuucaagcaucuuguccaguuaaccugguaugccccacaacuuuaaauuguuauuuuacugugaaauguaaaagguugggaagcauuguauuaaagacagcuaggauuuuuaaaguuuaauuuuaugcuagccaucagcaagaacaggaggaaacauaguaauuuuuguuacaauuuugugcccacuaagcacaggaaaaaagauuuaaaaaucuaccauuucuucauauacacacugaaucaagacccucugucaaguaaugccuguccacuucaacugggcaaaaaauguuacccuuuuuuuugguggaaauucuaugauguauuaugucuaguguuuuuuuuuuucucucuccucaaaagcaugaccuuuuagauaacaacccucugauagaaauaguaagcauuacuuagauuuuuaauauacaaucuuguuucuuaugacuucauauuugacuucaucacuacuuuuguuaguggaugcauccauuaagcauaagcaugcugcccuacucuccaucuuggaaacugagauuggcugugaauauuaaacagaugcauguaaaguuucauaaauuuagaguaccuaagcagucagugacaauaugcauuacauauugucuggcuaacaaagggaagaaggaaagugaucuagaagagaagacuaaagaaagaucauuuguaaauauuuuucuuccuccuuuacgcaguagaaagauuccuaaaaauguaugacuacuguaaauaauguaaauacuacuuacauuauguuaguguuaaaugaaccaagacagugauuuccagauguuacugauauaucuaggccauugauaugcuuuggaaagacuuacagguguuucugugcauucugcagguuuacgaaucacccuacuaaugguccuuguauuuuacagaaacucuguuaaugcauccugaguaaaauuaucauguauuguauaacagaacuguacauuuuauuaucuccugauuuaucuuuauacaagauuagauuuggggauauuauuuuuuaagcuaauauuuugguggacaaguuuuagucauucaugcucagcaaaacaacguuuuaggauggugagagaagacaaaguaauugauagaagaauguggacacuacuucaaaauaacugggaaauuaugaggcugggcacaguagcucaaacuuguaaucccagcacuuugggaggcagaggugggaggacuguuugaacucaggaguucgggaccagccugggcaacauggcaaaauaccaucucuuaaaaaaaaaaaaaaaaaaaaaaaggaagaaacaaacaaaaacuagcagggcgugguaguggugugcgccuguguacuuaggaggcugaggugggaggaucaguugagccugggagguugaggcugcagugagcugugauugugccacuguacuccagccuaggcaacagagcgagacccugucucaaaaauaagaaaauuauaaaauauuuguguuuuguuuuuuugagacaggauuucacucugucacccaggcuggagugcaguggcaccaucucugcauauuacaaccuccccacacaccucgggcucaaguaacucucccgcuucagccuccagaguagcuggcaccacaagcgcauaccaccacgcacagcuaaucuuuuguauuauugguagagacaggguuucaccauguugcccaggcuggucuugaacuccugagcucaagcgaucugccugccucagccucucaaauuguugggauuacaggcaugagccacugugccuagccuguguuuuguuacuuaaaauaaauuauugcauauugaaaaguauuuuuaaugcagucauugagccaacagaaauguuuuaugggguuccacucuugaacuuuguucuuuucuuuaaaauacaguguuuuuuagaagagcccacaucaugacaauuuacaaauaagccauuaaacucuucauguuuuaagaaaagaugaguucauuuauucaauucuuaugguauguuaaguuugcauuuagcaucucauuucucaaaacugucacauuggauuguuacuguuauuuacuuuuguuuuauagaugaaauugaagcacguagaaauuaauaauaugcccaaggucacacagugaauaagggauaaagcucaaauuuuaauaugaacccucugacuugaacccauagucuuauccauuuugcucucuacugccucccaggcaguaugcuaccaguccccauggccaugacccuuaccccaucucucucagucaucccuuaggcuuaucuuauuucuuacuauaucauuguaauuuuuuuaaaagcuaauuuauaaaacaaguaggguaaccagcugucuugguuugcccaggacugcccaguuguagcacuacacguccugcauucuuugaaaccccucaguucugggcaaacugggaguuggucacccucagccuauuccuuacccaaaccuauccuugcaucucauuucauucuucuucucacaaccaugaucugaggcucagagaugagauacgagguuacagaauuagaugcaagucagaauuuuacacacacguacacacacacggagcuagguauuaaaaagcaguguuuauacauuuugguuuuucuguauccagccacuucaaaaauagcuuugucaaaacguggagaaauagugcauccugucugucauguuuccaugaagacuuucccaugcauacaaagcaugugaggaguauuggcacauuacacaccaaacuagaugggaauggaaugguguaaaaaguacauucacauuuuguucaauauuuuguauuauuuggaacuuuuauaagaauuguuaauguauuauauuaguaaaagaguauucacuaaagaucuucagcauuuuauauauuuauaaagcauauuuuuaaaaauuaauaaaagggcauauacauuuuuauucaguaaaacaacagaagcuuuaguauauacuuaacguuucucauuauggcaaagugggagggaggaagaagagagguuguuugaaagagguggaaaaaagagagaaaccagaggcugagaagagacagaccaaggcagaaagagaaaauaggacaguugaagacucuugauguuucugauugguuucaauauacaagacuuauugucauuugugcagauuggguuugguuucuagguucuggcugguagagaaacaggaauauacaagauaacugaguuuggauaaaauaaaaaauuuuaauuugguggggcaugguggcucaugccuguaaucccagaacuuugagaggcugagguggguggauugcuugaacccagcaggucaagaccaacuugggcagcaaagugagaccuugucacuauaaaaaaauuaagaaauuagccaggcaugguggcacgugcccguguucccagccauucaggaggcugagguggcuugagcugcugaggcagagguuguggugagcugugauugcaccacugcacuccaguuuggguggcagagugagacucugucucaaaacagaaauuuuuuuuuaaagguucagcaguauauuuuauguguucauucagcuuucuguagaaaaaaauugaagccagacuuaccucugugagacaugcuauacaugaaauguauaucaagcauuugguuuaguuagauggcacauugaaguacuauaaaaaaggacuuuugucuguucugaacuuugcuucagugaacacaacuugccuaacuguauuuagugucugguuuauaagacauuugacaauauggcagagaguauaauaacauauuuuauaugacugauauguuuauguucuaaaguggagaucuguuuuaaauuugauauuaacuucagaguccagguacauucuuucaaaugucaucacauuaaggaguagaauaagaaucuacuccucaaauaaaaguuaacuaucauuuauccuguuaauauacuuuucacauuuuguauauuuuuucaguaugacagaagaaauaccuuuagguugugucuacaugacuaggcaaaguuuuaugggcccugaauacauaaggcuguaugaucauaacucagaacucaucuguaucuuuguuugaugauaaucauaaucuuagguucaaauuagcucgaggggaacuggcugguuacauuguuauuucuaauuguguuggcuuugcacaaauuccuccucucuuacauuucauaauuuuccgcuugaggcacaugauccuguuacuugguuaaaucuuuaagauuuucuuugguguuuugaauuaauggguucaaagaggguccaacuuuauaacauuuaugcuauauauuuuuauuaacuguugaauguuugacuuugauauucuuuuucuuuuuauauuuaaaaggguugguauuucuuuauuacaaagaacugcaaaagaggauaucgccuuaccuuacaaaauaagauuuagguuugauuuacaagcaccaccaaaaaacauuucuguaagugaauauuuuauaauagcaauagauucccaggagaaauuguugaaaccaucuguauauaucuagaagaagaugcucaucucuuugggauuguuuagaucacauuuucuuuuuuaaaaaaagaggauugauguuugcuuugaaaaguugauuaggcuuuaauuucagaacuuacaaaauaauggcucuuaaagcuauaucacuuauucccaucgguuuaaaaauagauaauuuuaucaucgugaaguauuugauaaaacauguuucuuuuuacacgugaagcaacagaguuuguaaguacugagcguucuauuagcuacaacuauguccuguuuccaaaauaccuuacucagcauucaguaguuuuuuaaaaugguauuuucauguuguugaagacuauagaacaaauuaugucauuuuucuuaauacacaguuggagaaucuaaugcuggacaaagauggccacauaaaaauuacagauuuuggacuuugcaaagaagggaucacagaugcagccaccaugaagacauucuguggcacuccagaauaucuggcaccagagguaggcuucgguuccauuaauaggaaaguaacauugacauaaugauuugcaaaguaaaccauuuaagcauuaaaaguuaacuguaguaucuacuacuuuuaucuauauuucaaccugaaucaaaauuuuuuggcucuuaauuuguuauaaugggguauuguaggaucaagaauauacugaaauuaaauuuuauaaacuauaagcacaaagguacuagcuauagucaguuaaaucaauuuuuauuucuuggccauauccauuuuaucuuggcuauacccauuuugauucauuuauuaaaauagaauaauugauuucagcaagaguauuuauauuuauaaaccaucuuggacuuuccuuagaaacaacagugguuuuuaauuuauaguauuguggguuuauuuaaaauuauuuuauugggaaaauuauugaaaugacaguagcuacauuuuggaauuuaugucagaggaagcuccaaacugguaacuucccugugcuaaggguuccacaauaauuuauuaauuuguuuauucaacaaauauuuauuguguaucugcuguauaucagguacuuuucuggaugaugugguuacaggcacaacacagaaaaggauccuagucucagggaacuuaacuuucaguggagggagacagaauaaaaauaaauaaauaacauaaugucuuaaguuucauaaacaaacaaacaaaaaagcaagauuaaauguaagggugugguguggcuguuguagaugguguuccaguuacuaaugcuguguaacaaaccacccuaauacuuagcaguggaaaacaaccauuuuauauaaaauaauggauuuucugaaucaggaaugcaaaugggcacagcaaggauagcuaguuuauucuccacuauguaugaggucucagcuugaaagacuuuacagugagagcaugauucuauggcuggagacuagagucaucaggaagcaucuucacucacauguccgacaguucugcugccuguccacugguaccuuauuugggcuguuggcaggaacacuuacauguagcccuucucuccaugagucuggacuuccucauaaugacaguuucaaugcagucagacuucuuuggcucugagcccuaaaagcaaauguccuagggaacacauuagaagcugcauggugccuuuguuuccaccuaguaaaccaucaagacuauuaacuuuuuaaaaacuugauuucacagauauuuuuauaauuggaguacaauucauaugccauaaaacuuacucuuuuaaaauacacacuuuggugauuuuuaauauguucacagaguuguacaacuaucaucgcuguccaauuccagaauauuuucaucacuccagcaagaaaccccauacccguuagcuccucauucuuccuuccgccacaggcaaccacugaucugcuuuuugucuuuauagauuuaccuauuguagacaguucauacaaauggaaucauacaguauggagucuucugugacuggcuucuuucacuuagcauaaaauucaguguuccucccuguuuuagcauguuauacuuauuucauuccuuuuuauggcuggauaauauuccauuauauggauauaccacauuuuguuuauuuguucagcagcugauguacauuggguugcauccauuuuuuggcuacuaugaauaaugcugcugcuaugaacauuuguuuaugcaucuccuuuuauggccuauuuucagaagucacacaacaucauuucugucauacccuuacucccugaagcaguuguaagccugcacagguuaaagugguagagacagagaccacaccuuuacauuacagaagagcaugugagaugggagauacugccacagccaucuuugaaaaauaacaucuuucacagauacuauguucagcgaaagugaugguugauggaaagugaugguaccuguugcaaagguaaaagggaagagcuuuccaaagagagcagcuggugcuccauuuccccucaaacuccaauacaguuauuguggcuauaggcaaauagggagguguuaauauuugaugugugaggguaacuauuuaaugagcaucuacuaugugccaccugcuguguaagugcauuacagcuauuauuucauuuaacauuuggaauaaucuuugaugauagauagcaaaugcaauuuuuuaaaggugagggaucauaagaucagaauauuuaaauguuaucuguacacagcuaagaggugguagaaguguaaugaagauucuaauuagugugucugacuauaaagcccacuuuuacuuuuuaaacuacauacguccuggccucaaaaaauccuaauuugaagaccacuuacaaauauaaauaaucguaauuuuuaaaugaaugcuuuguaaaugcccaacaggaaaagguaaucaaaagaaauuaggaaguaaaauaaauccccaaugauacuagcauuccuuaaacauaaaguaacucaugcuggucuauuauucuaauacuucuuuucaacuagggauuacauuuacauuucaacaauguuaaguuauuguaaauaagugcuacuauuuaaaauacaauaaauuucauacuauuauuuucuugccaaaaauauaauuuucucucuuuaaaaauuuguaguuuagaauucucuauuuuugugguuuaauuagguaaaacuuuaguaacacuguuucuuguuuauucaaauaaaauauuuucuagaauagaauuguuuuuauaaaugucacaaaaaauuauuuguuucucuggaguucaguuaccccugcuauaaauuugcuauggaagaagauaugccauauuuagaauaacaaaauuaauugugucacaauuaggguaaauuauuucugaagaagaugaauacaucucauuuaagaagcagaugaucugagaaacaaauauauuauuucauaugcagugucaucaacugaagaacaaauuaagaaucuaaugcaagaagaguccacuuguuucugaauggaaaguuuauaguugccacaaaauuaucaguuucucuuuaaagacaagaaaacauuucuguauaccuuuuuuaauacuucaaaagucuggucuuuaaaaacaguuuguauacccauccuugguggauacacauugauucauaauucaaaucuggacaccauguuuuuauagggaagagugauuauuguuguuauuauuugaguaugagaaaucuugaaacaacuuacgaaauuguaacuuuuauauuuuaaauguugugucacauauugcauuuuuaaacuuugacuguguuuacccuuaaaaaaauaagaauuuaauuccuuuauucuggucuucagcguggaccauuuuacugagggacacucauucauucaucaaagaauuauuuauugaauauuaaguaucaggcauuacauuagguacugggaauacaacgaugguagaagauguuuuugcccucaaguggcuugcuguucacugaggugauaagacauggaaaacaguuauuacugugcaagaaaauaacugcuuuacuaguuccauacaguggaguggaaggaaaaggaaaagugcuuaagccugcagggaggguccggcaguggaaaaggggaagcaggaagagaggaggcuggacacauagauagggauugaaauguaacaguuuuagauuugauccugugggcuagggaaaauuacuugugaauugagagcaaggcgauacugugaucagauuuacauggucaguguuagggagcgauuggcaggagcugaagccagccucuuccuuuuaccucagauggugucucgcacuuuuuuuggaccuugaaauuucuaguacauuaccauuauuaaugcugggcuuuucgugacaguacuagaaguaguaguuguguaucagaucuguaauacauucuugacuacugcuucucuugugaaugacucacugucaacauuuuccccucugucuuuacagaagauuuguuuacacauuauguaggaaucuugcugcaaccuauacuucaucuagcaauaguguuccuucgccuuuuacguuguuuuaaucugguauaaagacaggugaaggguauuuugaagauacuucacaaagaguguuagaaaucaguuuaaagccaguuuauuaaauguccaaugucagauacauggcagguuuuaaaauaaacuugaguuuuaagugaacuuaauuuguuucuuauggcaaauuagaaaaacauaaaacuuacaguauaaauaugccauuuguugaaaaaagaauauuuuuaagguauuuguucucuuaucucuuuugaugaagaaugcagcuuacaaugcaguuuuccaacuugggaagcauuuaacaauacugcuaauguagaaaaggcuagcuuuguuuuguuuuguguuuuuaacagguuacagcgguucaguucuagcuggcauaugcacugugcauuuagugugcuacaucuugaaaacugcauuuguauguauaguuuuaaaugaauguacuuuugcucuuuuguacauucgaaggaaauaaacuuauaguaaauuauggaccauaugauaucuugaggggauuuuguuuuuauaaucugugcuguauuuucacaccuagaaauuauaaaagaaauuagaaaucacauauaaacucuuacugcuaaauuuuauuauuugauuuggcuccuauugaauccaaaccauuuuaugcagugcuaauuauuuagagucucagcuuugcucuugaguuagcaguaccugauccacuuuccaacuguaaaacaguuugaaaaucaaauguagcuuacaugcaagacccaacaaaauuaaaaguguuaagugcguuuuggcaguucacuuuuauuaugcccaguccucaaauguaccagcagauaaucaucugaauguuaguuauuuuucacaugcuuaugugaucacacaaaaaguacaugcuaaaaagaggcagauggugacagauggggaagguugaauaaggugguuuuggaaaccuagagaaaugcacuucuguaauaguguaaaaauaaaaauuauuugauaaucaaguuagaacuaacaaagauugcaaaaaaugacuugauuguugggaaauauaucuagcugugguugcuauugagaaaaaaaugcaucuaauuuuauuucaucuaaauguaaaaugauuuguuuuuccaguggcugaagugcaguauuugaugcauucuuuuuaguuuuuuagaaccccauucuuagaaaauguuuugcuugccaaaauuuuccugauuuuuucuuugaaaccuacuaucuuuaauaucuugcauauaauguaacauuuuuaaaauagcugaaauagaugagaauauuuugacaacuauuuugauacaaagauuugcucaaagucauuguguuagcucauaguacacauggagauuaauuucuauauaaauuaaaaaccaaagauauauauuaacuuccacaaaagguaguaaaggcagugccagggcauggacuaguguuguaggugugggaaauaguuagaagcuaacuugcuugaaauguauuaaacagaauuuucuuuauuuuaaauccaacaaagaauaaauguaaaauaugucauuuugugggugcugccaauguuguuuuuaggagaucugaagagaaaugaaugaggcuaaaguuacauauguuugcacauuuaaucuguagguaaaaauaguagcacauguaguuacauucugauuagucuuugcacaaaguccuacuauauuccagcagauuguaaaacuagucuuagaaucucuaugcuuuuugugaaaagaaagaguuguuuuaguagccuuucuaaaauuguggacaacccuaacauuuuauuuacuuauugauaauucauaugauaucucuccaccugggguaauuuugaaaaccuucaucuuccugggaauucagaaaaggucucaucaccaugauuaaagggaacauuaaaggaguagagggaugaguucagauagaagcugucugcucuauaguuagaauucauguuuaagaacuucuaacucucauaugaguuggcuuacuauuuaguugaauauauuuaauuucuuucuauaguauguugcuauuuuauaugauuuucuggguaauauuaaaagccauuccauuuuaucucauaauuggacauuguuuaaauaugaacuaaaauggaauuaacgccucucaauguuuauaaguggcaucuuuuacuuacuuagaggucugucaguucuuaaaguagcuauuuuucgcccuaacuucuuuucaauguuauauggucuuuuggcuuuaacagaauauuugcauucaguacuucggugugauucuaguuuaagcaugaaguuuaauuuuaaauucucuguaccaugagaacauauacaaaacuaacccuaacuggaaacacuggugauuaccuauaguauuuuacaauggcuauuguuacuuggguuaugaaggcucaguuucuuggaaucccauaaugucuauugcuucagaauaaaaaagaaguauagaaauuucuuggaagauauguguaaguaugaucuaaucaucauuauuguauccauuuagccuuucucuugucaaaggauuuuuccugugcuagccagaguuugcuuuugaaaguacgauguuaacuguauacaaguauuugugugugcuaggagagguggccauaaagcguacagcauucuaauucauagcaaauggcauugacaguugcugucacuuaagaacuauuaaagcaguugagaaauaguuauaaaauauauauuuaugaagaaaauaccaagcaacuguagaauuuauaaucuuauguauugaaauggauacuuuuccugaagcugcaguuuacuuuaaaaucugaaugagaagauuuauaggucuuuuuuucuuagcccauaccugugauguuaagaauaucugaagggcucccauaaaugauaaaugauacagauguauguuuagguauaaaacacacaucuaucaguuaccugaaauguaaggcuaccagaaaaaacuuuuuuuuugaauuagugguaaauugguucauccaaguucgcaguuuacuuucacagcauaggugugcagacaguuuguuuagauguuuaauuuuuucccccaucuguucugucaggauuauugauugagcaguaagccacuccagggcauacauagccuccuuauaauugcuugccuugggugcauuguguggccuggugggcaagcugagagaggggucccuuuaaccuccuaguaaauccuccugguaaacaaauauuguaaugaauaguuuuuuuuuuguuuugaaaaagcccauuagccaaauaaauauuuacauuaguaacuugaauugguaguaucauuuaaaaauauauaguuucucauucaauaucauucuuugaaauuaauaacaauucaaaaacuaauguguuuuaacucaccuggcuguuuuauaaauguaagugucuucaucaaauauugaucaaauauuuccaggauauuuaauguuaauuuguaucugcuguaaccuccuugagucuuagguuuuaucguaucauaaaguaaagcaguuucuggcuccuauuagaaauacagccuuguuuucuagacuuugugcucuguuuaaguuuucauuugaugugaccucucaucauuuuuuaacaauuacauuuuuuugauguuccaaaucuccucuuucaucucuguuugggcauuuguguuaaagguagguauaauguacaacuacaucugugguuacaaaggacuguagggguagaggaaauaccaaaugucugcuuuccuauuuaaaguuuggguuucauuuacaagucaguaauguugguuuuauggaaaggagacagaaguuauuucuucaagauaaaucuuucacuggauuuuuucaggagcauauuuugaucugcauuuauauccaaauuauaugagaaauuaaccuuuuaaugaaguugaaauaugcucuaccauuguuguaccuguccauuauaccacuguuuaucauaccuuucagccagcccucacaauaaccaugaaauaaauuagccuuuuagcuagaaaaaaaugaucagagguagccagaaagaauuugcaauccuuaaguuaaaaaaauguaaauuuuauauguuauguauuuauagaauaauaagugcuuugaguagagggagaaaaauugucuucuuaaaauaaugugaaagagguuauuggauucgaauugguuaauuuggcugugggauuuccagaguauuugaaaguauuguguuuugaaauaauuuagauucaggaaagagaaaggauauuguuuuaauagugggaacauauguauccacauguaggauacuguaaucauuauuuauguauguuucaucuuauagcuguuuggagauaggauuuggacaaaaaucuuucuaauugauagugaagucucuuagguaaagagggauuuuaguuguuaggguguuuucuucucagcauugcuuaaguuuacaugucaggaagacaauacguuacaucaguuuuguucaauacaaaguaauacggcaaacaguucuaauuauagcauuauguaucuguagaucaauuaaggcacguauguucagaggcaaaaucacuuauuuuaagaaucgauauucauuuuacaaagcuaaauaaaauguauuuuauuuuaucaaacagauuuuuuuacaaugcaguuuuauuuuucaguugcuuacuucucuucaaaaauaaaaccccccuuuuuuauguacucacuuucccuucuggcugcaaaccagguauuuaaaaaaaauaaaggauugccaguuuugccagcuggggaugagaacccggcuggugaaauguggguucgggaggcaguuaauccagcuuuuaugcuuuuuaugguuuuaugaaaaaaaaaagagguuaaaaaccacauuuggcuccuuuucguauaugccacuguuguguugguguuguaggaauguaguuaaagguuacuuagauauaaauuuuugguuguuauuaguuaaaaucuugugucaauuagauaaaggcccaccaacagugcauuguacuaauuggccaugagcgagauccuugaaucaucaaaagucagugguauuuuaaaauaauacaugcagcauuuccuuuaacguaaauaugaaguagaauuucuucugcuuuuuuagguuauuuuuuguuuucuauuuguucucaaauuacucauuucaaacaaguaaaaauaugacauucuuugcgcugaugaugaaaacuagaauuuguuguucuuccagaaaauguuuuuuuguuaguuugugauuuacaaaacauuucuagaaaagcauaggaucuaaacauguguucauaucuuaccagugaaguuuucaguuuuuuagccguaaaacaaacauugauauaauugaauuaaaaaucuuuucauaauagaaaugcuuauugaauagaucuuuuaaguaacauauuuuuucuuauaaauuauauccuuugucuuuaaauacccuaccaaagugccuuucauaguauuuuuagguaaucauaauguaacugucaaaaauaucaccuguaauucugugagauuauugguaaauuuuaaauaaaagucauguaggaguaaucuuccagaaaauauuuaauucgaagcaagaaaguuuggaacacaaguacugcuuuguccuuaucaaauguucuccuuuguaaucgguuguaaguguuuuuaaauugauaaauucauauauuugguuuuccccaucugguuuuccaaagcugagaggaucaaauaaaauaagcuuuaagauuaucaaauauaguuuuaaaauaaaauauucaaaguugcauauagaugaggaauauuccauuggaugaagaacaaaucugauaaaaagauaaaaccaaauuuuuccuggggcaaaugguagguuaccauguuaccauuugaacagguugcuccagcauaggcaaacggauacuuuuguaucauuucuaacuaaauuuauuuuacguguaauauauuuugggaaaaauuuaaggacauauaccacacagauauuaaguccauuuuuuuugcuguaacaggaauuuuuguugugagguauaaagcuguggcuaucaaaguuuauuacagcucguaccauaagcuuuuauauucacuuugucucuuaaauaguuccagaaagaguugaaacauacaggggcauccaaagguuuuucaaaguuauuuuaaugguugucuugcccuguagacuucuccauuacauugccuuuguuuacuacugucuuucacuguuuaauuuguauuacuuaguucuucuuaaggcaagaauguacagugcacuuuaugugcucuauaaucagcacacccuagcucugaguuguuacuugaaguccacauggguggaaccagaaugaaaaagucaguaggccuaagaaaaaauauguaaauaugcuagcuaacguuuuucauuugauccuuauguauauucauguacuugggauuuuuuuuuuuuuguacgaccugccccuuuuuuuguacacuggccauuuguggauauauauugaauauuucacauauuugaugugauuuguauuuuuuguaggaugcuucacaguuuaaaugucaagaucucagacuaccuaggcuuugaaaguuaagauucauuuuuauguaaaaaucuuauguuuuaugaauaaugcuuuaaaaguuaacauguaauaauuaaucuuuuuacugauuucacuuuuagguguuagaagauaaugacuauggccgagcaguagacugguggggccuagggguugucauguaugaaaugaugugugggagguuaccuuucuacaaccaggaccaugagaaacuuuuugaauuaauauuaauggaagacauuaaauuuccucgaacacucucuucagaugcaaaaucauugcuuucagggcucuugauaaaggauccaaauaaacgguaagccucaaauaacgcuuagugaauuacugaugaaugugguuaaaaauugagauauggaaauuaauucaaauauaacuaacuccaagaagcaauguauuugguguagacaucuucccacugagauccugacuuauuuuuaacugcauaauauagaacauuuaaaaauuuuucucaacucuuuccuaacuuggaaauuuuaugcagauuuaccaaauaaggauuuugagaguuucauuauccauauuaugagugaaaauuucuuaauugcucuguuacuugaucuuguggggauagaagaaucacuuuucuuucuuucagucucugggccuuuguauuucuuauaaaaggaauagaccuauuuuucaauacucuccucccacccgcaaccuguguuaacauaucuaauugcauuuuuuuuuuuuuuuuuuuuuuuuuuugagacagagucucacucugccacccaggcuggagugcaguggcgcgaucuugacucacugcaaccucugcuucccagguucaggugauuuuccugccucagccucccgaguggcugggacuacaggcaccuccaccacgccugucuaauuuuuguguuuuuaguagagacgggguuuugccaaguuggccaggcuagucuugaacucccgaccucaagugauccgccugcuucggccucccaaagugcugggauuacagucgugagccaccgcacccggccucuaacugcuuuuuugucauuugaaaauaaucuuuucuaugcauagcugaaagaguugauggcaaaaaauaauuguacacacuuuuaauuucuguuuuuguagcuacagcuaugaauugaagaacucuauggcucuugcugcuuuguucaaugagcuacaguauuuuuauucauguuuauacauucauucauauuuauaaauucauaaaucauaugugaaaugacuauuaauauuaaaauguuucuuaauauguguguuuguauauggauauaucugccuucccaucuagguaucugugcauaucaguauuucucugagucuacucauuugaagcauagaugauuucacauauuguugaauauuuuauaauaccucacauagaguuuuaugaaaauguuuuacguaugguugaugcucauauauauauauauuauauauauaugaguggguuaaugagugaaucccaaaaaguuggauuuuuaagucuaucugagaaaugguuuucauuguauucuucuagcuuuuaaccuuguaaggaacauggcuuuaucuucagcagaaauaagcaaacauaauaaaagagauauugucuuucugcuuugugaagacucauucaagaaacauuuuguaauccuagcugcagauauuauuuauauguguaaagugauuuuguuuucuucuucagagcacuuucacagcuauuaauucccuugcuuuuucaggagccuuguuggguggauaggggagauacuauucuuauuuccauuucauugaguugaaaacaaaggcccagagaggguuaggugauuucuucaaggucucucagaacauucaugcagaccaagaguagaagucaaguuucuuggugccuauuugguauuucuuauguaucuuauuuacaaugcagcaguuucucaguuuaaguuuugaaauguguuccguuugauagcguucuuuuacaauuaaguaaggagcagcacccgaugauagguaacuuuaaacagaguggugacuuuuaucuuuuuuuuuuuuuuuuuuuuuuuuuuuugagagggagucucgcucuguugucugggcuggagugcaguggcgcaaucucggcccacugcaaccuccgccuccuggguucaagcaauuccccugccucagccuccugaguagcugggacuacaggcgccugccaccacaccuggcuuuuuuuuuuuuuuuuuuuuuuugguauuuuaguagagaugggguuucaccauguuggccaggauggucuccaucuccugaccucgugauccaccccccucggcuuuccaaagugcugggauuacaggcaugagccaccguguccagccgacuuuuaucuauuucauuuuuuggucuaauauuuggcuugguauucgaggcagugaauauuuaucucaucguuuucuuauuccugcaggcaacuuugaccacccuuuacuuuguggcccucuuuauauaaguggcuaguagaacaaaauguacuugugguuuucauguguaugucucauucauuuuuuuuuauuugucagcccacuccaugaauagcacauagucgguacuuaggaacuauugaaugaaugugaggcaaauucuuagaauguuaaccgccuaguauguauuaauagaacaauuccuaacuguuuguucaccaggagguugauauugaucuaaugagaagaugcaguauuuucaaugaucuaauaauuucuuuuauaauagaugugucaagccccuccacugcugcaucaaaauacagagaauacaaggaugagugagaugaaccagucucugcucuagauguucauagaauaauuuggggcacaaaacauauacucacagaugcucaggucaaacuacauacaaaguacuguugaaauuauuggcuuugucuaggggauugggggacuugagcuggaucagaaaggaguuugaauuugcauuggcacucaagcacagaaauuuacauguagaguauagcuaggauugcaaaagaacauggcauuugagaaguucagugacuagaguguagaauaugaguuggguaacacugggaaaugaagcugauauauuagauuauaaggaucuuagguuucuuagaaaauauuuaaucuucauucagaagagggugagauacugcuuaaguguuuaaagcaagggauaguauaaucagauuugugucaugaaaagguaacucuggcagcuuugucauggacagauuagaugagugaggauccaggggcaggcagagcaguuaaaaguguuuauggggccaggcacaguggcucacaccuguaauccccgcacuuugggaggccgaggcaagaaggucacuugaggucgggaguucaagaccaaccugggcacauagcaagauucaucucuacuaaaaaaaaauaaaaugcuggguaugguggcacaugcuguagucccagcuacuugggaggcugaggugggagaaucgcuggagcccaggaggucgagacugcagugacccaaggugacaccauugcacuccagccugggcaauagagugagucccugucuuuuuuuuaaaaagaauauuuauggaauuguucagauaauagauggauuccuuccugaagcaguaguacacaagugauagagguuaugauuaacuagaaacuaugaggaaguaggaggaguuaggaaucccucugagguuuccagcuagggugauuaacagacaggguaugcaaaccaaggaggcuugauggggcuagauguugauaauaacuuuggguacacugagucugaaguuucuauauaaaaccaagauggaaaugucaagugagcagcuggaaauaauagaaugaaugcuuaaaagaaacacaguaacugacuacauggauugggaaccauaacuauaucuaggagguagcuagagccaaggcaguaguggcaaggguaguggauaaggagaagagggccuaggacagaaucuuagggaaccucaguuucagggggagaaagaaaagaaagcuaacaaggaccuugaaaagccuuuggaaacauaaguaaugauagcauuauaauacaccucuucauuuuuucuacgcagcuauuuuaaauacuacuggaauuuuucugguauuucuuauugaauugcuguuaguucuauccaagggucaacuaucauuuugcuuuuauuucuuagucuccauccuuucuguucauucuguuagccccuccuuuaucuuccuaugcggaguugauaggaaaagcaugaccucauguauucaguaacauuaggaaaaugugaauucugugauguuccuaauaguaaaggaauuuguaguagcugaggauuuagucuggcauucugauacuggaguuuaguauucuagacauaaauaucuuacuucaaagcauauuuuguuauuauuuuugaagucuuaaauuguauauuagagagucauugacacugaaauuuuugacaguuucacacauugaagaaguguguuaaagaauuucuccuagcuucuaaaauggaagucugauuguauucucagacuuugcauaguauucauagcugauauuuuaguuuuauauguauuugauaaauauagaauaaaugcuggcuauguucaaaaccaaaguauugcuagaaaacuugaggaguuacaaaaauggauaacuaaagcuggauuaaaacauuuuauuuacaaaaugauuaugauucuccacuccaacucccaucucaaguacaauucaaaugaaaacaguauugaaauaaacuacaacauaaguguaagaaaaugccauggagcuuugauguuucucaugcagacuauguugacgcaugcuugaaaauauuaaaugcuuuucagaaacguguuuuggugcuuuugcuucucugguuccccaagcacaagcuuagaaugccuuuuggauaauccagcacugaucuugccuucaaaggaguuugcagucuccugggaaagaaaccuacacaacugaaauagaaugaaaaagagggcagggucugaaaugcugagcucucacugaacacagaacuaccagucugaaaauuccaaaugcaaacaucgaacagcacuauuaugaucaaaccuaaaagugccaucucugggguauaguucauuuagagaauucuauaaggaucugggaguuggagacccagcuggugggaauuauuuaucaucacuaaagauauucagguaucaguugacuguuuuccauuuuaauugugugucaaaggauacuagguccuucccagucauguguuucuuagaucuaauaaccagaauucauuagaauuauauaauuauaaaugauuucugaccuacgauggcuugacaauuuuuugacuuuaugauggugcgaaacugaugcguauuuaguaugcuccucaacuaaugauggaauugcauccagauaaaaccaucuuaaguugaaaugugggcuuaucuagacauaacccaucauuaaguuuaggagcaucuguauuuguuuucuaugacguauuugguuuucuuccaacccagugguguuuuggaguuagcauauaccagcucucaagaaccaacuguuaaauuuucaccaauuuuaugagcugguuguauauuauagucauuacuaaaaauuauauaaauuuacuaauaauaggaaaaucaaaggucauaaauacuaaaaagucauuacuccuuaauuuguuauguuucacuguuaucuguauuuuugagauuaguuaugucugcuguaucuguuuggacauaauauauaaugguuugcuacuaugcaucucuuccugccuacauguucagugacaucuuauugguagcucgaaacuggccacaguggaagaauuuauaccgccagaauuggcaaauacuaugaguuggggcugcacuuacuguuuuguugacuguuuagacuuaagagaaaauauuaauaaugcagauucauuacauuguaaauagcaccaaaaaaugaaucuucuuccaccaucccaaaguuacuaaacauuuagcaaagaaaucacucacauaacugacaagugaaguucugaagucuccauuguaucacuuucagcuuugacuuuaacauaaacaaaaaugucaaccaauauucauguuggaacuaaucguaaguuucauccauuaguggcuuuggcguacagcagaaauuaacaaguuuucugugagaaucaggugacuaauuuacaauacacaacauuguauguuuuaugaucuuuguaaauuuuguguuuugcauucuuuauaucaguaaaauuuaaauuuauaugucugggguguggugguggcuaggucaggcaagguuuggucccagcagcuccauggcugcucugcucugagcaucugguaucuacugugccuuugaaaaaaaaaagaaaaaaaauuauauuuguauaaaugcaugauugcucacagagagcugguuguuaagcacuuaccagcacauaucauuucuaauaaugaacaaguccaaauaaagccuacuauauaaaauucagauuuaaauagguuuauuuuaucuuccuuuccuuguucuuuuccccucuuuuccuccuguucuuccuauuucucacuuuuaguucuuuuaugcuuaguaauauauacuauauuaaacugaauaagccagaaaacacugaaauuucuuuaccuauuauuaguccauuuucauucugcuaugaagaaauaccugagaccgcauaauuuauaaagaaaaagggguuuauuggacuuacaguuccacauggcuggggaggccucacaaucauggcagaaggugaaggaggagcagaggcacaucuuacagggcagcaggcaagggcaugugcaggggaaucgcccuuuauaaaaccaucagaucucaugagacuuauugacuaucaugagaacagcaugggaaaaaccugcccccaugauucaguuaccucccaccugguaccucccaugacacauggggauuaugggagcuacaguucaagaugagauuuggguggagacacagccaaaccauauuccuauguuguuucuaacccuugcagugacccaccagcaaacguuaucauuccccacucugcagaugagaaaacugagguuaagccucuuuucuguugucacacaucucauaagugccagacaugauugccucuuccagaucuaucucuaaagccucugcucuuuuccaaauaccauacuguucugaagcuaguucuuacaagcauauuaggaaaaauagaucuuauagcaaaagcuuuuuacuuuuagagcuauuuaucccaagaacuguuuauuacacagaaaauuacacuuucacaaaauauuuuuuguuaugcuuugagcuuauguaaauguuuuauacuuacuuaauuuuauuucuguucucauagccuugguggaggaccagaugaugcaaaagaaauuaugagacacaguuucuucucuggaguaaacuggcaagauguauaugauaaaaagguaagauuucuuuauggcauaguguguauauauuuuggcugcacugcuaaaaugaauuuauagcaaaaauauuuuaagugaauaaaaguuaaugauguaaugauacuuuccauuuuaccgacauuuaagugauuauugaacuucugugcacaaaauuuuacucaugauuuugacuccccaaaugccucuugagauuuugcucaacaugaucacagaauuuuucuauuuuuuucccauaauaauuuguuugccucucauuauuucuuuaauuuuaauaaagauaccaaguguuaauuuuucuuuaagaaaacuaguuaaaauuuuuuaauuugcccuuaugucuuuaauuuuaaagugaacacuucagauucauuuauacaaauccuuguuuuaaaagaaauuuaaagaaauuuguuuuuaauauuuaaugaagguaguaaacacagugucuuacuuuggacuucucugucauuugaaacagaacuuuauugcccacaaaauuaauacuacuaggccaggcaugguggcucaugccuguaaucccagcacuuugggaggcugaggugggaggaucacuugaggccaggaguuuugagaccagcaugggcaacacagugagaccccaucucuacaagaaaaaaaaaaaaucaacugggcgugguggcgcacuccuaagaaggcugcuaaggcaggcaggagaauugcuugagcacaggagguugaggcugcagugagcugugauuacaccacuguacuccagccuggaugacagagugagacccaaucucuuaaaaaaaaaaaaaacaaaaaacaaaaaaccacuacuaauuacauauguuuaguuuuauugugaucugcuuauuacuuuuuauucauuuauuuauuuauuuuuugaggcaaggucucuguuggccaggcuggagugcaguggcacggcacgaucacagcucagcagccucuaccuccccaggcucaaguauccucucaccucagccuaccaaguagcucggacugcaggcaugagccaccauaccugccuacguuuuugguacuuuuuguagguuuugccauguuucccaguaugguacugaauuccugggcucaaacaauccucucuccuuggccucccaaagugcuggauuacagacgugaaccacugcacccacccuucuuguucuuaguacugcaauuuuugcuuaaguucaggagcaggaaauuauuaugucugucccccccucccccugcuuuuuuuuuuuuuuuuuuucccccacuaccucagauauuguuaguacagacagggauuuugauacuuugauuuucagaugcuuguauaaaauguuuacuaugaaauguuuuucauucaauaaucuacuccgaauuuuucuguaauuauuuuuaguucauccauuucaguuuauuccaacauuucauauuuuucucugaaacauuuauuagucaacaacauuuauuuggggucuguuaugugccaaguguucuucucuguuaagccuuaagguaaacauagaauuaugucauaugaauuagaugaguuaggaggaaguaacacaagcacuucaugucuguauuauguuauugguuacugggaguauggugauuuucuguuucuuguaacuaggaauuuaaaauaggugcaucauauuagacaccucuacucgauucaacucacauaucuugaguuucuacuauguauaaaguaccauguuaaguacugaauccuucacaaccuuuaugagaagcacuugagcauuccuaaauguuuauucacuucuuacagacaauuuuauauccacuuaguaucacugaggauguuccuuaugaguugcaugcauauauaggaaugccucuaaugagcuguguacuguuuucaucgugucaguacacuacaaaagaaccuggaaggaagaagggcuugcugucucucccagaaaucaugcaugguuuuauuuuuaauaaauagcuaauaauaagcuacaacuaaauaucauccuuucuagacacccucuucuaggaggacuuacuccaaaaaaaaagaagaggaaaagaaccauuucuuuaagagacaaugguugagguaccaauguggcccuguaaauucaaggaagggccaaaauauggaccuucuuaguccugugaggaaauaagauuugcuacaacguuuccuuaucucaguguucagcuauucauguugaauaagaguuuggccccaccuggagaaagcucugagagcccaaccaguauaccaguaaggaagcaaggccuguccuaucucagcuccacuggguuagacaugcccaguguaaaggugauaguaagacagccaggagcuaccaugugggaauggaauuaggggagccagcagcucuggcagggaggaggagcugccuaaacaccuucugaugacauguagauaaauucguucaaguuguuauaauuauuuuuuuuuaaugggugccacuuaauuugagcaaagguguuaaauaucuugcauaaagaagcacaacccaaaaugacuguuucuguaaacaauagauuggucguggauuggugccaucuacaggcuuacucacgguguccugugugacccgcgaggcucugguguucucugccgccccauauauacuugaaggagcaacuuuauuauagcagcacuuuuaaauuugaguuucuuucuaaaaggaaaaugugauugagucuauuuggguuuguaucauaucacagaugaacaugaaauuaauuuugagaaccagccuggggguuaguagcuguuuuaaugaauucaguuaaaauuucaguguuuuaguguaaauuacuaaauaauuuauaaaauaaaacauuuuaauggaguccuuauaucuuuaaaauguguaauuuauuguaaaagucaauucauuccuaagaucagggauuauuguuacauuuuuauuguuuugauaaauuuauucuuaauuuauuaucacauaauuauugguuauuuuucuacuuauugcugcacaucgagaggugauggcacaucuagagauucuggcaucuguugaggagaucugaaucucuuucuaggcaaaguaaaaagugaaaguaaucuuaauuacaaguagcaugauguaccacucuaaagagcacaguaucaaaacaugaaagaacaaaguuggauccugguccuggauuugcuucuugcuuucuuuguggaaauggacaggucauuuacucaugcaaaagauaugauccuuuaacuaccuucaagcuuuuaagauucucuagcaggguguuuuauagcaugaauuuaucuagauuaaugucuauauagauuucuacguaaauuuuacacucugucagucugcuaagauuuugugugagauuguguugaaucuguagauaaauuuaggaagagcugacaucuuaacaaugagucuucagauccaugaaugcaauuuauuucuccauuuauuuagguggucuuuaauuucucacaguaauguuuuguaauuuucaauguuuaagucuuacacaaauuuuguuagguuuauccuuacguguguuucaugucuuccaagggaaaugauauuuaaaauuucauuuucacuuuguuuuacugccaguauauagaaauacaguugguuuuuucauauugaccuuuucuccugcaggcuugcaagaauuaguuguaguaaccuuuuuuguagauuacuuacaauucucugcacagacaaucauaucuucuguaaauaaaguuuuacuucauuucuaaucuguaugcauuuccuuucuucuuuugccuugcuguauuggcuaagaccuucauuauaauguugaauagugguaagagugagcauccugacuuuguuucuagucuuagggagaaaagcaccuuuuaccauuaaauaugauguuaaugagcacaucuagcagccagaucuggguuucuaacuauuauucuccaauaaaaggaaccaaggcuccuugaggacgcgacugauuucagcacuaguauagggggagaaaaaaagaugagcguggagaauuuuguggugucagaaaguaaggagggagccuuaaaaaaaaaaggcaagaccuagaaaacagcccaagcugaaggguccuguagcagaagcugaaacaauuucaguaauaaaguaaauauaguguuaguuuaugauccaaaggaugaaauauguaaucaugagucuauauugcauaaauaagugauugauugucuaaauaaaguguugagagggacaugucuuccuuacagaugaauuccaauuaauguaaaagaggugaguagaguagaaaaucaaaucaccauuagaacuccagagugaaaauugcucauucagaauucaccuaugaauauuaaaauuaguaagcaaaaguuuaggaaagaggauauuuccauacucucaagauaucucccugugaacauuuaucauuuacaaagguaaaaugacuaacuuuacaguggagagaucuggaaaacacaguuuuaaccaagugaucacgguuaacaucaccaguaaguaagauguugacuucauggaacccaugauaagaugcucugagaagggcacaguacuuuugaagugcucuccuccaagaugcauaaccucaguauaaucaugaggaaaccugaagaacucacagggagggacauuccucgaaauaccuggccugauaacuuuaaaaguguuagccucaugauaggcaaagaaugaugauggaacacucauagauuggagagacuaaaguggcaugaugacuuaacugcgaugugggauccuggguuggguccuggacuaggcaggggcauugguggaaaaacuggugaaauugaaauaaaguugguaguuuaguuaauaguauugcacugauguuaauuucuuuguuuugauauucauacuauggcuauacaagauacagaggaagguggguaaagggcauaugguaacuauguguacuauauuuuuguaagucuucucuaaguccagaauuauuugaauauguuauaaaaacaugauguuauaauauagauguuuuaugccuccuuuaucagauugaggaaguucuaguccuagguuacugagaguuuuuaaaaucaugaauggguauugaauuuuauuaaagcuuuuucugcacuuacugcaaugaucauauggcuuuucucuuuuauguucuguuaaaauggugaauuaacauugauuuuccaaaguugagugaaccuugcauuccuguugaaaaaaaccacuuguucaugauguguuauuauauauugcuagcguugguacauuguauuucuaaggauauuugcauccugaaauccugagugauauuacuaugucaucuucuuuuccuaaaaugucuuuguauaauuuucacuucaggaucauguuugcuuuuuaaaaacaaaaggggaaguacuccuccuuucucuuuaauuuuauugaauuguuuguaugggauuuguauuauuuauuaaugaaauauuuggugggauuuacuagugaagcucucccuagaccuggaguuuugucuuuguugguaaguuuuucacugugaauucaauuuauuuaauaguuacagggcuguugugguuaucuguuguuacucagaugaauuuugcucuuugugucuuucaaggaauuuaucaucuaaguuaaguuucucucuaaggacuguuagucaugcuuugcacauuuugaugugcuguguuuucauuucaaaagaguuuuaauuccccuugugauuccuucuuaaggguuauuuguaaguguguugauuaauuuccaaauauauggauuuuucagauaucuuucuguuacugauuccuagcuuaauucucuuuugguuggagaacauauuuuauaugauuuuaauuguuuuacacuuuaaaagauuuguuuuauggcccagaaaauggcuuauguugcuguauguucuauauacacuugaaagaaucuauacauugacccuugaacaaugugggaguuacgggcaccaugcucaaaaacccaguaacuuuugacuuccuagaaacuuaacuacuaguagcccacuguugacgaagccuuaaugaacaguugauuaacacauauuuuguauguuauuuguauuauauacuguauuuuuauaauauaguaagcuacaggaagggaaauauuauuaauaaaaucauaaggaagaggaaauauauuuacuauucaugaaguggaaguggauuaucguaaaggucuuccuccucguugucuucauguuaaguaggcugaggaggaggaggaagaggagggauuggacuuggcugucucaagagguggcagaugcagaagaaaauccggguguacgugggcccaugcaauucaaucucauguuguucaagggucaacuguauucugcuuuuauugcauaaauuguucuaccaguguucauuaggucaagacagcugguaguauuguuuaugucuucuauauucuuacugauuuucugccuacuuguucuauugguuucugaaaaagauaguugaugucgucaacuaugaucguggacuuuaucuuuuagguuuugccucauguguuuugaagccucauuguuaguugcauacauauuuagauuaaggauuguuuucuuggugaauuuaccucaucuuuuuuucuuuuucuuuuuuuuuuuaagagauggggucuugcuauuuugugcaggcuggauuugaacuccugggcucaagcaauccucuugccucaggcuuuugaguagcugggauugcaagcauacaucacugcgcucaucuuuaccuccuuaucauuaggaaauguucuucuguauagauggcagcaauauuuguuuugacaucuacuucaucugauauuaauauaaguacuccaccuuucuuuugcuuuuguguaauauaucuuuucccaucauuauaccuuuaaccuaugccaauuauauuuaaguggauauucuuuuagacagcauauagucaauucuuguuuuucuguuauucauuagaaaauacgacuuaauguaauggguagcccguuuucauuuaauguacuuaaugacauacuuggguuuaaauauacaaucuugcuguuuguuuuuuuuuucuuuguuccuuuuuuucucuuugucugccuucuuuuggauuuguugaauauuuuaugguuccauuuuaucacugcuauugucuucuuguaugucuguuuuauuguuuggagguuguuucuagaguuugcaguacacauguuuaacuuagucuaccuugagucauaaccaauucucauacaacagcauauuucuguuuccuccaucuauucuuuaggcuauuauuuucuuacaguuuacuuucacauauguuaauaaacaccacaauacaugguaaugguaauuagauuuugcuuuagauaauuauauuuuaaagugguugaaaaugcuacacauuaaccauuauuagcacucuccauuccuuuacauagacuaugcuucuaccugccgucauuguuuucuugauuauaaggcuccuuuaacuccacuuccaccucccuggguuuggaaaaauucauggaaaaauguguuugaaggaauacaggauugggaaaugaaggaaaugggacauuucagaaugggaaaacaaugugagaaaaaaaaguaguaacaagagaagugaaugaagauaugcugacuggaggaacugggaaucugugguggauagaaucuggauguaaacagcggacagguggccugugaauacacugcggcuucuugaaagucgaccucguauguuugcuugauccacuuaacagaacuguagaugcugaaguaaggaaaugacacgcagcaacuggauuuuuucaaguuuuguuggaauagacucuuauggagaagagccuggaaaagggaaucucauuaagagacuacugcaguaauacaguguuaagugacagagcucuuacuaaagcagaacauaggcaacaaagggaaaggaagugugaauuccauagaaauuaucaagaaauugaggacuccuauuuuagucugauaauacuggggaaaauacugggagaaaguuuaaggaagaggauuauagcugguuuuugguaauuaauuucagauagaauugucuaauggcuagaaauauagcacuucugggaguuaaaauggaaauaaauaugucuggaaauucagaguuuaauuagagcuguggaaaugauuaaggaggagagggcuaaggaaauggauaggagagagggaagagaaaauuugaaagggaagucaggagggagggaagcagugagaauguggaagguugggauugagugcuggaaaauauucauggucaauaauggaaguugguuugaggacacauuuuugcaagguguaucaagaucauuugugaagcaucgugccagaguugaaguggaacuuuccugaguugugacuuucuacuuucugguugagauauucagccugaagaguucggugauugauggcaguuacgcagagguuaaugauuguaagcuacugcuuuacaagugaagcaaggccagaggaguagaacagaugcaccagcggaagagagaugaaaggcugaaaauagguuucuauuugauacuucccuuaucacacucaaauaauggcccacuuuuaaacuuggggucaaagaaagauguguuccaaauaccugcuagacauucugauggcuaagccuuacaauuagugucuucuuuuggucaugaggcauuguacuuaggauauaaaaacacaaacagcugucaaaaccaguguuauuucuggcauaaaauguauacaguuaaagcuuuaaaagccuucaaauuggguuaggaaauauaacuagauguuccuuacaaaaaaucucaccuagaauaaaauuacacagcaaacuggaaaaaauaagaaugaggaaaagcuuaaucaucaaaugacacaaaaaguaaacagaggcaacaauaauaauuugaggcuaaguagauuucagauauuaaacgugauaaguagaucauguguagcauaaaugagaaacauauuuauuugcaccaaauaacagcaucuauaugcacaaaacaaacacuauuaaaaaugcaagaauuaacucaagauggauuggagacauaaauguaagaccugaaaccauaaaaaauucuagaagaaaaccuaugaaaaauucuuccggagauugaccuaggcaaagaaugugugacuuaaguccccaaaagcaaauacaguaaaaacaaaaauaaauaaauggggcuuaauuaaacucacaagcuucugcacagcaaaagaaaucaucaacaaaguaaauagacaacuuacaguuugggaggaaauauuugcaaacuuuacuucugaaaaagggcuaauacccagaaucuuauaaagaacucaaaucagcaagaaaaaauucaaauaauuccauuaaaaagugggcaagcaacaugaauacacauuucucgaaagaaaauaugugcaaauggccaacaaacaugggaaaaaauguucaacaucacaaaucaucaggaaacuaccaaauaaaaccacagugagauaccauuuuaccccaaucagaauggucauuuuaaaaaagucaaaaaacaauagauguuaauguagaugcgguaaaaagggaaugcuuacaugcuguuggugggaauguaaauuaguacaaccucuguggaaaacaguauggagauuucucaaagaacuacuaguagauguaccauucgauccaggaauuccacuaguagguaucuacacaaaggaagucauucuauacaaaaggauacauauacucauauguuuauugcagcacaauucacaauugcaaagauagggaaucaaccuaaguccucaucagccaaugaguggauaaaguaaaugggaugugcacacagacacaccuuggaauaucacuagccauaaaaaagaacaaaauaauguauucugcagcauauagauggaacugaaggccauuauccuaagugggguaacucaggaacagaaaaucaaauacugcauguucucacuuagaaguuggagcuaagcuauggguaugcagaggucuacagaguaguagaguggacacuggagacucagagugaggggaggauggaagagggaggugagggaugaaaagucaccuguuggguacaacguacacuauuugggugauggguacacuaaagcccagaguuuaccauuauacaauucauccauguaaccaaaaaccacuguaccccuaaagcuauugaaauuuuuaaaauauauuuuaaaauaauuuuaaaauauauuuuaaaauuauuuuaaaauuuuaaauauauuuuaaaauauauuuuaaaauuuuuaauuuuauauuuuaaaauuuaugcaagggagcugauagaaauacacuuacuuaacaugucuagagguuuaucaguucauugauauuuacaaagaucuggcuuuugcuuuuguuaguuuuucuccauugauuuucuguucucuguuucauugauuuccgcucuaauuuuaauuauaucuuuucuucuccuuacuuuggauuuaauuuucucuuuuucuaguuuuguaaccugaaagcuuagauuauuuguuuucgaucuuuucuaauuugugcacucaaugcuauaaauuuuccucuaagcauuauuuuaacuguaucucacaaauuuugauguuuuauuuucauuuaguuacaaauaguuuuaaguuuuauugaauuauuuaauauguguguuguuuagaaauguguuguuuagucuacagguauuuuggagcuuuccagcuaucuuucuguuacugauuuccaguuuaauuucauuguggucugagagcauacuuuuauaugauuuuuaaaaauuuguuaaaggugcauuuuauggcccagaacauggucugucaugaugaauguucugugugagaagagaagaguuacauauucugcuuuucuuggauaaaauauuccauaauguugauauuaaauccaguugauugauggugcuguuuaguucaguuauguccuuaacugacuggggggacauguugauguguccaacuauaauaguagagucaucuguuucuccuuccaguucuaucaguuuuugccucacguauuuugauucuguugcuagacacauacacauuaaggacuguuauguuuucuuggagaauuggcccagguaucauuauguaaugccccucuuuaucucugauaguuuuccuugcccuacuuugucuuaaauuaauauagcuccucccacuuucuuuaaauuacuaugagcaugccuaucuuuuuuccaucccuuuacuuuuaaucuaucagugucuuuauauuuaaaguggguuucuuguagaccauauaguuagaucuuguuuuuuuuaucuacucugacugucucugucuuuuagcugaugucuuuagaccacugacauuaaaaaugauaauugauacaguuggauuucuuacagguuuuuuuguuuuucuuuuuguuuuuggaaacggagucucgcucuguugcccaggcuggagugcaguggcacaaucugggcucacugcaagcuccgccucccggcuucacacuauucuccugccucagccucccgaguagcugggacuacaggcgcccaccaccacgcccggcuaauuuuuuguauuuuuaguagagaugggguuucaccauauuagccaggauggucucgaucuccugaccucgugauccgcccaccucagccucccaaagugcugggauuacaggcgugagccaccgcgcccggccuucuuacaguuuuuuauccauugcccuugcuguuucuuuguguguguguguaucccauuuuuauucugccuucucugguuuaauugagcauuguauaaggcaacauuuuucccucucauaacauauuaauugaauaaauuaugcuuuuuuaacuuuuuuuaacugccagcccuugaguuugaaguauacacuuauaacuaauucaaguccucuuuuaaauagcaccauucauuucacagauaguacaauugccauagguacuuugcucuuguguagaauauucuauaaaugucagugauagaauuggcuaauaguguuaagucuucugcaucuuuacugauagcuuaauggcuugcuuuuaucaguuacuaagagagaagugaaaccuucaacuauaauuauggcguugacuauuucuguuuauaguucuaucaguuuugacauuuuuuuaguuccauguguagaugcacccaaauuguaguauuguuauaucuuuuugguaguuuuaccucuucauuauuuugguuaaccaauuuauugguguaaagauuacaacggaaauaaaugaaaucgauaauugaaaagcaauagagaauaaugaccgaaaccgaaaguugguuauuugaaaaaucagcaaaacugacaaaacuuuaaauggauugacuaaggaggaaaaagagaaaaaugaaauacugaaucagaaaugaaaaaagauauuacuccugacuugagagaaauagaaaggguuauaagaugauacucugaagaaguguaugccaccaaguugaguaaccuagaugaaauggacacauuccuggaaauacacaaaucaccaaaaugacuuaagaauaaauugaaaauccaaauagaccccguaacucuuaaagaaauaaaaucacuaaucgcaaaccucccaccaaagaaaagcccagggccaguuggcuuuacuggggaagucuacccaacacuuaaagaaaaauuaaugccaguccuucucaaacucuuccaaaaauuugaagaggagugaacacucucucacuugcucuaugaagggagcauuauccugaugucaaaacuagaggcauuauaagaaaagaaaacuacagaccaaugucccuaaugaauacagaugcaaaauuucuuaacaauacuagcaaaccauucagcaguauaauuaaaggauuguacaccuuaaccaaguagauuuauuccaggaaugcaaggauguucaacguauagaaauuaaucaguguaaugucccacauuaauagaaugaaggagaaaacuugcaugaucauuucaacugaugggcagcauuugacaaaauucacuccuuuaugauaaaaacaguaaaaagaaaaaaaagcuaggaauagaaggaaacugccacaacauuauaaaggucauauaugaaaaauucuuggaaagacuguccuuuaagggaucauuucuauaguuuggaaaacccucagcucacauuauauucaauggugaaagacugaaaguuuuuccccugagauaaggaagaaaacaaagauaccacuuucaacauuucuguuaacgugacacuggaagcuguagccagaggaguuaaauaagagaaauaaaaagcaaucaaauuugcaaggaagaaauaaaacuaccccuacuaauaggugacaugaucuuauauguagaaaacccuaaaacauacacacacacgugccacacuugugcuuagaacuaauacauucaguaaaguugcaggaugcaaaagcaagcuagaaaauacauuguauuuccauauacuagcuaucaacaauguaaaauugaucuuaagaagaucaauuucauuuaaaauagcaucaaaaaaugucuuaggaauaaauuuaaccaaggaagcacaagacuuauacacuaccgacuacaaaacauugcugaaagaaauaaaagaagacauaaaugaauggaaagacaucucauguuuauauauuggauauuuaauuuaagaugagaguacucaaaaugauaauacagauucagugcaguuuuuucuuaaucuuaugguagaauacuauucaagaauaaaaaacaacucaaauuuauaaguaucaauauugauaaaucucaaaaaacaaacacagaaaaacaaaauacugaggauauuuacagaauaccguacuacaaaaacugaaaaugcaccauaaaaagcauuguauuuaugacaaaauauauauaugggagaaaacuauaaaaacuugcaugcaaaugauaugaaguaacuucaggacaauauuugcuugaaucauaggugauugccauucucacagguuaaaaugguugaacauuuccaggugcagugacucauuccugugaucccagcauuuugggaggccaagguaggaggauuccuugagcccaggaguucaagaccaauggcaaaaccccaccuuuaccaaaaauaacaaaaaauuagccgggcaugguggugcacgacuguagucucagcuacucaggaggcugaggugggaggaucauuugagcccaggagaucaaggcugcaaugagcugugaucacacuacugcucuccaagcuugggugacagaacgaggccucaucucaaaagauagagagagggauggauagauagauagauagaaugguugaacaucaaugaguaggaagaagguagguauuuagcaguaacuauuuuacaucugaaaaaaacagauguuugaaaauacauauaguacaauguuaacauccauuagauuugguuaucuuauuuucuacucuuaaugcuuaaacuaguucuuuuuuuauuuucaauucaaguguaaguuaaaagaaauagaacaccaagcuuaggcuacucaagaaaauugaagaguaguaaugaccccuuugucauuucugauuguguuuauuuggaucaucucucuuuuucaguuauucuagcuagcagucuauuuuguuaauucuuucaaaaaaccaacuccuggauuuguucaucuuuuguacuuuuucugcauuucaauuuccuucaauuccgcucugauuuugguuauuucuugccuucugcuagcuuugggguugcuuugcucuuguuucucuagcucuucuaguugugauguuacauuguuaauuugagaucuuucuaacuuuuuaugugggcguuuagugcuauaaacuuccuucuuaacacugccuuagcugugucccagagauucugguauguuguaucuuuguucucauuuguuucaaagaauuucuugguuucuaccuuaauuucauuauuuaccuaaaaguaauucaggaacacguuguuuaauguccauguaauuauaugguuuugagagaguuucuuaguauugauuucuguuuuuauugugcuguggucugagagugugguugguaugauuucagguuuuuaaaaauuugcugaaguuaaaccauccauguuugcagacaguaugguucuauauaccuaaacaacccgauuuucucugcccaaaagcucuacaauccaauaaacaaccuaacaaaaauugacaaauuaacauaagcaauaucucaggauacaaaaucaauguacaaaaaucaggauuccuaugcaacaacaacaucuaagcugagagcaaaaucaagaaugcaauccuauucacaauagccacaaaaagaauaaaauaccuaggaauacagcuaaccagggaagugaaagaucuuuacaaugagaacuacauaacacuggucagagaaaucagagaugacacaaacaaauggaaaaacauuccaugcucaugguugggaagaaucaauauuguugaaauggccauacugcccacagcaguuuacagauucagugcuauucuuauucaaacuaccaaggacagucuucacaaaauuagaaaaaaaaaccaaacuauuuuuaaauccauguggacccgaaaaagaacccgaauagccaaggcaauacuaagcaaaaagaacaaagccagagacauuacauuacgcaacuuugaacuauacugcaggcuauaguaaccaaaacagcaugguaaugguacaaaaacagacacauagaccaaugggacagaauaaauagcccagaaaugucacacaguuacagacaucugaucucugacaaagucaacaguaagaagcaauagggaaaggacucccucuucaauaaaugauauugcgauaacuggcuagccauaugcagagaagguggaaacuggaccccuuucuuacaccauauacaaaaaucaacucgagauagauuaaagacuuaaauguaaaaccuaaaauuauaaaaaaugccauauaagauaaccuaggaaauaccauucuggacauagaccuuggcaaagacuucaugacaaagacuccaaaagccauugcaacaaaaacaaaacuugaccuaauuaaagagcuucugcacagcaaaagagacuaucagcagaguaaacagaccucugcagaaugggagaaaauauuugcaaacuaugcaucugacaaaggucuaauauucagaaucuauaaggaauuuaaacaaauuuacaaaaaaaaaaaaaaaagcuccauuacaaagugggcaagggacauggacagacacuucccaaaagaagacauacauguggccaacaggcauaugaaaaaaugccuaacaucacuaaucauuagagaaauguaaauuaaaaccacugugagauaccaucucacaccagucagaauggcccucauuacaaagucaaaaaauaacagaugcuagcaagauugugagaaaugggaacacuuauacacugcuggugcaaaugcaaauuagcucauccacuguggaaagcaguuuggcaauaucucaacucaaagcagaauuaccauuugacucagcagucccauuauuggaauguaaauucuucugccauaaagacacaugcacacauauguucauuacaacacuguucauaauagcaaagacaugggaucaaccuaaaugcccaucaauuacagauuggauaaagaauguaguacagauacaccauggaauacuaugcagucaucaaaaagaacaagaucauguccuuugcagcaaaauggauggagcuggaggccauaagccuaagcaaacuaacacaggaacagaaaacaaaaucccgcauauucucacuuacaagugggagcuaaacauugaguacguaucaacacaaagagaggaagagcagacaccaaggccuacuugaggguggagggcaggaggaaggugaagaucaaaaaacgaccuaccagguacugugcuuauuaucugggugauggaaugacauguacaccaaacccccccaugauaugcaguuuuccuauauaacaaaccuacgugugugccacucaaccuaaaauuuaaaaaauagagaaaauugaagaguuaagaaaggagcaguagcuaaagggagcauguagaaugggugauauuuauuucauacacucaggaaugauccaaaagggagugugaaauuggagcuacauagaaacaaguaauauuuaagauaaaaacauacagauaguaagauguaaagugaguaaauacagaaaaaaauguaagaucucugaagcauagcuaaccuauagaaaggaggugggauacccuuguagugacaucaauuggaaagaaguaagacgcccaccagagcagauguguuuauaagcauuuaggcagaaaguuaugguauuuaggcagaaaguuaugguaguuucugacugaaggccucaaauucucucucucucucucucucucuguguguguguguguguguguguguguguguguguguguguguguguguguguguguguguguguguuuuaagagauggagucuugcuguaaugcccagguuggagugcaguggcacgaucacagcucgcugcagccucgaauuccuggccuuaagggauccucccgaauagcugggccuacagguauaagucccaccaucuuuauggcagaaguucugccuucuuauuaagagugagaagaauguuuuaugguugauauuagaaguuuuaagacagugacugucacauguagggauaggcucagagggagcuagagagaaacccaaguagggaccuauaaagagguaccgauugcuggagggcccagcugagguugaaaaucccaaagcccaauuuuaugcugacugcuaaagccuuguuccucgaaagaaaaaauuauaaugauuauaaaacauaauuauauaaguauuauauaaagcacaacuuagaaaagauuuaagagguauucuaggaagauugauuuagaauguuuggauuauuuugaaauggaucuuaauacuuauugcauuccuacuuaucuuucagagauuuccuucagaaaagaagaaaaaaucuugccucuagagaguaauuuagguacuuuauaguuuauuuuggucacuugguugauacucauuucaauaggauggcaacugauuacauaaguaauauuuuuaucuaucaugugcaaggcacagagaggccucaaugaaauaaugucuccucugaaagggccuaagugaaucuuccagaccuuacuauauuaauuuuaaguguuucgguuuauucauuaaacaucuguguuucuguuugaagauuaaucuucauaucugucccagauucuaaguuaggacucuuaguauuuauuauuuucuuacguauuugcuguuuccaguguuauucuuuuguuaauuuuuuauugagauaauucacccuuuaaaguauacacuuccaugguuuuuagggucuugacagacuuaugcaaccaucaccgcugucuaauuugagaacacuuucauuucuucauuuuuuuuucuuaaagauccauguuuucgucuggaauaauuccuguucagucuaaauuuuuuuuuuuuuuuuuuuuuuuuuuuuuuuuuuuuaaccauuuuuuguagugcagcuggcaaaaaauuuguuuucuuuuaugggaugaugucuuuauuuugccuucauucuuaaaggauauuuuuacugaauauaaaauuguggguugauaguuuagugaguacauauuuaaauauuucuuccuugcaagucaugugguauauuucacuggcuguuuucaagauauuuuuguuugugugauggcuuuguaauaugucaguugacuagacugagccaccuuucccaggauuccuuuugcuauuuaagauucucgugggagauuuggaggauagacgugacggaacagccauuuuguagcucauucauguugucugcuagaccaucuuauugguacguggcaguggucaggccugcaucagcuccaccuccuccugcauccuguuagcccuugagccuacuucugggcuggaguguguguuuagcuccaugaugaaagucccagcuuuugcaggauauccacaccagcaaggucaggcgguacgaauuaacacggguuucagucuauccuccugggcuccagcuugugcuucuagauuccauuucaucuuuccucuccuggcuuugcuugcaucuucgcuucucaacuuacuguccuauggacaugaagccucagcagugaacuuggagacaacagccuuacagagacaacauaacuagcucccacaaucagggaaauucaguuaccuguaaucucuuuacacacacacagaguaguucugcuucucucauggaaccgugacagacucugguuuuaagccuuuugacuauaauguguuuaggugagguuuucuauuuauucugcuuggaguugccugagcuuuuugaaucucuugcauauccuucuuuaacuuuggaaaacuuuuagccauuauuucuugaaauauauuuucugucuuauuaucuaucucuccuccucccccucccucccucccucccucccucucccucucucuuucuuucuuucuuucuuucuuucuuucuuucuuacuuuuggaaguuguccaacagguaugaaguucugcuuguuuuuucacauuguuuuccugugcuauucaaauuggauaauaaucucugcugguauaucaaguuuacugacucuuacauaaucuccaaugugcuccaagcccauagagagaauuucuuauuucagauauuuuauuuuuuuuuauuuuagguuuuuccauuugguccuuuuccuaauaguuucugugucucugcugagauuuucaacuuuuuuacucaugaacauauuuuacuuuacgucauugaagauaauuauaaaguugcuuuaaagucuuugucuacuaauuucaacaugagaucaucagagcaucaguuuccuuugaugucuuuuucuaguguauggguucuguuuccuuuguuuuuuuaaugcugagucauuuuggaauauauccugggcauugugacugguauuuugugccucugaauucgguuagguugcagcaaagaauacugaauuuuuuauuuucuuaggccagucaucauggaugaacucaaacugcaaacgcuuucuuuuuuccaguggguuaagauuccaggcugguuuauuuagacuucacuaggaggcuuggagccugcccugugcaugugugguucaagagucagagaucugggcagacuuuauacugagauuuuagggcuucuucucuuuggcugccucuuuucuggaauuucaccuccuucacuuaaaagcugcuguacuuguucaagcucuguccucugauuguucauggcaguagaacuguggguuucuaauuuaagauuuuuacccuaaauggcauaagcuggggcccaccuucaggcaaaaagccguaaaaaugagaaauucauuuggugccauuccuuauuccuagugcccaccuccucuuuaguaccugccuguuuuuaguugcuucccagaaccuuuagauuguuuucaugucuuucuccugagguuacaguuauauggaggaggguuaauccaaucggagcugcuugaccaugauuguaagugaaacugaguauuuguucuuaauuaugcauuauugcaugccagauguacaccuuuucuucauguggcacagcaguguuuuguauucaugcaaggaaguaucucacagauucacguuugugcaaccuucuaaagagcuugugugagagagcuuauuuaaacagugugaauuaccagugaauguuaugguuaguucagugcagccaaaacauaauucauggcuguuccccuucucuuuugucccaauucucaguaacaaauucagaccucuuuuuagagaacguguaauuucauuaccuuuugacaaugccuuuuagacuucacuagggagcuuggaggcuucccugugcaugcaugguucaggagucagcagaggcuggugccugguauguaugguucaggagucagcagaggcuggugcuugguguuuggcaccaguggccaaaacaccaaagaaccuccugugaauauuuucuugucuuuacucaccaaauauuuagugcuuuucuguaagucaugcacaacauaaugaugcuucagucaacacaccgcauauaccacagugguuccauaagauuauaauagcguauuucuacuguacuuuuucuacauuuagauacacaaauacuuaccauuguguugcaguugccuaccguauucagcacuguaacguguacagggcuguagccuagggcaguaggccaucccauauggccuagguguguuguagguuacaccaucuaggcuuguauguaaguacucuccaugauguuugacaaugacacaaucaacuaacaugcauuucucagaagagaccccugucauuaagugacacaugacuguaguuuaugguaaguauugugccaacagcuagccuugcagagauagcuaagauaaagucccugucuucaaacgguugcuuacaguuuaguagaagagacagauaaauaagcaggcgauuuacauuuucaugugaugcggguuguguuucagaggugguagaaguauuucagagguugccugacccagauuuuaagaguaaaggaccuguuauagaagcugcaguuaggauuggauuaaaauuaauuggguggugguugauauugugaugcuuuaguaugacuuuaguaugaauauuuaggggcucaguguuuucuucaucuuaaaaugaggggauuggacuagaucuauaagauuauuuucaaugugaauauuuugucaguuuaaagacacauugaagagaugcucaaaaaacauacuucuuuuuucuuuuuagggaauagaguauuucagaucauuuaaaguccuguuugagaguuuaccaggcuaacaggaaguacuacuugugauuucuuugccuguuccuguucugauguuuagcugcccaguacaaaccugcaaggggagccuuggauauccaauugguuucugaaagguguguguguguguguguguguguguguguguguguguguguguguguucguccuuuuuggagccagagcuucaaaacauagcuugcaucuucuguguccuucauaaaauuccaguugguuuccugcauucacuuaauuaguacagcaccugggcauaguagcucuggauaaauacagguucuuuucuccaauagcuuccuugcagaacauagaaauugcugccugccccuaugccucaaauugaccuucuaccucuuccuccucagcuuuuaaagccccuaucuuuccuucucaccacaaguucaucccccaacccaaauguucccuaucacugggucucuccagcauucaucuggugugguauuaagagaguggcuguggcugucagugcuagaaccuggacagagagagagagagggucuuggucacgucaucuuuacagaaauauaauaggaauuucucuauaaaaauaauagauacuuguuagaagcuuuaauguuauauuuuuuauuuauuucugguuuaauagaccuuaauguuacugccuaguaaccuaccuacauuauauagccuuucuguguauguguguguaucuauugaaacaggucccaaguuuuuuccaguuuauauguaggcugcauuuuucuuuucuuuucuuuuuuaaauuuuugagccagggucucucucugucacccaggggagugcaguggcgcaaucacagcucacuucacccucaaccuuccaccucagccucucaaguagcugggaucacaggcacaugcuaccauaccuggguaauuuuuaaauuuuuuuguagagauggagucucucuauguuacucaggcuagucuugaacuccuggccucaagugaucugcccaacuuggccuccuacauuguuggaauuauaggcgugagccacugugcccagccuuacauauauaggcuuuuauaacaaaauuagcuuguaaguuggaaauugccuuuaugucauuucuccccagucugcauacuuauucaacuuuugcucauguucuugaauauuucuaagagaaauagugauuaauggcugccacacugcugauguuggacagagccuauaaaaucagcugaagaagggagaaaguagauuguuucacuaggcucuuagugaaguucugauaguuauaauaaaugcaacuuguccuuuaacacuacuaggugcaaaaucuuuuuguuacccucucaugccuuuuaaaaaggcucccaguguuucacuaaugagagcccuuuuguuguaauuuauaggugaauccucuccagguauaacugagaucuucaaauaauguaucguaucuauggauguuugugaauaacaucaccugggcauaaaccuacagucaauaggaugagugcuuaugaaguuauuuuugaaugagaaaauuuaucacagaaaagaaaauacaaguuccaguuucuggggauuacuuuuuaaaguaaugcaaaucauccauaucauguguuaacaaaccccucagaauuccaacaaggaaagcagauguauuaauuaaacauuuaaugucuuuuauaguuaaaguacucauuuuggcaggucuaauauuacgauacaauagugguauauuaauuuguuauauaccuugggccccuugguacauuuuauguaggcacaagauuaacagcaugaacuucaauuauuacuguguaguuuuguaaaaaugaaauauaauuauuuuaguuucuaguuuuaugucaagaagaauucauugguauggcacagcuuagcauacaaaguaacuaaauaauguaugccacauacccauuaguuuuguuagaaauaaauccucuuuuauacuccugcuuuuccaguacaugcacaccuacauauacacaaagcgugaagccaguauuuaguagagauuaaauaaaccagaaucuccaccuaugauugacuacuuucucauguuguuucagagaagugaaaauuauagcaccagauuacugucucugggaaaucuaaacaugcaauaguguuggcaauucuuuacugcaaacaucuauguucacuggauuuuggacccuauaugccaacacaaagugguggaaauaaccacaguuguuaaggcaauuaagauaccacaaucacuguccacaucagcugucccagaaaguuucaaguucuccagucuauuucuuaagccccuggaaggaacaauagaagaaagaauauagauaucugauaguagcacgugacuuguuacuaaaaaaggucuguggaaucucuuaccuucagagaccuugguguucaugcauacacucauggaaucauuccagccauaccagaaauaccaaaugugacuuacucuaacaaccuucagaaaauuaucucuuuguucuuucauugacacuuuuaggaagauaguaaaugguagagugauuucauagcauuuaaaauuugauaaaagaucaguguggaaagaauuuagggagcuucaacguugcugucaccauacggacuugaaguugcauauuuucagugagaugaaauugaugucuugaacccagaaacuuuauccucuuguuuaagaucacugaauacuacauuuucugaaagcaaauugguuuucaaauaaagauuuguuucaaguuuagugcauuugucagaaaaauauguuguuugcaguuaaugacacuauagcuguucauugaguugauccauaaaaguagcugagauuuacagaaauauauaugacuaucuuuucuaaaugggaauuuacauucagucaguugacagaaauguuuugagagaugugguuagaggaaaagaagagaugaagauacugguuuaaagcugaaauaggaaauuaauguauuuaugugcuagggcugcuguaacaaaauaccacagacugggugguuuaaacaacagaaauucauuuucucauauuucuggcgaaaguccaagaucaaggugcaggcaggguuaguuucuucugaggugucuguccguggcuugcagauggccgucuuuucccugugucuucauaugguuuuuccuuagugugucuacuuggguguccaaauuuccucuucuuguaaagauaccagacugaguuaagacauauccugauaucucauuuuaaugcaguuacuuuuuuaaagaccuuaucuccaaauagagucacauucugagguacuugggguuaggguuuaaacauacuaauuuuggagggacacauuucaaccuauaauaauacaauauuugaaauuuguucagcuguuguuuaaaguaaauaugaggggacuucaaaaaguucauggaaaaugguauuaaaagauaaaaacagaaaauauaaacuuuauuucucaacauaagcuccgucaaguucaagacacuuuuguaagccaugauaccagcuaguuaguucaucccuaaagagcugaacauccugguaauuuaccuauaucagugcagucuuuuuuuuacauuauuaagugaagaaaaacuaauacucuuuaaaagcuuuuuuaaguuuaggggaaaaauaagucagaaggagccaaaucaggacuguaagguggaugccuaaugauuucucaugaaagcucucaugaaauaccccuguuuaaugagagggauuuagcaggagcauuaucuugguggaggaggacucucuggugaagcuuucccagaaguuuuucugccaaagcuuuggccaacuuucuccaagugcuuauaaucagguguuaucauucuccugcccuccagaaagucaauaagcaaaaugccuugagcacccaaaaaacuguugccaugaccuuugcccuugaccuguccaauauugcuuugacuggaccauuuccacuucuucauacccauugcuuuaucuucaggauuauacuaauagaaccauguuucaucuccuguuacaauucuucaaagaaaugcuucaggaucuuuauuccacuuguuuaaaauuuccauugaaaguucugcucuugucugcagccgaucugggugcaaugguuuuggcacccaucaaguggaaaguuugcucaacuuaaauuuuucagucagaauucuguaagcugaaccagaugagaugucuaugguguuggcuguuguuucugcuguuaaucauugguccuuuugaauuagggcacaaacaagauuaauuuuuucccuugcaaauugauguggauggucugucgcugcuggcuucgucuuccacauugucucaucccuucuuaaaauaaguuauccauuuuuagacugcugauuuauuuggggcauacuucccauaacuuuucauaaagcaucagugauuuaaucauucuuccacccaagcuucaccaugaauuucauguuuguucuugcuucaauuuuagaauucauguugcucuuacaggggcucuguccaaacugaugucuuauccuucuuagucccucaaacuugauccuguacagucauguuauaacaaaucaguaugaguuaauuuuggugcagaaauuuuuugaaaucugugcaugguuuuuucauaauacacauuuuccauaaaguuuaugaagacuacucaagaauauuauauauucuagaaauuuguaaugaaaucugaaguuggggcauucugaugauuuuugugggacugcuucuguucaaguacuguggcaguuuuuuuuuguuguuugacgaggucuugcucugucacccaggcuggagugcaauggcaugaucucggcucacugcaaccuccaccucccagguucaagugauucuucugccucagccucccaaguagcugggacuacaggcaugugccacuacacccaacuaaauuuuguauuuuuaguagagaugggguuucaccauguuggccagucuggucucaaacuccugaucugccugccucagacucccaaagugcugggauuacaggcaugagccacugcacccagccauacugaggcaauuuuuuacaagcccuacccgacaauguuccccauauacauaauguagggucuuugcuucccuacaaauguuuauauuccacugaguugucuucaccuucagggacaggggaaguggaagggggaauaaugcuuccuagaaugaauaucuugacuaauguauagagaaacaaucaaaagcaaaaguaguuuucauucaaagccuucacauuguaaaugcuacaguaaaaagaccuugagaucaagaaaccuagguuuuugccgcuccaguucuuauucguauaauuuuuggcaagccauuuaaccagugucagcuuuaauuuccugaucucuaaaaagguacacuacaugcucacugacgucuuacucagcugcaagacugaaugauugauucauuuauuccgcaaauauuguugaaugcuacuauguggcaaggacuguuuuaggaguugggaauaucacauuagugcaacacaaaguuccagaggagacaagugggaaacaaauagcaagaugguaaauuuaaucuuacucguaucaauaaucacauuaaauguaaauguucuaaacaccacaauugaaagacagagauuagacuugguaaaaagcaagaacuaccuauaugcugcuuauaagaaaccaacuuuaaauguaagauauaaguagauuaaaauuaauagaacagaaaauuauauacuaugcucaaccuaaucagaagaaaacuagagugcuauauuaaaucauaugaaguagauuucaaagcaaguaauauugcuggagauaaggaggaacauuucauaauaauuaagggagucauuucaucaagaaguauuaaccgucuuaguuaugcaucuaauaacaaaacaaaauauuugaagcaaaaacuaauauaaggaaaaauagacacauuuacaguuacuauuggacaguucaauauccaucuucaaauaauugauacagcaauuggagagaaauugguaagguuauauagcaacuugggcaauacuaucagucagcuugaucuaacugacauuuauggaacacgcuacccaacagcauaagaacacuuauuuuucucaaggucacagaucauuuaucacaguguaccauauguugagcaaaacaacuccaugaauuuuaaaggauuuaaguacuguaaaacauuuucucuuugaaggaaaugaaauuaaaaaaacacagaucuauggaaaauccccaaguucuuggaaacuaaauauuaauccauggaucaaagaagaaaucaaagggaaaugagaaaguauuuugaauggacugaaaacgaaaacacaauguguuuagcugugauauacagcuaaagcaauacuuaaauuuauaguacuaaauacaauuuauaguacuaaaagauauuuuuaaacauuagaaaagaagaaaaguguaaaauuaaugaccuuagcuucuaucuuaagaaacuaggacugggcacaguagcucacaacuauaaucucaguacuuuugaaggccaagguagaggaguucgagacuagucugcacaacauagugagaucccaucucuaaauaacaaaauauuagcugggcauacuggugugcaccuguggucauagcugcucaggaggcugaggcaggaggauugcucaaggaggcugaggcaggaggauugcuucaggaggcugaggcaggaggauugcucgaggccaggaguuuugaggcuucagugaacuaugaucacaucccugcacucuagccugggugacagagccagauuuugucucuaaaaaacaagaaaaagaaaaaggaauuagaaaaauaagaacaaguuaaacacaguguaagcagaacaaaggaaauaaagauugggauagcaaucaaugaaauagaaaacaaaaaaucauagagaaaauugaugaaaggaaaacugggcuuuugagaagaucauuaaaauugauguauuucucaccugacugaaaagaaaagugagaagacaaauaauaaauguugacacugcuacagauucuauugguauuaaguggauaauauggaagcauuauguauaacuuuaugccaauaaauucaacuauuuagcugaaauggacacauauguugaaagauacaaauuaccaagaagaaauagaugucaugaauagccuuguaccugcuaaagaaauuauaguugugguuaagauccuucugacaaagacaccagacccacauauuuucaccaacgaagucuaccaaacauuuaaggaauauuaucaguucuauacaaauuauuccagaaaauugaagaugagagaacauuucucaguucauucugugaggcagguauuaacuugauaucaauaugcaagagauuuuuuuuuuuuuuugagauggagucuugcuccgucgcccaggcuggagugcagugacgcgaucucagcucauggcaagcuccgccucccggguucaugccauucucccgaguagcugggacuacaggcaccugccaccacagccggcuaauuuuugguauuuuuaguagagacggggguuucccauguuagccaggauggucuugaucuccugaccuggugaucugccugccucggccucccaaagugcugggauuacaggcaugagccaccacaccuggcccgcaaagagauuuuuaaaagaaugcuauagaccaauauucuuaaugaauauauaugcuaaaauguuuaauuuaauuuuagcaaaucaaaucuaacaauagauacaaagaaucacuaccaguguggucuguucuaggaauauaagauugauuuaacauucaaaaccaaucacuauaguucaccuauuaacagaguacgaaggaaaugauuauaucaaaugaugcaaagaaaaaacuaagaaaaauccauccuuuuuaaaacuuauuuaaacaaaaaaugaaacgcucugagugaauuaggaauuggguuuuuuuuuuuuuuaacaugguaaaggaaaacaauuugacaguuucuggaaaagucaaauguauaccuaccauacggcccagccauuccacuccuuaguauuuguccuaaauaaauuaaaucauaugucuacacaaagacguggacauaaaaguuaauagcaauuuuguuuguaauugccccaaacugggagcaggcccuguguucauugacagaugaguguguccauugugauacaucuauguacugaaauauuacccagcaaagugaguaaacuauugauacauguggugacauggaugaauaucaaaguaauaaugcuaaaugaacaagccagauaaagaguacauacucuaugauccauuugcauaaaauucuuuaaaauacaagcaaaucagucauggcagaaaguaugucagucauggccugcaggggaugggaggauggaaguacacaugggcacaagaagacauuugaagugguagauguuuucaucaucuugauuuuggugacaguuucauggguauauacauaugucaaaacguaucaguugcauguuuuuuguuuguuuuuuugagaggguuuuacucguucgccccggccggguuggaaugcaauagcauaaucuuggcucacagcaaccucugccuucugggcugaagugauccuuccacgucagccucccaaguagcugggacuacaggcgcccgcugccacacccagcccaaguuguauauucuuaaugugugcuguuuaguguauguuaauuacgcaucaauaaacuuuuuuuuaaaguccuugcccucguggaacuuauauuuuauuggugaugaacauugacaguaacaaauacauguauaucauaugugugcauguauacgugccuguguaucagaugucgcaaagucuugaagaaaaagcaaugugaagauagaaagugagggggaggauagcuguuuaauguaagaaggcggucaggaaaguccucaguacacguggcauuugaaacagagacuauuuuaagcuccccuauaaucuuuugaaaacuguguuaagauagguuucaguuuguuaaaguuacaggucaucauucucucaucuaaaaggacaaguuuccccuaacuugaaggcaaauuuaaauuuuugacaucacaaagaaccagaugaaaaggauggggcagaggugagcaaaccuacuccuagugcccaagagaagccgauuccagccacaggaauuucuugugguuaacuucugauuggaaagauaaagaccuauuuugugaacaucuguagaauaguaaaucagaaaaacccaaccagaauuccagucuucccguuuucugccagauaggggcaauuacccccuugguuuucuaaaaaaaauaaaaaaaacaaaauuguuccagccucugucaccucugggguucccugugcgugugcaugugauaugugaggcugguguggagaauuuagccugagagucagagggaggguuucuagcaguggagugaccugcuugcucauguccaggggauccagcagggcagcuagaaagaaauauggucuggcacaauggcaggcuucuccuugccacugguggaggaguuuguuucaguuuagggauuagucgccauuaccagcugaucaguggaacguagaguugguucauccccaaaggagugcuugcuaaucaugaagaccuuagaauagcugugugcuggggguaaacagaaagaauuauaaaaagaagagauuaagaaugcuuuguagcauguaccauaaacugaaaugucccuuauuuugaaaaccugcuuuuaauucugcucaucccacgauucuuaaaaauauaguucugucuagagaauaauuuaaagauuuuccuuauuauuuaacauacauuuggugacagaaagagugggaaaaugcacugaucucaagccaauuguguauuuguuuuuguaaaauuuuuauaaaacaugcugauuucugucauucuguuugccauguuccuauccccgugagaacuguauucuaaagcagcauccccuguucugaaugauacucugcagagcacgcacucugacccuaaugcucugggacugggcauccugugcuagaaggaaccuguggguuccaccugucccucaaggcuagagcccugagaagcaggagccucguguuagcuccuucucccucccaaccaguggagguucacagggcuccggcuccugaaaccuccaguagcccgagacuuuccuuccacccccaccuucccuaacgccaugccugccgcaggugcagugcgaaugagaugauuccugcccugucaaucucaggggagcuacucuuaaucucuucugggcugugguccccuuugaggaucugaugaaagcugugggcaagauuuugcauguaacgucaggggcuaccaggaaacccuuuuccagagcagggcaggcaucaaugcccaucucuuaucagcaaauucuuagcaaaguacaaaguuguaguucuuuacgaagggcaaaggcagcacucucaucuguaaccuggugauagcuguauuauuaaguuguauuuuuauuacuacccucuucagcuagcacuagaaagagguugcccgaggaagagcccacauccuggcacacugcuccccaucaauaugguuuugcauguauguuuguuauuggggaaaaaaaccagcacagauuuuucaauaucccucucccguccuauucaaugguuuucuuuuguuguuuuucgugauccauuagauuuuauacagaaccaccaauuacccaccgguugguuuagacuguugacugggaagccaaauaucaugucucccuuacccagcgacucagcauuguagacuuuuguucuguucauuuaacuacgugcucucugcuuuuuuccuagaaaggaauuuuccugaauugaaaucaguuaauaaaacucuuuuucuuucuuuuuacagcuuguaccuccuuuuaaaccucaaguaacaucugagacagauacuagauauuuugaugaagaauuuacagcucagacuauuacaauaacaccaccugaaaaauguaaguaaauuuagaaggcaauugauaaauuucuaauauaauuucuccuaauguaauugaagaaaacagucuuuuaaaaacucaucugauauuuucaagaucaaauuccacagugacuuacuccauucuauuuaagaauauugaauauugaauugaauuuaagaauauugaguucccagugguaauaucaaaagacugcaagaaaugcuuuucuggguaggacaaauuauauagagagaaauuguagaugaaauuacagacuagcucuuccuuacuguucaccaauagauuguuuugacaccaacugaaaggauugugaaauagagacuccccucuuuccuagacuucguucauucccacauaaccuucagaauuuugccaguuuuggucuccuacuuacuuaauaguuuuaaaauucauguagagucacuccuuuuuacuuagcucucucuuaaauaguauuaucugugaagacauaauuuaguuugcuaauacuuuuggauaccuauaaauuacauauuuaugaaaacuguguguucauguaccacuucaagucaauucauauacauuaguaugucucacacuuggagaaauaccauaaauaaguggagcuguaaugagggaaaaggugaucagacauaauugauaaacauuuucaugcugacagaggucuguguguaucaucauuaacuuaagaauguggauaagauugcguuucagggcaauauuuggauggcugcaagaaugcuucaaguuacacaucuuuggguucacaucauaguuuuucuuuccuuuucuuuuugauuccuucccuauaugucuucuccucucauuccuuuuuuggaggcagauuuauccauagugcugauguggacucaguguccgggagaggggcgauuggaggcuaaugcugugccagagauggucacaggcagcagauucuacugucgagaggcaaacaaggggucaugugggccaagaggucuuaaucuugggaccauggucuggccacaaggggauugugaacacccugaaagugaagauaugaugacgugugugugcuuuucuuucuuuagauucacaaaaaguuaaggugcuccagguccugaaguugggucagccauagccagaagcagggcuuaccaacuugaccgauguccaggcuaaguugugaaauaccaauccauugaagugagcuacucauggucaguccuguggugaggcagaguuuccacucaaucuugugccauugcuagaauuuuagaaucacuaagagucacagacaauguuggaaagccuguggagucaugggcaaguagcucagcgcugaguagaaaucaugggcauaggccuuggccucuguccccagcauagacuguggcauuagaauuguccaaaaugcuggguaacaccagugaguuuucggaucggcccaugggcaguuccugccauacagccuuugcuaggcccuuucauuuggauauaauccuaacuguaaucagaccacaucauuccucugcuuaaaaccuuccggugccaucccauugcacucuaaauccaaacuugcucacacugguuugcacagcacugacugaucugggcccuguccaccucucugaccucuuccuguuccaucuucccccacugucccuggguuccagccacaccucgaacaugccacacgucaccaugccucgggcucuggggacaguauuuaugguguccaggccuggaaugcucuucuucccugaucuuacuuggauggcuccuucuuguccuucagcucuaagcuuacaugucauuccaucagagaaccuucuuugaccuccuagucugaagagcaucagucugacaacauucccucucucucuucauucucugcauuggcaccuugacuugcugguauuuuucuguuuguuugguuagugucuauuuccgccacuaacaugcaguggguuggagaggaaggaucuaguuugucucauucguuauuagcccaagcuccuaguuagaugccuggcacagugugcguauucaauaauacuuguuaggugcaugaauacacagaauauggugagggccuaggaacuucagagccgggaggacacccaggcuugccuccccucugaauauccaaagcagauauugggauaggaaggucuugacaggucucuuuccucagucucagccucugagaaaguuuccauucuuaaauagagcauuuggcauuugcguaccuuuagagcaaguaaauauguuauuuuggaagucauagaaauaagaaggcucuaaaaugucaagccaggaguagauauuuuacuuaagaaagcuaaaagugaaaucccaauuugggacauggagugaggcugaaaaagcccaggacucagaccuggggaaccugccuuguguccugccugugccccuuacaguucugggcgauggccggucacuuuguccccuggaaaagcagggagcagggcugauagucucucaguggcguuuuuguccucccgugugccugagaagccgucucuuuaggagaggcaccgagaguucugccaauuugaaucacccuauuuucaauucugcucaagcaccagauuggcuaguccauaguguuacuguaugcugugggccaguccauuuagggggaugauaggcccaacgcagcaagcaccuggcugcaggggugguguaguggagggccggcggacagggcugacuaaugcgaugcucagaaaugugagacuagaaagaccagagcaaaucaaaauggauuuggguacaaauaaggucaauuagaaacuguuguauaugacucuuaggcuagucagucauuuuuucaugauugacuugaauuucaaagcccuagcuuucaaggaccagaaucucuucgaaauucaucuuaccugcuuuauuccuuacucgacacccgcggggcacuuguccugaugagaauuugucauuagugugcauuuuauugcucaaucucuaggacuucuaaaaugagacugaaauguuagaagguguuagaagucccccagcacaguuucuagaacauaauuugaaccuaguuccuuggcuucauuaaucagcaauauaaaagccaucaagaauguuuuuccuggcaugucauauuuuaccacugacagcaccucuguucuuaaauaacaugugucauuucagacauggaucaugcuguaaaagcccuacaaccuuggugucuuuaaaugauaauagguucacuucuagauugagacagagauaccuaggaagccuguacauuguaguaacuuucaagaugguuaucaaaauccaccugcaauuguaggaccacaaaagucuggcuuuugucuaggcgcaguggugcacaccuguaaucccagcacuuugggaggccaaggcggguggaucacuugaggucaggaggagucugagacuagccuggccaacauggugaaacccccucucuacaaaaaaaaauacaaaaauuagccagacgugguggugcauuccugugauuccagccacucgggaggcugaggcaggaggaucgcuugaacccgggaggcagaagcugcacugagcugagaucacaacauugcccuccagucugggugacagagcaagacucugucuuuuaaaaaaaaaaaaaaaaaaaaaaaaaagucuggcuuuugugggugucagaaauggggugugguccugcccugcuccugggcccuggacaguacggaaacgagagcccagcaaugucaucuguuucugacagggcacaccgcaauugagggguggggagggcgcuauggacuugcuguguuuuucccuauucaggaccucuguagcaaggaaagucagacggaagagcucagcagaguaugcccaggcaaagacuagcaucgacgcaucugcaggcaccucuguucagcagccucuccugcugucuguguggcucagcagagcgcagcgcucagcacugggggccauggggcccugggcuuccugucuuaggggagcagccuugauggugguuaacugcagcuucuggguucuucuagggcaacggggcaguauuuuuaguuugacaguuccuggauacauccuagauucccuuaaggagcagauaaaaugagaaucacugaaaccuugaacggugauuacauucaacauaaccuuuuucuugcagcuuugaauaguuuaacugguaagaaaccguugcagcucccuaagugcuaacacacagagguuuuguugauaaaaguccaggguaguaccauucguuagcaauugucuucccacuugccaccuugcuuguauaaaacagaauacaguuauuguuuagaacaaaucagcaguuagaaaggcaaaauguuccauuuucuacaaacagcugcagugacaugccagauuguccucacuggcguuaauaauggaacagauuugggaaugugucaucuuucguuaucgccauugaugguccuccuccuuccucuuacagaaaaagaggguuucuuugagaucuggucgcuuuuacugccauauaaugccauuuguuaaauguucuaagaaaaucaggcaacugauguuccuuggaugcagggauucaagggauguagcaaguagaguugaucauugucuucuuuuuccagauaaguguuuuugaaaaacauaguucauguucauuaucaucacuauucccuaugcacagccucucacagcaggaacuaacuuguguacauugacaggcuccgacucagagucagcugccacuuccuccagcuccccucccaccgcagccccugcccaggcucucagcucuuuuagggccaugaucagauguucacgccucauuguuuccaagccugacaacagaaaggggcaggaaugauggagggagaucauuggcuuuaaagaauaucaaggauuggggcccucagggauaucugugaaauuuccuagauucagaauugugaugaauguguuacugaagugacagaaugaaggcugucucucaauucuuagcugacaccagcaagagucccuccucuuccaaaagggugucuagcaccugccccuguugagcaucuggcuaaccugggugcugaaccucgccgggcuggaaugaguccuggccauggccccaggaguccaggcagcuccugcccuuccuggcugagcaggacaagcaccaggcuccccacugcuguccagagccagcugcagguuugcugugcagaaacacugaguaaaauaaagcuguuggugaggaaaauuguuuauuugaaaugugauuggcucaugucagaaucugaacauuaagguuuuagcugcccguauucucuagagaguuuuuauacucuggggcucaaccacggguacaccaucauucccagcuccuuccguuuuuacuguagcuaaaaauacugcugaagguauuugaucuaaaagaugugugugacuugcuugguacaaauauuggaaccaauaacuuuauaaggagguagagauuuccccaaaucucaauaccuucuagaaaugcugacugcaguuacaguggucuauuugcagaagaagagagggccuccgaguucagugucuuacacagagcagggagccacaaaugcuucuugauggaucaguucucaccuaauacgaggauaucuucugguacauuaggggucagaaauuuuggcuaaugccagcuugaucccauuucuagaaucuucugcauuaagagugggauacagaaaagaaaaacagugauacaagaauggaaguguuuauucuucagacaaaggcagagcccccuccucuucggagugacagagucagagccucagugcagugggaucuggccuguaugcuuucuuuguuuacacccacauccagcggaugcucccuggagagguuagaauauucaaaaaaauugguaauguacuuccuauauggguuugaggacaucgaauuauuuugcuugaagagaaaaggguugaguauuggaaagauucacugauuuccauugcaggacagcauaugauuaaacaagcuuagaggcaagcacgggggauuuaaaauggagcaccucccccaggagacugugaggccagggggcccuugggacuuuguucaaaguucugcgguccuugggccugacgggugcucagcccagagcagaugcgugggagcgcauguugacugaguggcugaccacguggccacauaccaggaagagcuuccaacagcacaggacugucaucacaggacauuuaugagaacagggugcugaucaucugugaucuuugaaauacaggaaaccaggaaagcugacaggaggaacacugugauugucagcggccuguuuugaugccuuucaagucucuuccauuguuuccugaugagcuaggacucagauguugacauccuucccucuuuuucuuucacuuagucccuucaugcuaaaguuuuaucauagggaaauugggaaaggugaguuaagccagaugcuagauguugaaugaaauuucauaagaagcuuuauuuugcaguugcacuuaaagcaucacaaagaaaaaauauaagcacuugaagacauucgaugaugaauucuauacagacuuuggaugcuguggauuucacugacuugcaguuuugauauaugugguuacaugaaaugaaagguuacugaagacugcuccuucuuaaaaacuucuguuuucuucaauaccauuuuuuucacuguuucauugagucuugaaauuuugaugucuuagagaugauucuauaguauuauuucuucauagacuauguauuuaugaaaaucagaugauuuuugaaguauaauuacucuacagcuuauugaugaacacaaguuuaugggagcuauugccucuguucaucuuuccuauguucagaguuuaaaaaacauagacuagagauaauguugcaaaaaaugaauguguaaaauuaaaauagauguuuccugcccacagaugaugaggaugguauggacugcauggacaaugagaggcggccgcauuucccucaauuuuccuacucugcaaguggacgagaauaagucucuuucauucugcuacuucacugucaucuucaauuuauuacugaaaaugauuccuggacaucaccaguccuagcucuuacacauagcaggggcaccuuccgacaucccagaccagccaaggguccucaccccucgccaccuuucacccucaugaaaacacacauacacgcaaauacacuccaguuuuuguuuuugcaugaaauuguaucucagucuaaggucucaugcuguugcugcuacugucuuacuauuauagcaacuuuaagaaguaauuuuccaaccuuuggaagucaugagcccaccauuguucauuugugcaccaauuaucaucuuuugaucuuuuaguuuuucccucagugaaggcuaaaugagauacacugauucuagguacauuuuuuaacuuucuagaagagaaaaacuaacuagacuaagaagauuuaguuuauaaauucagaacaagcaauuguggaagggugguggcgugcauauguaaagcacaucagauccgugcgugaaguaggcauauaucacuaagcuguggcuggaauugauuaggaagcauuugguagaaggacugaacaacuguugggauauauauauauauauauaauuuuuuuuuuuuaaauuccugguggauacuguagaagaagcccauaucacauguggaugucgagacuucacgggcaaucaugagcaagugaacacuguucuaccaagaacugaaggcauaugcacagucaaggucacuuaaagggucuuaugaaacaauuugagccagagagcaucuuuccccugugcuuggaaaccuuuuuuccuucuugacauuuaucaccucugauggcugaagaauguagacagguauaaugauacugcuuuucaccaaaauuucuacaccaagguaaacagguguuugccuuauuuaauuuuuuacuuucaguucuacgugaauuagcuuuuucucagauguugaaacuuugaauguccuuuuaugauuuuguuuauauugcaguaguauuuauuuuuuagugaugagaauuguaugucauguuagcaaacgcagcuccaacuuauauaaaauagacuuacugcaguuacuuuugacccaugugcaaggauuguacacgcugaugagaaucaugcacuuuuucuccucuguuaaaaaaaaugauaaggcucugaaauggaauauauugguuagaauuuggcuuugggagaagagaugcugccauuuaaccccuugguacugaaaaugagaaaauccccaacuaugcaugccaagggguuaaugaaacaaauagcuguugacguuugcucauuuaagaauuugaaacguuaugaugaccuggcaacaaaaaguaaugaagaaaauugagaccugagugaagauaagaaaugaucuuuacguggcaaaaugaacacaucuugaguauuuaggaaaugggcagugaaggcuaagaaccugguguguuucuugggaucaugguacauuuaucacugaauuaagccaucagggaaaaaacaacaaaaaaagagaacaccuccagcuuuucuuuuucuguauauacucaugucccccagauuccaacauuucucacugaaagggggcauguaugcaaaccucaucuuucuccuucauuaaugaugaucuucagauuaaacccuuuggugcuaggagcugacaauuuccaaagcagccugugaaguccuaggggcugggggccacucuugcggcaagcagaaggccauccuacuccgcggagugaucauggaaauguauuuuaguuaaacucugacagcucccaaacggaagacuacagcaugacguaguauuaugauugcauuguaugaaagagcaagugacuuucuaaguaggaugaaucauauucauaugcagaugucuuagccucuugacgcuggaaguguggauuuauagcuaugaaaccacugcuggcagugggugggccacugggacugacggggguuaaagggcauuuuacuaaggcagcuaagacauauucagacaucaacguuauccuucuuuuucauauuucuaccugagugaaguucauccuuaguauugaguaggaaguuacaguaaaugguaguucauucuuacuuacacacauagcuaaucuuuuuuuuuucacuuggaauuauguugaauguuucauuuugacaaaaaaguagacuagaagguauguucuuuaaguugucuugcauccauuauauaagaaagaaacaggugagaggaagagcagaaagcugagacuggcugauguucagagcacuuacuccucuagagggaaagcaugacaccgaacacuaagcacacagcuuuuuguuguuuugguuuuuucucccgcaaaucuuaaagugauucccaugaccuuggccaaggacacuucuuaaagauuaaugacuggcacugacauugccccaggcgggccacuccucacacuggcucucaguucccagccaugccuggggcucagucacuucuauuccacccucugagacuccauuggugucacacaaggugucuucuuggcuuugauuuugagaauccccuauuuucacuuccagaucugucagcugccauggaggaauaauagaaaaccagaaaugcguguagagggagauuucuaaaacuucccuugugucgcccauaguuguaguuuuggguucuggcagguggaacacccugaaaccuggaaucauucuaugagaauacaguucagacuuugcagacuccagcccauacuaacugucaugaagcuugacuucuugucauaaugcagccaucuuggaggaaauuggccauuucugcuuagaugguuggcagggucgcgcucagcuuugcuuucuacacuaauuacauagcauuauucaaguauuguuuuccauuucccaucccugauuuccagcuucuuaaagcugacuguucuugcaggggccacuugcuucuccuagaguacaaaaguaagggccuuccuuacuaacugcagggucucucuauuacaccucaacauacacacuuugcugcuacuguuuguacugucuacaguagaauuuccuuaucuugcuccugguagugcauuacaggcaagcaugaaauguaaaguauuuauuuaaauaaaaagaaaaccucuaaauugguaauugaauuaccucccuguagcuuuauaguuugugacauuucuugaccuugcuaguucuuucauuagaucugcgcaagaucuagucaucugguuaaggauuuuaagcagaugcaacuauaaacccaagaaacuguauuacuauuacuguuggucauacuaaaccugucuauuuccugaaguauaugacccacaaggauguggaauaacuaggagaaacuguuuuuguacacuguacauccuuaguauuuuuacacguauaugauagggaugaacaugauuuuccuucguacagacagcuuaaauaaagcacuaugucaaucugcuacuucucuguuuauuguuguuggaugugguucuauaauccccccaaauuaaaucuucuuuaaugaaaacaugauuuuuaauagccccagcugguauuaaccuaccuuguauaaaaugugacaggaaaauauagaaauaauuccuuguagcucacacacacacacauaggggaucauuuuuacuucagugaaauggcaguagugcgguugugcaaacuuugaugaacggcugcuucugaggggaaacgcugaccucucagcacuggauuuaggauggauguacugugaagccagggaugaaggaggucucagacccuggggacauucagacccgaaucaucuauacaacacacgguuuggacccagaaucugaaggaauguagcuuuucauuaacgucuuccugauaauguacugcucugcauauuuccuuucuuagaguguauuucuaacaacaugucauggcaaauuaacaaacuuagacgugggugauguagauggguaggauggcuggacugcagucugacuucacguugaaucauucuggauggggccuuuuucugauuuuaccucauaaagcuacuauuguagaaacuuggcuuugcuccugugacgaagccagacagaggaauggcuuuugggaccagagugagucaagcauguauguguaugucacacggccaaauuugagggcauucucacaugugcucuucucucaaaaccacugggguugacagauccaggaggcuaaaaaaaagugaccucuauaauucuuuaaaggugcuauuuuuagaauauuguauaauuuauucacaguauaucuaaaacagaauuaaggacaauuaaaauaucuuaugugacagccuuuaugucuagcacauuugaugaaauaaaaaacuucugaaucugaauagaaguucuacuguuucaggcuugaaccuuuuacaugcucaagagauucaaauggucucuguguguagaucaugccaccgccuccaaagccuaauccacaucacuucugagaggcaaggcugagcauauggugacaucagcucuguguugagauggugaugaggaugauggcucgcuggccaggcagggcagccgaaggucagggaccuguccuaacuaacugcagccuugccuuuaguguuugucauucucagauacaacacgguauguccaguguccguuuuuauuacuuuaaagcauuugagggcuuaauuguguauaguagaaauacuauuuuagacaaauaauuaucuguguacagauauuugauauacucuaaguaaauuuucuaauuucacuaaguacguuuuuaggcuccucucaaauacugcguauugaagaaaaaaaucugacaccaccgagccaaagaugcuuuuuugucuguuuucguuguuuaacagaauggaaagaguaaugcauagugcuuccuggugucuccugauugauugauugugcacaaaguaggacgauaaauaaauaaaauggagucugaugggacauugauuaaaggugaaggaugauugauauauagaucaugaaaagaaaaaugaauggcaggaaaaaaaguuugguccuuaauauacuuuggccuaguuaaaauaugugccuuuuugguguguuuuguucaucacuacaagauaaaaaggaaacauuacaacucaagucuuuaaaaaguucauuuauugaaaaucauauguauaaccuagcauacgaaugagcagauuuaaacacauaacuucaagccauuucugaaaacauacaccaggagcucugcucagcuagagucagacuccagcuccagcccgacugcgugcggggacagcgcccgcguugaugaggaccagccccacugcaggcugaggcggugucacccugggaaggucguggugcguuguggcauauuaagucuaaaccagaugaauguaaauaucucuuuguaaaucauuuauuucacucuguuccauccaggucagcaaucagauuguggcaugcuggguaacuggaaaaaauaauaaaaaguaaguuucaauagcucauguucuucaauguuauuugucuucucauuugcugguuuagucaccuuuuaugaugaaaacuguuguuggagaaaaaaaccuguugcuaaaaauguggaaauuauaugaaaaguuugugccucaucuuguccacaucaaagcccuucacauaugaaauaagguuaacugguuuaauggguuaaauuugaagacaaccuagacaaaagacacgccugccucuuaaauaaggacagucugguguuaggacauggccagagagccaucucuucuguccgggaaaggacacauugauuugugccauaaucuguuuacugaaaauuuaucugaccuuaacggcagguaauucuagaacaaaaacaggguguaggccaagugccccuaagaaauuccucgugaaacaauacaagcugaaacaccuccaaauuuguaacugcaagcaauuuauuguaaccuaugaaaaaguacuuucacauggaaaccucacauguguuggaagaggggauuggguguacugaggucucuuaguuuuacgcagauacaaauguuccaaaguagcuucaugcagaucagguugggggagaaucacaaguucagaaaguauugaauacuguuccuggccucugcugccauggcugcccaaauuaguuuaaaccacaucaggaacuagagucagaagccacuggaaauguuuccacuccacaaagcaugucuggaguuucuacugugcacugugugggaaggugacugggccacaguccucgcccucuagauugugaaguccagagaaaagccaggaugguauuuuccaaaucccgguuucuacgucagauaaauugggacgcacugcagggccaggggcccaaucuggucccucuuucuuuaguuaggaaccaucuuccaaaaagagaagugggccugccccucuccagugaggauuuuccaagcuggacuccaagggaggacucuaucaaccuaauuuaagccaucauuaacauggggauuuccaagacagggcaaugagugaaacugaauccgcauucaagagaaauauaugaacaucagccuguugccuuuuaugaaaaaugagaaaaaguaauguuuacauuucaaguagauuucccagugugugagagacccugaggacaacuuuuucuugaacaggucugugaguagugggguggucucagcaggguaguuagaguagguggggggccuggccucaggcugaaugcagguggggcuccggcaggaggccucacuccuccucguaaaccugccaucccaugcacacagcccucccaggcccguggagccagguggacaauuuccugggcccacgggaugcuuuguucuccaggcccugucugaguggcccaugaggaguccaccccaugcacuaugcccuagagcccugccauugcagaggggacucccuucuguccucagugggauacugacagcacggagacugccaccaacacgaucugauugucaaacgcaggguuugcaccaagcugacgugcccuccaggccaggugaucgaacugacccagcacaguccugcuaaaugacugguuugaauggcccuccaccccugcuccauggauuggccacauaaggcagguggccugguggccucgcucuugacacaguggcuuccuaacuuuagaaaugcuaggaugacugaauacaaaagggauaagcauaaaucccaacagauaacacuucaaaagaaaaacaacccaacaguggcucacaccuguaaucccagugcuuugggaggcuggggcaauaggaucgcuugaguccaggaguucgagaccagccugggcaacauagugagaccucaucucuacaaaaaaaauuguaaaaauuagccaugugugguggcgcaccccuguagucccagcgacucaaaaggcugauguaggagaauugcuguagcccagaauucaaggcugcagugaugaauuuuggguagagaacacacccacguacacacaauacagaauaggcguaaagaccugaaguaaaaguaaaauguguugcggaauuuuuugauaagcuccaggaaacaggcauuucucaugaugagucuacauaaugccugugggcucccaggccaccuagcaauuuaucacuaucggagcuguuccagaaacgggugaccuccugauuccgugggccugcaugggggugacacagauguacgggccucaccaggaaccaaucaaaagucagccugauuccuuccugcggcagaucagccauggccaucucuaugggcuuuguauuuccugcgguucaggugagaagccccauauccauccccacuuucacacuguugaacuuaccguucacugcucaacgcccccccccccacccgugccuacagccgugccugacccauggugagcguucagucagcacuggagggcuggauaauuuguccuaggaggucaccguuuugucgccuccauuugcugacucuuugguaacacacauuucucugaccgagacagaagccuuaguuacugcccacaucuggcuugucugccauuagggauauccacgaugcuuauuuccaggaaguccugucaucaacaccacagugaucauggucucguccaggagaguagagcgugcguaugccagugggacaugagcccucagccagugucucccguccuucugcccuuccauuugucaucauggcccuugcuguggcccuccuguggcuguccugcagcucagaggggggcgacagggcgcccuggccacugcuccccugccgugcuguccacaggugguggaaacgugcccccaucugcaggcacacagcugcuaacccauuuucuuuguucucauuuuaaauccuaucggagucaucucuccacaaacccugccucauuuauuucuaaaguuuguuaaguucugaguguaagaaaucaguugcucugggugaccugaacuguuccccaggcaaccacacugugggguccagccagccuuugcugcugcuuuguucccaaaccagccagaaguggcagcccggggagaugguggcaccccucgccccugcucacaggagaccugcccgggcuucgcacuucacugucuccguggguggcucuagccaacccuucugaagguaacaaccccuucccccccugcuguccgcucugcucacuggcacgcugucucuguuuggccaagucaaaacgugguccuguuccuugugugucuggcaauaaagcauccauuuguaacuggagagggcaggccccucccccuaccuccaucuggggcauuucaaagcuggcccugaguugacagagcuccagggcagccccugccucgcuugguggcucgccucccgccuccgccucguguucugggcaccggggccagggcucggcagcuguuccagccaggcccggcuccgcccgcacccgcucggguaccugcccccauccacacauccuguggccugagaagaaguucauuucccugcccagccacuucccaauuccauucacuucauuucucugggccuuauuuuucuaucuguacaaaaugguuauuuaucucaaauggcccuuucaagcccacaaugaucucagcacuaauccuguugguuucauaaucaucugugcugggcucuggguaauaugaggcacuuccuuuuaaagggaagcugguucuuucuuuuucucugccagaaaucaagugacaugaaagcuaacacaugucucugaagcaacgcagagcugagauucgaauccaggcaguuugaccucaaaguccagacucucccaugcgaggcucuccugcuugcucuggcagaugaggggcagccaguuugauaucuacggaauuaagcugccaaauugggaaggcaaccuggaugaaauaagccacgugagcucuggcucgccaccaacgcacugaggagagaggugcccucagcaugcugggcagaacgucggggaaacgcggccuucgagcaggaccgcccaccugucagaagggagcacuccucuacagagccgaggggcagucagccacccucaggccccugcggcccugcuguccccagcacagcgacugaaguucucacugaggggccucguccccuccgggucaggccuuuccaggaaccuggcucugccagcugcaaagcaggcgggggcucacgguuaaggccaucgcagggcagcggccauucuucccuccuggcugcccggcugggccccugauaacagccuccacaccgcagucagaguucaaagcccuccuucccuuccaccgcagggcuuggcuuugcugcuucugggcuccgagaaaggaacagggccgcagaaaccagaggaauggaaagguauccacagagaaggccgccuugcagacaugaagugggacguuccguaagacagcaucucgagcuggacuuggcggggagagggaggcggccccgcacaggccagggaggccccagcacacaugaggccgggguggaggcccuggcucugcggugccaccuguccuccccagggcgcacccaagcccaaggguuccuucccaaccguggggucugaguuugucaucuuccagcuuucucaaguccccugagucaugagaacuuccucuacacacaggcaggucuguguuuuauaugaaccauguuuccaugguaaauagauuuuaagaauucccaaaggacagacagugucaccaacagcagagaguggagccucuggcugccucauguuugaaaguguuaaaaauaaagacaacacugacauuugggguuguaaugugacggaauuacagucuuuuaaaggcaagaaccacuuaucuacacuacaugcaauauucaguguuuuguucacuugucuaauuggauuaaaauauuuagcucccuuuaaaaucuugauugugaauuuauauugugaaauguaaugucugacucaggaagcaauaaguagagugaauguaucugaaggaauauaaaauucaauugacuuuucucccaugauucuuauucugaaaguacucacucuuggacaaagugaacuguuaacggaagagcaagucuggcuaaaaugaagcccuaugcgcuuuucaauauuaauuauacacggggcgcucagucaaaaaacaaaaaguuuaacugucugcuguuggagguguuuggggaaguuucuccgaaggucgcgagaugcuuauguuagacaugcagcacccagggucuugugucauuuuuuaaaaacacucaggcagcagggaguuaaugacauuuuagcugcauauguucaaguuuauuuaaaaaaauaugcaagucacuuugguugacagugucuuguacacaguuuugaaagaaucagggcaaacuuuaacagagucaguuuuuauuugaaaaauauuuucugggaauguaucaguguuuauuuuugagacugacaauucgggugaaaaucaggauaaaaacaaaaaaacaacaauuugguugaaaucaaauuguuuguuuucaucuauuuagaauucuuuccaaaaaaucuugguucaggaggaggcuuuuuaauuuauuuuauucaauguauuugcuguucuauucaagcgccaucugucuuacagguagcuaacuuugugguagcuccuaagucagcugggcgaggcccccagggcuccuggaaggaccacaguaaauuaggugacaccuccaaggccuaacaugggcagccugcagcagcuccgccuugcagccaggccucccucggcagggagucuugcucccugagagcugucacuuuucuagaaccucccuucucccuuugcuuccaguugcaaugggccuuuccucccuucaucaucuucugugucucuguguccccugcuuguuuucggcucucuucuaugaguccuuugguauaaugagauaaugucgaugaucuugaauauaaucacauauggcugcuggauccaugcacaaguuuaaaucaaauuagaaaguaaauucacugccaagaaugcuuaaaagucauagggccaacugauuaaccacugacaagucaguuuccgacucuguuuucuaaacuguaagugauucauaugaggggacuaaaagggaaucacuccccagauugaacacugcagacagaaccaagcagccugcucaggauacgacggcuaccagaaaaugcaagucagccaaaaccguauucauuaccaaauaagaaagcagacacagaaaaucaucuugaugguugagaccauccucuaaguggacagauaauuucuguuuuccccugucccagaugccauucuccccaagacucauguuuccucaccagcuggcuccaaccuuccuagccagauguuagagcccccaggcucugggccgcagaccccugacccugcuccaagcugucaggcccugcccaaacuccccugagacccaccacccucaccccgaaucccccuccccccacccccaccaccaagguuucagccucccccagccagggccugccucucaagagggcgagagugcgacuacccagcccagucucaaacaaaagacaggccagggugugugucuggaggcccugacccucccggaauacagaguguggggaacugcaucuaggcaaagcugggcuagugcuucagugucuguuucuccacaaggacaaguaagagccauuucaugacauuuaaaagcuauuuucuugaaguuguuuccgaacccaggugaggcaggagaucaauaaugccauuauuuguagucacccuaaacuaagaacaagccaagaggccgggcaaagcucaugccuguaaugccagcacuuugggaggccaaggugggcagaucaccugaggucaggaguucgagaccagccuggccuacguggagaaacccagucucuacuaaaaauacaaaauuagccaggcgugguggcaggcaccuguaaucccagcuacuugggaggcugaggcaggagaauugcuugaacccaggaggcagagguugcaguaggccaagaccaugccauuguacuccagccugggcgacaagaacaaaacucaucaaaaaaaaaaaaaaaaaaaaaaacagcugggcgcaguggcucacgccuguaaucccagcacuuuaggaggcuaaggugggcggaucauuugaggucaggaguucaagaccagccuggccaacauggcgaaaccccguuucuauuaaaaauacaaaaaaauuagcuaggugugguggugggugccuguaaucccagcuacuugggagccugaggcaggagaaucacuugaagccgggaggcggagguugcagugagcagagauugcaccacuguacuccaguccgggugacggagcaagacuccgucucaaaaaaaaaaaaaaaaaaaaaaaagccaagaaacgagccgagagcuugagccagugcccugaguccugcccaccgcagacagcgccggggagcggggaggauggggguucucguggccaaaagcauccauguggcagcuaccacuaccaggggcucccucugccagccauguuguugugaguguuucagaauucaagcagaaacaauuagaauaaugaagccugccaacaggcuagacacuuccuguuggaggccacaggccagccugagccccaccaccaggggcagcggggcucaggacccaggacagggagggaaggaaagggguggacuuugcuuuggaaccauugcccgacccauucucuucuggguauuaaguggacagagauguuuagaguuugacaugcaaaauuaaguuaagcuuaacucauccaggcugagaaaacggaagccuuuaguuaaaccaucucuaacccggacaugaggacagcucuaacccucagcugcccaagaucuggacccacaggccacuccaggaaaacagagaggguggcugagcacuccggagcccucaggcggcaccgcauccaaaauaccugcucgaaccuacagcagccucgcccacaucauggcucagcagaagccuaacucacaacucaagcugauuccaugacaagaaggcaucgcagaggcugaagcccacugacagccccuaccuagaggugaaggccaggcuuagccagaaaaagcaggcucuggguuuagauauucagcagagagcuugcaaaccuggaucccugccuccucucugaccacuaguauuugcaacugaaagccaacauucccucuaccaaauuucuuuugucauguucauauuaaaauaacuccaaguguaauauuugaaucugaaaggccgcuuuagagaugagccagaugggccaguaucagauagcacaggaaugggcaaaucauugcuguugcuucaggcaaaagaagaaagaaagaccugcuaguuuuucugaggauuuuuugagguuugggguuuuuuuaaugcguuuugugaaaauuuugcaacucauuuggcaauagccagauuuuuaaagcccuggaagaagcuucuaagcaucggugauccauguuaagaucuaagugugcuguaaagcaggcagauggggaguuaaaaggcaaagcccacguucuccugaucuaguccagagcccaaaggaagcugccgugugcuccagcuuccacggaagacuccccacaaccugaggucugacagaguucuuggcuuuagaggcugaagauucacucaugccaggagucacggucccucccuccuaugugacaagagccuagucaccugccaggagaccuaguggcuccagugguccugaucuuuggcuggccaggccuaaagcaggugcugcuggggcccucccuggggaccugcccacagggcuggguucugggcugggucugguggaggaugagggggucauccugaaagcagaggggaggggaguggcacuggucccacagcugcugcucugcaggccucugccuucccugaaccucucccaggacccucugaagaugagggagaaaggaaacacccucacacguccucagccugugugcccaagggcccguggggcaucccgccugcacucagcacucccaguagcccgugaagccaggcgugcaccaugcccacugugcagaggagaaacugaggcuggaaaaaggcuuaaguuacuuguccgaagcgggggcaggggauucagcacagugacacaaccuggaauaauucucuguucuuuccagcuccaaacacuucagagguuuucaaaauguagugucguccagaaucaucccaacagcuuggcaaaauucagguuccagggcccugccauggagcgugccaggugaggccucgccuccuagauuagcuguggcagugcggcuguggcucggacuuugagcggcccgcucccccacagucccugggagcagucucagaagcauggggacaguagaggcauuuccaccuccaggccuuagcuccguggcgccugggugugcucauuuacugucugugaacacauguuuggcagagggauuuuggaccgagugggaaaagucaguacuuacagguuccuugagcacagggucauuuugugaggagaaugagacuccucuucguuuucauuuccagaugcauuuuucauauuaaucauuccaagcacuuacugccugaaguccccagggcacucacagagcaccugggugcaauccuaauuaaaggcggaggccuuggucagcccacggaccaccucauuauccuaacaaacugcuugacggggcaaaaugcacagccucucugacaggaagagaagcgauuuagcaaacgagguuucauacuguguuccaaauucaccgggacacuuuccuuccucccuuuucccugcugguggccccggaucuaaccugaauggggaaagccugggcuguggagucaggcuuagccuccguuugcggugucccuacuugccagcuguaaugcuugucugggccuuaguuucccuaucuaaaccaugaagacaauaaagucagcaucgccugcuuguucaaggguaaagggaauuaaugcauguucuguguguaacacugccgggugcucugcaagcacuccagauauuagcccaguaaucagucagcuaauuuaggaugagaugccugccuuccauucaagacgacuuugcuaauugggaacaccucuuuccucaaccaauucaaaccauacacgaccuucagaggcagcucaaggccaccauccuccaaaaagccuguucugccgcccacggccguccucccgcuucucccugcucucgcacccuccgcagccugcacggcgcaacuuggcacucggugugguucguugauucgcgggccggggucuguucaccugcacggacuuuaacucccucaccaggacgggcccauggcuccgcuucucuggguccugcacugugcccagcacagucuucgggaccucccucccagcuuacugcuaaccgaugugauccgugagaaagccggccuguugaggugcauaaaagauccaccuguagacgcccgcccaaggacucccaccugcgccgcguucugcacaguaccuggguccgcagccgguccaccucuuccgacaggcucugccucuccaggagaagcugguucugcuugcugaggagcugcaccagcugcugggcuguggccuggcugugcuuauccagcugccuuagccuggagaaaaauccaccgcagaauuaaagagggauaacgucagccuuucaacaggcccaggggcuguguguaucugagggaagccccugauagggaaccaugagcaggacgccuagggugacccugaggugccaggcucuggcuggcacuagguccuugguacgcacugugugaagguaacauucuagcaaaugugcgugggaacugggagccaucucaguacacuaucaauuagaaaacacgcagauaagugggguaaguagaaggaaaaggaagcuuugaacucccaagcagaggucaaagaugaggggccuaaaugccgccauuguucagcuggaaaggucucuggcaggcugagcagacggccgccccggcuggggaagugggugagggccguggaaacacugaaguaaggguuuuccauuauuaaucacucagucaaucacgagcuccggcaucgcugaccagaugucuuuaaagauccuaaauuugucauucugcugaugggcgcuccucuccagacuugcuaauucacucagaccauuauccucaucuguccacagucggcuuccuacagccagcagcacagucacccauggaacuguuggcuuuggauuaaauguggaauugaacgacuacccagaaguguucuggaaagaagcgagauguguggccugccucaccguccucacccaucaaaagcaccagcaggcacguuaacucgaauucucacaaggaaaaggccauuaaagcucaaggugcauuucaaacuccaggcuac

SEQ ID NO: 192982 - RNA, 24277 nt, Homo sapiens
cuccgagacggguggggccggagcuccaagcugguuugaacaagcccugggcauguuuggcgggaaguuggcuuagcucggcuaccuguggccccgcaguuuuguaguccccgccuuguuucuccccagaggccucucaauccucccuccaugaucuucgcauagagcacaguaccccuucacacggaggacgcgauggcucccaagaaacgcccagaaacccagaagaccuccgagauuguauuacgccccaggaacaagaggagcaggaguccccuggagcuggagcccgaggccaagaagcucugugcgaagggcuccgguacugccugugccugcugcuugaauauuuccgccuuuuagggugcucgcgcaggaggcugcagcgggggaugggugcuccgaggcucccgaggcccgcgcaggucacgggugccuccggcugugcauucuaccugcagguccuuugacaccagaguguuuagguuucaacaccucucccgcuagguaacaggaagcagaugagcuccguaacaacagacacacggacuugucagauuccuuguucguaucaggguucuugcacaguuaggacggcuucagagaauccuaccuuuccuggcgcugugugugcuggauuucauagucacgcuuguuagcugcacguccucgguggucaguugugagagcccccaauuccuuccuccuuagaaagcucauucucugagguuuacuggggcuugaaccuggggcuauaaggaguuucgagacacucaaaaacgagcuggggcuuguuaaucaagugguuuuuguccaugagaagaaagaauugguugucaagacgucggaccuauagugauuggguccucaaauacaguuuggugaucaggaguuguugcuuuauugcuauucuaauuucacuuaccuccccagaaguaaccuaguuaagagcauuuccaggccuuccuauuccuucuuuuccuaaacggugacuucugccaugcugcccuaaaaucuuuuuauugugcauuauaugugauuuauaaaauugugacccagucccaucucgaguuuugcagcccaaacugggaagaguucugcauuguacuuuauccuuguguguuucuuuggcuggggucucaggaacccugcacgacuguauuuacuuucacuucagacuuacuguuugugggaguguuuuggggaaggggccaaauccucacucauuuuuuuauuucuggugcucguugagaccacacagacauggaaaggccgcaggaggugaugagacagagauuaaccgugccgaaugaaacaaggcuuccuuucggggaauucagcagaaaaaccuuucgugagauuggagaggaaaauaugucuguucugcuuggcagguccuagcagaagaugugacucagacugccucuggguggggcuggcuggcccacagauccugccaccaugccgcagcaucgucaggacccuccaccagcauaagcugggcagagcuuccuggccaucuguccagcagguaaggcauuuuuugccucaaguccucaaggguuuacacgugcauuuuuacuauugcaugcucccaaauuagaugauggcuugguucaccagcuugucagagugguccgaucacccagacuguggugacuggccuacugggcacucagccagguaaaaaaugucuuauguuguaaaggucccagcuggaaugcacucugccccuuuugcuuuccaagauuauucguucguguacauugcaaauauuuucaugcacagggcaggcaguuagcuuuccuuuggugggaggacuuggaucuagggcucauccaugaaggaggcagagauuggcaguuuacccagaacuuggguuuuaauucaaccuaauucauuucucucuguggcaggggcuccagcaguccuuuuugcacacucuggauucuuaccggauauuacaaaaggcugcccccuuugacaggagggcuacauccuuggcguggcacccaacucaccccagcacuguggcuguggguuccaaagggggagauaucaugcucuggaauuuuggcaucaaggacaaacccaccuucaucaaaggggugagcaguuccccaugccaggucgugcuaaagaaguguuuguuggcugggugcagugguucgcaccuguaaucccagcacuuugggaggccaagguggguggaucaccugagguauggaguuugagaccagccuggccaacauggugaaaccccgucucuacuaaaaauacaaaaauuagcugggugugguggcaggcgccuauaaucccagcuacucaggaggcugaggcaggagaauugcuugaacccgggaggcagagguugcagugagccaagauugcaccauuacacuccagccugggcaacaagagugaaacuccaucucaaaauaauaauaauaauaauaauaaaagaaaauaaaaauaaggaguguuuguugaaggcaugaaaggaauauugaugucauccaguaaucaucaggaagaggacugggaucaaaauuaacugugggcauuuucaaauacguaaaugaugaugauauauauuuuucuaaugccuguccuuaaaauacuagaagauauagacuauugaucacccauagaauugaagccccuucugggcugggcgcaguggcucaggccuguaauccuagcacuuugggaggccaaggugggcugaccacgaggucaagagauggagaccauccuggccaacauggugaaaccccgucucuacuaaagauacaaaaaauuagcuggaugugguggugugcgccuguagucccagcuacuugggacacugaggcaggagaaucgcuugaacccgggaggcgaagguugcagugagccgaaaucacgccacugcacuccagccugggcaacagagcgagacuccaucucaaaaaaaaagaauugaagccccuucuuaccacauugaccucaucuuacgccauugucuuuucucacuucuaugcuguagccacaccagcuguuucuauuccugaaaccgggucucuguaauugcuguucccuuugacuggagugcuuuucccccauggucuucucauggcuggcgucuucucugcaggucuuugcugauucuaccucuucaaagaggcuuucgcugguuguccuuacucauaacguagaucccacuccuccaccgucauucccuguaucauuacccugcuucauguuucccccaaguguugaugggugucugagaucugaugcuuauuuguauguuugcccacugauggcagggaccuuuccuuucugguucaccauccuauucccagugccuggaacaaaguuuggccuagaguagcugcuuuauauuuguugaaugagugaggggcuugaaguguaauugagcagaugggauguauacauacgagguaauuaacaauacagaugccaagugcuacagaaugugaaagaaggaagaaccccuugugaauuggagucaauaaagaagacuccauggaugagcgaggaggagcaguauuagauaaauggagagaaaagaaggaaagacauagugugacugggugagguuuggcacagaguucuugggaauggucuuuguugugcuagaguuuaucauccauugcugaggggugagugugucguccccucuaggaccuuuagccagcccagcugguggcugacauuggagggcugugcugugaaaagugacacuggguuuagagcaggagucacaaacuuauagggcuccagaagccagaguggaaaaaaaaaaaaaaagaauguauggugguagggucagggguaaacuagagaugacuguugugcaaaaauguaggucuuuugauaucagaugugauuuuucucaaacaaagacacaaauccucauuuuuuaaaugucauauaucuugaguuuuaaaaaaaauuguaaaauacacguaacauaaaauguaucaccuuaaccauuuaaaaguguuuuuuuuuugaggcggacucucgcucugucacccaggcuggagugcaguggcgcaaucuuggcucacugcaagcuccgccucccggauucaugccauucuccugccucagccuccccagcagcugggacugcaggugcaugcugccacgccuggcuaauuuuuguauuuuuaguagagaugggguuucaccguguuagccacgauggucucuaucuccugaccuugugaucugccugccucggccucccaaagugcugggauuacaggcgugagccaccgcccccagccaacuuuuuaaaaaauaaugauaaaauacauauaacaugaaauuuacuuucguaaccauuuuaaagugcacaguucaauggcguuggguaaauuguguaagcagucuccagaacuucauuauuuuuuuuuauuuuuauuuuuugagucucauucugucacccaggcuggagugcagugacacaaccauagcucacugcagccuccaccuuccugacucaaggaauccuccggcuucagccucccauguaucagggacuacagguacgcaccaccaugccuggcuaauuuuuagagauguggucucucuauauugcccaggcuggucucaaacuacuggccucaagcaauccuucugucuugucuucccaaauugcucgggauuacagggcugagccacugugcugggccucuagaacgucuuaauauuggcacugaaugaaacuaaacacacgucucagccgaauucugcuucaguccacuauuuuucuagcucugguuuaaagguagacaugagggggaacccaggaggaggucucuuuauuuauuuauuuguuuauuuuuuugagauggagucucacuccgccgcccaggcuggagugcaguggcgcaaucucggcucacugcaagcuccgccucccagguucacgcgauucuccugccucagccuccgaaguagcugggacuacuggugcccgccaccacacccggcuacuuuuuuuauauuuuuuaguggagaugggguuucaccguguuagccaugauggucucgaucuccugaccucgugauccgcccgccucgaccucccaaagugcugggauuacaggcgugagccacugcacccagccagcaggaggucucuuaaguggagggauuuggagagcagaccaccagaaaaggccagguuagacaggugugggagacuggaauucaaagugugagauggguguucaaggaacaagugccagaagcccccagaaaggcagucagaggagugccgcggacagagugggguagguuuccugcccagcuaaagaggcaggugaccgcuaauaaggcagcuugaaguugaagucagaacccagagcucagacaggaagaaauuuguuuucuuguuuucuccaggagucuaggacaugggaauagaggaauuuagcuuaugccuggagaugggaagaagcaguguaggguauucuaggggaagagcuuccugacuaacaggauaaugacaagugcuuugaacuugugccagacugagauugcuuuuuuucuuuguugcaucaccuuaugacaugcguguaaccuucuuuacaguguaaacuuucuuuacacuguaaugaagauuggucuaggcauugaauuuuguggcuugcauuugcagggagcuagguuggagcagaggaaggguauggcagucuggaagagaccugucugguuuuacucccagaugcugacagcagaaugcugauuugagaccaguuacuggaggagcaacagugccucauuuugucacuucuuuagucaucugaccuuggcugugaccuuuacauucuucaggcccuuggcaagggaacauguauuacaguuucacaaugaagauagcuuaauuuuauuccuauuauaaaaacaauguauggggccaggcgcaguggcccacgccuguaaucccagcacuuugggaggccgaggcggguggaucaccugaggucaggaguuccgagaccagccugaccaacacauagugaaacccugucucuacuaaaaauacaaaaauuagccgggaguaguggugcacgucuguaguuccagcuacucaggaaucugaggcaggagaaucacuugaaccugggagguggagguugcagugagcugagauggugccacugcacuccagccugggcgacacagugagacuccaucucucaaaaaacaaaacaguguauucuuaucauaaaauacagagaaaaguguaaaaaauaaauuaaauaugauccaaaauccccauuuucagcaucccucugugcauguguacacuauuuuuuuuuuuuuccaagucugagucuugcucugucgcucaggcuggagugcaguggugcgaucucaccucacugcaaccuccgccuccuggguucaagcuauucuccuuccucagccucccgaguagcugggauuacaggcaugcaccaccacaccagcuaauuuuuguuuuguuuuguuuuuuuaagacagaguuucacucuauugcccaggcuggagugcaguagcacgaucucggcccacugcaaccucugccuccugaguugaaaugauucuccugccucagccuccugaguagcugggauuacaggagccuaccaccaugcccagcuaauuuuuguauuuuuaguagagacgggguuucaccguguuggccaggcucgucuugaacuccuggccuaaggugauccaccugccuuggccucccaaagugcuggcauuacaggugugagccaccgugcccagccugaauuuuauauuuuugguagaaacaggguuucaccauauuggccaggcuggucucgaacuccugaccucaagugauccgcccgccucggccucccaaaaugcugggauuacaggcacgagccacugcacccggccuggguuuuuaaaauuauaucuuuauugagguauaguggacauaaacugcagcuauuucaaguguacaauuuggcuauucucagccuaugggguaguccuacuccagagaagcaguaagaaaaaaagaauaaauuguacaauuccaugaguuuugacauauguguacaacugugaagccaucaccacaauuaaaauaacucccauuuccccacccuuuguugaauauuuggagagugauagauagaugaguuaucuaugccccuuuguaauccaccccucucuacccaauaucuuauucacuguaaacugcugaucuauuuuuuauuuuuagaaauuaauuuacauuuucuagaacuauauauaaauagaaucauagaauauauggucuuuuauuuuuguucuagcuuguuucaguauaauuauuugaaauuuaucuacauuuuuauguguaguuuuuuuuuucuuucugaauaaugguucauuguuuuuuguuuuaagacagggucuugcugugucacccagggaugaucaugguucagcauagccucaaccuccucagcucaagcgauucucccaccucagccuccugaguagcuggcacuacaugcacaggccaccauaccuggcuaauuuuaaaauuuuguuauagagacagaggucucacuguguugcacaggcugguuucaaacuccuggccucaagcuauccuccugccuuagccucccaaagugccgggauuauaggcgugagccccugcacccagccacauuguacugauaugauacaguuuauucauuuaccuguucaaggacauuugaauuuuuuucuaguuuuugaaugcaacauauaaagcgacugugaacauucacguacaaguauuuguguggauauauguuuucauuuuucuuggguaaauacuuagcaguggaauggcuggauuauagaguaggaauguuuuaaagauacuuuuuaaaugagaaaagguuuuucuauuugcccacauauugucauuuccagugcuuucauucuuucaugugauccagauuuccuuuugguaauauuuucuuucugccugaagaaauuccuuucauauuucuuauaaugcagauuggugauaaauacuuuccacuguuguuuaucuagaaaaguauuuugccuuuauuuugagggaggauguuuuugcuaaguauagaauucuagguucacaguuuuuaaaauuauuuaacuuuuauuuuuuaauugguaaauuaaaauuguauuuuauugcauacaauauauuuguucacaguuuucuccugucaguacuuuaaagaugaugucuaggcugggcgcuguggcuuacgccuguaaucccagcauuuuggggggccaaggcaaguggaucauuugcgaucaugaguuuuagaccagccuggcuaacauggugaaaccccgccucuacuaaaaauacaaaaauuagcugggugugguggcgcucaccaguaaucccagcuacccgggaggcugaggcaugagaaucuugaaccugggaggcagagguugcagugagccgagauggugucacugcacuccauucugggugacagagcaagacugugucucaaaaauaaauaaauaaggcugggcgcgguggcugacaccuguaaucccagcgcuuugggaggccgaggcaggcggaucacgagaucaagagauugagaccacccuggcuaacacggugaaacccugucuguucuaaaaauacaaaaaaaauuagccaggcgugguggugggcgccuguagucccagcuacuugggaggcugaggcaggagaauggugugaacccaggaggcagagcuggcagugagccgagaucggccacuucacuccagccugggugacagagcaagacuccgucuaaaauaaauaaauaaauaaagaauaaaaauaaagaugauuucuaguugggcucaaugguucaugccuguaaucucaacacuuugagaggcugaggcugggggaccucuugaggccaggacuuuaagaccagccuaggaaacacagcaagaccccaucucuacaaaaaaaucuuaaaaauuagcuaguggcuugaacuuguaguuccagcuguucaggaggcugaggugggagaauugcuuaagcccagggggacaaggcuucagugagcuaggcaagccugggugacagagcaagauccugucucaauuaaaaacaaaacaaaacaaaacauccugaugagaagucugcuacaauccuuauguuccugucuauguaauuuuucuucuggucgcuuuaaaaaugauuaugaugugcuuguggggggaucacuaagcuucuuugauuuauggauuuuuuuuuucuuuugagacaaagucucacucugucgcccaggcuggugugcagugccacaaucucggcucacugcaaccuccaccuccaggguucaagcgauucucccugccucagccucccgaguagcugggauuacaggugcccaccaccucaccuggcuaauuuuuguauuuauuuauuuuuauuuuauuuuuuuaguagagacaggguuucaccauguuggccaggcuggucuugaacuccugaccuccagugauccgcccaccuuggccuccugaagugcugggauuacaggcgugagccaccuugcccagcccauuauuucuuacaaagaguucaaaaugaagaaaaagaacaguucuuuuuuucuugggacugcgauuacauaugguccugcaggugguugaugcacuguucauuuuugucuuuuucccuguuucauuuugugcaguuguucacugaucuuuacuucuguaauaucuaaccuucugcugucaaucccucccucccucccucccuucguuccuuucucucucuucucuuccucuuccuuuucucuucucuuucuugccugugcagagcagggcugcuccauaggcaaaguagcccagcguauuuuucauuucagauacuguauauccccucuagaaguuuaauuuggauuuuuuuucaugucuuccauuucucuccucauauuuauuauuuccucuucuuucuuuuuugagaugaggucucacucucucuuccaggcuggagugcacuggcaugagaucucagcucacugcaaccuccaccucccagguucaagcgacccuucugccucagccuccugaguagcugggauuacaagugugcaccaccacgcccagcuaauuuuuguauuuuuaguagagaccaaguuucaccauauuggccaggcuggucucagacuccuaaccucaaguuauccacccaccuuggccucccaaagugcugggauuacaggcuugagacacugcuccuggcccgauccugugucuuuaaaaaaaaaaaaaaaaacucuaacaaguaauacugcuuuuuuuaaaaaaaauugugggccaggcucaguggcucacgccuguaaucccagcacuuugggaagcugagguggacggaucacaaggucaggagaucgagaccauccuggccaacauggugaaaccccgucucuacuaaaaacacaaaaaauuagcugggcauggucgugggcgccuguaaucccagcuacuggggaggcugaggcaggagaaucacuugaacccgggaggcagaaguugcagugacccgagauuaugccacugcacuccagccugggcaacagagcgagacuccaucucuauuuuaaaaaaaaaaaacaaaaaacugguagaaaacacguaaaacaauuuacaaucuuuacuauuuuuaaguguacaguuuaguaauguuaacuauauucacauuguugugcaacagaucacuagaacuuuuuucuuguaaaacugaaacucuauacccacugaacaagccuccacuucucccuccccuuagccccuggcaaccacaguacuacuuucuguuucugugaguuugacuacuuuagauaucucaucuaaguggaaucauacaguauuugucuuuuugugacaggcuuauuucacuuaaugcaguguuuuaagauucauccauguuguagcauguggcagaauuuccuuuuuuaaggcugaauaauguuccauuguuugcguguaccaccuuuuguuuaucuguuuauuaauugacagacacuuggguugauuucaucuuuuggcuauugugaauaaugcugcagugaauguggaugugcaaauaucccuuugagaccccgauuucaguucuuuggggcuuaugccaauaaguacgauugcuucaucaaaugguaauuuuguuguucauuuuuugaggaaccgcuauauuguuuuccauacuggcuauaccaucucauguucccaucagcaguguacaaaugucccaacuucucuacuuccccaccaacauuuauuuucuuuuuuuuuuuuuuugagaugaagucucccucugucgcccaggcuggaaugcaguggcacagccucagcuuacugcaaccucugccuccugaguucaacugauucuccuggcucagccuccaguagcugagauuauaggcgcacaccaccaugcccggcuaauuuuuguauuuucaguagagacggguuuugccacguuggccaggcuggucuugaacucccgaccucaggugauucauuugccuuggccucccaaauugcugggauuacaagugugagccaccaugcucggccuuuucuguuuuuuugauaguggccauccuaagggaugugaggugauagcaguguaguuucauuugcauuucucuaaugauuagugauauugagcaucuuuacgugugcuucuuggccauuuguauauuuucuuugaaggaaugucuauucaaguccuuugccuuuuuuuuuuuuuuuuuuuuuuuuugaaacagggucuuacuuggucacccaggcugcaguacaguggcacaaucauagcucacugcagccucgaacuucugggcuccagugauccugcugccuuagccacccgaguaacugggacugcaggugcucaccaucauaccuugcuaacuuuguuuuguuuuguuuuuuucgcugucucuuacagaaaggacuuacuaaguuaaaaaaaaauuuuuuuuuauagagauuggaucuugcuaugucucccaggcuggucuugaacuccuguuugccuguuuuuuaguuggguuauuuguuguuguuuuguagggguucuuuauauauucuggauauuaaccuuuuuuuuuuuuuuuuuuuuuuuugagauggaguuuugcuccuguuguacaggcuggaguguaauggcucaaucucggcucacugcagucuccaccucccggguucaagcaauucuccugcuucagccuccugaguagcugggauuacaggcaugcgccaccaugcccggcuaauuuuugugcuuuuaguagagacaggguuucaccauguuggccaggcuggucuugaacuccugaccucaggugaucuacccgccucggccucccaaagugcugggauuauaggugugagacacugcgcccggccaugauauuaaccucuuaucagaucuaugauuugaaaauaucuucucccacuucauagauugccuuuucacuuugucgauuguuucuuuugaugccugaauuuuuuuuuuuuuuuuaauuuugagauggaguuucacucuugucacccaggcuggagugcaauggcgcaaucuuggcucacugcaaccuccaccucccggguucaagcaauucuccugccucagccucccaagaagcuggcacccaccaccacgcccagcuggcccgauugauuuuuaauaguuaaaccaacuuugcauucuuggaauaaguucauccuggccauaacauauuuaucguuuuuaaauauuacuggauugagcuggcaaauauuuuaagaucuuugcauuuguguucauguguaaaauuggccaaauccuugucacauuuguguaucaagauuaugcugauuucuggccaggcgugguggaucacgccuguaauuccagcacuuugggaggccgagggggucggauuaugaggucaggagauggagaccauccuggccaacauggugaaaccccgucucuacuaaauaugcaaaaauuagcugggcgugguggcgcacuccugucaucccagcuacccgggagguugaggcaagagaaucguuugaacuugggaaguggagguugcagugaggugagaucguaccacugcacuccagccuggcaacagagugaggcucugucucaaaaaaaaaaaaaaaaaaaaaagauuaugcugauuucugugaauugcuugagcccaggaggcagagguuguaguaagcugagugcaccacugcaguccagccugagcgacagagcacaacucugucucaaaaaaaaaaaaaauuaugcugcccucuuuagcuugggaauuauucccucuuuuucuagucuguggagacggaggguuuaagaucaauaucuggcugggugcgguggcucacuccuguaaucucagcacuuuggguggccaaggugggcagaucaccugaggucaggaguucaagaccagccuggccaacauggcaaaacccugucucuacuaaaaauacacaaaaauucgccaagcaugguagcagguaccuguaaucccagcuacucgggaggcugaggcaggagaauugcuugaacccaggaggcagagguugcagugagccaagauugugccacugcacuccagccugggcaacagcaugggacucugucucaaaaaaaaaaaaaaaaaaggaaggaaagaucaauaucucuuccucagccagguccgguggcucaugacuguugggaggccgaggcaggcggaucacuugaagucaggaguucgagaccagccuggccaacaugaugaaacuccaucucuccuaaaaauacauaacuuagcuaagcgugguggcgugagccuguaaucccagguacuugggaagcugaggcuggagaauuguuuaaacccaggaggcggagguugcagugaccugagauggcaccauugcacuccagccugggcuacagagugagacuccaucucaaaaaaaaaaaaaaaaagaaauaucuaucuaucuaucuaucuaucuaucuaucuaucuaucuaucuuccucuuucuucaucuucuuuuucccuuccugaacaguucaaaccaaaagucauuagguaggaucaagcaagauagauguuuacguagugggaaggcuacagugcuggaagugccagaugcuggggccccugaagcugaggugaaugucauuacagguggcagguggcagcucaguacauagagacugggcccaaacaagaucagaagggcauccauguaggcaggggugaagaguagaggaggccgggcauggaauagugaagucugaagcgggguugaggaugcugaaccacagggaggccuagagugggguggcggagucaaguggggugagcagggcuuuugcauggagaggggcggccguggcgccugaugugggcaaggaaguugugucugcaugguugagggaguggagagagggaagagggugauugugcccucgggaggguaaaagaguccaagcauccuaaggaagacgugcauuuggggaguguguggcagcaauaguggaagacugguuacauacaaggagauuaaucaaauauguaaguauauugaguaaaaugggaaccacauuuuucacugucaaagaagggaauuauaaacauggaaagagagaaacucgaaucaacucugugguguugacuuugaauugaagacauugauacaaauuuaagguuuucaguauacaaaguaagacaguugugaagcaaucugauugcagauuccuuuuacauuuuuauuaccuuaaucuuuuauaaguaucucacccuaugcuuaauuugauggcucuucuuuuuuuuuuuuuuuuucuucuuccuaauagagacagggucuugcucugccacccaggcuggaaugcaguggcaggaucauagcuaacuacagccuugaacuccugggcucaagucaccaucccaccucagccucucgaauagcuaugagcacaggugugcaccaucacucccagcuaauuuuuaauaauuuuuuauagaggcuggacccagugggucaugccuguaacagcacuuugggacguugagguggaaggauugcuugagcccaggaauuugagacuggccugaguuacauagugagacccugucucuaaaaaaaaaaaaaaaaaaaaauuggugacacacaccuauagccuauagcaccagcuacuugggaggcugaggcgggaggauugcuugagcccaggagguuggggcuacgcugagccaggauugcaccacugcaucaagguuuugaacuccuggccuuaagcgauucuccugccccagccccucaaaauacugggauuauagaugugagcuacugugcccagccaauagcuauuauuuuugcaacucauuaucaaguucuuccaaagcuuucaacacggcuuuuauaguaguaauaauggccuuuguuuuugcauguauuucaucaauuuacaugcuuaauuaaauuugguguuaauugcaauaaaagauacaauuggaauaaacagguuugagaacaacuacaaccaacccuugguuugguaagcauagaacucaacuggagggagccgaagauugucauacuaccagcaagcauuuggcagaccaugagcauuagaaugaccgugagguuagaauguuuuauagagggaagggaaugugccaguuaguauguugugauagcuaagugguuguugcauagaagaacuuguacaggucugugaggcugggauagcugcagcguaaagaagaaguggaaaagguggagaaaggcggacaaguggagaacuuuacaucuuggggauguaaaguucuuaaaacagugccugacugggcgcaguggcucacgccuguaaucccagcacuuugggaagccgaggcaggccaaucaccugaggucaggaguucgagaccagccugaccaacauggugaaaccugucuuuacuaaaaauacaaaaauuagcugggugugauggugugggcauguaaucccagcuacucaggaggcugaggcaggaggaucacuggaauccaggagguggaggcugcagugagcugagguugugccaccgcacuucagccugggcgacagagcaagccuucaucucaaaaaaaaaaaaaaaaaaaaaaaaacacacaaagaaaauccccccaaaaaaccagcgccuaguacauaguaagcacuuaauaagguuaagccauugauauucucaugauuauuuucaucaucauuuucaugaauguuuggaagaauaggaaggggcacagaucugacuccugcccuccuaacucagccacugcucugagcugaagcucuucuaaagagagcacugugggaauaacaaauuagggcacauccauguaauggaauaccucagcaauaaaaugagaugagcucuugauacagcaaacucagaugaaucucagaggcaugaugagugaaaugaaacaagacagucucaaaagguugcauacugccuaauucauuuacaugacauucuauuuuuaauuuuauuuuauuuuauuuuuagagacagggucuugcucugucacccacgcuagagugcagugauucgaucgcaacucacugcagccucgaccuccaggcuuccgucaucuucccaccucagccuucugaguagcuagaaccacaugcaccuaccaccaugucuaaauuuuuuuuguguguguagagauggggucucccuauauugcuuaggcuggucuugaacuccuggccucaagcaauccccccgccucagucuccccagguguugggauuacugugcucggucuauaggacauucuaugagggcaaaacaauagugauggagaacagaucagccaggggcugggggcgaggggagggugugauuacaaugggauaccacgauggaguuuuugggcuguugcaaauguucugcauccugauuuggguggugguuauuuaagucuauacauauguuaaaauucagagaacuuuauaucccaaauuugcuauauguuaauuaaaaaaaaaaguaaaaauaaagccuuaagaaaugaagggaggcggggcacgguggcucacgccuguaaucccagcacuuugggaggccaaggguggcggauuaccugagggcaggaguuccagaccagccuggccaacauggugaaacccugucucuacuaaaaauauacaauuuagccaugcgugguggugggcaccuguaaucccagcugcuugggaggcugaggcaggagaaucgcuugaaccuggaaggcagagguugcagugagccgaggucgugacagagcaggacuccaucucaaaaacauaaaaauaaaaauaaaaauaaaaaaaagaaagaaaugaaggggccagacaaagcggcucaugccuguaaucuuagcacuuugggaagccguggcagggggaucgcuugagcuuaggaguucaagaccagcuugggcaacgugacaaaaccccaucuuaaaaaaaaaaaauagaaaaauuagcugggcaugguggcacgcacuugggaggcugaggugggaggaucgcuugagcccaggagauugaggcugcagugagccguguuugugccacugcacuucagccuaagugacagagaaagacccuauuucaaaggaaaagaaaaagaagugaaggcccuguagagagcguccuagugucuaagcugaccuggccccaagcgcugcucgaggggugcuucugugacggcgcagcaugugugcccaggccugguuccucacggccaggcccaucaucacucacuggcuuuuuccuuccucguguuagauuggagcuggagggagcaucacugggcugaaguuuaacccucucaauaccaaccaguuuuacgccuccucaauggagggaacaacuaggcugcaagacuuuaaaggcaacauucuacgaguuuuugccagcucagacaccaucaagugaguaguuuaacuagcaggggaaagggcuucuaagcuuagguguaguuccggcaagagcauccagaucccauuuccuuaacccaaccuggcccagggaagaaaggaaagaugucagccacuuuccgcccuucuuucucuuucucaaacugcuccuuggcugcccucacuuugguccagguggguuacugcuuugggaagguguucuggagccucagcucuucuguaagucauaccuguauuagacuggaccuugacccucacuagauaagccagcauggcguggacccagaaagccaccuagagaauggagcaacagcucagaacuugagacugaaugcccugcacucacugugguguaaugaccugaccuguuccuggguggaagcuuauauggauggaaucuuuuccauaaagugcucuggacuucccaagagaaaguggcuggagaaauuacagaaugcggccgggugcaguggcucaugcuugaaaucccagcacuuugggaggccaagguggguggaucaccugaggucaggaguucgagaccagccuggccaacauggugaaacccccaucucuacuaacaauacaaaaaauuagcugggcguggugguaggccccuguaauucccagcuacuugggaggcugaagcaagagaaucgcuugaacccaggaggcagagguugcagugagccgagauggcgccauugcacuccauccugggcaacaagagcgaaaaucuaucucaaaaaaaaaaaaaaaaaauuacagaauacucgucacuuugauuuccagcuagagccgugacucugacugcucccugaggaauuaagugagggugcugggguguaacuagcauuggauuggauccugggcugucccgcagggaugaggagugcaugcgcacgcaaaucagcaggcaauuggauagacaaggcuccaggcuacucuuccgcaagaaaucuuccugcuugaagauauucauaggggauggcaaaaggcaguguagcauggauuugagaguuugagagaaaaacugugagcugagcucuucuggcugaauagcaggaucccugaagcacccuccuagucagccucccaguccagugguuugagggaccagaagagcuccugguuguguuuuuucccccaguguucagaagggggcagaagugcuuuucuagccagcucugaggaacagggccaggcaaucccucuuuggcuugugucuccuuuggccuaaagggugaagagugaaaggagagagcaguaaaggaggcuugcucagaacccgggguguggggggcaggcgugccucagggcuugcuuuaugguauaagcuuugucugcuucagggacuuuuaggagcuggggauccugggcccagccauaaccagacagauuucugagccccauuaucccauccccucugucuggacgguagagcagucugaauguuccucacuaggaauccacggcaagacaguuauucauucauucaacaaauauuuauugaaugcccgcuguggguuagucaccggagcggcaacagugaguaaauaggacuaucucuguccccaagaaucuuacaacacagucucucccuccagcaucugguuuuguagccuggaugugucugcuaguagccgaaugguggucacaggagacaacguggggaacgugauccugcugaacauggacggcaaagaggugcguucuccgagguccugccuuucccucccucacccccaccucgguucuguguccccaccugaaccgagcucuucucugcagcuuuggaaucucagaaugcacaaaaagaaagugacgcauguggcccugaacccaugcugugauugguuccuggccacagccuccguagaucaaacagugaaaauuugggaccugcgccagguuagagggaaagccagcuuccucuacucgcugccgcacaggcauccugucaacgcaggugugauaucccagaccucaucucuccugcagacccugccugucugaccacugcugggguuuucccucaguguggaagccacuacgucaaaccuuuaccccugauagcgucugccaagcugaugucugggaaccuuuguggcuguggcuguccccaucagcugcugaguuuccagaauuuuuuuguuguuguucacagcccagauucaccucuuccuuuccgcuccugucuagagaggagugggagggagaguaccccugcaggagaaggccugcaaggccaggaccacagagggcuugugguuccuucagcucaggggcuuuucacuuugccagcuuguuucagucccgauggagcccggcuccugaccacggaccagaagagcgagauccgaguuuacucugcuucccagugggacugcccccugggccugaucccgcacccucaccgucacuuccagcaccucacacccaucaaggugaguggcggugggaaggagcucgcagaaggaggcugugaucaugaggccggagcaggucugcccacaguggggaagggcugaugugguaagccugccaccccagaucgcuccuggcccgagcacagagcaucucuuacccauuggcucucucucuuccuuuuaucccacuucugccaucccauaugguugaguuuucugucucgcugauaagauauuuuucugaguuuuuucagcccagcucugaucucacugugagaauuuucuaagauccugacccucuguucugucuucucagcuucaguuaccuguguacaguugacccacaaaccuucauuuuuuauuuuuuuauuauuuuuuuuaaggcagggucucgcucugucacccaggugggaguacaguggggcaagcaugguucauuacagccuugaucucccaggcucaagcgauccuccugccucacuuuuuuuuuuuuuguagagacaggguauucuuguguuacccaggcugauccuuuuuuuuuuuuuuuuuuuuuuucuugaaacggucuugcucugucacccaggcuggagugcaguggcacaaacauagcucacugcagccucaaccuccuggguucaagcaauccuuccgccuuagccucggaaguagauuggacuacagguaugcgccaccauacccagcuaauuuuuuuauuuuuuauagagaugggguuuugccauguugcccaagcuggucuugaacuccuagguugaagccaucccccaaccuuggccucccaaagugcuaggauuacaggcaugagccacugcgccuggcaacuuugccuucuuaguuugucuugcagguuucagugcuucuaauaauaaaaauaagucuuuuauuuucccaccuuuucucaggcucuuguuaauagcuucucuaucauuaguccccaacacuaauagcuuucaaguccuuugaugccuuuuugccuaagcccccaugcagacugagcucugcuaguucugcauucuuuuccaaaacuacagauccucuucagaucuucagguuuuaugccuauacuucucuggucaguucagaauagugguggggagcgccaguuuccagcagccagaccccccggguuagaauccuugggcaaauuacuuauauuuuggaucuguuuccucaucugcaaaaagggaauacuagucucuaacugauaggguuguugugaagaugagucaguauacuuaaagcacuuggccccaugcccagcaccugguaaguacugguaaguauucaauaaaugaugauugaauauugaguggcccccacguaccucaaucacauccaagcucuuaauaaauaaugucaagaauccuuccccaguugguguuccuguuaauccaucaguguucccgauaauccaucugucugcaugucccaguuuguaucuagccaggugucguaagucauuacagcuuccugugugugauuugugacuuauuucuaagccuucgcauguacuauuucuuccuuccugcuaaccaugucuuucuuccuucaaaacuuccuugagaaguuuaggaaaaucccauccaauucugccauuuuaauaacugccagauuuguuuuuaguggggugaucuggggaauguggguuuccuucucuuuuuuagccauuagcaauuuuacacucagcucuuaguuauucguguugauggagacaggaugacaguggggcuccuccagaacucaaguccuguuaggguuuggucaccagaggcuuuuucugcuuuguuguaggccucuuaggucaguaucugggucaggcugauguuaaaacguuuaccaguugguaugaucuuaggaaaugcaaaugagggagaaggccugaaggugcccuaagggccagggaggccagcuagggauuaaaaaugugcaauggcagaggcacacacaaccuaaaaccauucuuguaguuuucuguaagacuuaucuccauuauuagguuggcuuguuacuggcaaauacuacuuuuuuuuuuuuuuuuuugagagucuugcucugucaccuaggcuggagugcagugacaugaucuucacucacugcaaccuccgccucccggguucaagugauuccccugccucagccucccaaguagcugggacuacaggcauguaccaccacgcccagcuaauuuuuuuuuugguauuuuuaguagggacgggguuucaccauguuagccaggauggucucgaucuccugaccucgugauccgccugccucagccucccaaaguguugagauuacaggugugagccacugcacucagcccaaagaauacuuuugauguuccucuuuguucauauuuguuuuugaugucccccuugaucauguucuguguuuacccucauggccggccucuccaucuccuaggcagccuggcauccucgcuacaaccucauuguugugggccgauacccagauccuaauuucaaaaguuguaccccuuaugaauugaggacgaucgacguguucgauggaaacucagggaagaugaugugucagcucuaugacccagaaucuucuggcaucaguucggugaggcuuggguccucaaauaaugaugggaggaagcagggauucaaccuaccuuauugaccaaaagugaccagaaaucaggugucucugcuaauaccuucacccucuccucauguugacacucuugucucugcagcuuaaugaauucaaucccaugggggacacgcuggccucugcaaugggugaguaggaggagaaugucucugacuugccaaguccgauccuacuucccaagguucagugcgggccagccucagccccgcccugccacauucaccccagggcaguggcccacgaagaagauggcugggagacaguggucucuauagccaaggcccuccauuccucuggcuuugucuuggucaugcaaugccuggcuacuguccaguuuccuaguauuucuuuuuuuuuuuugagacggagucucgcucuguccccccgggcuggagugcaguggcgugaucuuggcucaaugcaagcuccgccuccuggguucacgccauucuccugccucaaccucucgaguagcuaggacuacaggugcccgcuaccacgcccagcuaauuuuuuguauuuuuaguagagacaggguuucaccguguuagccaggauggucucggucuccugaccucgugauccgcccaccucagccucccaaagugcugggauuacagacuugagccaccgcgcccggccuuccuaguauuucuuuaccaaauuguagguuugcgggccagccccaggcucugagagauugguaacagaaaguguaagucagacuggucucacucuuccuagguuaccacauucucaucuggagccaggaggaagccaggacacggaagugagagacacuaaagaaggugugggccagacaaggccuuggagcccacacaugggaucaaguccugcaagcagagguggcgauuuguuaaagggccaaaaguauccaagguuaggguuggagcaggggugcugggaccuggggcacugugggacugggacacuuuuauguuaaugcucuggacuugccuccagagacugcuccagaguuggugacacagcugucccaagggccccucuguaucuagccuggaaccaagguuaucuuggaacuaaaugacuuuucuccucucagugggugguagcagagggaucaagcaguuauuugauuugugcucacuuuugauauggccaauaaaaccauaccgacugag

SEQ ID NO: 192983 - RNA, 136732 nt, Homo sapiens
gggcggcgccgccgcgcccgacgccucuggggguggggacuucgcgggagucgccggcggaggcgaggaggagcucugcgcggcgcggcgggcgauccgagccgggacgggcugcaggcgggggugcugcagaggacacgaggcggcgggcuggagacauggaccgcggcgagcaaggugagggcgcggacccagcgggcuugggcucgggcuuggacucgggcuuggacucgggcuuuggcucggcgcggggcugagcgcggcccggcggcucgagcaggugccgagccuccugggccggcgccgcaaguugcaucucccggauccggaucuggcauccuggggcccuggaaggagcggcucuggcgggggcagaugggacugcaugugugagugugagugugcgugugugggggagagggagagaagguucugggagguggcgaaggggcuagcgucaggggcuggcggccgugaugcgcuuuggguggaaagccgcgugaagggagcacggcgcagccagcuccuguaagugacuggaaccaggaacagaggacagugagucgcucucgucccuccaggugggaaaccccucucucccucauaaauuaagacuuucugccuucuucuaaguucaggugguuaggauuuuugguggcguaugacccaugggggguuugggaggcagauauuuaucauacuagaaacccccagauuguggaguggugucuguggguuugagggaagagagcuuuucguaggaagggugaaaucccacaacacaaaaccuucagucuaauuuaccauagcguugggugcacuugcuucugaaaacagcucaagugaaauuacccccaaauagagcaauaguaggccaugguuuucagauuuaaauaguuucauccuagagaucucugcugaucauaagccugugacuguacgcagauguguguggcacgcuuuuaaaaagauacauaaaugcugaaaaaagaaaacaagguagguaaucuugggaagugaggauaggaaucacuccuguuuugagcccugacacaaguuuucauguauugcuuauuuuccuccaguaugugccgucaugugugcauuuuuauguaaaucaaaccauauuccaaauauacuaucuuguacuuuauuuuuuucagacucugguguuuuuuuuguuuguuuuuuugagucuccaccuguagcccaggcuggagugcaguggcgggaucucagcucacugcaaccucugccucccugguucaagugauucuccugccucagccucccaaguagcugggauuacaggugugcgccaccacagcccggcuaauuuuguauuuuuaguagagacagagguuucuccauguugaccaggcuggucuccaaguccugaccucaggugauccacccgccucagccucccaaagugcugggauuacaggugugagccacugggccaggccuguacuuuacuuucauuuacuuguaagauagacucuuuggagucuuucagcucuuuccucgcuccccuucagauuaauuucagacuuaacacaagugcuuacaaacauuacauacaauaugcuuuauauguguuaccuauguguauauauauauuauacauuaccuguauaacguauauauacacauacauauuauuaucuaaauuuuaagcuucuugagguuagaaacauuucaucuuugguuguccugagugggauaacaugaugacuuguacauaguagacaugcaaauguuugaguuagaaagcuugucacaugucuuguauauauuguuagccggcuuaggggccaccauguaagucagcauuaugucugucuggcuuucaaugggggcgacgcaggacgggggagacaugacgacaaacgugcccauguguauuuguauacuaaucuguuacacacugucguuugacauaaugauguuuuuagaauaacuauguuugguacuugucaaaguaaauuaaacggcuguguuuuacuuacgugaguggaguaacuaguuuuaguaguguuuguguucuagcuugggugguaagaaucaacagucauugguagcacugcaguauuccaacuucuuguguaguuuuuauaggacuaguuuaagugucuaauucuaagacauauuuuuuucaaaucuuuaucuuguaagaugagucuuuucgugucuauaauuuucccauauguucuuugggugagguggaggacucugcuccgaaugaaagaagaggcacugccuugggagggucaguucauuuacuccaaagcuuugcuguguuagaacaacguggccaaggcugggugcgguggcucacaccuguaaucccagcacuuugggaagcugaggcaggcagaucacuugaggccaggaguuugaccccuguccaacaagguggaacccugucucuacuaaaaauacaaaaauuagcucggcgcgguggcaccggccuguagucccagcuauucaggaggcugaggcaggagaaucacuagaaacugggaggcagagguugcagugagcuuagaucaaaccacugcacuccagccugggcgacagagcgagacucuaucucaaaaaacaaacaaacacaaaacaaaaccaccuggccauuccuuacucuugcuuccaccugccuaccugccuuuucaucuuuauguuaccagugcacacaguaggugcuuagaaauauguguugacugccuaagaugagugaggaaaguguccaagagcaggccccagccauaguaaccucugugucccuccaaauccaucucuuguuucccacuuucuccuguucuguuuucccugucuauucucaagaagcagaacuuagccagagaguugcugauaaggcagugcugggcuuggaggauaacuuuacauggaagaucuuagaacuaguagaguggaugacucagucuuaagugaaucuggagcaagacuccugccuuaaacuggaaaaggcacaaccugggauuuuaaaccugguguucacuagcaaacuguguuggcugaaauaagguuuaucaaacucugugauugucuccugaauugugauuuuggcaacauacuuaaaaccaaagcagaaaauuuuaggauuuguugaacuuuuaauaguuuuuaauguacauggaguuuucuuauauuugucccuuaaaaaaucccuaaugaaacucuaguuguaaaauuaaaugcccuaccucuugucuuacaugcauuuaucuauugaaaaucccucuuccaaccuucuuaugugaaguuaucaaaaaaucuguucuugcuacugauuguacuuaacagagcuguaaauuuuuaaaauaaacacugaguuuuccuuauguuuucaaccacgaguauucuaaugcucuguaguaucaggcccagauucuguuguuuuucuacuuucucucauaccuagggcuugaauacaauacucugcuuacagugagaguucagugaacaucaaaugauuuaaaauacguuaaauugcaucaugccuuucaagaguuuccaagcauuaagcucagcgcagcacauuuacugugugugguauuuccuacuuugauagagcaguguugcuaacuagagcauacauuguguagaaaacccuccugacuaccuuuuauggagcugaauaaauauguauacuugagugcucucauguuagucauaaccuuuaguuuagcacuguuauauagaagugacagucacguagcccacuacacauuauacuaguuugaauuuaaacaaagcaaaacaacuuuauaauuuuaaggggaagaggaaugguuccugaggccaaaaaacuagagaggaaaggcuucaaaaaaagaauaacacaauaauaugucacuaucauuuuaacauuguaauugugccuuagaaauaaauaacagaaaugugggguaucauuuauuuaaaaauaaagcaaauguagagaauaauggauaauaauuuugagggucuacucccaagucucugggugugacccaccccauccaggcuguuaauuuauuuggucaacaguuucgugauuuccauauggugcugaugucuuuguuagcucuucuucacuuccugcauuuauuuuuauguggcaggcugccuagucccuaggggaauagcugagugguaggagggguugugaucuuuuagcaagauuucaaaacagaauaauguaugcauguaauaaaaacaaauacgcucacucacagugcaaaaccaaaaagaacacccaaaucccuggaacuucugugcuacuaagucuuuuguuguaggcuaagauuauuuuccuuuugggguuaauuauuucugccuuaauuauugacuguugugaaaucucucuucugagacauucccaaauuuuauuuaaacuaguggguaccagcuguacugaaaccauaauuuuagccauguauuuuuauuagaaaaauguuuccaggggauuaaggaauuuuaauauuuaguggaaguuuuaaaaaagaauguaaaaaugccuuuuggaaccuaagaauaguugucuauuuuagaaaaaucagaaauauugauggagaaaaaagaaaauuacccauaauccugugcgagaaugagaaaucauaguuagcauauuaauuuauaccuguucauguaucuaugcuuuaaacaaaucacaauuuuauuauuauuuuuuuuaacagugucucgcucugccacccaggguggagugcaguggcgugaucucggcucacugcaaccucugccuccuggguucaagcaauucuccugucucagccucccaaguagcugggacuacaggcgcaugccacgacacccagcuaauuuuuuuguauuuuuaguagagaugggguuucaucauguuggucaggcuggucucgaacuccugaccucaggugaucugcccucauuggccucccaaagugcugggauuacaggcgugagccacugugcccggccaacaaaucacaaaauuucuuauugaauauugcauuuuauaacuugcccuuuuaaaaaaacccuaaauguauuuaaaaaauacacuuuaauggccgcaugugguggcucaugccuguaaucucagcacuuugggaggccaaggcgggcggaucaccugaggucgggaguuggagacccgccugaccaacauggagaaacccugucucuacuaaaaauacaaaauuagccgggugugguggcauaugccuguaaucccagcuacuagggaagcugaggcgggagaaucgcuucaaccugggaggcggagguugcagugagucucucucucuugcccaggcuggagugcaauggcaccaauuuggcucacugcaaccuccaccuccuggguucgagugauucuccugccucagccucuugaguagcugugacuacaggcgugugccuccacgccauaauuuuucuauuuuuguagagauggguuucaucauguaguccaggcuggucucgaacuccuggccucaagugauccucccgccucagccucccaaagugcugagauuacaggugugagccacugcgccuggccuagagcagcuccauuuuuaauggccauuuguauguauuuauuuauagauguaacauuuuauauacuguuauagacaauauuuaacuuguucccuguugaugaacauuuacauuuugccuuguaggggaggaaaaauuucucccuacccuuuuaggguuucuggcgaggccuaggaauuaaaccaacaugagauagauuaacaggagaaaagcaugcaaauuuuauuuagugcuuuuuauguauuacauaccuuuuacccucacaagaggaaugaagacucaaggaaguggcuuggccugaucgauuauauacuaggucaaaaaaagaguggcaguuguggaaaaguaacuaggaagguaagguuuaguuuagcaagguuucuuuaugcagauuucuuugggcuuggacuuccugugauaagaauguuucuuucuuccugguagagggaggacaucuuucauaugggagcuucaucuucugcuuucaggaaaaagagaggagguuugggugcccuucuuaacaccugcuguuuuucaagugccuuuagcccaaaauaaucagcaugcuaaaguggaauguuuugggaugcuguguccugaacuccuucacccugauauuuugcuguuaaaacaaagcugcagcaaauguauguguaugcaagucauuccauaaaaaugccagugugucuguaggaagaauucuuagaagaauguggcuguucaauuuugauagugccaaauucugcuccauagaaguggugccaguuauacuuccaccagcaugugcgagcguuugcuuucccuugccauguggccaggauguugccacacuuuuccauuguugcuugucuuauaggggaaaaaugguuucucaguauaagucuuacuauauauauuuaauauaaagguaguuuacuucuuuugauauguuuacaaucuacauggcauuuucugugaaauaucuggccauaucuuuugccaauuuuucuauuguauuuuauagaauguaccccguuuaugagaugaguuguuaauuuuuuuucuaguuugucauaccuuuuuugacuuuauagugauuuuuuuuaaccaagaagaaauacuaauagcucuuuuuuuuuuuuuuuuuuuuuuuuuuuuugagacauugucucccucugccacccaggcuggagugcuggagugcuggagugcaguggcaugaucucugcucacugcaaccucugccucccaggcucgagcaguucuuguucagccucccaaguagcugggauuacaggugcgugccagcaugccuggcuaauuuuuuguauuuuuuaguagagaugggguuuugccauguuggccaggcuggucucgaacuuguggccucaagugaucugcccaccugggcgucccaagcugcugggauuacaggagugggccaccauacccagccuaacuaauggcucuuuucauuuauggauucuagcuuuugaaucauuuuuagaaaugccucccucacuuugaguuuaugcuuuuaugguuuuauuuuuuauguuuaaaucuuuccucaaucuggaguuuguuuugauaaugagaugugagguauaaaucuuaacaccuccaccuccaauuggccacccaacugccuaacaccauucauugacuaauggcuucuuccucuauugauuugaaauaccacuguugucauguacuaaauucuuacauucuuuucuuuucucuuuaucuguauguucauugccagcagcuaaaccuaguuuaaguuauuguagcuucauaaaauguaaaaaugucuggaagggcuaguuugcucugauuacucuauuuuuuuuucugucaguuuuuuucuagguauucuugccagacuauuuccaaacgaacauuagaaucaacuuaucuaggugaaaauucaacaaaaaucaugcuggcagaucuuuuucuccuucucucuccuccccccuuuccccuuucugucugucugucucucucucucucucucucucucucucucugucucucucucacaguuagaauuuggucuguuucuuuauucaauaccccaauauauguucauuaggguuauacuguauacacuacacauaacaguuuuguuuuuuguuuuggauauuauuugauaauaagaauuuuaccacaucauuaaaaaaaguuuccccaagcuauaauuuuugauaauugcacucuuccacuauucaaauguuuauuuaacucuuucucuccuggaguagguuuacauuccauuuuagcuaugauacugcuuuaagagaaauuguuuuaagauaaauuuccauagacaggucaaaggaggugaauauauguaagcuuuucgaugccuguuacugaaucucauucuggaaaacauaacugucaaugcccucuuuuucucaugguaaaaaaauacauaacaaaauuuaccaucuuaaucguuuuuaaauguacaguacgauaguguuaacuguauguaccuugugcaacagaucucugaaacuuuuucauuuuucaaaaugaaaacucuguacucauugaacagcagcuucccaacuuccccauuccuccauccccuaccccugguaacagucauagaaaccgugauuuuaugaguuugaccacuuuagauaccucauauagguggaaucaugcaguauuugucuucuugugaugcuuauuuuauuuagcaugauaucggggcucaugcguguguagcacaugacccaauuuccuucuuaaggcugaauaauauuccauuguauguauguacuacauuuucuuuauuauuuaucuaucaguggaaauuaagguugcuuccacaucuuggcuguugugaauaaugcuguaaugaacaugagugugcaaauaucucuuugagagccuguguucacuucuuuuagaaauauacucagagaugggauugcuggaucauaugauaauucuguuuuaauuuuuucagaaccuucauacuguuuuccauaauagcuuuaccaauuuacauuugcaccaacaguacacaaggauuccaguuucucuccaucuuuaucaacacucguuauuucccguuuuuuuuguuuguuuguuuguuuuguuuuguuguguuuugagacacagucucacucugucacccaggcuggagugcaguggcucaaucauagauuaccauaaccuugaacuccugggcucaagugauccuccugccucagacucccaagugcuggacuuacagguugagccauugugccaggcuguuuugccuguuuuugaucagauuaguuguugaguuguacgacuuuuuuauauauauguucuggauauuaacccuuuauuggauguuugguuugcaaauauuuuuucuuauuacguaaauugccuuuuuauugucuuuuuuuucuuuucucuuuuuaagagauugagucuuucucuuuuguccagacuagagugcagugaugcaauucuagcucauuguagccuugaacuccugggcucaaggaguccuucugccucagucucucuagucauuuccuuaaaaaaaaaauuacagagcuuauaggcuucaauuugucuguuuccuagagagguuauagauguuauuauccauuuguauuucccucuagagauuguuacuuaucuacuuugggaucuuagugugucuugccuucucauuguucucugucaccuucccuccuuggcaaguauuuacuuuuucuauuuugcuuaucauuuugguuauguuggaucuuucaauguuauuuuuauuagcaaaauacaguauuaggagcaaauauuuuccaggugacauuuuggggguaauuugcauggcuuucuguggcuuucaguacuuccuucuuggugucuuuucuguuuagacacuuguaauugguacuaaaaauagugauuucagacaggcuauuaauuuacaugccuuggcucauaaucauggugaguguguuuuauguuacagcuauacaaauguaaaugucaguuuuaaaaauuauuuaaggccaggugcgguggcucacacuuguaaucccagcacuuugggaggcugaagugggcggaucacuuggggucaggaguucgaggccagccuggccaacauagcgaaacccugucucuacaaaaaauauaaaauuagcccggcgugguggugcaugucuguagucccagcuacucaggaggcugaggcaagagaaucgcuugaacccaggagguggagguugcagugagccaagaucaugccucugcacuccagucugggugacagagcgagacucugucucagaaaaaaaaaaaaauauauauauauauauauauaaauguguucuugauaaaaguuuuggauugggaacuuauuaacaggaugaaauuucacccauuguauccuuaguuuauuuggaggcauugugguguggaaaaggagcuuaugguccaaucaggagggcuuaagaaauaaagaugauaguuuauccaacccacuagaauguguacuuggcuagaaauagugucacuagaauaggagacugccuuacauuuuauucccagcuugcaguucaaguaugaauguaguagguacuccauaaauauuucucauauugcacauacaucaaucaaaaagacuucuagcauuaauagagucagauggauuuggauagaaaagacuaagaauuaaagaaggaacaugguuuggcagggagauaggaauauauguucuaaauaugcuuauagucuuacauauaaucacugaaaaucugucugugaauauaaguuaaauugguacuuugcuccuaaggcagguauguaagaauguguguguauacauagguagaagagacgguguugguuaaauuuuuauucuugaaaggauauuggauauagugcucaauaaauacuucauaaacacauuuucagugcuguucuauugaaguuaguuauuuacuucuuuuuuucuuuuucuuuuuuuugagacagagucucgcucuguugcccaggcuggagugcaguggagugcagugauugaggcucacugcaacuucugccucccaggcucaagcaauucucgugccucagccucccaaguagcugggacuacaggcaugugccaccaugccgggcuauuuuuuuuuuuuuuuuuuuuuuuuguauuuuuaguagagaugguguuuugccucguuucccaggcuggucucgaacuccugagcucaggcaauccacccuccuuggccucccaaagugcuagaauuacaggcaugagccaccgcccguguccagccaguuauuuacuucuaaugcauucugagccuaggagacauggauggccuuagcacauguuaguaguaguuuuuaaaaaacacauuucagaagggcaagcaguauguugacaguaguggaaagugcuugcuacuaguaaaccagaacaaaaauucuguaaagagggaaaaaugcaaacauuuugccugccugagacauuuggcaaauggaugauuaaucuuccauuucaguauggaaguuggaauauuccauauggaaguuggaauauuaaguauggaauauuauuuuaugagaacccagaaugagaaugaugacgaugauaccacauggccuuugagaacucuuacuaauuuucuacauauuaucuuguuucagucuuucagugcugcaggaagguaggacugguacauuuucauuuuauauaugaggaaacauaaucugaaugaucacgacuuccccagauguacucugcuggauguggagagcucuacaaaagcuucguuccaaaucuguugucucuaagagaauaaucuggaguccaagaaaaauuuaaacuacuuuuuuuuuuugagauggggucuugcucugucacccaggcuggagugcaguggugcaaucauggcucacugcagcccugaccuuaugggcucaagcaaucuuccuaccuaagccuccugaguagcuggggccacaggcgcacaccaccaugccuggcuaauuuuuuuauuguuuguaaaggcaaggucuuacuauguugcccagacuggucucgaaccccugggcucaagugauccuccucccucggccuaccgaagugcugggauuacagguaugagccacugccuggccuaaacuacauuuucuaaucaguuuauagggcuaggaacaucucauacuuuuuaaagaaauguuuucuuuccaaauaauugaaacaaaauuggaaucggaaguaacagagcuucagcuuugcauuacaauuaaguuuuccagcugggguuuuacugggucauuuuuaguaauacaacuacugugguuaccagcaacaacauuuauuguuuucuguaugucagguucugucuaaaugcuuuucauguuuuauuuuugaaaaauuucagaacauacccuaugagcagaugcuaacaguaucccuacguuacaaaugaaacagggcaugaagggacagaguaauaacuuuuucaggggcacacagcuuggcgcagacaggucugggauuuugaucugugaugucuggcuagagaguacguguccuuacccagccuauaccuauacuacauaaaaguugcagacaaucuuccuuuuccuugcaaagguguuguucaaaagcacaguacagcugugguaggagccauggaaaggagcaccaagcaguguaucuauaccagagucuggccagugugucugaucuuaugcaucagaauugauuguaaauuaguucagaauacugaaccugaagucauaucgagguucaaaauuuggcuucaucauuuucugguugugagacauuggauaagucacuaaacuucucuaaggcugauaucucacauaugcaugaaaauuagguacaaaucuguuacuaguacuggugcucaauagauacugauuuuugaaacugaauauuagauacuucuguaaaaugcuaacucagugguucccaguuuaaacgaaacauuuuauuucuuuagagacaagugugauauuggacauagugcucaauaaguacuucauaaacacauuuucgaugcgguucuauugaaguuaguuauuuacuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaucguuuuagccgggauggucucgaucuccuccugaccucgugaucagcccgccucggccucccaaagugcugggauuacaggcgugagccaccgcgcccggccuacuucuuuuuuuuuuugagacaggguuucgcucuguugcccagccuggagugcagugaugcgaucuaggcuuugagccugcucucaggcucauaggccauucugaagaaacaaacauacaaauaggcugcuguaguagaguagauguugugaaaaguuuauaacccuggcugaggaggaagugagcaacgcuggcuggggucuucagaaaagaauucccaaaguaggugaccuuugaacuuggacuugaaagcugcuauugacugaauguuugcaucucccucacccccauuauccaccacucuggcagugguagauaaugcugaaagauuuggguuccauggaugggggugggggguggaguugaggagaauuggguugggguugaagaggagugggguggggaggaggagaaugggagggcugguacaauggauugcaggccugugggaaugggggaaugguaaagggaaggcaaccggaaagggaaacugcucuuuggagaagucauggguguuuuaaagggaaauuuggauuaagugaugggaauuugcuuggcuauucccaagcaaauauucccaagcaaauagacuauagauauuaaauuugaaugucguuuuuaguuccucaguagagaggaugaguaguuuggcauuuguguguguuuguaaaaugagagcagaaacuagaggcaugggagaauaacuggauuugcuaugccuguggaugccacugguuuuaguuaagaugcuuuuaaugcaaaauguauuuuaauagugauaucguagaguuugaccuucaagaagcucaagucuguaagcaauaauucacuuuaauguguaagagccuugcagagaauaagaacauauuaaauauuugcagaaugaaaguauuauacuuucccugggugguaugauagccagagaagcaguuuagucuagaggugacauuugggugaaauuguaguaaugcugugauuuuagaauuuuaaccagugauuucuaagggccaaccugaagcuuguuuucaucguggagugccuuggcuaugggacugauuugugcagcuucuagauuuguuaacuauucucgcucggguuuuuuugagaaaugauuuucauuccagaacagcaguuccucgaccugagagucggucagugcuuuucuucaggucauuguugagggggaaaccuaucggccaagccugccucuccuggugacuuuauagugcugugacuuuauagugacuuuacacugcugauugugucagggauucaaugaaaauccugacugaugguaaagagggcauggcagauuucucuugguuuaggaguuuuauuuuucccagcauuaccauccuuucccaaacuuauuuccuuuuuuuuuuuuagccuucaagaggggccucugguuccaggagcccugucuucgccuugguugggcucugucuggggcuguggucacugcagaugacauucucuugacuggauuauuaauuucaugaugaugacuauagauacuaaauuugaaaaguagugaagucugaugaggcaaccagcuuuucaaagugcauuuugugaauucccuccaauccaaaguggagcgggaaccucaaaucacugguuagacuugguauuauuaaauaaucagcuccauuuuggcaaagagcagucucccuuucugguugccuucccuuuaccauucccccauuccugcaggccuggaauccauuguaccagcccucccauucuucuccaccccaccccacuccucuucaacccgaccccaauucucuucuacucuaccccaauccacagagcccaaaucucucagcauuauccaccacugcuucuuaucaccaaauccaguaucuacucuucccucucaaccuacuuggcauccccacagccuuggaaaguccagcacugcauuucuuaauucguaccuuccuuucccccugagauguucacauuccaugcucauuucuccuuguuucuccuauucuuuuuccugggccaucuaaacagcuuaauagcuucaaauaucacacguccucaggucuccuaaaccuugauauccugcccagcucuuucucuuagaaauccauaugucacuccugaaucuacccacaucaacaucccacaaagacuuggugaugguuuuaaaacauguucacacauucguugauacuccucccuccaaaagguguucugauuccccucuccuugaauaugggcuggccuuugugacacauuucuaacuaauagaaugagacggaagugacaccaugugacuucuaaggcuaggccauaaaaagccacacagcuuguaccugccucucuuggaacugcugccuugagaacccugagcgaacauguaagaagccuggacacccugagucugcaugcuggaggccaggcagacagagacaggugccaggaaaccucaguugcuaggucuuccuggugucaguagccccucaugugagcgggugcaccuucagaugccccuagccucagucuucaaguccccccaacugaggcugaguggagcagagaauagcuguccugaccaagccaugcccaaacuacaguagugugaccauaauaaaugcuguuguuuaaaaccacuaaguucugggguggcuuguuaugcaguauuggauaacuggagcagaccuuaaauaugauguaccccccaaacaaaugcaucaucuccaucccuucaucugcucuucuuucuauauuuucuuuucuuuucuuucuuuuuuuuuuuuugagaugaaguuuuccucuuguuguccaggcuagagugcaauggcacaaucuuggcucacugcaaccucugccucccggguucaagcgauucuccugccucagccucucgagucgcugggauuacaggcacacgccaccaugccuggcuaauuuuguauuuuuaguagagacagaguuucuccauguuggucaggcugaucuugaacucccgaccucaagugaucugcccgccucggccucucaaagugcugagauuacaggcgugagccaccgcgccuggcccuuuccguauuuucuaucucaguaacuucuccauucaaucugaaagauuuucucuacuuuuccuuuuccucagaugccucgagucccccuccacugcucaacgucugacuauuccaacccugagccuugcagaaauccagcacucacaccccaugacacccccuaccugguuugaggauucauaaaugccuuuuugcccucucauaccucugcauuguugcacuugcugaaucuucuucguaaauuucuuuccuugcuguucucuuuauucucucaccaccucaaaucacuggaauagggagacccaaggaaagggagagagauggaggaacggccagucaguggagcagucagaacacacacaacauuuauugauuaaauuugcuguuuuauacaagcaugguuauggugcaugaaagcaauuacaauaguaacaucaggccuggagcaguuguuuaugccuguaauccuagcuacuugggaggcugaggcaggaggaucgcuugagcccuggaagcggaggugucagugagccaagacugugccacugcacuccagccugggugacugagugaaaccuugucucaaaaaaaaaaaaaacaaaaaaccaaaaacacaaaaagccaaccaaccaaccaaacaaacaaaacaaccccaaaaaacaauuauaauaguagccucaaaggucucucaucacagaucaucauauacauaauuuauguaugauuuauguauuauauaacauuuuguucugcaggaauaauagaaaaaaaacccugaaauggauuuccuacuuuguuuauuuauuaguuaauuucauugcuacuucaaagcuaauguagguguuuuguguguguguguguguguguguguguguguguguguguguguguguaugucaugauucaaagcauagaagaaacauuuugaauuauuaauugagaauuuaaaaaucauacuucauuaguuuagcuauuugaguuucucuguaugaauuuugggcugaggagaaacauagaagccacagcagcuuucccuuuucuugauucaaaggugucauaauuuaaaaacuuuuuagaagaugaagaggacauuugauuuuuuguuaucacuuaaggggagagggaaguaagcagugagucaauugcaauucaaauccggugccaucccaggacauagaccucuguaguauugucacguccaccuugggcuuugcgcacauuggccaccagggaggguucgacuccagagagccucaccugugucuagagcuuggggaggcugcgggcugggccugccucuuccacaggaguccugggagcccuccugauacuccccaugggggacaacagggcccguugcuucucugucucucuuccuucuccugaccaaguugccugcccaugcagucacccuuuagcuuuugaugauaauauuauuuuuuagaauuuuaaagguguguucauuuucccaccaacacuccuacuucauaaccuuauuuugugcagugaacaaaagaagaugugauuguguccuucacaguggggcagguucugcucauccuuuuuguagagguuggaaaaggugagugaaagggcgcauagggagggauggggaugguuugggccuuucugcuguugaagaguuugaaauucuuaguucuuuucaaccaguucuauguggaaagaaagguauuuuauuugacagugauacuaacauugaaggaguguuuccuagggccuggcucccgccaagcaucuaugggcagcaaaugcccuguuugucccucacaucagcccugggcagauguauuuucccuuuuccuguuuuacugaugagggagcuuaaaauuuagggagauuaaggaccuccccaagaucauagaguuuaucaccaauauuuuacugacucuccauaauauagagagcucuuaucuuaaaugaauugguuacagauguaaauuugccaaaauggaggugauuuauuuaauaauaccaagucucaaauguuggagguuuuaacuuugaauuauugacuuaaccucuaguagaauguuaugaugccaguguagccaaaaaagaaaagagaaaaagucuugcuuuuguugauuuuaaaagugccugggaccuaggaggggagagggcaaugaugagauguggaaagugcuggaagggaagcauucugcuuaccccuguccagccuucuugagggaucauugcucccuuugaggaaauaguuuuuccuuccaaggcaauauacucugcuuauuccaagggaagccaauggacagcucaccgugcgggccccgugucuuggaagcaccuguggugccauuaacuuccuucaguuccuggagcauugcagucaaagcagcuguacuuaauguaguucguauuuuccugcacuugaaguaauucuuuaucauuuuuugcauaaguuauacauaaccuuaguggagaaaccugugaaagcauagaaguaagacauuucuuuguaauaaaauccuaguaaccucagcacucuccucccacauuuguuagugccuaagagucuucuuuuauuuaauauacauauaaauucagggucaaauaugcuaucagaaacaauucuaaugaagguaaaaacuaauuuuauucacaaauguuuuuguguacccucucuuucuccccuccccagcacacaccccgucaaguugauauucagguucuuaaucacaagcauuuacuugccacauaggcugucuuuggcaggccuaucaguuuccucaauucgaaggaaaccugagaucugcuugugccuggcauuuuuuuuuuuuuuuuuugagacggagucucacacuuucgcccaggcuggagugaaguggcgcaaucucggcuacuacaacaucugccccccaagauucaagugauucucuugccucagccucccgaguagcugggauuauaggcuugcaccaccaugcccugcuaauuuuuguauuuuuaguagagaugggguuucaccauguugacccggcuggucucggacuccugaccucaggugaucuaccugccuuggccucccaaagugcuaggauuacaggcaugagccaccgcucccggcugccugacaucuuucaugugagagaucuuuggagcuagaugcaccaguuacucuuuuggauauuaaaugguaguggguguuuuuuguuguugggaaugaguguuuaggaggaaggguguuuucaucacagcauuucacaccuccuuuggugcugccauucgaguuugcuucugcccaugugauucugucagguacuaucaaggguuggccuggcuucuucauccuccugcugaggauauggcuggccucucuccccggucagcucucuaccuguggguaggaaaagguauucaagauucaccuccugcuccuggggucgggggggcaugaaaggcaggucugaucuucucccuuucucgagcuguuacuggcuauuuagaaaagucuguucuggaaggugcgucuaaagccuggguguugccuuucuagcguugcaguauucuauuuuugaagugauagagaggugcagggcucuuguuuauauugaaagcugcuuaccaggaaguacuuaggucucuucugacaaaaaucaacauaagcgcaauuaacauugucuugcuuuuaacuuaauuugcuuucuaauucauuuagcaauggauguauuacuaaaugaccuuguaauauaucuuacaccugucaaaagacaaaauuacaacaaauuuaguuauagaucuaauuggcauuuauucauuauuugguaagugggcagccuccauucuauaaaagagacugagcuuccacugggcaaugucagaacagugccuuuuauaagggaacaaagaaacagaacaauagaaaaaaaaagcugauugguuaacaacaaguuacuucagguuacuucuuuuaaagguuaaagcagaagagacuuucuuauuaugcugauucugguaguuuggaaucuccuguuuccagaaaaaacugaucuuuuuuuggggaucuacugcuucuuuaaaguuucaauaugauuauguggcaguaagcaugagugacucacuuugguguggucuggcuuuuggguccuagugcaggagcuuaguccaaaaacaguggccucccauaauuuuuguuuaauauacuuuaacaaucacuucggcuguuucuucaaguuuuaagccuauucuuuuuagagguaaaauauacuuuuguuauuucucuuucccauuguaauagucuguucucacauugcuaauaaagacaugccugagacaggguaauguauaaaggcaagagguuuaauugacuuacaacuucacauggcuggggaggccucacaaucauggcagaaggugaaugaggagcuaagucaugucuuacauggugacaggcaagagagagcauaugcaggagaacuucccuuuauaaaaccaucagauuucaugaaacuuauucaccaucacaagaacagcacgagaaagaccugcccccgugauucaguuaccucccaccaggucccucccacgacacaugggaauuaugggagcuacaauucaagaugagauuuggguggggacacagccaaaccauaccuuucuuccccuggcaccucccaaaucucauguccucacauugcaaagccaauaauggcuucccaacagucccccaaagucuuaacucauuucaucauuaacucaaaaguccacggucuaaagucucaucugagacaaggcaaguccuuuccaccuaugagccuguaaaaucaaaagcaaguuaguuacuuccuagauacaaugaagguacaggcauuggguaaauacagccauuccaaaugggagaaauuggccaauauggaggggcuacaggcuccaugcaaguccgaaauccaguggggcagucagaucuuaaagcuacaaaaugaucuccaugucucacauccaggucacgcugaugcaagagguggguucccauggucuugggcagcuccaccccuguggcuuugcagguacagcuucccucccagcugcuuucacgggcuggcguugagugucuguggcuuuuccagguacacagugcaagcuauugguggaucugccauuuugggaucuggaggaugauggcccucuucucacagcuccacuaggcagugucccaguggggacucugguaggggcuccauacccacauuucgcuccugcacugcccuagcagagguucuccaugacagcccugccucugcagcuaacuucugccuggacauccaggcguuuccacacauccucugaaaucuaggcggagguucccaaaucacaauucuugacuucugcauacccacaggcucaacaccagguggaagcugccaaggcuuggggcuugcacccucugaagccacaguuggagcuguaccuuggccccuuuuagccaugacuggagaagcugggacacaggacaccaagucccuaggcugcacacagcaggagggcccuggaccuggcccaggaaaccauuucucccuccuaggccuccaggccugugaugggaggggcugccuugaaagucucuugacauucccaggagacauuuuccccauugucuuuauguuugucuaacguuugucuccucauuacuuauacaaauuucugcagcuagcuugacuuucuuccuagaaaauggguuuuucuuuucuacugcaaauuuuccaaacuuuuauacucugcuuccucuugagugcuuugccacuuagaaauuucuucugccagauaccccaaaucaucucucucaaguucaaaguucuaccauuaucucuagggcaaaaagccaccagucuguuugcuaaagcacagcaagagucaccuuugcuccaguucccaaguuccucaccuccaucugaaaccacgucagccuggacuuuauuguccauaucacuaucagcauuuagauuaaaggcauucaacaaacuuucccacauuuuccugucuucuucugagcccuccaaacucuuccaaccucugccuguuacccaauuccaaaguuacuuccacauucuuggguaucuuuacaagcagcaccucacuauaccagugccaauuuauuagucuuuucucacacugcuaaugaggagacauacuggaaaguggguaauuuauaaaagaaagaggcuuaauugacucauaguuccacauggcuggggaggccucacaaucaugguggaaggcgaaugagaagcaaagucaugucuuacauggcaacaggcaaggagagcgugugcaggggaacgggccuuuauaaaaccuuuauaaaaccaucagaucucaugagacuuacuaucacaagaacagcauuggaaaaauccgcccccaugauuuaauuaccucccacugggucccucccacaacacacgggaauuaugggagcugcaauucaagaugaaauucggguggggacacagccaaacuauaucaccuauguaguggcaaaucuuuuuuuuuguuugguuuuguuuuaauaauuggauauuucuuuuauaugaggcuguaacaacacuuuuugcuucaucuucucuguguaaauaacuuaagcuuuuuaauggauacagcuaaaaauuuggccuuguuaaaggaggaaaaaaauaggcugaauagugggaagugagcagaacuguguuugcuuuuagguuaaaaaaagaaaugauuuuucucuguacaacagagaaacauggcccagaaaguggaauggcauacagcuguuucuuuguaguucuucagucuucaagcaugggcuuuugcuuguaucaaaauauaaguggguuaugaugaccuccuagaauccaagagaauaaagcuugaaauuggaguaacugauguuccccaaaccccagagugagaaugugcuuuuauuuagcauuuucucuucagcaaaaucugaagagugcuuguuacagagagcaaaacuuuuacuugaucuuuugucagaaaguuaaagaauuaaaaaaaggcuguuuuagauauuggcuuuaaaacuguuguuuuauguuguuaugucaagggugaugccacacacuguugacaucaaauccaccaaaaucucacuuaaaaacaauuuagggccaggugugguggcucuugcguguaaucccagcauuuugggaggcugaggcaggaggauugcuugaucccaggaguuuaagaccagccugggccacauaggaagauucucucuguacacacacacacacacacacacacacacuuagccaggaaugguggugcacuuguaaucucaguuacuugggaggcugaggcaggaggaucacuugagcccgggagguugaagcuucagugagcugugauugugccacuguuuuccagccggggugacaaaaugagaccuugucucaaaaaaaaaaaauuuagaaguggaaaauuuguaaguuuuaauaaaauaccacuuacuuuuuagcucugguuuggaaccugacuuacagcaauaguagggagauuaauaagguuaccucuuaaggcagucucucaaaugaaaauugaguauaguuaucuuauuuuuagauuuauagaugucucuaaaccuuauuuuaaagugaguuccugacuacucuuguggcguuuauuuuaucuuuacaagcauuggcaguaaugguugauuucacuucugauuaugaaguuaguaggaaauaaaguacaggggguguggggggugugugugugugugugcguguguguguguauguaugugugugugcacauuuuccaggccccacugucuugaagaggcuugauuagggauuagaaugguaguggcuagagggccucacuaagguuuguuccauaggucucagagcucccuuuuuugucgccuuugcccugcugcccugcucaacaaccccugcaaauguaaggaugauggugggggcugggagcugggguggccgcugccacauguagugcuaaagaaucaacaaaacaggacagcaaaagacuaugcaaauaguuuagcuuucucaaacaaggucuucauuguucauucuuuuucauccuuugguagcuagcuguccuuccuacuaguguugacuguuugucauguacucucuccaccggagucaccaguaagaccagcugaacucuguugagaguuuuggaguaaaauucugauuggacgugguuuuuugugcuuuuugugaucggcaguguuucaguagcucuuaguucccggaaccucauucuccuaucccgucagcgaggucucccuuauuuuugcugagaugcaugguuaaccauuuccccaggcuccucccuagcaccugcaguaucuuaaaaaugguacuuuuaacuuccaggagcaauacaugaacacaagaguauagauaaagauaggcaagaguguagauaaagagaguugugcagagacuucaucuggugcaagucuggccaaccuuuucuuagugauuuuuaugccugcccauguaggccagugguucucaagcuuguuaaaacaagaccucacacccucagagggcuuguuaaaacagacugcugaccccacccacagaguucugguucaguaggucugcggugaggccugagaauuugcauuuuuagcaaguucacaggugaugcugauacugcugguucagggaccacauuugggaaugcuauauagcaugggauuuuuuugugugugccuuuuagaaaaucaaaugcugucaugcuuguguuucuguauuuuucaucagcuccaugucauggagcacuuucugugcuaguacauauugaucacuucauuauuuuuaacugcuacauaguguacccacauauaaaugugccuuaauucuauuaauggauacuugauucuuuccaguauuuuuuguuaacuauuauaaauaaauccugcauugaacaucuuuguuuauuccuccuuuaugcagcuauguuugucuaggguaauauggagaagugaaauugaugaacaugugcacuuuuuguucuauuuuuguuuuaauagauaaugggaccaucacucuaugaugcucaccacauuaaugcccggccuuagguaguuuguuuuauucucugccuaagcugaggcuaaccuggaguugcuaggaaaaucauaaaugugcuuacuagacccuuuauaaacugaaccugaaaugggcuuugggcugcuagccaguuuuucuaagucuuuuuguagacuaacuaaaagcagugauagucaacuguuuuuuuccccuaccagcacaccugguaaauaagaauugcccuuagcaacaauggcucacuuaggugaacuuccaggggcuauacauccaaguauauuuuuuugcacgacuucagugcuagacuuuuccaaucuggauguucuuaccucauguuagauuccguguauguauagccaaauacagcauucuuuguccccucugccuucuaaaccaguuuguccuguuucuguucugcacagugauguguguuaggugaguugggcuguaggcagggcaaguggguguuacguccuagcauuacccuuuuuaauuuuuuggaauucauaaauuaaaauugggugggggagagcucacacugaguugucuacuccuuguuuugccaaguuauuaaaaucaacuaacaaaaagccaccauguuuuuauagauaugagauuuuuaacacuccuccuccccuuccaaaaaaucaggaaaaacauuaucucagaauaaagggcauuacuuuuaaauuuaguuucaggaacacuguggguuuuuucccuccuccuuucaucucggacaagugaaaaugcugcuauugucuagaguugcccuagguuguagagaaacugagucauuucuugaagaaaagauuugaugucuauauuacauauuccuaauuaguucccuauuaguuugucauacugcugaugauguuccugucuaauaguaacuucuggggcaugaagugggcccggaaugugcaguacuccugaaagaagaaaaauucuuaugauuccuacagucacccauucccauucccggagcaccugcuaugugcccagcacugagcugaguccuggauacagagaaguaggggaagguguucuugcauuucggcugcuccuucauagucuagcuucuucaguagcacauaggcaacuuucccgugaaaauguguucgaccuuuuguggugcaacugccaugcccgcucaaagaucaccugccaucaaaaucuucacauagauucaucacuucuggccacaugcuaggauuaaacaagauuacuguuauaucuuugagccuugugggagaaucugcuuuucacuuagcuguucaugcagggcagggugaagcaaagaaauccuuucucuuguaaggaaacuuugauaucucuuaccuacuucugugcuucugcuuugggaugugaaaauacucuacuaaguggcaacaaaauuugcaccaguuuuuaacaccagugcuucccagauaaagagugacccuccaggaguucuucagcugagccugaguuaguugcucauuuugaaccucaugugguguguagaaaugaauuaaaaaauaacccacagaguaacucauuauaaucuuaauccuuuccacacaaccaggauauaagggcuuauuaggcuuugaauagauacuaugcuuauuagguuuuuuuuuuugguuguuauaacuuacuggacaaggugcuacagggaaugagaugaccuacaaauuuagacaauccuugaguuugguuagaaugcacaccgaauaccauguaaaaaaugcacacaaaaagccaugucaaggagacaguccaacaccugucugccccaaagaacugguuguggucucccuuucuggguguauuucagugacucugauagaaaagguguuuuugaaggagggauggguggcugugaguugugugugccucccaugaacuucccugggaagaccacuauucagaaaccuaauaaauauuuaauguaagaggaggcaccuaucuguuaucuuucauagcgcugaagggcaugcugcaguugcuauggagaggcaggugcuggcucagcugugugacaaagacaggcccucaggaacaggagcaggagcaaaaggucauuuaaccucagcuggaagugccuaguugguucugaugaguauugauuaguuuuuuuaugggcugucccauauucuaauauauguaacauuuuuaauuguucaguguuuuuuaaggcacuguuuuauuuugucagaauuuggcuucuaauugcaaaauccuagccuuguauguugguaauauuaagauguaauuuauguacuaauuggaauauugugauauucuucauaguaggaaaaagaacaaaauauuaugauauauguaauauuacaaaauauuacacaaauuuuuccugacagagauuacuuucauuugaagaaggugaaaguucugguugauucugauuauaccuucaacauuuuuagaagcugauuacagaauuugucauauaaaauuaaaauuuuuguuguauaagagguauccuuuggggaaaaaauuuaaauuuuagaguauuuuacauggauuucaccuuacagauucaucaacaaacaaacuaaugugacuuuuaugauuguuuaaaauguuaauuuuuauguuucaugaacauuacaagaacauaaauggcauuuuucuguaaaguguuuugcauauuugucugcuuugauguuuaauaugguggaauguacuaaaaucuuaauaaauguuuagcuuccuguugcaauggaacuaucaaaucauuaguaaguuuuucauuguuucuacuuucuuaguucccuaaguuaggguuaugugauacuaaguucuagaaaugauaauuuuugauugaucaguuggucgcuuuuaaaaugauggacauuuuguuaaacuaugaagcuuaaaaaaagagagaaaugaauccauggcuccugcacguaaggaagguguagacaggugguggaugcuagcauaugaguuagcuacaguaagcuauuaauauauaggguggugcuguguauaauuagcucacuguggguggcuuccugccaaguuuuaaugaguuuuggucaaagagaaauguaugucccaaaggagccaaacuuuuaauugggguuauacguaagucuaucagugaaguugaggguuauguuuucaacccuggacccucauucgggauuuguagcaguaaaggcaaauaaagaugacuugacuuuggguccuuauguuaggguuuagaccuucucauucuggauacaacuucucgaagccuggcuccagagaggggaaaagaagugagugauuugacaagcauuguucuuggugguauauacaaacuccuagauugaucauauuucaucuuuucagcaguugccuuaauaauuuguaguaauuuucagaugggagaugugagaguccaugaaguagguacuuuccuccuaguucauaugguucauaguggagucaagauccagaccccaucuauuuaauucccaaguucaugcuuugugaccauggucaccagauacuuaagacauggcagcugauuuggaggguguugcucuguugauuggugaacuaccuacuuuuaccucacuuccccugagugugugcauccuuacaugcacaugaggaaauacaugaaugugugugcgagguccuagcucuugcuggauucugggcacaacagucagcagugucgucaagucagaguuucuauagauuauuccuccuucccuauucucuuuuaaugggacuguaagggagaguguagggguaaggaagggaagguugaguucugcccaggaccagucugauugugcuuucuuuuugugacagagccucacuccguugcccaggguggaguacagugacaugaucuccacucacuucaaccuccaccuccuggguucaagcaauucuugugccucagccuccugaguagcugggacuacaguugugcggcacaacaccuggcucauuuuuguacuucaggcuggucucgaacucuuggccucccaaaguaauccaaagggauuauaggcaugagccacuguacccagccugauuguaauuuuugucuuccccuuuuugcugaccugcuuuauuuuccaguugugguccuugacuagagacagcgucuucacaguuaagccuuuauuacuguggaccagcccaaccuuaauuuaauguccaacaggaucacuucccaguuuuuccuguacacagguacgggguagaugagaaucucugauaugacuaggcuaacugcucuccaugagaagauacagacccgauuugugccuuugggagcucaugguuaguauggaaugcaggcauaugagccuuaauugcaacacaugacagaauaacgucacuguuagagacugacccaugccauuuaagagaaagaagugaugcuggugagugagauuccaaagcauuuucauaaaagacaagccacuuuccuuggaucucaacuuuucagaauuuugauagaccuagggaagaacauuccagaugaagaugguguggcuauuaucuuaguaucuauugcuacauauuaucccaaaacuuagcagcuuaauaaaauauuuuuuuauuuuuauuuuuauuguuuuuuugagccagagucuggcucugucgcccaggcuggagugcaguggugcgaucucagcucacugcaaccucugccuccuggguucaagugauucuccugccucagcuucccaaguagcugggacaacaggcccgcaccaccaugcccagcuaauuuuuguauuuuuaguagagacgggauuucaccauguuggccaggauggucucgaucuccugaccuuguguucugcccaccucagccucccaaagugcuggcauuacaggcgugagcccccgcgcccagccacauuuauaucucacaguuucugcaggucagaaaucuggggcuggccaagaaagugguucuggcucugggucuuccaugaggucgcaguagaguuguuggcuggggcaucagucaucucagggcuggaggaucugcuuccaagcuuacuuggguggucauugacagcaggugccaguuccucaccccagggaccucuccauaaggcuguucacaacguggcuucccucagagcaaaugaugcaagagaaagagaacccaagagcuguauuauucuguuggucacacagaccaacccuggugccacguggaaggggccuacccagaggugugaaugccagugauauugggggucauagagaugacccacuggguaaugaguaaggaaagguacagggcgucuguagcuggaauuuaggggauuaggagugaugucugggaggugaggcugaugugucgugaguugcauggaguaugaaugugauguggaauuaaccuucaaacagcuuagucuaguaguggaguuacauuuuguauguaacuguggaaagugacacaugcacagagccacagaugauccacguguugcuaacacuggguggugugguucauccaugccucauaaugucaugauugauacucuuucuacacacacacacacacacacacacacacacacacgaguuguauugccccugaaaaugcuccucuuggucuguucuuccugccgguaugacagaacuuccugagauuguugaguuuaggguuaaaucaaaucugaggugacccacucguuaguuugguaguguuuccccaucguuuuccuguugcuaaguggugcaggaguagaagcuggugcaauaguuuccuagagugcggugcagcuaacccuuuuacguacaucauauuguuuagaauuuguuaccaccuucaaccaauucauauaaaaauagauuacaugugggaguuguauuuguuuguguguggugugcauccaagucaguguuaauuuuaagugaguguccugcacucuggguguuuuucguagcuacaaggaagccuuaaccguuguuacuuacaauggauuacuuuucaaaaguuguuuaaucucuuucaggucauuaauggcuuggagacuaauaagcaaaaccauuaaauacuacuuuaugucugaaaaaagaguuaauguuccuggaaaaagcgagcuguuuucuuuaguuaacaagguggagcugguguucccagugguuccgguucuaauaagacuugaugaguuggaaaugauguuauucuggagacaacuguggaguaauuagaauuuuaccucauuuuaauuaaaagauucuaacucuaaccuaccuucccaggcauuugggaaaggcacagguaggucuccuugccagugaggcuccacuacucacuugugggguugacaucaggagaacccaggacuugggccuuagugaggucucacguucucaccacuaaacaaagagaaagcauuuaugcaggcaucgaaccagcgucugugugucacagcuggacuggugcugaaaaaaucaccagggccuuagcauaaaacaaaggcugcuuuauuauguugagagcauaaauaggcuucuuuucuuuuuucagucagauaugaaauuagaguugcuuacugcuaacauggagccugcuggauugagcuguuuugcucacuucugccagauaaucagaagagccgggugggguccccuagcugggugacugggagucaggcauccaucccccgaacaucaggcuccccauuuguaaaugucuuguauuccugucaagaugguuaggaggauugaaaaacgccguuguauuuuauuugauuuugauaauacacuuaacaugagaucuaaccucuuaacaaauuuuuaaguguauaaugcaguauuguuagcuauaguguucaagugcauugggaggcgcuauccaaaugcaaccccuuccccgcccucacccccaccccccguuuauugcuacuuguuauuuucaugguugugcugaauuuuuccccaaggcaaaucuuuaccucugcccuugaaguugcauaugccccagaguggguaauuauuaacuguauuaaucuggaccauauacuguacagucuuuggauaaccuggacaguuuauaauuuuaaauguuuuaaaaguuugcaagucugaaacucugaaaaaauuuuuuuuuucauaaaaauacuagccuaggcugcugauggauguggguuucuuuuugggguaugaaaauuagauugcggugauguuugcauaacucugugaauauacuaaaaaccagugaaccauacucuuuauaaaaaaauaguggauuuuauaguaugcgaauuauuucucaagcugcuauuagaaacaaaacacuguccuaauuguuacuguaaaaauacccuuauuuucuccccucccugccagugucuuaggcagagcagccauucaguaaauacagguggcugaguguugaauaauauaguugaaauaauccaaguggcacaaauagaugagaguggaagugggggcugcagugucaguuguagaaaucucacgggaggcagacucaugggguggcugagacgguggcuccuuugucaguggaggcacuggaggaagaagaccccacuagcaggagaggcucugggucggaggggcugccaugauccuggaaacaggucaucugguuggcucguguuugaaaguugagaauacuaauauuuuaugguccaaauuuugguuaccuuggccuuguaaaucaggaagccgucugaugacaggaugagccuaagguggggaggggaggaugcggugagccacagguucucaauguucagagagccaguguccuuaaauagcgaggugaagagcucaauuaggaaccaaagccaaaaaugagcugaggcaagaugguagaacccaggccuggaucugagcaguugucaaaagucugguuacaacauuugagagugugguguucagcuaccuuuuuggauucaguuuuaguuuuuuauuugcauauucuuuuucuuuuugauaaagcucuaugaggacuauguuuucaacucccuagaugcauauaguccuguacucagauauaauguaucuaaucucuucccagauuuauaauugcaaaccauaagccacuuugaguuguguuccagcaccugccgaaggagacgacuaaaugauaugaaccccauuuuccuccuaagagggcauucaaauucucuuccucuuggauuuuaugaaaucagauuucaguuggaagauucugucacuuggccucuuauugucaaacacagguaccuuuuaacgcagacuucuacugagaaauaauuagagacagggucucauggucaggcgcgguggcucaugccuguuaucucagcacuuugggaggcugaggcgagcggaucaccugaggucgggaguucaccaccagccugaccaacauggagaaaccccaucucuacaaaaaauacaaaauuagccgggcgugguggcgcaugucuguaaucccagcaacuugggaggcugaggcaggagaauugcuugaaccugggaggcgagguugcagugagccaagaucgugccauugcacuccagccugggcaacaagagugaaacucugucucaaaaaaaagaaaaaaaaaagaaaagagacggggucucauucugucgcucaggcuggagugcaguagcacaaucaugacucacugcagcauugaacucgugggcucaagugauccucccgccuuggccucccaaagugcuggaauuacaggccacccuaccuugcugaaauauuuaaauucugaaggaccaaacuauccccuucucaaagaacaauaugaacuagcaccguuauaaacuugguacugcuguaagaguccuacuccugagggcuuccacccaucuuauuuucauacuuaugaaaaauaauacauguucaaagcaaaugaauccaaacaguaugcaauuaaaacucaaacucucuuagccuagacccauuucucccagagcggcuguuaugaucagccucuggguguccuuccagaaaugucuaggcagguaauguauacaaucacuuuaaaaguucaaaugggaacaugucauacacauuauucuguacuuugcuuguuuuaacugacacguaucuuggauauuaaaaaaaaaaucuaacauauaguuuccauuuuuuaagaaaaaagcuuuauugauauauaauuugccauaaauaaucaccauauaguuuaccuuaaaauucacuuguuuuaaauguacaauucagugauuucuaguaaacuuacagaguugugcagugaucaccacaaucuaauuuuagaauauuuucaucacccugugucuauuuacagccacuccacaucccgugcccgcaggcaaacacuuaucuauuuaguuucuauagauugauuuuauuacucuuuuuaauagcaaccugugguccauuuuggaaaaauacaaacauguauuuaauugugcuuuauccaagcacauuuagcuuuugcugauguuuuauuuugcugccugccuacuuuaaaaaaaauuggaaaagauugaaauuuugucuuugagccauacuuguuaagagugauaagggaguuuuagcugaaguuguuuguagauuuuccagucauuaccuguggaacuaggagaagaauuuuggggccuggauaauuauuuauauuugaauagaaacugccugagguuguucuugauuagaugaaagccccagcauuuauuguguauuuuauggaugugggugaaguggaacuaaguauuuacacaugauuggggugaagggggauuuauuauuucaguuuuuugccuuugucucuaccuaggaggauuuuaggagcuguugaguguucagaaguaugucuucggauauauucuccauacuguuucuugggaccuuuuacuggguuguggauuuugaccaaguguuuuuuuaagaagaacaaaguaguagaacaguaugagaccaaaauguccuucauguucuaauggugagcacuguuuucuuuuuuuuuuuuuuuuuuuuuuuuuuuugagacagagucucgcucugucgcccaggcuggagugcaguggcgugaucucagcucacugcaagcucugcuucccggguuccugccauucuccugccucagccuccugaguagcugggacuacaggugcccaccaccacgcccggcuaauuuuuuguauuuuuaguagagaugggguuucaccguguuagccaggauggucucgauuuccugaccuuaugauccacccgucucggcuucccaaagugcugggauuacaggcgugagccaccgcgcccggccauuguuuucuuaaaugucaacuuuuguuuaaaugugugugugagugugcuuguuuuuuuuuuaaccucaaagacugaaauuuuuuuuuuuaauuaauuaauuuauuuuuuauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccccccaccccacaacaguccccagagugugauauuccccuuccuguguccaugugaucucauuguucacuucccaccuaugagugagaauaugcgguguuugguuuuuuguucuugugauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuuacuauugugaauaaugccgcaauaaacauacgugugcaugugucuuuauagcagcaugauuuauaguccuuuggguauauacccaguaaugggauggcugggucaaaugguauuuccaguucuagaucccugaggaaucgccacacugauuuccacaaugguugaacuaguuuacagugugcuuguuaaguaguaauuaucagaaauguuggaaaaccagugccuuaagaguaaggguauauucaggcuuccucuuugucagagcucuaacucuccuggggggcagguaggcuggggcagguagggugagaagacucagguaguucaccgagauaaaacuuuguugagguuggcuggggaagugagccaguugucuugggaagugggaggugaaaaugaaacucccugugugaccacuuuucucuaucaaaaauaauaaauuauuucaaauguucuaaauaaggaggcuuuggauagauuuuagucagcuuguuagcuauucaauucuggcaacaaccguguguacaucuagacuagggagacguuuacaauuaaauucacugggucuugugguuggaaguaaccugaagggauaucuaugcaaguuuccauccugugugugcaucccuucuguaauaccucugccuggcaguucagcaucugcacuugcguacgucuccuggaagggaauucaugaacucucuugggaucccaguucuugucagcuucuucauguugaaacccucaggcuucauauaucucaggguuuggauuggcauuaguuaucuaucgcuguguaacaaauuaccucaucauuaaggggcuuaaggcaacaaauauuuauuaugucaggaacaagucaggagucuuggagcagcucaucuggaugguguggcucagggccucucgugagacuguggucaaguugacaguuggggcugucgucauuuggaggcugaauggacuaacggauccacuuucaacacggcuccugcaccuaguugcuggcaggaggccucaguuccuacuguguggaccuccacuuggagcugccugagugucuucaugacacacucucucucggaucagaaaggagacauuaguaaugccaaggauacuccuuuacucccuucacaagugggcacagauaugguccuuuuuccaccagcucuagaaagaaacaugcagagauguuugaaggcaagaagacaguggccugcaugacuuggagcuuuucuuaauuguaagucagagauaauaauuaaugucaugccuaguucagagaauuauugugugacucaaaugagaugaugagcauuaagacauuggaaacuuuagguacuauaugaauguuuucuuauuggggcaaaccauuuuccucuuguaaaggugagcccagggacaugucucucccccaucucuauacuaucaguucugaucuuugaaugauugcagugccccucauaggguuggguaaggaccaaggcagagaauauguagauaaugcagcacaguacccggcacauaguaagcauucaguuaacagcuacaauuacuuaaugguuuugaaauagauaugccaggcacuaaagaaaauuaauugauaaaugaaauaacuacugcuccuaagcuguggccguggauuagaaucaccgugucugccaugucacugacucuacagaauacuguauauggaaaaaugguuuuuauuauuuguuauuuucuauauuuggaugacauuucugaucugaauuucaaccgugacuucuaguccucuguaucuucuucuuauucugacuugcuacaauauaaacuucauccuuuaaagaaaaagugacccuguuauucuuccuugggguguuuugaauauccucccccuccuugcccagcuucccucaaaugugccaacaauuuuuuucuuuucuuuucuguuuuuuuuuuuuuuuagcaucagcgguaccaucaaguuccuggacucuugaacuugaugaaaucgagauaguuucuguagggcuccauuuggaauugaggagcagguguggucuagaccuaagguccaguggugggaggaauggaaagaagaaauggagccaaaggaaacugagggaaggauucauguuucucuggcucagugagugggugggucaaagaaauaaaauguuuguaauugguuuuaagccugggcaacuggagaaaguggugguaguguuaauaagagaccaggaggaacacaaagaggaaagaauaucugguuuuggagggaagaaggaaaauucaguuuugauucugaauuugagggggguuggcauccaccagacagcuaaacauggaauauggcccauggguggugguagcaguccuugcugcuauuccuggaaccucucagagggucaaucacaggcugucaccguuugccuaagugguauccuaagaaaaugucugaagugguccaggaagaggggccgauaauuauugaguaaagguaaagggaacacacauuauuagacuggugcuuuugaaugucauauuuauucuuaauagcaacuauaugaguuauaugugcauaccugguuuuacaaaugcaggaaaaaaggaccggagugaccagguaagcuauccaagguuaugcagcuaagagguguuggagccaggauuugaacucuacacucaguuuucaucagugaacagauuuuccuuuuacaucagcaucagaagcauuauggcuggcugaacugauagagaacuagcaaguauggacucaaaaguggcauggggaccccuuaguaauuaauuacugaggguaacuaaacuccagguaaccuuuugccccuuccuuucuuccagccauuggaagaacguccucaugugguacagugucaggcaggagacccauguuucuuucucugaaucaauaguggguggcacagaacaacaaaaggacgucugcuuuuagauccugggcuuccaaaucuucuggcgccaucagcuccccuucccucuuggcaccucuccuguccucacccugguauguuguaaacccaagaaguacuauucucuggguccaccugcccauaggauccugaaucuucacacaaacaauaguagucacaauucuaacaaccaguucugaaacauuuacuauauacugaaugauuugcaaacauagaaaaguuaauuuucacggcaaccgaaugaaauagauuuucggccuggcaugguggcucacaccuguaauccuagcccuuuggaagccugagguggauggaucacuugagugcaagaguuugagaccagccuggacaacauggaaaaaccacgucucuaccaaaaaauuaaaaaaauuagcugggacuacagguccugguauauuguaaacccaagaagugcuguucucuggggccaccagccuuuguauuauguugguguggaggagggaggauugguauacagauaaauuugcccauaggcuccuaaauccucacacaaacaguagcaaucacaauuuuaacaacacaacuuuaacaggugcuacaggugcuaccuguagucccagcuauuugagaagcugaggugggaggauugcaugagcccaggagauugagacugcagugagccaagaucacaccacagcacucuauccuaggcgauaagagugagacccugucuccaaaaaaaaaaaaagaaagaaagaaaaauagauuuuuauuauccuauucucauugaugaggaacuucagguucagugaguugagauuucaccauuucauacaucuaaucaguaggagaguuggguuugcaucccuaguucuucugacuugacagcugcguucuuaacuaggaugcugaauugcgucuucauagaaaaucugucuccaaaccaaaaccuuuuccacccacaucuauuaauaguuuuacgcuauucaguauagauggcugccacguggagcaccuguaaagggguguguggcugugagcggccacugaguaucuuaaagugugugagcucauagguauuauuguaggguaucugguccuaagguaucuuggaagacuaaauguggccaaauuucaacaauguuggaauggaaugaaggguagaggaagugaacuguuaguaguggcccaggacucuugcuacaaaagccaccaggcauaacugguuccaccuauaacugggaaauucagcuggagucuugccaaggaguagcuagaguggagggauuggaagacauacugaucuuuugaagauaccuggauacaguugauaccagauuagcacuuaaaagggagucaauauuccucugaguaccaauuaauauuugaggguauauaauaugcuagguguuuuccuuugaaauauguauacagugauuaauaaagcagauuuauuagaauaauaguuuauuaauuccuaguagaaguauaacaggcagauggaaucguuggacugacuggucaguuuguuuccuuucaaguagcuuagccauucuggauauuucaaagaguugucuuugcugauuuuuuucuccugaucucaacaccagccuuucuucuuggcucuccucucuauucugaccacacuggcucuuuaggucaccuuccucaggaccaaagcuuuaaauaccauucagucacugacuccugaagcuaaaccucuaccccucaccccacccacauuuuaacaauuuacggaagacacugugugaaaaauuacccuaugcacuugagaaaggucuggguaaauuacuuucuuccuagauuguucucuuuaaaaauuuguuuuaagcauuuggguuaaacaguaauuuuguuugaauggugaaaauaguuuaaauacguuaaaugauuccccuuuuuguuaacggagcccugaaaucagguauuuuauuucccagccuuuaguugauauuguagugcauugaagacucuuacugaacagaaaaugccaggauuuauauuccuggugaguuggauugagggaagguuggucaccaaacaguccagcugguagcucugcaucuuaauuucuaagucaugccgcagaauguuauuuuaagcuauacacuuaugaaauauauuuucuaguaucuuguugugauuucuugacucugucuuguccaucucaauuuaagauccaauuuaacuaaaaauuccugcugugggcaagaagagugcucuggguggagggcacagcauaugaaauguccugaagguuaaguagcucuuuggaaaacugcucaucaaccagaugguuaccauguagaauaugaugggacugguaggaagaaaucagagggcuaaaaaaucugcuacauuuaggaguaaacgugguccuaagagcaaucgguccuuaaaaccacugaaggauuuuaagccguguaaugacauaauuuggguuuugucugcaaccagacauugcaaaguaaguuagaaguuuuuaauggugguuucaucaagccugaaauacugacuucugugauuuugucugugucuguucccuuuuucauccuuuccaccccaugucuauuccaaacuugcaaaacuuucccuccaccuccucuucaucucagcagaugcucuugucuucucucucugagcaaucugagccaauucggugugaccucuugggcuucuugucacuuuccuucuucagaauauaaaacucgugaccuggcugaccucuuauccaggaugaucauuuagaaacaaaggagaguggccgggagcaacggcuuacgccuguaaucccagcacuuugggaggccaaggccaguggaucaugaggucaagagauagagaccauccuggccaacauggugaaaccccgucucuacuaaaaauacaaaaauuagcugggugugguggcgugcgccuguagucccagcuacucaggaggcugaggcaggagaaucgcuugaaccugggagguggagguuucagugagcugagaucgcgccacugcacuccagccugggugauggagacuccgucucaaaaaaaaaaaaaaaaaagaaaugagaguuaggauuugagagaagucgggggaggaugccacgguucuccuuucuaauugcuaaagucagugaaaucagcuaaacaaacuauggaacauacauugugguucucagggaaauauaaaacaacaacaugcagguagaauacaagagcaaagaagagugaugagcacuuagcuauggcucagcugacaaauuccagugcugacguugcuauccggccagcauucuacgucccguguagaaggauuuguuguucgugucaaugucuuagcagauuuguaaugcuuguaugggaauuuuaaauguaaauuucaugagcauacaacuuuuaauauaaucaugcuguuaacuuaauauaaauuuuaauacaaauuguaugccuguguaaauauacuauuuuauaauuaaacauuuguucaauacuuugugacugguugugauuuuuaaaauaauagcaauuauuuuuuaaaaauuuuaaaaagaguuuauguucugaggcaagcagauaugaauaguggggaacaaccaauaauuuuuucacuauuaauaaauucauguauaucuaauauauaggagaugagaacuaggaaguaucaagcuugaaucuugcuuauccaccaaauucuugaaaauaagugaaugacuaugucaaucaaaauuuaucuucaaguuagaagacauucaagcaaacuucaaaggcuuaauguuuuuuaaaaaucuuguaauuuauauuuuuguaaauaguugaaauguaacauuacagagaaugaaaucauucugguacuaaucuagcauuucuuccugaaaaaaaaaacccagauguaaaaaugaucaagagaaauuuagaaaacaugaaacaaaugaagaagugaauucuuuaaaauuuacugcaaauuuugauggaaaugguaauacugucugauacaguauuacaucuuaauaucuaauauuaccaguauuaguaucugucugauacuguuuauuaauuuuuuuaauauuuaacauuuaaauuuauuuuauuuuauuuuauuuuauuugagacagggccuugcucaguugcccaggcuggagugugguggcgugauaauagcucacagcagcccugaccucgugggcucaagcagucuucccaccucagccuccugaguagcugagaaguauggguguguaccaccaugcccagcauuuuuuuuuuuuuuuuuuguagagacagggucuccuuguguugcucaggcuaggggucuugaacuccugagcucaagcagucuuuccaccucggccuccuaaagugcugggauuauacgcaugagccacugcucccggccaaugauaaauuauuaucuauucacucaagauagacagaaaaauagaauguacuugaaauuuuuaguaaaauaucuuacuuauuaaagaguuuaccauuaugaggugauauguuguuuuccuucuaugaauaaaaguaaaaaucagaauaaaaauauacaaaaauaaauuuuaaaaauauacaaaaugaacagauuucaagugagauaauaaagguugaaauggacauuaugagauaauuguuucuuuuguuuacuuaguaaugugauaagacagucuauaguacugcggacagcuggcaauuuaagauagccuuugacauuuucagcagcuaucuaauuuucauuagcugcuuguuagaaaauguaaaaaaaaaaacaaaacagaaauacaaaccaaaaccaagcagcacagaagaguacaaagugaaaaacaaaaccauugcuaucuacuucccugauuuuugaguccuauuuuugagagagaaccacuauaauguuuuaguauuuaccuuuauauuuuuuauuauguaucucuguguguguguguguguguguguguguguguguguguguguguguguguguuuauuuagaaaucacaagugggaccuguauuugucagguucuagauuauaggauaauuccuguaaaaaucucaaaguuucuguuucuuugcauaauaaaauuugaacacuugcuggucugauuugcagugucuuuauuuggguuuuucuucuuggcagugcuccauuaaauggaaacucaggaacccaggaucuguccacaugguggcuuuacucccaccuguuuggaugugaaaaacagaauucgaauuauagaauuagagaaaaagaaccaagagcucuauagccaggcugccaucuuuaccuuuugaguuuguaaguaauuagauuugugaagauaugaacauccugucaauuuuuugucauucugucaguuucacucuauaguuaacauucaugcauuuauacaaugauugucaaauuaucaaaauauacaugaacgugaacgaagugaaguuauaauacacaggaggaugauaauccaucaaaaauauucaggccaucaguuuggaugagagagcuggagaguguugaaauguuucaaguuguaucaaaagauucuuuacauuuauaguuagcugaugagucaauugauuguuugacagugguuucuaaaccugaauuucuuuuguacaaaauuucuuuuaacaugguaucuuucucuucuuuuuuuuuuuugagacaucaucuugcuccauugcccaggcucuagaauacaguggcaugaucucagcucccugcagccuuggccuccugagcucaggugauccuuccaccucagccuucugaguaacugggaccacagguguaugccaccaugccuggcuguuuaaaaaauuuuuuuguagagacaggguuucucuauguugcucaggcugggcucaagccacccucccaccucaaccuccaaguauuggguuaaagguaugagccauugugcccugccugauaugcuauuguaaaugaaacuguuguaaauaauuuaaaaucaaaauuauaaacuuuuggcugggcgugguggcucaugcuuguaaucccagcacauagggaggcugaggcggguggaucacuugaugucaggaguucaagaccagcccggucaacguggugaaaccccaucuuuaccaaaaaauacaaaaauuggcuaggcaugguggcguaugcuuguagucucagcuacuugggagccugacgugggagaauuacuugaacccaggagguggagguugcagugagccgaaauugcaccacugcccuccagccuggguaacagagugagacccugucucaaaaaaaaaaaaaaaaaaaauuauaaacuuuuaucuucaaaagcaaaagcauuguuuacuguuucagucagagagaaaugaugcguaauuaaaauccauuugggaugaacagagaauguuugcaaaaaaaaaaaaaaccucaaugaguauuucaaaaugaaaagaaaaauaaaaaagcaaaaauauuuuucccugugaaagaaaagaauaaaaccagaauaaguuauagaauuugagauaauacauuuucccccuugcuuucucaaaauaguauguaauucauaaucuuaugcuugaauacaaauuuaugcuuaguuuuucagaaauuaauuggagcaaaaucaaaauaaaugaaacaaaauauagauauuaaauaaagcaaagaucaaauaugcaggugaauuuuacagacuccauaaaucugaguguggacauuuauacagacugcagcuuaucugugauugugucaccauauuaaugcuggcuucuuauuucccugagugaacauacaccccuugcugugagcauucaggacagccuguugagagugcucacguccuccucacauacucacuuaggccgugugugaugauucuggggugggauuucauaacaaaaguguuagagccuacagcugucagugguuuuauguacaacuuuguugcguuaccuuagagacugacaagguuuaauaguuuaucucuagaaauuguauucuuagguagcugaauugucauauuuccuauuuaaauuuuaaucacuuaggagucuuuaggaccuuaaaauugggugugauguugacacuauuggguugacauaaugaauguuaaugaauuauaaaaauacuguauuuuauugauucuauaaucaagacacauccuguagucaguggcaucuuagguugaaugaacugcaguagucucucuuuuuuuuuuuaaaucaaaaggccaaauuaauugugaaaaauguuaacuuaaaauuucucagaacuuuuggcuucuuaauugccacuggaaaaagaaguaucaguaucaucgccagcugugcaaggcuugcauguuuguuuguuuguuuguuuuuuaaugggacagugucucucugucacucaggcuggaguucaguggcaggaucguagcucccuguaaccucaaaugugccaccacaccuggcuaacuuuaguuuuuguagagagggggucucguuauuaauauuuugguuaggcuagucucuccaacuacuggccuuaagcaguccuuccaccuugaccucccaaagugcugggauuauggcgugagccacugugcagggcugaggcuugcaucuucauaucuguuggacucuguaguccuucaugcucuugcuccuuggcucccucuuucuugaaucuccacucuucccaucuugauaaaccauuaccucugagucuagugguuucuuaacucacuuguacauuagaaucaucagggaagcuuuaaaaaaagaaacugaugcugacugggugauaaugauguaucaguguagguuuaucgauuguagcaaacauuauuguggcaugggaugucaauaugaguaagggagguugugcauauauggggacaggggcuauaugggaacucucuguacuuucugcucaauuuugcugagaaccuaaaauacucuaaaaaagaaggugguuuuuuuguuuguuuguuugucuuaauggucaaaugguccugggaucagaauacgugcuaagcauggcaaaaaagaugaucaacaucauuuagauagugcuauucuuaaaaaaaaauucuuucuccccuagagugauguuauuuuuaugcuagugaaauucauauaaacauacagcuagcauauaucaucuaauuuaagacacuaucaauuguaagccacacuacuaagauagaaaauugcuaauuaaacuaugccauacuguguguguauguguauguguaaacguacguauacacacuacugaugucuagguccagacuaagaccauugccuuuagucuaugaaacuugccaggcugggcaggguggcucacaucuguaaucccagcacuuugggaggccgaggaggguggacugcuugagcccaggaguucgagacuagcuugggcaacauggcaaaaccccaucucuaaucuccacaaaaaauacaaauauuagccaggcacggugguaugcacugguagucucagcuauuugggaagcugagguaggaggaucacuugagcccgggaggucgagauugcagugagcaaagauugugccagugcacucuagucuggaugacagagugagacccugucuaaaaaaaaaaaacaaaaagagagagagagaaacaugcugauaaccccuucuuuggcuacaggucccucucuaguauugccuaacauguuaccucccuuuuuccugcacaguucuccaaagagggauguguucucagucuucacuuucuuaccuuuuagucauguucagcucagguaauuaggcuuuuccuuugugaguuuccugacaugcugucgcugauaaucaccaguaaccaccugcuugccuuuccuuccuuacuagacauucuguugcacuggacgcuguuguccauuccuuuucuugaaacucuauuuccaaaucuuuccagauguugaacucucccaguguuuuucauaccucuuugaccaguaccaagaauguagaaccaagacuacauucuugguccauccuuuaugacaguuucccugccucucugugcccuccuucagagagcuuauacauuuucaaguuuucagcuacaauucugugcucaugauuuauaagccguuucuuugguuauucccgccagcaucagaaucuuauuuccaacugcccacgcagcacaucuacuuggcuaucccauaaacuugaccaagauggaauuauuaguaguauuucuuuucauagagaugaggucuuacuguguugccaggcuugucuccgacuccugggcucaagcaauccuucugccuuggccucccaacuguugggauuacaggcacaagcuguugugcccggcuggaauauauuuuucuuuaaaccuacauucucuuucuuggucggagguaccaucgcccaccuugucuugagagucauuuuucccuuuuuuucagccucuacauacacucauuuaauaagaccuacacauuuuauuuugaauauuucucagcauuuacauuccccucuaagccaccagcauccuagcucaggaccucaucuucacauagauucugcagagcccuccugccucugcuuuuggcccuuucaaauugguccuccacagucaccagagagacucaucuaagaugcagaccugaacugucaccucucuaccuuaucaccagcacuuaccuccuuuccucccacccacuguccuugucucaagucagcuggugccuuucugcucagaggaccucaguagugcuccugagcaugcuugcaguuccggcuuucuuccuacuccaugccccacugcugaccugcuucugccacggcaugcccuugcuggccuagaggcagacgucagaauucucagccuagcagugaagguuucccaaacuauugucuguggaauugccauguccuuguucauuaccaugcauucagccugaauccugcuucugacugaacaccuucuucccucuguguacuccaacugucacuggauggugccgugcaguuccaggcucuugguguccugaacaaagaauuggacgugacacacacaaguagcaaagcaagcagcaaaaguuuauuaagcacuguauuacacucuuggagagaggagaguggacugaucucugugaaaugagaucagcaucaguuugauguacuuuggguauuuguauguguuuuuuugucucuucucuucccaaggcugccuaaucuuuagccagacucugccauuuaauugauagguggacugcuuacuuuggcccuuaugugcuuguguguugccuccaucccauaauauacaguccauaugcaugagcuuuaaugagcugauuaucauauggggucauguuaaggauacuuuuucucucugaugcgcaugcccaucucugaggagccagcuauggggucucuuuacucacuuuuuaaucuuguuuuuguuuuggcugcucagcuucugucucuuguuucuuacucagcuacccauucaccuugcuucugcucucugcuuuuacucauucugcccuuuauccaacuuccaguucccucuguuuuccugcaucacagcuugguuugucuuacuuucuguuuuguuuugagaugugacgugucaccauagagaaagcccuuauguaguaagaccugauuccuuguucucuugagagaacuuuugugagauuuuagcuaaauuaaauaauuugauuuuaccuuucucaucuauaaaaugacaauaaugauaaaacaucauugcacaggaguuuuuuuuuuucuuuugaagguguaaguaagcaaagcaaaggggaaguagaaaaaaaugugaaguagaaauaaugauaaacauaauuucuuuauuaauuacauaauuauaauuuuugaaaaacccuuuuacugugucuuauuacuacuagcuguaggaacucagcuggaaaucaaugaaaaaaccuuguaaaugaauaaagaaagggauaaagccagacuggagcccugguuuauaaaccaggcuaccuguggaugaaaggagauaaaagaggaccauccgaugcagguuuugcgucgugaaggccacuugguuaggccugggcuuggauuguuuuggaauuaauuccaggcauuugcacuaagaauguaaucacaguaggaacucccuguaacagauguacagaguuuagugggagguaauuauauuagauuuuccacguggcuccugagguuucaggggauuaguuuggauggucuguuugggcuugacuacuuuuacacaauguauuuguuaguuugcuguacgguauucauggggauuaauggcugcauuaaguaagaguaacccuaaaacucucugagagcucguuauaaaaacauucagugaaaauucugucuccauggccauaaucuuuuaauugaauugaauuauguggccucuuauccugcacggagaagggucuugucacuuucauguuuacugggggcuccugucacaucuugccuuugcuggggcugugaaagggcagcaguuuugcuguguucaccuuaaauaacccuuaguguuaacaugauuauuuguucuugguggaaaauguuagaguguugacuuuugacgucuugauaaugaucuuggauauguucacaaauuucuguggguagaagaagggaaaaccaacauaaauaaguuuguauuucaggcugauuuuuucuuuuuccuuuuuuuuuuuuugagacagagucucacucugucgcccaggcuggagugcacuggcgugaucucagcucacugcaaccucugccucccugguucaagcuauccuccugccucagccucccaagcagcugggacuacaggcacaugccaccaugcucagcuaauuuuuugaaauuuuauuagagauggggguuucaccaucuuggccuggcuggucucgaacuccuggccucaggugaucugcucacuucagccucccaaagugcugggauuacaggccugaaccaccccguccagucugauuuuuuguuuuaaaugacaaaugaauauuaucucuauguuauaagacauaaggcaacugaagaaagccuucuuagugugaaauauuuaucuuagauauuuuuuagccaaaaugauuuuaguaaacauucuguuuauauugcuaacugaagaaggucaaaugacaauguugauaaaagugcaagccauuucaaagauuaaagcagcacuucacuucuaugcauauauuguguuuuagucccaucgauagcuuuuacaggaucaaccugucauucaauccauccauucuuuucuuuuuuuuucuuuucuuuuuuuugaaacagagucuugcucugucgcucaggcuggagugccguggcagcucacugcaaccucugucuccuggauucaagugauucucgugccucacccuccugaguagcugggauuacagacgugaaccaccauggccagcuaauuuuugcaguuucaguagagacaggguuuugccguguuggcuaggcuggucugaacuccugaccucaggugauccaccugccucggccucccacaguguuaggauuacaggcaugagccaccgcguccagccuauuauuuuuuuuuagaaauauucauuuaauuccaauuuuguugugcuuagauaccaucuacugaauccuuauauauauacaugguacaagguauguaaaccucugucuguuauaaauauuuucucucaggcugucacuugucuuuuaacuugugcuauucuaucauaacagaguuuuaauaguauauagucaaauuugucagucucuuaguaacuuuugaguuuuuuaucccagagagaucccaucaguacccaaauuauuaauguccuguaguuuuucuaacauuuuaauuguguauauuuucuaauguuuucugcuauagcuuuuuauuucaucuggaauuucuggcuugaauuagggaaagauuuaucuuuucuccacucauauaaaauguaaguauuuucauacauuaaauuccuuuauauuuguggaucuauuucuggacuuguuucaaauguuuuguuuauucuuaugccaguacugugugguuuuaaaggccauauauucuuuuaauuuuaaagaagcuuauauuuucuuucacauggugugaaacaaauuuuacaugaacagcaagguauaaaguaaaaaauugaaaucccuuuuucuugaacucauucacuauaguuucccuucccaaaguaaacuacuguuaaauuucuugacuuuuuuucccccagaaaacuguccauguacuagcacauacacaaagccacggguagaaguuuacaaugggauaguauacacauuauucuuugcuuugcuuuuuaaaaaaauaacaucuuuaagauauaauucugauaaccauacagcucauucaaucuauaauucauugguuuuuaguguauccagauacuuguacaacauuuaccacaauuuuagaacaucaacccaaaaggauacuccuuacccauuagcagucacuccucauuccucuccccacuuccuuacucccagcccuaggcaauuacugaucuacuuucugucuauaaauuugccuauuuuggauaugucauauaaauggguuuauacauauguggucuuuugugucuggcuucuuucacgucacaugauguuuucaggguucauccauggaguagcaucugucauuacuuaauuuccuuauugcugaauaauauucccuuguauacauguaccauauuuuauuuauucagucaucaguugauggacauuuggguuguuuuuacuuuuuaacuacuuugaauacuuguguauauuugugcauguuuuuuuguacagacauauuguuuucauuuaucuuagauauuuaccuaggagugcaauuaugggguaauacaguaauuucuauauuuaaccuuuugaggaaaugcuagacgguuuucugaagugacuguacuguguuacauaccuguuaggaguguaugaagauuguuguuucucuggaucgucaccaacacuuauuauugucuucuugauuauaaccauucuagugggugugaagcaugaggugguuuugauuugcaucucccugaugucuaaugauguuggccaucacugugugugcuaauugaccauguguaugucuucuuuggagaaaugauuuauucagauucuuugcacacuugaaaauuugguugucuuuucauuauugaauggcaagaguucuuuuuauuuucuagauacaaugccaucaucagauagaugauuuuacaguauuuccucacauucuguggguugucuuuucacuucguugacggugugcuugaagcauaaaagauuuuaauguugaugauguccaauuuaucuaucuuuuuuugugcuuuugguguccugucuaagaaaccauugcaugauccaauguagaguuauaucuguguuuuccucuaagaguuuuauaguuuaaacccuuacauuuaggucuuugauucuaaguguaugguuugagguagggguccaguuuuauucuuuugcauguggcuauccauuuuccccagcaccauuuaaugaaaagacuauuuuuccaugucagacugucuuggcaccuugucagaaaucaauuaaccuuaacugugaaugucuauuuccgaacucugaauucuauuccauugaccuauaugucuauucuuauaucuauaacacauuaucuugauuacuguaguguuguagugaaguuugaaauuagaaggcuugagucuggguugggugcgguggcucacaccuguaauccuggcacuuugggaggcugaggugggcggaucacgaggucaggagaucgagaccauccuggcuaacauggugaaaccccaucucuacuaaaaauacaaaaaauuagcuaggagugguggcacgcgccuguagucccagcuacucgggaggcugaggcaggagaaucgcuugaaccugggagguggagguugcagugagccaagauugcaccacuacacuccagccugggcaauagagcaagacucugucucaaaaaaaaaaaaaaaagaaagaaaaaaaaagaaagcaugaguccucuaaguuguucucucuuucaagauuguuuuggcuacucuggguccguugaauuucugugagaauuuuaggaucagcuugucaauuuuugucaagaagucagcugggauuuugauaggcauuacacugaaucuguaaauugauugagagguauugucaucuccacaauauuaagucuucagacccaugaauauggaugucuucccauuuuuuuagacuugccauuuauuuaaauguauuuaauuucuuucagccauauuuuguaguuuucaaaguauaaauucucuuauuaaauguauucuuuucaaugcuguuguaaauacaauuuugucuuaauuucaauuuuagguuauucauugaaauuguauagauacgugauaaguuuugugaauugaucuuauaagccugcaaaguugcugaacucauuuaugaguucuaauaguuuuuuaauggauuccuuauuauucuauacaugagauuauguuacugcaaauggaaauuguuuuacuuuuucauuuccaaaacggaugccuuuuaguccuuuuucuugccuaaguguccuggcuagaaccuccaguucaauguuaaauagaagugauaagaacaaauacccuuucuguuccuggucuuaggggaaaaacauucggucuuuguuaacuaagauguuagcugcgguuuuccauagacacccuuuaucaaacugaggaaguuccuuuacauuccuaguuuguugaguguuuugaucauaaagggugaugaaucuugucaaaugcuuuuucuaugucucuugcaucuauuuugaugaucauauguuuuaguccuuuaucuauugauaugauuacauugauugauuuuuggauguuaaaacaaacuuacauuccugggauaaauucuacuugcucauacuaaauaaacuuuuuuuuuuuuuuuaacauuccuagauaaugguuugcuaguauuaugcugaggacuuucgugucuguauuuauuagaaauacuagucugucguuuucuugugauaucuuuguccgauuuugguagcaggguaauacuggccucauagacugagcugcauagcauuuccuccucuucuauuuuaugcugaaaguauuugugaauaauugguauucauucuucuuuaaauauuugguagaauucaccagugaagccaucugggaguaggccuuugcaugugggugguuuuugaauaucuuugcuuguuagaggucuuuucagauuuucuguuuauucuugagucaauuucaggauuuugugucuuucuaggaauuugucauuucaucuaagcuaaccaaucuguuggcacacaguuggucauaguauuacuuuauaauccuuuuuauucuguaugguuggcaauaaugauugcuguuuuaauucaggauuuuaguucuaccuugcuuuuuaaugcuuuauauuuuagagaucuuuuuguaaaaauugaauucaucuuuuagugaccacauaguguuccauaacuaaccuauuuauggucauuaauguuaugaauaaugccacaguuaauaucuuuugauauauuguaggguacuuuuggugauaguguguuucugaggguaaauucuuagcaguugauuuguuaggucaaagggauauaauguucaauauuaguagauauugacaaauuauccuuuauagaguuugcacuauuuacauuuauuuuucuauacuaugauauccuuuacuucuuugucuuuuauuggguuauuuauuuuaacaaguuuuuguuauauuaagaagaaauuagccuuugucauaugucuuccaaauauuuuuuccuuguuuauaguuucuuuugaccuuguugaacauuuuuugccauacggaaguuuuaaaguuuuguguggucagauuuauccuccauuuccguucuggcuucuggacugguaucacugccauguaucacacgguauuacugccauauaaauaggcucuguuaggcuucaagaaacaagugauggauuuuauugaauucauagagaauaagaaaaguaggacuagccacacaguuaaguuuauguuuuggggauacagcagucuuccaggaguuagucuguaaggucugcccucugcagggagcuugauugaaaaucuaguaguuggcuguucagagaugacauuccauuccucucuugccucccuuccuucucucuaggugacauucuacuguuaugguucugcugccuuuuccgccgcuuguaugacucuugaucuuucuuguuuauugaagccuuauagcuucugcucucuugcucugcuuuucgucaucucucuguaggucauuguggcuucugugcccauugguaaguacugacucuugguaucuccauuuuagacuccuguucagaggagagaucagauugguuugucaggucacuguuuuuuauucauuguagaccacuguagacgggcggagacuuucugccaagccugucuucagucugcagauuggcugcucuuugcacucuccagucggccugggcuucaaaagugggccuaagugguugaauguagggcagcccucuguguuuaaaaaagucaaaaagcuuaaaaaggugcauguggcagaaauuuucaaaaaacaaaaggagcauuauaagcaacaggccccuuccauugucugacuuguaaaaugugcaacgcaauaggcagcuauucuuuguguacagauguaccucaaaucccagaccaucagggcccucaguuagcuagcgucaguggagggguacgacucagacacaauuaaccacaacauauggaagcauggaagauggcacuuggcagaaacuaagccuuaggaguggagccugucacgccacugaauucagggauguguuugaaacagacaccguuucagagaccuuggagaguaguuucucauucacaauaggcaucacguugauagauaaagauauugugguauaggcaaggcagccagaaagggcuacaucaacagaggcacaggggcaggaaagcaggaaguaaggaaaugucaacucuuggacuucugagucugacuuaggaaaaauuaaggauggaaaggucaguuagggccuaauuuuggaguguccagauucccugagagcgugcuuggauuuuauuugauuaguaguggggagcuauugaaaguuuugagcuggacaaugacauuaauuaacuaauuaaugcaacaaauauuuaugugugucaggcacuguucuaggcauuuugggguauaacaaugagcaaaauaaaccagaaaaaaaauuccugcuucuaaaacuuauguuuuaguugaggaggcagucaauauuacuauguguaauaaguauaucauauaguaugcuagguaauauauucuguugaaaaaauuuaaaaaguaggguaguggggaauggguguauagguggagguuuagggagaaaggcagaguugugauuuuauuuuauuuuuugagauggagucucacucugucgcccaggcuggagugcaguggcacgaucuucacucacugcagucuccacuuccuggguucaagcaauucccccaccucagccugcugagcagcuacagguauauacugccacacccagcuaauuuuuguauuuuugguagagacgggguuuuaccauguuggccaggcuggucuugaacuccuggccucaagugaucugccugcuucaacuucccaaagugcugggaucacaggugugagccaccaugcccggccugugauuuuauauaugccucuuauuuuuacuugacacauaauuguauauauuuauuagauacagaaugauacuuugauaucgggauacaauguguaaugaucaaaucaggguaauuagcauauucuucaccacaaacauuuaucauuucuuuguguugugaacauuuaacauccucucuuuuagccuuuugaggauauagaauaaguuauaguuucuacucucuacuuccaugaggccacauuuuuuuuagcucccacauaugaaugagagcaggugcuuucugugucugacuuguuuugcuuaucauaauguccuccaggcucauccauauugcugugaaugacaggauuucauucuuuuuuauggcagcauaguauuccauuguguguauaugccacauuuucuucaucucuucaucuuuugauggauguuuagguuuauuucauaucuuaguuauugugaauagugcugcaguaaacauggggauucagguaucauuuugaaauacugauuuccauuccuuuggauaaauaguaguaggguugguagaucauauggucauucuauuuuuaguuuuuugagaauccuccacacuguuuuccauaguuacuguacuaauuuacagucucacaaacaguguauaugaauucccuuuucucugcaucauugccagcacuuguuuuuuuuuuuuuucuuuuugacaauagccauucuaacuggggugagaugauauuucauuucauagaugugauuuuaaauagguggucaagguaggguuuagugaaaaggugccagaagauagaaccugcugcagguugagcaucccuaaucugaaaauuugacaucugaaaugcuccaaaauuuaaaagguuuugagagcugacaccacaaauggagacuuccacaccugaccuugugacagguugccgucaaaacuugguuucaugcacaaaauuauuaaauauaguguauaaguuuaccuucaggcuauauguauaagguguauaugaaauauaaaugaauuuuauguuuagacuugguucccauccccaauauaucucauuagguauaugcagauauuucaaaccugaaaaaaucggaaaucugaaauacuucugacccuaagcauuucagauaagggauauucaaccuguaguucauuagggagaauauuauagaaagccaggucgaauauuguugaauggguugggggguugcugaugaagagucuggaggcaagaaaaccacugaagauuugugugaacugauaagucgcuucaguguuggaagugaaauuuuuuuccacuugguuuauauuuuucuaccuuagcaaagaaguccagcaguuaacuagcccaauaaacucuacauuguuuuuuuagacuugcgagauacgauuucuaaacuauugguauucuuuacuaccaagagucuaguguuucuuuauuuauggacuacucauaccagaaucacuuggggguacuaguuaaacauagagaugccugggaccugccccaaaucuuggaggaagagcaagauaguggccaagaacacaggcucaagguaaucagucuggguucaaauccuggaucugcccuuacuugacuggguggucucgagcaagauacuuacuuaccuuuucugugccucaguuucgccaucuguaaaaugggaauaaugauaauaucuacuucauagaauuauugugaggauuaaguagauuaauuuaugugaagugcuagagcacugcuuaucaccugguacacacuuaguguuagcuacaauuguuuguauucaaucauaaucucugaaggugaggcaaguaaucuucaaauucaacagucacccuggguauuuuauuuguccuugugcugugggaaaaacuguuauuacuucuggagccauggugaauucugugagugguccacacaucagguauggugacuuaguuagaauaugagccaauuaauguuuugauuucacacauacaaugguuuauuuagcaacaaaugccacuguuuacuguacauauugcauguuaagcauauucuguugccauucacaacaacccuaugauguaaguaaauaucacucagauuuuacaggugagaaaacugaggcuuacacugaugaaaacuuucccuaagugacacagccugugagcugugcaguugucauugauccuuggcucugccugacccaagaguacuuguuccuucuacaucuucuaguuauucaaccuuuuuaucuugcaaacauauauauuuuauagucagaugcauuuguacaaauucuuuacaacuauuggauaaaaaccucacugggcaugauuuauuaaugguaagcuaguugcaucauucuauaugaucaagaucuuaaaaaauuuugucuuuguaaguguagagauauaggaaaaaccaaaguucuuuucccauucuaacauagucacucaguaccacacagaaugcuucuguuaccaguacauggggguuuuucccuacacacuaaccaaacaguucugcagcagacaucagcucuggugucuccucuaauucaauuuaauuuugacucuaucuagagguagugucagaucccacugcuugagagcucagucccauaagacugucccccacuucagaugccaaucaaagucagggccuccagaauauggaauuucugacugaccagugguuaaagaaaaacuuaagcacuuuuaaaccauuuauuuuuauuuuuuauuuuuauuuuuagagacaggcucuugcucuguagcccaggcuggaguacagugaugauaucguagcucacugcagccucgaacuuuugagcucaagugauacuaccaccucagccucccaaguaguugagguuacaugugcacaucacgaugcccugcuaauuuuuauguuuuuauuuuucuuagagacaaggucucacuauguugcccaggcuaaucuugaacuccuggccucaagugauccuuccaccucacccucccaaaguguuggaauuacaggcgugaguccccacacccagccgaaacagcuugagcauucagcaguugauggauaggguagcagcagaccacaagggagugucacuccuccaggaggggcaagaggggaagcuuuuauaaaguauuugcagaagcaagacaaauaaaccaauuuugauugauuagaguggaaaguuccuaguuagagauuaguugguaguuucugauuggugcaguuucugguuuuaauuuacuguuuacauugggcuuugguuuguucgauuagggauuuaaagugacaagagcuacccuacccuagucuaauggacucucaauuggaaugguuuuuuuuaaguuuccuccuuuuuuuuuuucauuuauuuauuuauuuauuauuauuauacuuuaaguuuuaggguacaugugcacaaugugcagguuaguuacauauaaguuuccuccuuuuggucagccucucauuuauaaacuuggacguaagugccacucucugucaccaucauggcuagguugucuuugucuuaguguggaacucauaaaucaugacaacaggcucaaugaaaaacaauuccuuuuguugucaaucucauuuuuuuucuaaucacagugagacaaucugguaugcuguugauguuuuugaauauacauuuaagacccuugagagaauauagugcaccaggaagauuauaaugaugacuaccaggaggauaauacugagagacuuagcuucuuaguuaaaguccccacgaaccaaacuaacuaauauuucuauggaagcaaaagaaaaacaaagcuuaaugauaagaacaaaucauaaauucggucucugaguccagagggugauuagucaggaagauuucuagauuugagcucuaagcauauuuuccugguuugcaguuugaaugccccuaguuauggcagugggcauuuuggugaacucccugagugguccacacaucaggcaugaggguuguccucugaacuuguaucagguauacaucuccaucuugcaggguuucaggagcagagcaguucuuguucagagugauuccaagucagaaaagugggagaaaauuggauggaggaaccuagaagaacugaggauucagugcaaacuacagguagauaauaaaacuugaaaacaguuaauagggcugcagucuaauaacagguguacuauuguuucuuucugaaacauaauuuucucucuguagucauccuuguuucuaccaaagauaaaugggccaggcgcgguggcucacaccugucaucccagcacuuugggaggccaaggcggguggaucaccugaggucaggaguucgagaccagccuggccaacauggugaaacccugucucuacuaaaaauacaaaaauuagccaggcaugguggcaggugccuguaaucccagcuacucaggagguugaggcaggagaaucgcuugaaccugggaggcggagguugcagugagccgagauugcaccauugcacuccagcuugggggacaagcuugagacuucgucuccaaaaauaauaauaauaaucaguguaagacuaauuugauugcauaauaaauuuugucucaucagacuuggccugauuauguaagugcaguaagaauagugauugaccgcacaaguucuuuuuaaaguuuguuuugcuggaaccuuugauagggaaucagauugaacuuuuaaaaaaaccucuuaaaucuaggaagccaaaccaaggcaaauuuuagacuucaccugcaguaccuauauauuugggugaauucuucucuucucguaaggucccccaaauaucuugagguuccugggucugcugggaacugauagcuuuuacucacucacugugagacugggaacacuuuuagccaggcauucuaugcacacugucaaauaugacccuugguaauauaaccaauguuuccaauugugucuuguuauaaagagaacagauucuuuuugaacuuaugcaaauaguuauauugccauaaaaaaaaucuucacaaguagcuuuccaaguucccgaggaucagguagagaggaaaaguaaauacuucaaucuuuauucacaaaaguauacuuuuccaaauugcugcaagcaguagauagcuuaaaagguaaaauguuucuuaaaacuuuaaagaaccagcaaaacuuccacauauaaagucauaaaaacauuauuuucaucaguuauucagucuuauguaauucuuguucugcaugaucucgggauagcaguuucacaaacucaccaguuucuuuauuagcguucugagaauucuuacccacuuucauggcauuaucuuaauuuaaaguuauaagaaaccuguauauccagaguacuugucagaguucuuuccgugaauaucuuugaagaagaagcaauuuuggacuauagcugauugcaaaugcuuuuagagaaaaaucaaaacaauaacugccuauggaugacaagacuuaagauggccauaguuaaauucuaaugagguuucauuauaauaaugcaacugacaaaaaaaucugguuauuuucugugacauacaacauuuuaacauaauaaucaagauuaugacuguagacauuuuauaaaacauaauuucaaaaaguuuuaaacuuuuauuccauuuauauuuaagucacuccuucuuaaacaaauauacuugaauugcucaugaaaaaugucaugagauauugaacagaguuagccauugaaagaguucaggaaaugccacuccaaaauuuacugcuuuggaauauugauugcuuugagccgaaagcauuugaaaaauaacaaaugcagggaggggcuuuuugggacuccuuugucugccuaaagacagguccuccaaagaaauucagcuaucauccaugccuucucccacgccaucaucuuaauguuauuuaauuuuucuugacaaaucaggcagguaucacaguuuuuuacuuccaugacugacgugcaucaagaucaagcaauucauuuuuacugcacauuuuccucuuagguuggauuuaugguuuuaugaucuuaaacaucuagcagagccaacaccaaucugucuaaccagcaacccaggaaaaacuugagaauucugagaaacucccauuuuauuuuaccgacaauuuaaaaacuagcuuuauuuaccacagacuuauguaaaucaugugaacuuauuaaaaaaaaaacacacauuugggucaguuucugcauuucugagaguuuuagaaauaauuuacaugcaugcucauuuauccccaaaccaauuugaauagaucuccauuaaaggauuuuauaaauugguuuaguaauaccaucugaaaauaucacauauguguguguauauauauagacacacacacacacaaacauucauacaaagacagacagaaggagauaacgucugguuugagucacuuauuaaaaguaguccaaagguccuucuugguuguugguugcuccgcaguugcuauaauuacaaggccauuaauuuggaaaccuuuuguuucucaucuugcucugagguccucagcuaacuuacuuaacccuguagcuuccuuauccuuuuccucucucucuuucuuguuugguaauguuguggggagacuccauuuacaaaaaggacagcuaggauuagcugaauugauguaaugcuuggaaugcuguaggaaaaacaaaagguccaagugggcuuugaaauuaguaacagauucauuuuucuuuugucugcaggucugguuuagugcaggugggaaacacuuuaggaauggcuuucaaaagcuuauuuauggccgggcaugguggcucacgccuguaaucccagcacuuugggaggcugaggugggcggaucacgaggucaggagaucuagacaauucuagguaacauggugaaaccccguaucuacuaaaaauacaaaaaauuagcugggugugguggcaggcgccuguagucccagcuacucgggaggcugaggcaggagaauggugugaacccgggaggcagaucuugcagugagcugagaucacgccacugcccuccagccugggcaacagagcgaaacuccgucucaaaaaaaaaaaagguuauuuauguuuuuuugggguuuuuuuuugcuuuuugugguuuauauaugaaccaaauugggucucauggccacagauaucaucuucagagugauacccuucugccuuuugcguccauuuuggcuuuccucauguccuauccacaugaguuuacuggguacaaaaaaaaaaaaauagaacgaguaagaccuacuauuugaggcuggacacaguggcucaugucuguaaucccagcacuuugggaggccgaagcgggugggucaugaggucaggagaucaagaccauccuggcuaacacggugaaacccccucucuacuaaaacuacaaaaaauuagccgggugugguggcgugcaccuguagucucagcuacucuggaggcugaggcaggagaauggcgugaacccgggaggcggagccugcagugagccaagaucgcaccacugcacuccagccuggugacagagcaagacucugucucaaaauaacaacaacaaccacaacaacaacaacaauaaaccuacuguuugauagcacaacagggugacuacagucaacgauaacuuaauuguacauuuaaaaauaacuaagaauauaauuggauuguccuuuguguuauacaaaggauaaaugcuugaggggauggacaccccauucuucaugaugugauuauuaugcauugcaugccuguaucaaaacaucucauguaccccauaaauauauauaccuacuuuguacccaaaaaagcuagaaaaaucuaaaaacccacaaaaaaauaggaaaaaaauccauguuuaccuagguugccaaguucagagcaaaacccauucaugaauagggcagacaaagcauuuucucugccagacagggauaccuuuuauuauugcucugagauuaagauuuugaucaagacauaaggguacauggcgaaaccccaccucuacuaaaaauacaaaaguuagcugggcgugguggugagcaccuauaaucccagcuacuugggaggcugaagcuggggaauugcuuaaauccgggaggcagagguugcauugagccaagauugcaccgcugcacuccagccugggugacggagccagacuccaucucaaaaaaaaaaaaaaaaaaaagcagaccugggauggguguaauccuagcauuuugggagguugagacgggaggauugcuuaaguccagaagguuuguagcaggacgagccgcagacaaaaccccucagacacugaguuaaagaaggaagggcuuuauucggcugagagcaucagcaagacucauggcucaaaaaccgagcuccccaagugagcaauuccugucccucuuaagggcuuacaacucuaaggggguccacaugagagggucgugaucgauugagcaagcaggggguacaugacugggggcugcauguaccgguaauuagaaaggaacagaacagaacaggacagggauuuucacagugcuuuuccauacaaugucuguaaucuauagauaacauaaccgauuaggucagggguggaucuuuaacuaccaggcccaggguguggugcugggcugucugccuguggauuucauuucugccuuuuaguuuuuacuucuuucuuuggaggcagaaauugggcauaagacaauaugagggguggucucuucccuuagguugagucuacagugagcuguguucaugccucugcacuccagucuaggugacagagggagacccuaucacaaaaagaaaugaauuaaguaaaaaauuuucuuuuaaaaaauuuuucuuauuuuuuauuuuuuugagacaguaucuuacucuguugcccaggcuggagugcaguggcacaucucagcucacugcagccucagccucccagguucaagugauucuccuaccucagccacccaaguagcugggauuacaggugugcgcccucaugucuggcuaauuuuuguauuuuuaguggagaugggguuucgccacguugcccaggcuggucuugagcuccugagcugaagugauaugccucccuuggccuuccaaaaugcugggauuacaggugugagucagcacgcccagccuaaaaauguucuauuaaaaagaagcagaccugguuaaucugagaaccuaacuauaaauacucauuuaguucuuuuuccuucagggcaugcagauaaacaagcaaaaaaaaaaaaaaucagcagacucagaguagacgagagguuagaaaccucuacaugccaguaaaaaauacuucucauuucuguuuuuuuuguuguuguuuuuuuuuuuuuaaauagagauggggucuugcucuguucccccggcugaucucaaacuccucagccucccagagugcugaaauuacaggugugagccaccgugcuuggcccuucccacuuucugagauguucaagaucguguguguacguguguauguaggugaacaauuuuguuuagguaaaaacuuccacuuuguagccacuaaaauucuaaauugcuuuugguaagauuugcccauucuuuuagaagagcuuagguucugagaugcuauuaugagaagcacuugagacuauaacauccuucuccccacacccccaaacugggaaggagcugggagaccaaagaauaacuuggauaaaucuagcuugacggcuagaugagcuuguuaggacuuaacuucaggacacuccuggaugguggcuggacagcucuagagauccacaccaccucccauuucuaagcugcuuuuaaguuaauuuucuggcccuuugucaauuuugugugguuuuccuugauauguccccagcuaugccccaggauguuuagguucucagggacacgugguccuuggcugggcgcaguggccuugguucacugccuagcuuuugggguucaagcaauacacauacacucuuaaguaaccugguaggggaccagucacacuauagauggagucccagacucuggauuuaaauaaacucauuauuuccagucuucguggaaccuuuccuaguggaggucuuuugcuuaacccaguuugguuuuugucuaaccuaguuggacaccugaagccucccugcaaaacccagucuuguuucugcugugacuuccaaaccuagucuggagcagaaauguuaaaaugaacuuggagaacuugacgcuaguguuagaaugcacguaucuaagucuacuuacuggugaugaccuccaaaugugcagggaguaagcacaaggggcucugugggguaacuguaucuguuugcuuguugcucccagaggucauuaucauguaguguccauuggaucccacuucugauaucagaucugauaaaagaaaaucuuaagcacauuuacauuuucagcaguuuaguugagcauucagcaguuugugaaugggguagcaucagaccacaaggggcuagcacucugcccacaggggcaagaggggaaacuuuuauaaaguauuugcagaagcaacacaaaugaaaccaauuuugauugguuagaguggaaaguuucuaguuagagguuaguuggugauuucugauuggugcaguuucuaguuucaguuuacuguuuacauugggcuuugguuuguucacacacgaauuuaaagugacagagcuagucagucagacucaaucagaauuuuuuuuuaacauugccuguaaauugggguuuccaugacucaccuccuuggguuugaucaguuugcuggagagugguucacagaacucagggaaacacuuuucugauauuuacccauuuauuaaaaaggauaugccagaggauaaauaugcacaguuugauggaagaggugcauagggcgaggugugggagaaggggcauggagcuuccaugucuccuuugagcaugccguucuccaggaacguccauggguucagccaucuggaagcucccagaacuguuuuguuguuguuguuguuuguuuguggaaacuuuauuacauaggcaugguugauuaaaucauuggcuguugguuaaucgauucaacuguaagccccucuccccucccaacaaguugggagugggacugaaauuuccggcccucuaaucacaugguugguuccccuggccaccagaccccaucuugaggcuaucuaggaacccccagcuacuaauuaucucauuaauacgcaaagacacucugaucacucuggagauuccaaagauuuuaggagcucuaugucaggaaacggggacagaccaaauauauauuuugcaauaucacaacacgauguucuaaaaggccuuuucuauuugcgagguauuuuucugcuacccucuguagccagccuccagcaugguuugugaugaucuggucuucacacucguguaguugccucccacauguuaccagguuuagucugugugaccaguagaauauagcagaaaugauaugucacuucuaagauaaaggacaguggcuuccaucuaggggucucuuucucugucaaccacuuucucuggaaaaccagcugacauguagugaucagguccauaaagaggucaacaucgagaggagaaaaaggcuccucaguagcuacgugaaugagcuugaaagugagugagcuuggaagcaagccuuuggagauuacaacccugccugagggcuugccugcaaccccaggggaaauccggagccagaaccacucagcuaagcugcucccucaugccugaccuucagaaucugugagaugguaaauguucaauguuuuaagcugcugaguuuuggaguaauuuguuuuagauaacuaggacaugcugcaauuccuauugugagucgaguuguacuccuucauucccaaugcccuggagccccucagugugugcacacaggcuuaguugcaugcacucucuuucucugucugccuuccuccucuguuucucuuucucuuugccucucucucacacacacaauuucacuuggcugcugacacgguuuggguguuuguucccuccaaaucucauguuggaaugugauacuccccgguguuggaaguguggccucaugggagguguuugggucaugggggggauccuucaugaaugacuuugugcccuccccuugguaaugaucaaguucucacccgguugguucacacgagagcuggcuguuucaaagaaccuggucccucucuuguuccuucucucaccaugugaugcgccugccuucccuucaccuuccacuaugaguggaagcuuccugcgacccucacagaagcagaugcuggugccaugcuucuguacagccugcagaaccaugagccaaauauaaaccuauuuucuuuauaaauuacccacucucaguuauugcuuuuuaauaaugcaaacagauuaacacaguugcuuaauucuuuuuuuuuuuuuuuuuuuuuuuuuuuuugagcugggagucucacucugucgcccaggcuggauuguaguguugccguuucagcucacugcaaccuccaccucccggguuccagugauucuccugccucagccucccggguagcugggauuauaggcaugugccaccacaucuggcuaauuuuuguauuuuuaguagagacgggguuucaccauguuggucaggcuggucucgaacuccuaaccucaggcgaucugcccgccucagccucccaaagugcugggauuacaggcgugagccaccgcgcccggccuuaauucuuuauuauguuuaucuguuaucuacauuauuucucuucccauacaucuuuucuucucuuuuaaauauguuguugucugggucccugcugcuaauacguucaauaguaaauaucucacuguaacacuugguauggcaacacucugagcucaggaaugauguaacgguuaaauguauguguggacuugacugugccauggggugcccagacauuuggucaaauauuuugggugugucugaggcuguuuuuggaugaaaucaacauuugaauugguagacugaguaaagcagauugacuucuccgaauguggaugggccucauccuaucauugaaggccugauuggaacaaaauggcugggaaagagggaaccucucucugacugucuuccagcugggacauuggucuucuccugccuuuggacccaggcuugaacuagaaucuaaugccacaguuucuucugggucuccagcuuacuaacugcaggucuugggaccucuuacuuagccuccauaauugugagauaugagaacccugacuguacaaaugaccuaauaaacuuuggcuagcuaggugacuggaaagagcugacuuaguaaguaauuucugagaugccaccugcugaaaaguccuuuauccagcagccaguaugaaccugguuucagguaggguuuuucagugaggcagauucuaguuucuguuccgaaaacaauugguuuuuagagagaaaugcugaaggugcuguugccuuuuugcuucucuuugucugcuuguucauaagcagcagaguacaaucuguaaaggggaguaugaauaguguuucuguuuuuguuuaagaguaagaaauugccagagaaaauaauuagggcuuggaucagcuuauuuaaagcaaucaucuucacacuaagauauuacuuugguuuauuucagagcuuguuucugugugucacuuugcccccuucugcaauuugugcccuuugauuuucaguucuuaaaauuuggaggcgagauuuccccagaggauuaucuuucuaaaucaaauccucuuuaucaagaaucuaaauuuaaaauugcguguuuugauaaacaugcagguuaaauguuuagaacacuacuuagagaagaugcuggggcccaugccugccuucuuagaaauccacagaaaggaacuagggcugccaguauuuguuguaucauugggccauaauagguuugucaucuugauaggcuguuuucaccaaauauuugccaagaaaagagacuuuaagaauuaaauguaggccuuaaacuuguucuacuucugcauucaauagauaucuguuucuguuucauuuuaaaaagauguuagaccagcugggcgcgcuggcuuacgccuguaaucccagcacuuugggaggcugagguggguggaucacuugaggucagguguucaagaccagccuggccaacaugguaaaaccccgucucuacuaaaaauacaaaaauuagcugggcguggugucacgcuccuguagucccagcuacucaggaggcugaggcaggagaaucacuugaaccugggaggcggagguugcagugagccgagaucacaccacugcacuucagccugggugacagagcgagacuucaucucaaaaaaaaaaaaaaaaaaagauguuagaccaccauccaguuuugugaaccucccucaccugugguggaagguucuuugcagaugguaauacccucccaucauuugcagcaucucuagcuuggccagauauucaaaacauuguguuuuuuguuuguuuguuuguuuuuucauaaaugccaagaauuuagcuacaguuggucaggcgauugucuacuuugcauuaauaauggcauuugauauuauaauagggccguuauuuccuuuauuaugagcuuagccuuuccauuggaacugcuggaauaccuugggagauauuguggguuugauuccagacagccauaauuaaagcaaauauagcaauaaagcgacucacacacauuuuuugguuucccaguguauguaagaguuauguuuacacuauacuguagucuuuuaaaugcacaauaggcauuaugucuaaaaaauuguguauauacccucgcccccaaaacaaaacaaaacaaaacaaaauugugcacuuaccucaguuuaaaaauacuuuauugccaagaaaugcuaacggucagugagucuucagugaguccuaauguuuuuuguugcuggagggucuugccucaaugagaauggcugcugacugaucagggagguagcugcugaagguugagcuggccguggcaauugaugggcucuuccuuucacaaaaaaauuucucuguagcauacaaugcuguuugauagcauuuuacccacaguagaacuucuuucaaaacuggagucaaaacucucaaacccugcugcugcuuuaucaacuaaguuuauguaauauucuaaauucuuuguuguuauuucaacaguguuuacggcaucuucaccaggaguagauuucaucuuugcucaucuauaagaagcaacuccuuaucccuucaaguguuaucaugagauugcagcuauucaaucacauauccaggcuccacuuguaauucuguaauaguucccuugcuauuucugccacaucugcaguuauuuccuccacugaagucuuaagccucucagaguaauccaugaaggcuggaaucacccucuuccaaacuccuguuaugcuauguuuuaaccuccucccaugaaacaugaacuuucuuaauggcaucuagaauggugaauccuuuccagaagguuuuuaauguacuuugcccagacccacccgagcaaucucuggcagauuggccacaguagccuuacaaaauggauuucuuaaauaauaagacuugaaaauaggaauuacucauugauccaugguaugcagaauguauguuguauuagcaggcaugaaaacaacauucaucuccuuguacaucuccaucggagcucuugaugacuaggugcauuguaaaugagcaguaauauuuggaaaagaaaucuuuaucugagcaguagcucucaacagugggcugaaaauauucaguaaaccauauuauaaacagaugggcugucauccaggcguuguuauuccauuucuagagcacaggcagaguagauuuauuuagcaucauucuuaagggcuuuagaacuuuugaaaugauaaugagcauuggauucaacuuaaggucacuggcuacauuagcuccuaagaagagagucagccuguccauugaagcauugaagccaggcauugacuucuccucucuaacuuugcaaguucuagagggcauuuucuuccaauaaaaggcuguuucauuuacauagacaaucuguuguuuaguguagcuaccguuuuaguuuguucuugcauugcuguaaagagcuaccugagacuggguaauuuauaaagaaaagguuuaauuggcucacaguuucacagaccguacaggaaguauggcuggggaggccucaggaaacuuagaaucaugguggaaggcaaaggggaagcagggacgucuuagauggguggaacaggaggaagagagcaaaguggggagguguuacacacuuuuaaacaaucagaucucuugagaacucacuauugugagaacagcaagggagaaaucugccccuaugaucuaaucaccucccagcaggccccuccuccaacacuggggauuacaauuugacaugagauuuggaugggaacacagaucuaaaccauaucagcuaccuucauaaauuaucuuagcuagaucuuuuggauaguuugcugcagcuucccuaucagcacuugcugcuucaccuuauacauuuauguuauggagauggcuucuuuccuuaauccucaugaaccaaccucugcuagcuucagacuucuucugcagcuuccucaccuuucuuagccuucauagaauugaagagagguaggaccuugcccuggauuaggcuuuggcuugagggaguguugagcugguuugaacuucuauccagagcauucaaacuuuguccauaucagcaauaaggcuguuuuugcccucuuaucauucauguguucacuggaguagcacuuguaauuucgaagcuucaagaacuuuuucuuugcauucaaaaccuggcaggugcaggcggucugguuuuuggccuacagagacuauugacaugccuuucucgcuaagcuuaaucauuucuagcuuuugauuuaaagugaaagaugugcuacucuuccugucauuugaacaccuagaggccaucguagggacauuaauuggccuaauuuccauauuguugugucucaucaaauagggaggccugaggagagggagagagaugagagaauggccaguuuguggaacagucagagcacaaacauuuaucgauugaguuugccauccuguaugggugucguuuguggcaucccaaaacaauuacaauaguaacaucaaaggucacugaucacagaugaccauaacagauauaauaauaaugaaaaaguuugaaauaaugagagaauuagcaaaaugugaugcagagacacaaagugagcaugugcugcuggaauaauggcacuaauagauagacuuucuggacacaguguugccauaaaccuucaguuuguaaaaaacauacugugaagugcaaugaaguggagugcaguaaaacaggaguaugccuguacauguaaacaugcuuucuuuggugcuacuucagauacuuaggaagccuugaccauaguccaagcagaugaguuuuggugcuugaguauuuuaccccaggcagacuaggagaaguuuguguguguguguguguguguguguguuuguguguguguguuugauagucuuuauuuauuuugagacaaguucuugcucuugucacucaggcuggaguacauuggcacaaucauggcucacugcagccuugaccaccugggcuuaaacaauccucccacuucaaccucuucagcaggugggacugcaggugcacaccaccaugcccaacuaauuuuuguauuuuucauagagacggguuuuugucauguuacccaggcuggccucaaauuccugagcucaagcaauaugccugcuuuggccucccaaaguguugggcuuggaggcgugagccacugugccuggccgauaguauguauguauguauguauguagagauggagucucacucuguugccaggcuggagugcagugucgcgaucucagcucacugaaaccuccgccuccuggguucaagcgauucuccugccucagccuccugaguagcugggaccacgggcgcaugccgcuacacucagcuaauuuuuguauuuuuaguggagacagacggaguuucaccauguuggccaggauggucucgaucuuuugaccucaugauccucccaccuuggccucccaagugcuuggauuacaggcaugagccaccgcacccggccuagucuuuguauuuuagggcaguuuuggguuuacagaaaauugaacaaguagugcagaguuccuucacgccccuaguuucccuuauuauuaacaccuuaaauucauaugguacauuuguuacauuugguuaaugcugagacauuauuauuaacuaaagucuguaguuuuuauuaguguuguccaguucaauggauuuugacagaugcauaauauguagccaccauugcaguaucauacagaauacuuucacugcccuaaaaaucaccagcaccccaaccuagucauuccugcuugccucccccucagcccuugguaaccauugaucuuuuuacugucuccauaauuuugucuuuuccagaaugucacauaguugagaucuuacaguauuuuggcuuuucagauuggcuuuugucaauaauaugcauuuaaaguuucuuuguguuuuuucacagcuugcuaguucauuucuuuuuagugcugaauaauauuccacugucuggauguaccacaguuuauuauccauucaccuacugaaugacaucuuggugguuucuuguuuuuggugaucaugaauaaagccacuaugaccauucacuacaggguuuuguguggucauaaguuuucagcucauuuggguaaauaccugggagugcaauugaaggaucugugauauauucuuggucccagcaucucuccuccugcugacaauuacccuccuuauugugacaaccuaaccaggccugccucucccagggcuuccucuucuucacuuagagcauuuucugaacaagucuggacacaaaggucuugcuuauauuuucaggaaagaguauuuaaaauacuucuuaaucaugguuccaacuuauuucaacucuuauaauuaagugaucauuuuuuuuuuaaauuaugguagaauauguguauauaagauauaauuugugauuuuaaccauuuuuaaguauacaguucaguuguauucaucauauucacaucauuguguaaccaucaccacuaucuguuuccaaaacucuuaccuggggauaugaucauuuuaaaagaggaauuugaagaaauacaucugaagcuauauuuggcaauauguuuccaucaguaacucccaaaaucucaguggcuauuggcaacaaucuuuaugucucccucauguuauauauacauacauauauauauauauauauauauauauauauauauauauauauauauauauauauaaaauuuucuuuugucuagaacuuagucacauggccacaucuaacugcaaaggagccugggagguguagucuagcuaccugcguaagaauaagaacaaauuggcuuggcgauuuguuagcauuccuggccauauuaaguaagauuauuaaaucauacacauuguuaacuugaucuuucagagaugacaugacaguaauuguaugguuucauagaucuggcuguguuucaggagagcauuuuuccaucccaugcucucuuuccaucuaaacguuaauuaucuuauccuuuuaacacugagagagcuuccuggaauaaauaaaauuauaugccuauuuugauaaauaccuguuugauagcgauguuuuauaaaacucugagaaaagucaacaaggagccuucacagugauuaauacagcaguuauuauggucagauguuaaaaaaaaucucaugucuucagucuugugccaaaaggcaaagaaaguuuugaagcuuuccacacacugauuugguuucaagauaaugggcuacuauugaguuuacauguagcauuggucuucugcuauugucuuuauaaaggaaaguaugugaaauuuggaauuggaaaugucauuucuuaaccagaguagcagguucagauggugaagcuaucacuuuuggcacaggacucuuguuucuuaauaaaauuuaaugaaaaauugacaagauuugugcaguguauauuuuuuuuaaugguugacccacugaaugcaucuaauuagcuuauuacaguuuaaaagcaaguuuaacugccuaaauguaugacuugguauuuugaucuuguuuguuaggucucagcuugcugaugauagaaguuugugguccaauauuaauuuuaaauaagugccuacuguucucuagaaacucccauucccuuaaggaaaaguguuucauaugagccucucauugccaggaauagcuguguaagcauuguggaaguuuuuuccacauuaaaauguaguccaccaguucauuuauuccuuuuaggguugugacagucgcuuguguuuaugcaccccuguagagcugucuuuaaacucauucagcaaauuggaaacauuuagcuuggaugacaccucuuuaaucuuccaguaaucucaccauagagaccacuguacucucaaauacauuguuaauacuuuuaguaagaauggccugcuuucauucucuuauuacugagccauuauucuggacucuguuuauuauuauuauuauuauuccagagucgaaauaauuaucccguugaaaagaccaagcaugugcacacccuguugugacacagccgguuuuguccuaucugaacuugccugcuuugugaacuguuagggucucagaaaaacaaaaaacaaaaucuuuuauuuuuaacauuuaauuuuuuauaguuuuuauauuuuuuaauugagacaaaauauauguauauaauuuaccaucuguaccauuugaaauguacacuuccuugguaauaaauauauucuuuauucccccuuccaccuuuauuccauccuuuauuccuacccccaccccugcucaacuccuccucuucccagccucuggcaguaauuuaaagugugagugacaaucucaccucuuauaauuaugugaucuuuuuuuuuuuuuaaauugugguagaauguguauaacacggaauuugugauuuuacucucucuucacgagaucuacaguuuuuagcuccacuugagugagaacgugugacaguuguauuucuguuccuagcuuauuucacuuaacauaaugaccucuaguuccacccauguugcugcaaaugacaagauucauuuuuuuauggccaaguaguaauaaauuguguauauauaccacaauuuucuuuauucaacuauuaaugaauauagguugauuccauaucauugcuauugugaauagugcuucaauaaacgcgcacgugcaaauauccuugacaucugauuucuuuacauuugggcaaauacccaguaguaggauugcuggaucuauuaauauguuaauucuguuuuuaauuguuuugagaaaucuccauacuguuuuucacaguggcugugcugggaagaugugucaguggguggggggaggauaaaacgagguuaguuaaugguuacaaacauaccuuagaaggaauaaguucuaauguucgauagcaguguaggaugaccauaguuaacaacaauguauuguagauuucaaaauagcuagaaaagaggacuuggaauaaugccaacacacagaaaugacgaauacucgaggugauagaugccccaaaccccuaauuugaucauuacacaguguaagcaugugauagaguaucauauuugugcccccauauacauguacacauauuuguaucaauaagaaauauauacaaaaagccaaaccuuuuuagcuauaaaaucugucucuuauguucaaauguauauaguuagaaagugcuggaguccuguaacaucaguauucagaguuuacucaagcuuucauccucaggcaaacuuagcagcuguuaucuaaagccagacuugcagcaucagaaaucaccuggagcuuguccagaaagcaagagucuugggcuccaccccagacuuucuaacucagaaucuguaguuccacaggcuccccugguggcucugguauguaauaaaguuauuugagaagcacuggcuggagaucuuuuaccugagccuguaaucauggaaucacccaucaguauguggagugaccauaacauuucaacucaaacucuauuucuaaaaugaaaaaaucugucuauuguaucuaauuaaguauaugacaaauaucaagcucucuuuccacuauuuucugguguucucaugaucugacaaugacaguggcaggaccauguacugagaugaccgaagugaaaauaguaaugcucuuuuguguauuuuuuuuuuuuuuuuuugagauggagucucugucgcccaggcuggagcgcaguggcgcgaucucggcucacugcaagcuccgccucuuggguucaggccauucuccugccucagccucccaaguagcugggacuacaggugcccgccaccacgcccagcuaauuuuuuuguaauuuuaguagagacgggguuucaccguguuagccaagauggucuugaucuccugaccuugugaugcccgccucagccucccaaagugcugggauuacaggugugagccacugcgcccagccucuuuuguguauuuuagaauccagucugugacuccuugugauagagaauucaggcauucuugagacuucucaacagauucugacuuucccagguacaggcuuauccagacgacauguuuggagauagguugagagagggaaugacaucuuaugcuuauuauaugucacucuugcucuucaguauuugaaggaaacacugugugaagaacaaaaaccuucuguccuggcugcugacauuaacucaauuuuaguuauuuugagagggcagaagaauauucuaaguagacuguuagggguuccuaacaagugagaauuucuuugcaagucagugggccaaauaaacgauuucuuuaaaaauacaaauccauuuuaucacuuaagaguauuuacauuuaguuccaaauaauuugcauaugccugcuagguuaugccuuuuuauucuagagaagaggcuccaaagaggauaguuuuuuuuuuuuucuuucuuauaauacugugcuauaauagucuuuuuucccccauugggauggaaaauaaaggagaaaagaaguggcauucccauagggaauauuuccuaaguuucuaaugcaaaguuucuaaucugaaaacugccacauauuuuuaaaagaaugccaacaugauuuaaucuaguuucauucaguuuaggaacugaaaugccccugggugagggacagcaucccugaaccuuccuuggccccuggucugccccgccccuccccauccccacugugcuuccucuucugcauugucuucuuugcucuuaaacacacacauuugaaaacuuuauuuauuuguuuuuuaaagagguggcaccaucguagcucacucuagccuugaacuccugggcugaagugaucccuucugacccagccuccugaguaacuggaacuacaggugugcaccacugugccuggcuaauuuuuauuuuuuauuuuuuuuguagagccagggccucgcuuuguugcccaugcuggccuugaacuccaggccucaagcuauccuccugccucagccucccagaguucugggauuauaggugugaaccaccaugccuggccuaaaauacuuuuuaaaacuucuuuucauucgcuucuucccuuuccuuuccuccacugccuaccacuucugcuuaucugacaucuaccaucacucucacuaaaacuucagugcgagaucaccagaccccaaguccuguggcuucuucuugcgucucuuuagcauuugaucuuauccaguuucucuccucccuugauuccugugacauuggucacucaagguuuucuuccagauguuuugcuucuugagagcaauggaauuggaauccuaaguuuuaccacuuucuagcucugugccuagggcaagacacuuaacuuugaugugucucaguuuuguuguaagauaaggguagggaaaaacuuaccccauaaaauugaugcaagugcauagaagaaugucuggcacauaguaaggguuccuuaaggauaagucauaauuauugucaucauuaaaggucauugcuugcccuuuuuaggcucuuuggccugcaugcugauuguagguguucacuaauuuuuccacuccuuuucauagggccucucuucucuucaaauuuuuuuuugacgaucucuggguuucccacauuuuauaucuuagccccuaacuuuuucccugaggauagaaguuuaauuucuaaccucaggcuggccauuuacuccagaagucuugugagcucuauuaaccaaaucugccaaaaugcagcucauucucuuaucaccuaaagucucuucucucuguucuucaguccugccucucuuuugccaccaucuucauuaaugcggucacuguccuuuacaacuccugcugggguaucacacguuggcuucucauugcccgucacccaaguccuccaguugaucuccagcaucuguugauugucuguucauggugucaugcagugugucuuugcuuugcuguucccgcuucuguuccaugcagggcacaugccuuuuguauuaguugguuugggccgcaauaacaauaccauagaauaggugguuugaacaauggaaauuuauauucucacgauucuggaggcugaaaguccaagaucaaggugcugguggcaggguagauagguuucuggcaugggcuugcuuccugguugacagagagcugccaggcgcagugguucacgccuguaaucccagcacuuugggaggccgaggcgggcggaucacgaggucaggagaucgagaccauccuggcuaaugcagugaaaccccgucucuacuaaaaauacaaaaaauuagcuauguccucccuggccuuuuuucugugaaaaaggccuuuugcgugagcaucccuagugucucuucuuacuaggacagcaguccuauuggauuagggccucacccuaugacccuguuuaaucuuaauuaccuccuaaagaccccaucuccaaauacagccauauugggaguuagggcuucaacacaugaagcuggggagacacaauucaguccagaacacccuuggcgcuguugcuggguagcuguccugacuucccucuccccucggcaguccagcuucagacaggggugagaaugaucuuucugacacguggcuuuggccucccauuccuaauuacucgacuuggcuccccacggccuagaugcagugagaggaaaaugaccacuguaggguggcuuccuucauuucucaguuccuuaugcucacuccucuggaaauuggagauaacaugacuaaccucguguuauugagggauuaaauaaauucuaaugaagaauuguugcuuuaaucugacgaaaaccaaauuccuacucuccagccuccauucgaguucuuccaucaccuuguuacuccaagugugaucccaugugguuccagggccagcagccucccaucaccaggaugcagacucugcaucacagcaagauccccagggccauuagaugugagggacuggcuuauccuuacugcccggcucuaggcuacagccacaggauggagaggacagggacuuggaggcacguaccaggcuucaaacugcggcuccuuuacuugcuagcucuaugcccaaagacagguuuacaggaacuguccuugucuuguuuccccucugaaaaauagggagaggcagagguuuaccucacagagguuuugaggauuagcugagaaauuuuguaaauaagagagcaucuacccuugugauuuuaaauugaauuucauacuuaaaaucaaguacuuuuuauuuggagucaagguuuguuuauuguggcacagugucggggaaugaagagguguggggugugggguguucauuaaccucucagccucucugcccucucacccugugcaacaggguccccacuggucucccucugggaagaugugaccagcaugggauaugauggggagacuucuuuucuguagaagguaaaccaacugcugcuucgguggaagguggagagagcccuuccagcucucagaaggggccuggagccgguaugugccugugugucuguggcuggagcccagucccauuaggcccugcccccgugauugcugugagaggugguugccacacacuuucuccacagcgcccucagggcugcugaaucuaaggcagaggaguucuuguuuuuuguuuguuuguuuuuuagcccuuuucaaauuuacagaaggauugcaagaauaagaauaguguaaauaccugcuccuguguuacuuugcugaagauaauggcuuccagcuccauccaugucccugcaaaggacaugcucuuguuccuuuuuaugacugcauaguauuccaugguguauaugugccaacaacacaggugugggggagggagagcauaaggaagaauagcuaaugaaugcugggcuuaagaccuaggugauagguugauuugugcagcaaaccacuauggcacacacuuacuuauguuacaagccugcacauccugcacauguacccuggaacuuaaaaguugauggggggaaaaaaaaaggacaccugcauucucuacucagggucacuguuaacguuuagccccauccgguugaccagucucucuguguguggaugucuguacacaugcauacucuuauuuucugagcaauuugagaggaaguugcauauaucauggcgucugccccuaaauacuucaguauauauugccauugccuaagaaaggcaauauucucaccacaguugucaacgucaguaaauuugauuuuuuuuuuuuuuuuuuuuuuuuuuuuuuuuguugagacagcgucucacucuuguugcccaggcugggaugcaguggcacgaucucagcucacugcaaucuccgcuucccggguucaagcaauucuugugccucagucuucugaguaacugggacugcaggcacgugcccccccaaccagcuaauuuuuguauuuuuaguagagacggggauucaccauauuggccaggcuggucucgaacucuugaugucaggugaucugccugccuuggucucccaaagugccaggauuacaggugugagccaccaagcccagccaguaaauuugaaauugauacaagacuuuuaucuaaucugaggucauauuccaguuuuuucaauggaccuaguaaugccagucuccuuuaauguggauuuucacagucuuuguccuuuaugacaucgauguuuuugaagaaugcagccccuccucuuuuaaaaacuagaaccuuccggucaggcucgguggcucacaccuguaaucccagcaccuugggggaccgaggcggguggaucacgaggucaggagaucgagaccauccuagccaauauggugaaacuccgucucuacuaaaaauacaaaaauuagcugggcgugguggugugcgcuuguagucccagcuacucaggagacugagguuaggagaaucacuuaaaccggggaggcggagguuguggugagucaagaucacgacacugcacuccagccuggcaacagagugagaguccgucucaaaaaaaaaaaaaaaaaaacuaaaaaaaaaaaaaagcaaaaaaacccgaagcaacaacaaaaccccaacaaaaacuuguuuuggauuugucugauguuuccucaugauucgauucagguucugcauuccaagccugaacacuauguagguauucagagcgguccaucugccucucacugggguauggccaucucuauccuucagucaggguggggcuuuucuccauuauacuguuacuacacuugaucucagccaaaaggccaagaagugaucuccacucaauguuuuuccuucuggcagcuaguuaaucuguggagaggcacuuuaaacaucauuuaaauaucaucuucuuccucaaaauuucucccgagcuuuagcauccagcgaugauuuuugucugaaucuuuacaaagauggucaggguggcauucuucuguaguucuuccuucucucuauuuauuacuuucuuggacucuuggauuccuguuuuuuucagugguuuauaaucccugacugucccuaauuuuuuuggcggccugauugucccauauuggcuaguuggagccccuuccagccagcugcuguaucaccaugacacgucugcauuccccaaguaucugcggccugccucuccugguggacagccacauugucucccuuugacgugcccuccaaguaaauauuguguuucauagcuuuuaaaucagacuguccuuuauaugucuuucaaguuuguggagaauuuacacugacauauuugagugaugaguuaacaggcagacagaaacuuaauuuucuuuauagucauuuguaccuacuaccauuuccguuugcaaugacaugagucgucuccgguuauuacccugcaguacauacgcacuuuacuggcugcaccuaguugacuucugaacugcccuugggcucccucugcuggcauaguggugcgugagcacuuuucuggggucauggaauggauuucucuuucugcccauuuucuuucuuuugguuugugguuuucucucucauaaauuauuacacaaacauggaccauacaauacaaccuucuuucaaaccugauuuguuugcuaacuguaucaguaccuuuccauauaaaauucauaaauauuuuuauauaauuaugucaguguuuccauauuuuucuauuaccugaauguucuuuuuagcauuuaaauaauccauuuuuaguaggcauuuguauugcuuuuuuccauuucagguagcaucuaaagugaaugucccuugcauguauacuauucauaugugacuuaauaaguagagcuugcuaaauggguaggaacuuacaggaaaaggggaaacucuaguuugagaaaauugucugggcuaaguuuaggauguguucaacaaacaggaaagucaaguuuggcuaaagcaugguugaguaauagugggaaauauggucagaaaguagguauguuaggacucuuucuacugaaaugaugaaauucaacuccagccacaaguggagcagaacaaaauuguguuuguuuaauaacugggaagcccaggguagcuggaggcaggggcuuagaugcugcugcgccaucccuuaccugucuguuucuguuucuccuucugucccuucccagucucagcacugagucucuugcccauuggccuggugagggaaggagcugccagccccacccaacagcucagguuacagagagagucacuuucuuccauuacucacagaguaaacaucaaggaaggccacugauugauugacagugucugggucagaugucuauccuuaggccagucccugugaacaaggggauggggugucugcguggaccagaucugaagcacaggcccaugccuggggccagggggugggaacuauggaccucucuccccacugagaaccccagggagcaggugaggugaaauuccucuaggggaagaggggcaaaauugacaagauagcagaugucuaccauacugcuguggggccuggucccucccagaaggaaaaacauaguaacaauagagugggucucacccuccaccugggucucaaguaggguguggaugaggacaauggaaaugaaggaaagguuagaaggccugugguaccgguugguagauagcucuucgugcuuucuccauauggagugagagugcuuggaugugauuccuucaaagucaggucuaggagacucaggaugccuaaucuagagguaagaacauugugaggaaagccagugaauucagucuugugcaugcugacuuugaaguacuuuuggaagagccaaguggaauuauccacaggacaggaccaaaucuuaccugguucuuccccaggccgacuaguccacaacaggaaauaaaaagaguugccccgauaccaagguguacuaguccauucucacacugcuauggggaaauaccugagacuggguaauuuauaaagggaaaagguuuaauugacucacaguucuagauggcuggggaggcuucaggaaacuuacaaucauggcagaaggcaccacuucacaggguggcgggagagagaaugagugcccagcgaagggagaagcuccuuauaaaaccaucuguucuccuuauaaagaucucuuaauaaaaccgucagagaacuaucucauucacuaucaggagaagagcaugggggaaccgcccccaugauucaguuuacuccaccuggucccgcccuugacauguggguguuauuacaauuuaaggugagauuuggguggggacacagagccaaaccauaucacaaggcuuucuccuccuugcugggauuguacccauagccucuuucugaguccucucucuuuuagccucuuuaugccugcagugcauccuuauaccauuucuagagucaucuuuauaaaacuuauacucuccguaugacucauaaauccuguuuuuuuuuuugcacaguauauuaaguauaaaauuuguuaaagucuuuaauggucugcccccaagcuacauuuccauuuuguaugucuuucaguuccuuucuacuuuguauuuggcuguugaguuaacugaauuuuugccauuccauuaacccaucccaugcuuuucccacuucuagauuucacuuuucuuguaggcuagaaugucuugacugggaucugacuggagauaaugagaacaaaaacugguucaaagagccaggauguugcauaaaaguccuaagauuguaucuaagcagguaaaauaaaaauuuuaggcaauuacuuaaauuugaaaugcucacauuuauuaauaaggcauguaacaucuacaugagccaucauuugcuuuuuuaauuccacauugauuaggagccaaaccuucagggcagguauccgguagagcgcccuggagaggcccuggauaggcacaggcgccugucagggggcucuucacaugcugugugcugcugcugggagaagagggggccagagacuagggggcuucuaagaagagguggcauuucugccucaguguugaaggaugaauaacuuugacaggcuggaaaaaggugacauuucagguagagcgugucacauggauguaaauaccaaaggucaaggacaugggcuugagagauggugagaaggauggaggugacuguggcuugcauucuauccguaucacuauuaauuaccuucuaaugccuuuggcucuaggugguggaacaaguaaaguaauggacaaauacuuuuucuaccaauauuuagugaccaaaugcagaguuauggagagggccagggaccucaugaaccauacucuuucuagucuagggacauaacuccaaugccuuuccugucccaguaagaggccauggauuucaagaagccagacaauccauucuuucagauaaugauaaaaaagaaaccauuuauuuuauuucuaaguauagaaugaaacauuuauaguugcccaaauuuugguaccuuuuaggagaaaaauacagauuuuuuuguuguuaaaaauaaacuuaaaaaaaaaaaaaaaagacuuaccauaguccgggcacgguggcucacaccuguaauccgagaacuuugggaggccgaggcaggcggaucaccugaggucaggaguuugagaccagccuggccaacauggcgaaaccccaucucuacuaaaaauacaaaaauuagccgggcauaguggguggugggugccuguaaucccagcuacuugggaggcugaggcaggagaaucacuugaacccagaagguggagguugcagugagcugagauugugccauuguacuccagccuggucacaagagcgaagcucuguaucgaaaacaaaacaaaaaaagaccuacuguaaauagaguacaacaugagacuaacaaaaauaacaaauaaaaucauccagcauauauucuguauuuaaaaaaaaaaaaucacaagaugaauacagaccaucuuggugcauauguauuuuauacacuagacacaugcugauguuuuuaaugcuuaaaauauauuagguuucauacuugcuuccaauccaaggagaguauaucugagcucuuuuuuuuuagauuugaaaaccgccuuuuagauuagauuagaacacugccuuuuuuuuuguuaugcaguaacagaucauugcccaccugaaagcgagucgccuuuauuuuuaccuccuuaguagaaccagcaggagcugcaauugcuguugcuugagccaaggccacagucagcauagaaagguucugcuaagagacuguguuaaaggaaauaaauuuggugacuuaguuuuguuuuacaagcuagcuguggcccaguccuucugcaggguggguacgcagguuuauugcagcucugcagagccauggccuuagacaaacaaagaaggugugggaauacccgggagcuuuccauucaaaguagauucuucuccuuugagugcauguaacugaagcaccagcuuucuaaaaaaaaaaaaaaaaaaaaaaagagagagaaaagaaaagucagucugaaguuuuugugacacucagccagacuccacauuagauaaaguaaucauggaaauacagcuuuauuuuuauaccaaguugugcuuagaaagcugauugcuaaaccaggaagcuuggcuuucagaauuuuacuguaauccaggguggaaaaaaaguaucacucagauggcauuugugggagauuacugacugguaaucccuccuuguccuagaagauuaagucugcccugguguagucauggucagcugauuuuuuuauuuauuuauuuuaaauaaauuguaguuucuuguuguaagucagccagugucugauguuugccugaacuguuuguaccucugggccauauugcagaacccugcccuucuuuguugacugaggaaagcucgcucccugcccagguuuuucauuguugaucgaaauuaacaccagguggugaauagagccccuccuaagguugcucaggauaaaucauuuauuaaauaggucugcuuaucaggaggggcgugaaggcucccaaaaggaaaugcuggcaccugggcccagaagccagggccucuaacuccugggguugauuucuucagugaaguugcacccuacaaagggaauauggccaaagcggcacucaacugaaggcugauaucaggcgauuagacagccaugcauucugcguuugucuggaauggauuguagagagauggacuuauaugaggacuaccaguccccguuugauuuugaugcaggagugaacaaaagcuaucucuacuugucuccuaguggaaauucaucuccacccggaucaccuacucuucagaaauuugguaacuacuaauuuuguaaaguuaaguuugcuuggaauaaaaccuagacauaacuugggguuugccuggcuuuaaaauuguuaguguaaagauguaccagggugguguuggguuguaacuagcuaauaagcuauucuagauucaaaguacagagauagauggcucauuaaauauuuagaauauguguauacuuagaaguuagauuuuaaaguuaguacuauuuaugcgaucacuagacuucuccauugauagauauuccaagcucacuuugaguuuguugagcugguaaauaacaaaaaaggaggaaucugaaguccuugguuucuaguugcuuagguaauuuacgacaacuuucccgauuuuucucuuuaguaaaaugaugguuaagcacugacucaguucaaggucuugcuaaugacuguccuggguuuuguuauggaauauugagagcaacuuacagaaauugcuaggcaagagauuuuuuuuuuuuuaaagaaaaacuagaaauugcuguaccuuuagaagcaguuauuccuucauacuuaccaguaugagauugcuuugaaggccaggagcaccaucagggaggcccuuccuuuauuggcacaaggcagcagaaagccagaagcagcuuagccauccucccggcugggucccucaucucauagccaaugcugggaacugguuaaaugaccuucucuguaauuugccaaauaagcaaucagguuuuuccagaaguuaauuuuuuccuuauuaaugaagaacaggucacauuuuguucauuuuaagcugaaaaaauggguaaccuagaaaaaaacaugguaaaggugacagcaugaaacuuaguuuuaaguauuuuagguuuguguauuugccgacaguagggaugugugaagcagcauuccucucuugguugcaccugguagccaucuuuccccaaaaguggcugggauuuccaggaacaggaaaauguugaauauaacagagaagggguagagcuggucuguagaaguugggggcaggaggcagcagcuugaugucugcugggggauucugauugccaggaaacuuucuccagugcugaccuugccuugcccaaguggccccccucagaccucuguaauaaaggggccugggcucccccuuugcccagcccccuucuaacuuauaaauuuuauguauaauuuaauaggggccacacagaauggggaagcuagagcuugauaauggacugaaacucaagugacuugcgggggagggagggaaccuuugagaagcuggggcugugguuuugugacuucagguggaccuugaucggugugcaagcauccagauucccaggaagauugacacugcuugcuucuuuuaguucccuucuacccuucuugucucuugguuucaccuccuuucauuuuccaaguuauggucauggcugccuugggauguuuucugucaaaaccagggcaguuguaggguuggguguaccucuaggcagauucugaaagauuaucuucacaauuccuguuagcuguucgaaggaaccugggguugugagauuuaaaaaauuauuaaaaagcaaaugaauaacaguaaugaaaaacaaacucauguagcuagguuuaguaguuugcauuaauugaaagaaaagagggugaacaagcauuaaaacaagcagaaaccacccucagcagucaucuguaagaacacagugauuuuaaaauggccaaauaaaagugggggccuggaagagugauuacucaucucugugcccaugaccccucagggcauaagaagucugcacaccugucugaacaucaaacaugguuggucgauggaaugaauaauguguccuccguguguuugcacucuuuguauuucuacguagaagcuuuuaggaccaauacauuaugaauccauuaaaaguucuuguggcuuuuggccacuauguauuuucuuaaucaccagacaaguaauacagacaagaaggacugauauaaaaaggaauccuacccagagagguugggaauacugauuugaaaagagugaaaaauaucucugauauuuauccaaaaugccaucauggggcaaacgggaaaguaaugagauuuuaucuaugggcaggauguuccuaagaaguaauuaaagcgaagguuaggaugaggacaguggcugaaacaaaaugaagccuuuuauuagggaguuuuaaacuccuuugacacaaccaacccauauucagaaaugccuuauaccuccuuaccugcaauccucacaaauauaagaaucuaucaauaacugaagcaaaauuuuaugaaccagaacuucuccuuacuauaugugauguacucugacauuuuauacuauuugaugccauuucuucuuuuaaagugcucaucugguucugcuaacuggauuuuacaacccauagugugaaaacaccaauuuauaauaguuucagaaucuggaacauaagcuuuguuugucuuuuuaguucaccucuguuuccccaagcaccaagaauagugcuugacauuauauggcucaaaaacuuuguggaaugcaugaaugaaugaaugacacugguaaggagucguucacacuccaguucauuuuacggaugugaagauugaggcugagagacauaugugauguucucaacucacaaaguuuaguuaggcuaagauaggacuagcacucaucucuuaauucuuaagcuagugguuugguuuuuuguuuuuuuuagaccgcaacaucucagccucucugguaauggauauuauagaacagauuaacuauucaaggcuuaaguucuccuuuggucaaguguuuuaccgugggaauaauuuguugauacuuuauacgccacuuggaucucaacauucuauuccaucuuugggcugaacauuaugaggaccagggucucacagcuggggucuuuuguugcauuaucucuuccauucugugaacacccuuaaggauaauaucccaaauguuauuuacauagcaccuaucuuccucuuaagaauuuuuuuuuuuuuuuuuugagacagagucuugcucugucgcccaggcuggagugcaguggugcaaccuuggcucacugcaaccucugcuucccggguuuaagcgauucuucugccucagccucccaaauaccugggacuauaggugcgcgucaccacaucgugcuaauuuuuguauuuuuaguagagacgggguuucaccauauuggcgaggcuggucuugaacuccugaccucgugauccgccugccucggccucccaaagugcugggauuacaggcgugagccacugggccgggccagaauuuucuuuuuuaaaaaaaacuuuuggcugggcgcaguggaucaugccuguaaucccagcacuuugggagucugaggcgggcagaucacuugagcucaugaguuugugaccagccaucauggugaaaccccaucucuaccaaaaguaaaagaauuaaucgggcaugguggcacacgucuguggucccagcuacuugggaggcugagguaggaggauuacuugagcccaggaggggauugcagugagcugagaucacaccacugcacuccagccugggugacagaaugagacuccaucucaaaacaaacaaacaaaaaacccuuuuauuugagguucaggggugcauguacaggcuucuuauauggguaaacaugugucauagggguuugauguacagauucuuucaucauccagauacuaaaccugauacacaguagugauuuuuuuucccuuuuuuugcuccucuuccuccucccacccuccacccucugguaggccccagugucauuuguuccccucuuuguguccauguguucucaucauuuugcccccacuuauaagugacaaggugcccuguuugguuuucuguuccuguguuaguuugcuaaggauaauggccuccagcucauccauguucuugcaaaggauaggaucuuguucuuuuuuauggcugcauaguguuccauggcauauauguaccacauuuucuuuauucagucuaucauugaugggcauuuagguugauuccacccuuugcuauugugaauagugcuacaaugaacuuacgcaugcaugugucuuugugauagaaugguuuauauuccuuuggguguauacccaguaaugggauugcuggggagaauuuucuaauguacaggaagaugcagacuuggcuuauggcaccuuugguuauuucuauugacuuaaggaauuaugagcaauggaaaaaucugacauuuuaguuuaacacgaucauauuugauacucuagaaagacugaaaaaucaaacugaaauuccuuagcucauaguucuuuucauucuguuuuacccuuuuugauuuucacucugugucauucucacuucuuuuuagagaagugguuaccacuucuuaaaaguuuuucaugauugcaucagucuuaaauagcaaacauggcugugguuuacaaaauaaaaacuggagucaaauugaagagauguagaauuuccuuauuccuagagaggaaauuuaaggauggaagagacuuccucucuggggauucugagauuucugcauggcugaccuuugucacucuuuucuggaaugucccaguuacuaguuuuauacucaauuuuggggcaggggagcagagcaguggggagaggagauggcucugaaguaauugacugaagauuuuuucuuuuaaaaaaaaaugaaagagauuuaaggguccauuuagaaauaccuggaaggaccaaguaaagcauuugaaaauacuguguuuuaccuugaggaucguuucuucuuuguccacucuuucugugaagugaagcuuugggagguaaccuucugucuuggguggggacauugaccacuguucaggguccugcuuucagagcugagucccaggagcacuuugcacccgauguggcucccaagcgcuccuuucccuuuuugucuuagugcagccccuccccuccugcucuguuuccuuuacucuuuaauaacccagacauuggccaggcgugguggcucacgccuguaaucccagcacuuugggaggccgaggcaggcggaucaugaggucaggagauugagaccauccuggccaacauggugaacccugucucuacuaaaauacgaaaaauuagccagguaugguggugggcgccuguagucccagcuacucgggaggcugaggcaggagaauugcuugaacuugggaggcagagauuguagugagccaagaucgcgccacugcacuccagccuggugacagaccaagacuccaucucaaaaaauaaaaaaaaauaaaaaauaacccagacauuguccccuuacgcuugugaggagcuugggucuucccuuaaauggaguggaucaaguuuucucaguuuuuuucuucccugcuaccuugacuacaauuacccaacucguuuucccccuaagguuuuacuguucuugccaugggcacacaugggaaaauuccagccuuaagaaucuaaaguugucacggccugagcugcugcaucccucucuucugaaggcacucaguggcagacagcauccucuuagaugcucccucgccuuaagucagugguucucaaccacaguuuugccccacugugggcauuugaccauguuuguagauacucuuuugguuguuacaacuggguguggguguggggcugcuacugacaucuggugagugggccugagaugcuacacaggaagaugcccagggcagucccugccacagucauccaccgcaugacgcccguggugccgugccugagaagcgcugccuuaacuggaugcuuaaucuuuugggucucccgaagacaaccauugugguguggggacuugcaaauauuccucccacuucugggauuuuauuacauccagaaacaacaaggcacagagaaugggagccccaggcacagacuuaacauggggaaaaaacauccugugaucuuucuggauguuaccacuaaagauacuuugaauuauauguuuaaaucucuuuuuaugccucuagguuuaaaaagggggaugcauauuuccucuuguuugugcuuaaauaaaacagucauagauacugaaguuucuuaccgcgacuccggucuuaaaguuauugguccugcuuugaagacuuguguaggaaaggccugugcagcuuuauuuuccagagacgcuuccagggcucaaauauauguuaacagauucuuucuuggguaggcaguguuaacauucaggcuaaauagcagauaucuuagacuccauuuuggcaucuuuuucccuccuaguugaauuuuuuugggggcagcugacauauucuuucugugauaucauuuuugucccaccuauguaaccaugguacuuuugacugcacacuguuuuccuguaauaugaagguaggugaccugcccccaaaagugacaaucuuuggacagauuauguaugagauggaagucauauuucuuuaggaaagugacauuucacaucugcuuuaaauagaaaaaccuuucuagguaaaaacagugaagugagaaugcaauauauaaaauaaaaagcucgagauaaaaggagagagaaugaagggagacuggguucuuaucuuuccuucuaacuugacuguauaacuuccuauaauccauuuauccacaguguugacacgcaucugcugugugccagacacugugcaucagagauccugcuaaggcuaaagacacaggauuggagcaugaaggccaaguauugcccagcugcagucuguauucuauacaauagacuggaccguagguucuuauucccagagccaagaacuguuucucagccaaggucacgggguccaggggagaucccccaagaguaggagacacuuuugacuuauuuaagcuaaugggaccuggaaauagggaugggguuucaggcagagaaaauaauaugugcaaagacacacgaaaaauaguguguuuuagagauagcagagauggcuguacaacauugugaauauaauugaugucacugaaugacacacuuagaaaugguuaaagaugauacauuuuuguuguauauucuaccauaauaaaaaauuaaaugggccaaaaaguaugggagguacauuuaaacaaaaauuuuuuuugaguuaauaccuuuauuucuuuccuucuuucuuucuguauuucuuucuuucucgcucucgcucuguugcccaggcuggagugcagugggugaucucggcucacugcagccuccaccucccagguucaagugauucuugugccucagccucccaaguagaugggauuacaggugugcgccaccacaccuggccaauuuuuguauuuuuuaguagaguugagguuucaccagguuggccaggcuggucucgaauuccuggcuucaagugauccaccugccucggccucccaaagugcagggauuacaggcaugagccaccaugccuggccaaguuuauauauauauauauauguguguguguguguauguguauauauauguguguguguauauauguauauauguguguguauauauauguauauaugugugcguauagauguauauauguguguauauacacacauaucuauguguacauguauauacacacauaucuguguacauguauauacacgcauaucuauguguacauguauauacacgcauaucuauguguacauguauauacacgcauaucuauguguacauguauauacacgcauaucuauguguacauguauauacacgcauaucuauguguacauguauauacacgcauaucuauguguacauguauauacacgcauaucuauguguacauguauauacacgcauaucuauguguacauguauauacacgcauaucuauguguacauguauauacacgcauaucuauguguacauguauauacacacauacacacacacacacacacacacacacacacauauauguuuuuuagauggagucucucucugucgccaggcuggagugugguggcgcaaucucagcucacugcaaccucugccucccgaguucaggagauucuccugccucagccucaugaguaguugggacuacaggugcacgccaccacgcccagcuaaucuuuguguuuuuaguugagacggguuucaccauguuggccaggauggucucgaucucuugaccucuugauccgccugccugggucucccaaagugcugggauuacaggcgugagccaccgcgcccggccuacauuucuuaaaaaacaaaaaaagcauguguuucuggaggaacugcagguuggaggguauagugggaguguugugcuggugagggcaguagcaggagauggggcaggugcuggggaguggggccagauuguccagagugaggagcuuugcaagaagcugggaagccaucaaaggacuuaaggcacgggaguggcgucgucagauaugcacucuagaaagcucuuuguuggggcagguugaggaauauuugcagaugucagagacuggcaaggagcuuagggguaggaaucuaagcaacacauagugacagcucaaacuaggcaggagggcaggauuggaggcaaggagugaaguggauguccagagagugagauggagccaugacgucucagagagguaggaagagaaaaaccaggagggaggagaggaauggagauuucagacugaagugcaaugucagauggccuuggcguggcuagaugaggguagugacccagaauuguccuuaguggaagggagguggaaggggcagccacaagguugcaggggguugaagaguagugggcagugaggaagugagaccugagagccaagacucagggaggacgaaaggagagagaagcaauugccaggacaaguuauagggcauggaaccugggggaaacagcaaauccuuguguguacccauuuuuugcagguaaggggcuuggggcucuuugaagauaaaugugauuaaagaagaucaaccaacuagucaauggcugaaucaguguuuaugccccuuuccaucggaauuauucuccuggggcugcgguagccauucuggguggcuuaucacccgguucuggagguuagaaaucugaaaugaaggcguuggcagggucuugcucccugugaaacgugcagggcaaugaauccuugcugccuccucgcuucugguguuugcuugcagaccuugguguuccuuguucuguagugaugucaccccaaucucugcguguucucugugcuuugcgcucuguaucuucacauaaucucuucucugagucucugcguucaaauuuccuucuuauaaggacaugaaccauuggauuagaguucacuaauccagugugaccucaucuuaacuugauuacaucugcagaaauccuguuuccaaauaaagacacauucauuguugucagggguuaggaaauugaagacaucuuuaaaggcagcagaguucaacucacaacaccaucuaauuucaaagcucaucuugucuuuuccuauucuuguaaaaaucuguccucaguuuucucaucuuuauauaaugaagcauuugacuuaaaccagggauccccaacgcccaggugguggacugguacccaucuguggccuguuaggaaccagugaguggcaggcgagugagcauuaccgccugagcucugccuccugucagaucagugguggcauuagauucucauaggagcaugaacccuauugugaaccacacaugcgagggaucuagguugcacauugcuuaugagaaucuaaugccugaugaucugagguggaacaguuuccucucaaaaucaucaacccccaaccgccguggaaaaauugucuuccaugaaaccagucccuggugcaaaaaacacuggggacugcugacuuaaacgauucagaauucuuucagaucuaaaauuguaugacaauggccaaaaagcuuuuaaucaauaaucuuagaaagucuugaagcacuuggucauaauuggaauaaaagucaaagacgaagaacuagagggaagauaaccauuuaagugggugcuccaaagggggguuggggcugcacccaagcagagagaggcgcuccucaaacucuuauuuuuggcuuaaguguagguucuacauuuuuaguaaaaacgcuuuugcugcuuuccccaguugaaauuugugaaaguauguggcaaaugggugguuaugcaugggaaaguaaagagagagcuacuuuaauuaaaucuuuaaagaauaauucaguucagaugcaauauuaacauugacuguucuaggcacugugaguucugagauggagagauaaagugacaucaggacuuuauagucuagaacuagagauguguucaggacuaagcucuuaccgguucuuggccacucugcucugccuuucccugcucugaccacacucgcacacacacauuuccacuuugucuuccgcacauuauucacaaggacucugaagucuugaaguguuguauuucaucaaauccaagacaccacagauuguaagauguuacuauuauuuuuuguuucauuaaguauaaaauaugcuaauaguuaaacuaaaaaaaaaccugcuuuaucauaacuuaaguuuuaaaucuuuuuuaaaaauuauuuuuaguagagaugggguuucaccacguugcccaggcuggucuugaacuccuggccucaagugaucugccugucucugccucccaaagugcugggauuacaggugugugugagccaccaugcccagcccccuaaaaauuuuuauuaaaauuuuuguuguuguuguuuugagacagggucuugcucuguugcccaggcuggagugcaguggcacgaucacagcucauucagcuucaaccuccuaggcccaagcgauccucccgccacagccuccugaguagcugggacuacaggugcaggccacuauacccggcuaaugguuuuugaguuuuuguagagacaggaucucacuuuguugccuaggcuggucucgaacuccugggcucaagugauccucccaccuuggccucccaaagugcugggauuacagguaugaaccacugugccuggccaaaauuuuuacauuuauugaaguucuuuuuuagauuuauucagacguuuacacugaucauaacacuccugugcauauuuucuaaaauaaaaaagaacauuuccuaaaaugucuucacacccauaaucuaacuuauuugaauugcuauucaacuuggaguaaucuaugucuauucuauugauuuauuuuccucacauaaaaugucuguggugcagccuuucuuaagagacgucuguaaccggaccuggcauuuucuaagccauuuugcaaauuuugaagcauguuugcaggugauaaccaugucacaaugacuggcugauuaauuguacagugcaucucaaagauguaaaauguaaaaaguaucuucagauugaugggaugugucucugcuugucuucuccauccuuaccccugagacacuagaacucucagcugggaaucagcgagaugcauugcccugccaguggacuccagacccuucccaggggaggccacccaauacccagcuugcuggaaggacuuuuccaaagacaagucuagacuugucacucccccaccuaaagcucuucagggauccuauggauggaacugaagacaggcugacaaucuguuugcacagcuagaugaagagaacuaaggcaauggcuaaaauguuaauaaccugauggaagaaauuaucacucauuuucagucacuuguguuugauaauguuaucugugacuuucaaaccagggauccccacagguuccuagacccucaggaaaguaaaacguuucuauggagaaagacuaggcccuguuuccuuguccugccaugaucauugauguuucucuaagauguucgugauggagcugagucgagagacagaaagacccaaguauuaauccugccucuguaacucugggcaaauuauauagccuuagaggaccgcaguuuccugguggaaaaaaaauacuccucucggauggugguuaugggguguuuuuauuuuuauaagauaacauguagacuuccccucacaguggcugguguaguagaugucaguagauauuaauuguauuuuccccaccaucuuugucuuuuaaaaacagcuuuccaucagauucugagaaaaaaaaaacaacauuaaaauuaaugaacaaauaaguuuuggauuaugguuuucaauaaucuauacuuuuaaauguucuuauuuuccaccuuucauguugugaaugagaaauuaaucuuuucucccaaaagccagacucuauuuucauauuaaauccuauaccauuacugaacauacaagaaacaggaucauaucuagacgaauauauaaggcaaaauuuggauucccagguuuggggaaacuuuaguuggaauuaaugaagacugcuuuugaucuagucugccagauucuuucacuuuuuagggucuuauuauugcuucuagauaccuuucaggucugaccaucagccuccuacuuuugucuuuguuuucagaucagugaugugaagcauuuguuuuuacaucagaccgucuagguuuaaaaucugaccuccaccaaagauuuagguguguuaaccugggcaaguugcuuaaugucuguaagcuugagguuccugaucuguaaguggugacagggauccccaccucacagaaguguugcacauaaguauuuaaaacacuuaauuuggacuugucuguaaauggaaugcacucugucaugguggcugugguuaauaauuuucucaaggcaugacugugauguuuugcuggugauuuugguaucuaccauucuguucuuccuugguguucuuuaauuucuaauuuuuuuuuccagacugcaccuuuuaauuuuaaugauaaugauuugcugccaccuacgggcuaauguggaaagagcagaacaugucauuaccaacuuucuuagaugcugaauauaaaaucucaaggucauccuggcagacuugaagccaacuggacaacccgucauccucuuuucugagagauuuauuuuccuugauagccuagccgcauacuugaauagaaccagaauccccuuggauucuuuuuggaauugggcaguauacauaaagcauuguguuagcagucagauacuguauuucuccccuuguuugaguagauuugcaaaacaguguguaucaaaaaagcaugaaagagucuuugcuauuuaaguaaugguuugguaccugaguuuugcuuguuuuguuuuggagaucuguuguaguuggagaaccugggaguucuguacaaaacauuaaaaauaaaauaacguuuaacagguagcucuguuaugguucuuacuguguugccuuauaugauuguuacuugaaugcuugacucucaguuucaaucucauacaacuuucuucacauaaucugacauagaggguagauuuacaagcacacacagaugcugggaaaugguuucugacaguacauaguacagcacguuguucacggugugguuuggcaggaguuggaguaagaggugccaaugccagcuagcaggagacggguccaguaagggcuaccugccaaccucaggggucacacuuugcuuugaaaacaguaaggaaucaccaaaggauuuuaagcugaagagugauacagucagauuucuauuauagaaauauuauuugggcagucuguucacaaauauuuuagaggaagaccugcggaagcaauuaugcauugagcuuuucuacuugcugauuguaccuauuaaauauuuuauauucagucaagagcuuaaucauauuuuuugccaguccgauuugugguuuuugaauuuuuuguguuacuuuuaugccuuuaacaguucugugcuuuccagguaggcacuauuuuggugcugccaugcugaugauuauuauuauaauuauuaacugcuauuaaucagugaguguacaguagagccuguaccaagugccuuuguaacuuguacaccauguacauaagcaucaucucauugacucauguaauucucuaaugcuugcugcgacgcuggcugcuuguuccacagugugguuauucuccuuccuuuuucuucugugucugcucccuggcgccuugcauugggcaggaugccacauugcugcuguggcugaacuggcaguucucagaaaugguccugggggguagcagggaacaacugcaguggcugugaugcucacuggcaggaagagcaggcagaggaguaaaccuuccccugguuucuuugcaaaaaaaaaaaaaaaaaaaucuguugccagaggagacuuuguaaucccaaaucuguaaacugaacugaagccuaggguaaggcagcugaggccaggaagggggugacaaaaagcuuagucgucaaauaauauacaaauacaauauuuuuaaaaauuaauguaaaagaaaaucaugaauaaaauaucacaauuuuaaauaaagaugagauuaccaauagugcuguucaugcagagccauuuuggaguuugagacaaaguaucagcaauacugauccuucaauuuaaaauuuuggcauuuuuguucaucauggguucuuugaauuugauuuuuaaaaaauacugcauuaagauauuuauauugaguguuuuaguggccucuucaauuuugcacccaagguuggggugccuuucuggccucaucuuagccugugggugaggguugggcaggaaaagaggggagaucugaggggcagcugccuccuggucacucuccaguuguucuuccugacaggcuccguuccaaggggaaugggugcggugugguuggucuucaguaguguagaaugucucuguguggcuguuggucaugucucugaacauauaccuuaguauucuuuuauaaggguaucuggaugauauauauauauauagauagauagauauagauauauagauauagauauauauagauagauauaaucaucuauaucaucauauauauauaugauggcuugaagccaggaguucaagaccagcuugggcaacauagcgacacccugucucuaccuccuaaaacaaacaaacaaacaacaaaaaaagaacuuacaagaagauguuuucugccuccacuaauggaaagaaacagaauaaaauuuacuuaggacauuuaguucauucagugguuacuccuuuacugaguuuaugaaauguuggcuuugauuaccacagcaagcugaagagauaugcaaacuccugcccuggguuacugggaaggagcuaaaaucuuucaucuaauuuauacugauuuacuuuugcagcaauuuaaagucucagcaagaucucauuuugggcccuucacucuucugccauaacuauauugugacugagacuaugaacagaagcuaagagaaugcuauauuuucuaaauucauauuuuggcagagucuacuugguaguuuccggugguuagcucagauuuucuuuuguccuuugcugagaaagccaggucauuugaauauccagagaugagauguguggaucuacucuaauuggcuuuauucuggcuaggacaguggaggagcuuaaauagggauuuuacuuagauuuugcacuuuaaaaaaugguuuaaauccccaaccaggucugcugagaacagacccagucccugaggaaggagaagauguugcugccacgaucagugccacagagacccucucggaagaggagcaggaagagcuaagaagagaacuugcaaagguaaagaaccauuccuuuugcaacuuuauuuuugcacuuaaaauguacugucauuugugauucuaaaguacauggugauauguuuauaguuaguuccaggggagagaaagcauauguguuuacuucuccagcaggucuugaguaggggagaggagauagaagagggugacaucgguucguuuuuauaugagaaaaaaguauauauggguaaaauagaugugaaaaguagagugugaagcaggaaaugaaugagaggaguaguagugaaugucuucuaagggacuucacugacaucugauacacuugcucuucagugcaucagugacuuuguucuacccuuggcuguguugcagagauggccacuuuccaacuuccuuccgccuuuccuuccuuccagcucccuccuucccuccccucccuucccuucccuacccugccuucccuccccucucucccuuccuuccuuccccucucuuucuuccuuccccucccucccuccccuccuucuuccccuucuggcuucucuuuuuucucuuuccgcccccccucccccucccucccucugccauucccccccauuccuccucuccuuucccucccuucuuacuuuuuucuuuccuaacuucuuccaugaaauucauuuaacauaaaaauuaaccauuuuauuauauuuuauuuuucgagauggagucucgcucuguugcccaggcuggagugcaguggcacaaucuuggcucauugcaaccucuggcuccuggguucaagugauucuccugccucagccuccugaguagcugggauuacaggcgucugccacugugcucagcuaauuuuuguauuuuuaguagagauggauuucgccauguuggccaggcugguuucgaacuccugaccuuaagugauccaccugccuuggucucccaaagugcugggauuacaggcaaaaaaauuaacgaguauaauucaguaacauguaacauucacaguguugugcagcugccaccccuuucaaguuccacacauuuucuucaccuccaaagagaucccuguauucauuaagcauucaauccugacuacuccccuccuucagccccuggcaauaccuaauuugcuuugugacucuauggauuuaacugucuucugguuauuucauauaaauggaaucauacaauauguaaccuuauguauuuggguucuuucccuucauguuuuugagguugauucaugguguagcacauaucugugcuucauuauguuuaaugacugaauaauauuccauuacauguaucuauuguauuuuguuuauccauuuauccauucauagacauuugggugauuuuucaccuuuugacuaugguggguagugaguuaggaacauuuuaugaacaaauacuugcuugaguaccuaguuucaguucuuuuucauauaugccuagauauggaauugcuucaucaugugguaguuccauguuuaauguuuuaaaauuuuuuuaacuuuuuuuuuaagauacaaggucuugcucuauuuuguggguuggugauugugcaguggcaugauuauagcucacuauaauguugaacuccugggccaagcaauccuccugccucagccuccugaguagcugggacuccagguacaugccauuaugccuggcaaauuuuuuaauuuuuauuuuucauagagaugagauuuugcuauguugcccaagcugguuucaaacuccuggccucacgugauccucccaccucagccucccaaagugcugggauuacagaugugagccacuguuccuggcccauguuucaaguuuuuuugggaagcaccaaacuguuuucacaguauuaacaccauuuaauauucccaucagcaauuuccccacaucccuggcaacauuuguuauuuucuguguuguugauuauaguaguccuagugggugugaagugauaucucauuaugguuuugguuugugcuuuuggugugauaucuaagaauccauuucuaaauccuagaugauaaagauuuaccccuauguuuuugucuaagacuuuuauaguguuggcucuuaagauuuaagcccuugauccauuuugaguuaauuagcguauaugguuuugguagggaucuaacuucauucuuuugcauguggcuaguuuuccccagugaaugcucguggcauccuuguuaaaaaagaaaaaaaaucaguuaaccauagauguauagguuuauuucuggacucuggauucagauucauucaucuauaugucuuuucuuuugacaguaucacacuauuuugauuacuauagcuuuguaguaaguuugaaauccagaaauaugcguucuuuaccuuuuucuucuuuuuaaaaauuguuauucaagguuccuugcaauuccauaugaauuucagaaucugcuuuuccacccacacaaaaaugcuguuggcauuuugauagggcucgcguucaguuuauagauugacuuggugaguauugccaucuuaacaauauuaagucuuccaguccaugaacaugaaaugucuuuccauuuauuuaguucuuauuuuacuuuagcaauguacaaaacauuuuucuauguacgagucuuauacuuccuuaguuauauuuauuccuaaguguuuuauucuuguugaugugauuguaaauggauuuuuuuuaaauuuucuuuucaggugguuuauugcuauuauguagaaacauaacugaauauuauaucuugaucuuauauuuugcagcuuuguugaauuuaugagcucaaauauauuuaaaaaaauuuuuuugagacagguauugcucugucacccaugcuagagugcagugaugugaucauggcucggggcagccuugaccucccagcucaagugauccuccugccucagccuccugaguagcuaggacuacaggcgcuugccaccaucugccugguuaauuuuuuuauuuuucaguagagguggggucuugcuauguuucuggacucaagugauccuccugccaaggccucucaaagugcugggauuacaggcauaagccaccacaaccacucuugaauagauuuuuuuguggauucuuuuuuuuuuggggggggcggugggggggaagguauggaguuucacucuuguugcccaggcuggaaugcaauggcaugaucuuggcucacugcaaccuccaccucccagguucaagcgauuguccugccucagccucccgaguagcugggauuacacgaaugugccacuacgcccggcuaauuuuguauuuuuaguagagaugggguuucuccauauuggucagcugguugugaacucccaaccucagguguucugccugccucggccucccaaagugcugggauuacaggcaugagccaccgcaccuggccuuuuuuguggauucuuuaggauuuucuauauaugaaaucaugucaucugugauuaaacaucguuuuacuuuuccuuuccaauuugaaugccuuuaauuuauuuuucuugucuaacugcuuuggcuaaacucuucaguacaauauuguguaaaaaugguaaaaauggguaucccugucuuuuuuucugaucuuauggggaaagcuuucagucuuuaaccauaaguaugauauuagcugucauuuuuuucacaaaugcacuugcguugaggaaguucucuuuuauuccuaguuuuaguggguuuuuuuuuucaugaaagaguauuggauuuuuaugaaaugcuuuuuuuuucaccuauugaaaugauuguguuuuuccccuuuacuauauuaaugugguauauaacacugguugauuuucauguguugaaucauccuugcauuccuaggauauauuccacuuggucauguuuuauaauccuuuuaauaugcugcuggauauucauaggagauaugggcugcuguuuucuugugauaucauucucuggcuuugguaaauaggguaaugcuggcuucuuagaugaguuggaaaguguucuaccaucuucugguuuuuuagaagaguuugaaaagguuuguccauucuuuaaauguuugguagaauuaaccauugaagcuaucuacuuuuacacuuuucuuugggagauuuuugauacuuguucaaucucuuuacuuguucagauuucuucuauuuuguugggucaguuuagucauuuguauauuucuaugcauuuguccauuuacucuagacuaucuaguauguugguguacaauugcucauaauauucuuuuauaauccuuucuguuucuauaagguuaguuaauguccccacuuucauuugauuuuaguuauuuaugccuucucucucuuuuuuuuuuuucggucagucuagcuauagguuugucaauuucacucaucuuuuucuuuucuuuuuuuuuuuugagauggagucuugcucugucacccagguggcuggagugcaguggcagcagucuuggcacacugcagccucugccuccaggguucaagcaauucuuguaccucagccucccugguagcugggacuacaggcgugcaccaccacgccugacuaauuuuuguauuuuuaguagagacgagguuucaccauguuggccaggcuggucuugaacuucuuuuuuuuuguuuguuuugagauggagccucacuccguugcccaggcuggagugcaauggugcgaucucgucucacugcaaccucugccucccagguucaagcgauucuccugccucagccuccugaauagcugggauuacaggcacgugccaccacucccagcuaauuuuuguauuuuugguagagacgggguuucaguguguuggcaugacuggucuccaacuccucaccucaggugaucugcccgccuuggccucccaaagugcugggauuacaggcgugagccacugcgccuggcugucuuuuucuuuuuuuuaacccuuaaugcacuguugaucuuuuuaaagaaugaauuauugcuuuuauucauucucucuauuguuuccucuuguccauuuuaucuuuacucuaauaucuaaucucuuccuuauucccuuccuucucuuagcuuuggguguaguuuucuauuuuuuaaauuuuucucuaauuccuuaagguguagaguuagguuauugagauuuuuuuuaauguaggcauuuauaacuauacauuucuuacugacaguucuucaacugcaucccaaaaguuuuaauacacuguuuuuguuuuccuucauuucaagguguuuucuaauuuccuuugugacuucuuuuuuggcccauugguuguuuaaaagugugugguuugauuauuacauaguugugaauuuucugguuuuccucuuguuuuugauuuccaguuucaugguggugguuggaaaaggugcuuuguaugacuuuaaguuuauugagacuuguuuuguugccuaacguauacucuguccuggagaauguuucaugugcauuugagaacaguguauuucuacuaauuuggggugagcuguucuguacauauauguguuagguccaguugauguaugguauuguucaagucgucucuaugaucuucugucuguuuguacuacucauuuuuucgcccaaaguuuuauaaacaagguggggauagaauggguaaggcagaugggugauaaaccauuugugugguuguuuuuuuguuuuguuuuguuuuuugagacagaguuucacucuguuguugcccaggcuggagugugguggcauaaucuugacucacugcaaccucugccucccagguucaagcgauucuccugccucagccuccugaguagcugggacuacaggcgugugccaccaugcccagcuaauuucuguauuuuuagcagagaugggguuuugucauguaggccaggcuggucuugaacuccugaacucaggugauccaccugccuuggccucccaaaguccugggauuacaggcaugggccaccaugcccagccauauauuuuuauauuuguagagggcauuagaauacagauaaccuuuucccacuuaacugauuuucaaaaacauuuuuaugccaauauacucuugugcaaccucauuuuaaauugcugcguaguccauuuugaauuuccgcaagcucauuuuuaauuuauauuauuuauaaacauuuggauuguuuccauuuuuugcuauuaugaauaauaguuugaugaaaauaccuucauguaaguuuuuaugcacuucuuuaauuagcgcuuuaggauaaaguccuggaaguagcauuaugccugggucuaaugguuuuuaagaguauauagcaacauggccaaaaugcuauccagcauauuucuuacaguguuuugaaagagcauuuuuuuucaaauccuugacaguucucaguauuguuuuauuaucaacaaaauaaaaauaauaguaauagcaccuaaugucuauagacuacaugcugugugggaggcguuaaacugagcucuuuacaugcauuauuucauuaauuauuacaacagucuuacggggcaggugcuauuaugauugauggaagaggaaacauagucuuuauuuaacaaaugaaguuaccagcuauaugauuuguaaauauuuucucccauucuguggauuuuccuuuucauuuucuuuauagucccuuuuaaaacauuuuuaaacuuaaauuuuuuauuuaaaaaauuuuagauucaggggguacaugugcggguuuguuacaugguaaugccucaugauguugagguuugggcuucuaaugauccuguugcccaaguagugaacaugguuuuucagcucuuucccccaacucucccucuccacuucuggaauccccaguguuuaguguucccaucuuugugucuguguauacccaauguuuagcucccacuuauaagucagaacaugugguauuugguuuuccauuuuuguguuaauuugauuaggaagauggccuccagcuguauccauguugcagcaaaggacaugauuuuguacuuuuuaggggcugcauaguauuccaugauguauauguaccacauuggacagugggcaccgggguugguuucaugucuuugcuauugugaauagugaugcaauaaacauaugagugcagguguuuuuuugguagaacaauuucuauacccaguaaugggauugcugccauugaaugguagcucuguauuaaguucuuugagaaguauccaaauuguguuccacaguggcugaacuuuaggacuguuaugaauaaugccgcuguaagcaauuguguacagcuuuuuguauggauguguguuuucuuuuuauuguugcuuguuuguuuuuugagaagagucuugcucuguugcccaggcuggaguguaguagcaugaucucagcucacugcaaccucugccuccuagguugaagugauucuccugccucagccuccugaguagcugggauuauaggcacaccaccaccaugccuggcuaauuuuuguguuuuaguaguaugggguuucaccauguuagccaggcuggucucaaaccccugaccucaagugaucuguccaccuuggccucccaaagugcugggauuacagccgugagccauugcacccagccuggauguguuuucaauucucuuuguuauauauaccuaggaguggaguugcugggucauaugguagcucuauguuuaacuuuuugaggagcugucaaacugcuuugcugcccaacuucauuuuacauucucaccagcugugucugaggguuccaauuucuccacauccuugccaacacuuauuaaucucuguuuuuuuuaauuguaaccauccuaauggguaugaagugguaucuccuugugguuuugauuugcauuucucaaauuacuaaugaaugguguuaagcaucuuuucaugugcuuauuggucauuuguauaucuugggagaaaugucuauuuaaguccuuugcccauuuucuaauuggauugucuuuuuauugaguuguaaguuucuuuauauguucuagauacuagacucuuauuagguauguaauuugccaauauuuuccccauucuguugguugucuuuuacuuucaugacagugucguuugaagcacaaccuguaggcauccucccuuucccaaccucuaacacccacaauuuuacucucuacuuagauggguucagaguuuuuucuuggcguccacaugugaguaagaacaugcaguauuuaucuuucugugccugauuuauucugcuuaacguauuguucucuaggcucauccauguugcugcaaauuacaggauuucauucuuuuuuauggcagaauuguauuccauuguguauaccacauuuucuuuauccauucaccuguugauggacacuuggguauuguaaauagugcugcaauaaacguggggguguagguacccuuugauacacugauuuccuuuccuuuggauaaguaacccaguagugggauugcuggauuaugugguauuucuauuuuaaguuuuucugagaaaccuccauacuguuuuucauaguggcuguacuaauuuauauucccagcaacaguguauaagaguuucaucuucucuggauccuugccagcaucuguuauuuuuugguuuuuugauaacaggcauaauaacaggugugaggugauaccucauuuugauuuugauuugcauuucccugaugauuagugauguugagcauuuuuaauauauuuguuggccauuuauaugucucuucugagaaaugucuauuuagauccuuugcccacuuuuuaaaugggauugcuuguuuguuuuguuguugaauugaguuccuuguauauuuuggauauuagucccuugucagaugaauaguuugcaaauguucucucccauucuacagguuaucucuucacucuguugaugauuuccuugaauuuagucccauuugucuauuuuuguuuuuguugccuguguuucugaggucuuagccauaaaaucuuugucuagaccaaugcccugaaguguuucuccuauguuuucuucuaguaguuuuaugguuuuggguccuuaguccauuuugaguugaucuuuguauauagugauagacacaucagagauucuuaaucaugcucuuuaugcuuuuaaagucacucuguuuuacauguauauauugaauuaaggaaucgcagccaugaugugcugggcuagguguguuagcagcacaagcuaaccaacaaagguggggaauauacuguguugugcauuguucagaaagauuuagagugguuugucuuugcagcuuucauuagaggaagugaguaccucagagaagugcuaaggggugggaaacuuaccauuuaagucuauucuuagaagugucugaagcuuuggagccugaaguagagacagaggaagugggaagcuuaagagaguguacaugagaauucagccaguaaacugagacgugcauucagaaaaccuagauaggaauucugguuccuacauuauuuguuugaugacuuugggcaaaucauuuaauuuacuuaauuuugaaccuuauucuuuccucuuuuuuuguccuuuucuucucguauuccacuucgucaauguacaucuuaaaaugugacuuacaaaacuggguccaguacuugugacucugacaagcacaggggauuauuuauuuguucugagggaccucuguuccaguuaaucuuaucugagagugguguuguagguucuuuuucuucuuuuuuuuuuuuucuuggcagcugcaucacauuugauuuauccuuuucuccguugcacuaauuuucuuuguuuuguguucucuaaagacuuaaacaucugugaaaacauuugacugagcaauacucuauguuauuuuuaaagggcauguugucuuugaaaucauagaaauaccgugcagguuggggcugaaaauauggcuuugcaacaagccaggagacgcauuucucugagggucuugaauguuaauggauauacuuuagggaccuagauuuucaauuuccugggaccuaaagucucuuccacauggugucuauuucucucugaaauaggcaguccacccuuuucccuguuucugaaauagagagucuaccauuuucccuguuuuccuggauuagccuuuuguucuacucuguccauuuuuuccuuuucuucauagcuucugcuuacaguuuuagauuccucaagcauauuuaagcuuuccauaccucucauaaucucacuguagccuaccuauaccucaaggcuucuucaaguuuuuucagcuucuacuugcaaugucaucucacuucucaaacuagauuccugagugagagagacgaauaguugagcaccucuuuucacacugggcucauccacuggcucuugauggguggcuguccaugggucagggcccaccucuaaccaccuagucaagucugggcagucagcaucaagggguucacaugaaacccuugagagcagggaucuccugaggaggcgguuugauuuauuauggccaugacuuugccagacacagggacugaguauauguauccaguauauauacucauaucaaauaugcaaggagauuggauuuggguuuggcuugguuguguguguuuugguaggggauggagauuauuuugauuuaguauacaaauacaaguuuuguaggcauucagauagaaaugucuaggcugggaaggcagacccacaggucgggagaguggauguuagagugcuuuauuaaguauuaucuguguagaaauuugaguccuaaaccuacaugagauagcugaguaaggaaguauagggagagaggagaaggccaaaaacagcuuaagaugggauuauaaagagcucccauggaggaggaaagagaacucuacaggagagaucagcaaguaaccaguuuacucaacaacauuauacauuguuuuuagagagaaagauaaaugauucaaaaaaauguuuaaugacuggaauuuuggauguaguucugugguaauaaucuuaacuuacugaaugacuuuugcuauauucuuaccccaaaccccuuccucauagguagaagaagaaauccagacucugucucaaguguuagcagcaaaagagaagcaucuagcagagaucaagcggaaacuuggaaucaauucucuacaggaacuaaaacagaacauugccaaaggguggcaagacgugacagcaacaucugcguauguuuccuugaucauacacuuuccuugggaguguaaaggacacuguugugccuuuugucuggagaggggaagaaaaagaggauaaggaugcuucagcagcuuuucuuuggacgacacggcacccuuuuuuucugauuuucaagugugccugccuuuuuuuguaacuucaauuuuuccagaccacuuauucuaaggaauagaaagaaagcuagccaguuggagaaauaaaauucaaaucccauaaguguuauguauugacuugccacaaauauguacauuuuguccuuuaguacucagaauaacccaguaagaauggguggcaagauaacccuggauaaggaaacaggcucagacaaauuaaguuuucaugucacaaaccucucaaaauguggagugggaauucaaacucaggucuggagccagucuuuauuauuauuauuaauguauuuuuuuaaccuuguuguguagguaucaaaagauucucaggucguagucucagauauaugcucuuggcagaggucaaucccuuaggcuuuuugucuuuuugaccacacaugcuaugauauagcauuaucauaaugcaguuuuguuucccggcacaaggaggagcaagcuucuagcagcagaaaccgaacugcucugucuucuguauugagagccaucugcagagcuggugagcacagaaguuguuuuacaauuuaacuaucagaagugaggccaacugcauuuaacaugacaguacuugaguccccagucuuuugguccauuuucuacccaucuaaguuggcagugggaaaacauacaggaaacuauuuuuucaacaguauuaccaugaaccauguuuuuuuauugguauuugaucuugacaggguaaguaaaaaugccugagcauucuuucccauaaugugggaauuguuuugguagguacgauauuauuuuguuuuuuguuguuguuguugucaucauuuuuuuguuuuugcuuuucucuucucuaaucuccagguagcugggaaggaggugguaaauuauagcuuugcgugauagcagauaccacacuagaauaauuuuaagcauugcauauuuuacauacuuuguugaaaguccaucauguccguauuugguagcucucuaaagacaugcaaaaauuuuuagaaaguaugcccauaaaauguauuuggauaauaaaauacaaauggguccuacuuacgccagcuacuaauugcuucuggcccuuuuuuaggaaaucaaguugacaaaggcaucugaggaauuugauuucauuuuuguuuuguuuggauuaugugagaaaagaacaauagguaugaguucuuucaggccuuugcuuauuuucaucuugguuugaugauuauuuuuagcccuuaccuugacuucuuuggcccugccuuuauaggacucugucuuucuggcuggacuagggcacugcagaagauugugccugagcuuaggguugagcauacgaagauguggugaugccgcucugcugguuaugaaggauuuuagaaguucugaaaaauguuuucucuuuuugagaguucuccagcagguggugaccacugcacuugaaacaauugauauuagaaaagaugagcugacccuucuuuugcucuguguguuuauaauuuaauauaguuacaagaagacaucugaaaccuuaucccaggcuggacagaaggccucagcugcuuuuucgucuguuggcucagucaucaccaaaaagcuggaagauguaaaguauguccucauuuuuccuugcucauuaaguagcugacgcaaauuaaaauguuauuguuguugcaucuguuuccugaccuuggcucuaguugaugcuagcuacuccuguuagagugagggagggcacuccuucaaaccaguaccuggaaggcucaucuaaggucuucuaggccuagcauucuaacaucaaaugaucaucugaugaucauuuaagguuguugaaaaauucugguugugaacuucuuugucuuuuuaguucuucaugaucaugcaggguaaguaugucuuugguugcaaauuugugauugugggcagagccugguguguuacuaaggaugacuacaggagcacugaagugcacgcuucgauucagauuuggcuucacguucuauaugugacauuuuauaucauggugugauuacaacaugcucauuugugcacuguuuuauucuaacugguaagcuguaacuauguucaugcuuaggccaaaaucuugauuuugaguuguugcuuuuuuuuuuuuucauuuagauuagucugcagaguuuuccuugccauuuuuauaaaaccacuucacagugcuuuugugcccccccuucacucauguggauuaggauagugaugaaaaugacaaaugugguuuaagucagcugugcuucuguuggcaugcaagauuuguguuuaaaaaaaaaugcucagauugcauggcuucguguuuugcauuuguggggaaaguguauaucuuacaaccagaauuucuugguugaauagauuuggucaauuuauguguuauacuuuacaccaaaagaacaaauuccucgcucauuauauuuagacugucauugucuaagcauaauguaauaaauauagcuuucuugaacucuuuugacaauuauguauguaucuauuagguguucauuuucucuaugcugacugaauuguguagcaguuuagagcccagggaaaacauuauauguuuaaaacuuagguuauuuaauuguuuuagauuuaucagaacuucuuucuuuuuuaaugcuuacucuggcuucuuacagauugcaagccuuuucacauuccuuuagguaaggagaguuugaaccaucacugcaguccagcaguuguauaagaaaagugugcugagauuagauuaccaugcuacguuggaugaucguguuuguccaguacauaauuuucuugcguuuagaguaucuuuuucucuagugcauuccuaauuucaagggaggguuucuuguauaccauggguaguugauaaauuaaaagaaguauuugacacugugguucaagggauauggaaaugauuuugacauuucuuuuuuacuuuuuucuuugguaaaaagaagcagcuuuaccauggcaugcaaaauuccucccuuuuaaugucugacuuuguuuguuuugaugcuuuuguuucuuugguacuuuuguaaggauguuggaauucuucaccuggguuucauuacacaauuguaacagacugcauauguacugccuccugauguuagucuuccaucuucuauugguuacucuaccuuuuuuuuuguuguugugguaaaauauacauaagguaaaaucugccacuacucugcacuuuuuaauacuuguuuuacuagcuuauaguuuuuaugauuuuauucuuucuuuacacuuguuauauucuuuauguacacaaggcaacuucaugguuugaaaaagggaaaagaauauuaagcuaaaaaaagcacauuaaaaagauguuagcucaaaccaugccuuauagaaagagacuuugugauguugaggaaaccuuucucuuucccaggcagacucuuugauuaucugauuaguuguuggaggaaacuaagguggaggaaagucuuuagaguauaagcaggaaggaugauauaguagucuucaucucuguuccuauggaugcagauuauuuucuuaagcaaucacucaugguagucuagcugcuugccuuuuuaaguaagcaaacagguacuuaaagcuccuaucuuggugacacuuaccccuggaagucagaguaaauuauagggauauauaaacucuaaauguugaacuauuuaaagcuaaaauuaugcuuaaaaaaucaaguaaccaaugauaggugauuguguaucguuggcauucaguuaaaaagugcuauaaguaacugaauacagagccagucacaucacccauucugcuaacauuuagagugucuacuguggacagguuccaugggcauaaccauaaagaacgcauggcuuuuauuagaaugaagcuuaaaaucuuagaguggaguaggggaagaguggggacuugggauaaguuaagaauggaagagccuuaucaguacugguuauaaaauguucgaugugaugcaaacaucaguguaagauauaaaaguaagggcuauugaggaugauguuucuucaguacauaucacuagacuuuucuauaccuuuaaagaauaccuuucuauaccuuaaagccauaccuagauauggcucagugugugcugucuuauuaauucaucagcaacaaauuauguuuugcaacuguuuucuagcuccuuucacagucacuuuguccauuuuguuuaaaaaauauaauuaagauuaugcuguaccauuuucagucuuguuuuuaauaaauauuaaguuuuuaugaauauuuaauugcccaucaguauguagggguuaaaguaagguuuuugauuaaaauuuggaaaugaaagaaaugagauuaucuuuugaaaguuaaacuuuguaauucuugcaaaucacagguuagguaaaggcauuuaaaaaaauaauuucaaggccaagaaguccugauuguguucugauuuaauguguugacacauauaaagaaaaccuacaucuuuuagauuaugugagucacagaggcaaauauuggccacguucccucaagaacuacccaaggaaagggagcuuaggcuguagauuugaguguuacaauuccagcaauaaguccuuuucucccauggagguggauacaguaggcuccuuuugcuaagugcuaugaaguaggugguuaguccuuaaucccacucacuguuuguucuagguccauuuuaccuggcaaacuuaugccggugauuuuacuccuuaauguaauuauggauauagaaggagaaaaugcagcaguuuugccaaccugaauguguuagacucagcaacaguuuuuauuuuacauagucaguugauaaaucagcacuugggauuuagauauuugccuuaugccuugauugaggggagggagauguauaaggaaauagagaagagagagagagagcugcucuugauguccugagaaugagguguggugguagcaaggccaaggaggacguggucaugagugcuguccugggaggcccucuggggcagccugcuuuucccucaggugauaugcuuauauuuccccucuguuugcauauguucuaugccuaugugaaaguauugacucaugccuuuagcauuuugagggaaacuuuaaaagaaccuucucauugcagucagugccaggguuaaacauaaaauuuuaguguuauuaaaagcauacuauaauauucaguagacacauuugucucauauuuuugguauauuuaagaggaagugcuaauuaauuuugccuuuauuuccaaagaaaauuucuccuuuuuaaauguguguuucuucaugugccccuguagauauuuauuugguuugggcucauuaaaguccugcuagacaauucccuuuugcugaaaacuuccaccacuuaaugggaaaagaaaugaucucuuuccucgugucagaaaaagaauaucuuuugauuagaauuugaaacacuuuaaugaacuuuucucuguuucaugcccauauucccaauuuuaguuaucaaaauuguuuauucauuuauucauucauucuuucacucaaaaguauuuauugagugcuaacuaugugccaggcauugcuguagacuauagggguggagcuaaaaaccaaaauaaugcugaaauuugaaagcuucaaugugaaauuugaaagcuucaacgugauaugcuuauauuuccccuccuguuugcauauuuucuaugcauaugugaaaguauaauauacaguagaugcuaauucauguuucaauuaaagcauguguuauaauaauaauuaacauuuauaagcccagcgagacaauaguaccucagaagcagaugcuauuguuuuugauauuacagaugaggaaacugagccauagagagauuaagugacuuccccaagguugcacagcagguauaaguggcugauggucaggacuggaaccgagcacaccuaguccuggagccugcacuguccuccugggccuccccagagcaguggugguuuaagacagugccccucuaggcacuguccagcacuuugaacaauagcugcugugaucaccaacaucaaaagauugugugagggcaaaguggaauaauaguacaucaauagcugugaaaagcauacgugguauauaguaagcaguccaacauguuagccauuaacuuucccuucuccuccucccgcugcugcuacuuccuuccuuauccucccucuacccccuccucucuuauuauuauugagcaugaaagcaucagauaacuguuagaaacaaggaauauuuuuuaaaaaucaauucagcuguuuuaaaaaaaugacuuuuucaaaguaagaguaaaugcagugugagauugaaaaguacuuagugagaaucagauuauccugauuuuuuuuuucaguguuuugaggagcccauguuugcauuccuaguuugauuacagauuaauguauuuggggguuacaaauaagaugcaacauuuuuaacaaaaugugccuuauagaugguaaccgauucuuacaaccuaucuauuagagaugauucuggucccguagcaacaugacuuuuuacuuuugaagguuuccauauuacauuuaagcuugaaugaaacugaaaaugaugagcaaguugaagcuuuguguaacuugccauagagaagccagaaaugaaagaacagccacccuauaguuagauuacaacuaguuaccaacaaaauugaauuucaucuaacuauggauuauggggaggauccagcaaccagauagaauugaagcugaugugugcuccuuuucuuccuacuauaaaauagcuaccauaaaagcagagagaccuugacuuugacucuguuaacugauuuuauucuguuuaauggguauauuuaucuucaagugugauauaaugcauacagaaaagugcucaacaccaaauucauuucagugauuuuuuucacaaaauaaacagucuagucacuuccuugccuuuccuuauauauuaccacugaaacauauuuaguagguacaugcuagguaaagugguauagagcccaaccgauccacugcuggaggaagugauauuguacauggguucuuagggacagugacuagaauuagcugugaaauucugaaauuugcacuuacuuauccaccuguuuccacauuuuguugauacuaccaaauucaauguguggguccccgggacaaggaauuuaucacauauuuggccauuaccuucuuuuucagcgauuucugccaaaaugaauguccuaaugaagaguuuugauuauuaggaacagaaagcuauguaacuuuuagcucaccuaaaaagaagaauguguugcacaaauacaaaguuuuuuuguaauucaaggagagaaaagaaagcaaggccaggcuccacccaaaccagcuccaucaacugggaaauugaaguagcuucuauuauugaaaccaagaaaccuauuccucuuccauccugcuggauucccugcaugaucaccucuccugaccucaucugcucuaccucucugugugcuuauauucgauucuuucuuugggaacugguuuccucuguguucugucagcuuucaccuggucccaccagauccucuucaacaucuaaguguccagcagcuuaguguccuaauuacaauaugcuaggauaagagucuuaauugucuucacuccuucauuuuucauacauuccaaacaauuuguaggccacugggagguuagcagugguggguggugcuccacugauccaccuaucauaucaguuaugguagaaggugguuuguggcaaugugacuauuccaggcagcuucagcagaagggucugaggaagaacaggugauacuuagaguucugguguuguaaauuuagagauugggaccagcacacuuugauagauccaaaguaggaaaagaauuaucaaauuccucccagaauagauuauuauacucuuauacccuagguauugaccaccauuguaggauagagagaauacugaguuacaugcaucuuuuccuguuauguaagacaucaaguacagagguguuuaaauauuucauugauaauccugauuacacagauugccagcauauuugacauauaucacaaucauucuccauguuaucagauauuaaugcaaaauuagauuugaggaccuacauugaagacacguuaucauuuguaccaaaugagucuuuaagaaaaggaaaucauaagcgcacaaaauauuuaaauauaacugagaauuaauaccuugaaccuauacacuuuacccaaaggaaaguuuauuuaccaaagucgugccaguggucaaacuauuauaagcauaguaacaauauuagcagaauacaaucauuuuacgagccuaggaaugaaggcacucucaucucaugagguggucuuuaugggagauggcuaagaguagguaaccuugaaccugaguggucagugaacugcauuguccuugagugggcaguugccuccuugucuuacuaagagcccuucccuggccuugcuuguguguguauguguguaugugugugugugcaugcuucauuuuugaggggaggcgauaaacacugaauuagacccaaguucuauucuugauucugcugugaccuacgguaacucauuuaacaccuauaugccuuacagcuccgggugaaagcacuuuaguuuucaaagugcuguaaaaaugcaaggugguauuguuagcucuaguaacuccugggaauuaauuggcuccugaauaaaaguaaauuauguuggaauaacuuugauccccuccaccucaaaaaguagguaauucuucauggcgccaagagaauaaagcuccuggggagcuaaguuuugucagcuuuuaauaauguugaagcaccacuauacuaaccuuauuucuaucucuuuuuaaugcugccucuuaguauacguuccauucagcauucaauuagcaugccugcuaugagguaaaguauauuuuuaugaaauguaguuggucuuaugcuuuauuuuucuuuauuuagauguuuaacuugaacuguucugaauuagggaacuagaauuccccuugaaacaagcuguguguuuaacacucuaucaguuuucagcuacacuuccucugauguugggaugggugcaagagauccguuaaauguuuugauuuuguuuuuaaaaaaauuauuucuauuuuauuuuguaaaaccuuuguuuccugucugaaaucuguucacaaagugagcacuacuuguuaacaaaccuucuuuugucccgccaccucugucugcauucgcuuuaguuacauucuccuuuucuucauccuucccauuuucacuucccccaucccacugugacauuuggagccaacuaugauuuaauucuacuaucugcuuucauuagcacuugcaagugauauuaccucaccuaaccucucuagagaguuagaggauuuuuaacaaucugugcuuggcuuaaacuuaaguguccaucaaaaucacuuggagugcuugugaaaccgcugcuugcugggccccaccucuagagccucugauccuguagaguuggggugggaccugaaaauuggcauugcuuaugacuuccugauagcugcagcagcagcuggucuggggcccacacuuugagagcuguuggcuuaacuguucugccaucaccaccgugggaaggaagaaaccccuuuuccuuucuuugcauuuuucaucuugguaguaggaaggauauucaaggucaguuggauaggauaacagcauuggaaacccuguuuccaaagcgccuuugugagagacaaaggcgcuaugauccuccuuaauuaauauggauagaugugaauguaacauggaugaaugaauguccugugggcucagcgugcucuccucauccuuugggacagaguugugaaguaggcaaagccguuucuaugcuucucccccuucuuuuuggucccugcuuucccagucuauuaugcugcucccugauauugaaccucauaagcuugucccacuuaggugauguguguucauguagaaauucugccagggaagaugugaaucaaaauagggauuuuagagcguaguaccuuaaccaaaauuaaacugaucuaaugguggcauuuucuuguaccaugacaaguugguuggggaagugacagaauugcuauuuuacccggcuucguuaccucuccuuacacacguacuugaccauaucuauauuacuuaugucugagacuggcccuguucauggaaucaaaugcauacucuuaaaauauuagaucagaaauugagaaucuuacauuauaaauacuuguauguaccugcacauauaugguacagauuauaucuguucuuuugccgauugagaauaauguugaagaggaaucaauuauauuuucaaacuaguuggauuuuuuuucaguauuuguauuuacuauuuguuuuucuuuucucuccauagaaacuccccaacuuuuaaaucauuugaagaaaaggucgaaaacuuaaaggcaaguagagagaugaacagggucuuuuugauacauugccuggugucuuaauuaacuuugcugugcgaaaaucauugacauuaauauuucuuucuaaaaauaucuaaagaauguaaauaacuuuacuccuuauguuacuaguggacauuuaagguguuauguacuuaauaucuuuuuaguguaugcuguaguguggcagcaugccacaugcugaaaggaaauguacaauuuacaaagaaauggcacuuuagaaauuugugcugcuuuuugcuuuauucauuucaaguaccuuuguagguggacaaaauuuaauauaacuuucuugucaacaauuaacaagaauauaggaagcacaagaaagaaaacaaaaaauugguccuaccacucagacagugauagauguaugugcuauuaugcuguuacgcuuuaaaaaagaaguagccauacaucauaaucauuuuccuguaucaguaaguauucucuuucaauauuaugugcaauggcugcuuguauauuacuuuuuuuuuuuuugagauggagucucacucuguugcccaggcuggagugcaguggcgugaucuuggcucacugcaaccuccacuuccuggguucaagcgauucuccugccucagccucccgaguagcugggacuacaggcgcgugccaccacacccggcuaauuuuuuguauuuuuaguagagaugggguuucacugugucagccagaauggucuccaucuccugaccucgugauccgcccgccucggccucccaaagugcugggauuacaggugugagccaccaugccuggccuguauuaccuuauaauggauauuauuuguucaguccucaauuguuggacauuuuuuuuauuauaaugaugccaugaugaucguuuaugauucacuguuuuuauuuuuugauuucuuugauuuuaguggaggugaacauuuccccauaauaaugagcuuuauugauuuguaaauuauauuaucuuugagauuauauucaaagcuauaaaaucaucaacucuuaggaucacaggcaaccucaaaaguugucuaguucccaucuauuccucgacccucucuacggaguuuguauaaaacccauauuuucauuacuuccuaacucugauaauuauaggggauauauuuuaaggauuaaaacuaguaucuuaaauguuuuuauaucagucaguuuaaaaacuaauauucaguuuagucuuucagaacuuugagucacgaaaugcaucuuuaaaagcaggguacauuuauugaaauaaaacacucuacagugaucuggaucuuuuuuuaauuuauuuuuuuauuauacuuuuaaguucugggauacaugugcagaaugugcaggcuuguuacauagguauacacgugccacggugguuuacugcacccaucaaccugucaucuacauuagguauuucuccuaaugcuaucccuccccuaccaucccacccccugacaggcgccuuggugugugauguuuggaucguuuuuuuucuugaacauacaaacguuaguacauaccuuuucuguuuguaugcagacauaugaauguuuuuucagaagaggaguuacacuguacacacacaguccuacagcuuauucauucagcccucacuagcagggugcuuugugagccauaaaugcagggaccuguucuuuuuggucacugauacuucucaaaggcuuagaacaguucuuggcacauugcucaauaugcaucugaugaguaacaauauauauaagagucauucuucuaugucauuucaagagaccugcuuuauuuuucuuagugccaagucauauauuugaaagcaaacuguaguugcaggaagucaaggauuacuaaaauucaguucucaauauuguuaggacuguuauagccuuuccuugaaaucugccccaaguguuaauuuuugaaauggcaaauuggaaaaccaggaaucuuauguguuuuugacauuggacaugaggagaaacuuccaggucauucacuauauacucuccugaauauauuuagauucuauaaauuguaaugaagucugcuuuaaaauaugacuaggcaccauucagauuaaaaaguguaauuuaaaaacauacaauauguuggcugggcgcaguggcuuacaccuguaauuccagcacuuugugaggccaaggcaggcagaucacuugaguccaggaauuugagaccagccugggaaacauggcaaaacccugucucuaccaaaaacgauagaaaaauuagcugauguguuggcauacaccuguagucccaccuacucgggaggcugagguaggaagaucgcuugagcccgggaggcagagugagcagcgauuaugccacugcacuccagccugggugacagagccagacccugucucaaaaaaaaaaaaaaaaaaaaaaaaaaaggauagcguauuaaacagauaccccaaguauccuaaggaagcuguaaaauuacaugcuggggauauaauuuuguuaaauuacauuuauauuuaauuaaacaugagguccauuuagauuuuggguugauucauucaucugugauuacugagcauuugccaugugccagucaaucaguauuaggcaccagaguuaccacagugagcaagagagacauggaccccuucugcaagaugccuagacaauuaaauggccaaugaaacuaaagugagguaaggguucugaugugaaaagcugagggugugaugaggacaaguggcagaaaguucaccuggcuugguggaagggaaggucagagaagaccucuuagaggacucaguaauguccauugaggauuuuagguugaagggaauguuugaaguuugagggcccuuuugaggaccaccaagaacuucacugugcuguaggauauugagcaggaggugaagcuagagagauguguaggccacauugcagaguuugaacuuggggcaaugggaagccauugaaggguuuuaaacaacccaaguggugcauucuucuguaaauguuagagagaucaguggcugcccugcacaucaaaggggagaacgauuggagacaggcagauuagauggaaggacggaguuguacuccaagccaaagaugauggagagugaauuaaguuagugcaaugggaccaagucuagagcuauuuagaagugagaagugacacggaaaaaaaaaaagauugauuggauguagaacaaguuggauaagaauccaggacaaccccaggugucaggcuggggcagcuagguaggugcuauugccauauaaaguguuaaaaaagaauagagaaggggcuaguugucgggggaaggaguucaguuuuagacauguugaacugcaaggagauuugauacuauaauuaaggaauguguuuuaauaaauuuaauaaacaaugaacacacauuauucgcauuucccaaacaauuuggaugguagaucaaaaagaaugagagugaaaauaaggggucugugaccacucaauuaagauugagcuaagagcaaggucaaguucaaacccacuauaagcuucuugcauccauggucacugacuguuuucuuacuguuagcuguccuguuggacaguguaacagugagagagcauauacagauuagcauugaaaaggauaaagugacauguguaaggguuuugaaaaaguauuauacaaaugcaaggcagauauauugaaauaaaugcuuauuggcaaaauuucaggccagauagguuggaguagugcuucacaaacuauaaugugcacaugaacaacucagggauuuuguucaaguguugauuucaauucuguagcuggaguugggugggguagaaaggauaucugagauccugcauuucuaauaagcucccagguaauguugagucuguagguccuugaaccacacuuuaaguauuaaaggguuagaaagcuuauacuguaacugagaaaaaaacauauauuucuuucccauguuguauucaauauuucuugaaugaguguagcuaaaugagcaauucgaugcaauacaaaauguuaugcaaguguagagacagacaguucacuagguacuuuaaaauaauagaccuuacaaaguuuucuagacagacuuccugugaagaacaaggagcagggggaaaggggaagggguagaauuuaccaaucugaauauuucagcaagggagaaugcaugaguuuuacuauaaaaccacacugaacauugcaacaauacuaaauuccauacauauauaauaaucacugagcuauaagguugcugauguauuuguucuugaaagugaauuagaguuacuuuaugcagaaucagcuaguuuuauguuucauaaugucuuucccuuuuuugaacuuuuuuuuaagucuaaaguagggggaaccaagccugcugguggugauuuuggagaagucuugaauucggcugcaaaugcuagugccaccaccacggagccucuuccagaaaagacacaggagagccugugagauuccuaccuuuguucugcuacccacugccagaugcugcaagcgagguccaagcacaucuugucaacaugcauugccaugaauuucuaccagaugugcuuuuauuuagcuuuacauauuccuuugaccaaauaguuuguggguuaaacaaaaugaaaauaucuucaccucuauucuugggaaacacccuuuaguguacauuuauguuccuuuauuuaggaaacaccauuauaaaaacacuuauaguaaauggggacauucacuauaaugaucuaagaagcuacagauugucauaguuguuuuccugcuuuacaaaauugcuccagaucuggaaugccaguuugaccuuugucuucuauaauauuuccuuuuuuuccccucuuugaaucucuguauauuugauucuuaacuaaaauuguucucuuaaauauucugaauccugguaauuaaaaguuuggguguauuuucuuuaccuccaaggaaagaacuacuagcuacaaaaaauauuuuggaauaagcauuguuuugguauaagguacauauuuugguugaagacaccagacugaaguaaacagcugugcauccaauuuauuauaguuuuguaaguaacaauauguaaucaaacuucuaggugacuugagaguggaaccuccuauaucauuauuuagcaccguuugugacaguaaccauuucaguguauuguuuauuauaccacuuauaucaacuuauuuuucaccagguuaaaauuuuaauuucuacaaaauaacauucugaaucaagcacacuguauguucaguagguugaacuaugaacacugucaucaauguucaguucaaaagccugaaaguuuagaucuagaagcugguaaaaaugacaauaucaaucacauuaggggaaccauuguugucuucacuuaauccauuuagcacuauuuaaaauaagcacaccaaguuauaugacuaauauaacuugaaaauuuuuuauacugagggguuggugauaacucuugaggauguaaugcauuaauaaaaaucaacucaucauuuucuacuuguuuucaauguguuggaaacuguaaaaugauacuguagaaccugucuccuacuuugaaaacugaaugucagggcugagugaaucaaagugucuagacauauuugcauagaggccaagguauucuauucuaauaacugcuuacucaacacuaccaccuuuuccuuauacuguauaugauuauggccuacaauguuguauuuguuauuuauuaaauugugauuguuuuauuauuguuuaugccaaauguuaacugccaagcuuggagugaccuaaagcauuuuuuaaaagcauggcuagauuuacuucaguauaaauuaucuuaugaaaaccaaauuuuaaaagccacagguguugauuguuauaaaauaacaugcugccauucuugauugcuagaguuuuuguuaguacuuuggaugcaauuaaaacuaugugcuaucacaugugaaaagcuuaauaaauuccaucuaucaguaguauaggucucaauauuuauuaugagaccaguggucuggaaacagcuuguuguaccgaaucaacuggagucuaugcuuaaaaaaaaaaaauuuuuuuuuaaccauccuuaaauuauugcuuaaugguaucauauuaacauauucuaaauaagggcuuuaaggcacaggcuguugaagcauuuucucagaggaguggaucuguagaagucugucuuucuauagaaauauugugcuuacucaaguguuaaauuauuuuuucuaugaacuagucuacuucuuaaaauucaaacauauucuuuugaucacauuguuucuugagcauccugcccugcuacuaacuuuucaacaaggcaaaauggaguaaaguggcaauuucuuuagaugagugaaauacccucaagucucuuuucugcccaaaaagggaaaagugauagaaauggggguggcaaguggggugaguggaugaagguggguauuggggguggcugugaaagaaaauaauggagaaucacuuuucuagacaucuaccuauacuuaaucuaagaaacaaaguaaucuacuguaaaguacucugccccuugaaagaaguauuaaaaagagugaggauggauuuagaaaaaaacaugaauuuagaaauauucaaaaugguuuuuguggcagauucaauauuaugaauucacagauauuuaaagaaugagaaacauaguaauuaguagaaaugccagaaacaguuccugguuccucuuguguuugacacuaagaaaauagcaagagugugaaaucucagauacuuaugaaaucucacagauguaaggacucaaguguagaagaaaauauccccuucuuacaaaaagaaaugucaauuuauggaguuugugggaaauagggcaagaauucuuaugcuuaugagagccaaguagucaguggaagagaguagagcucaaaacuggauuaucaccuuagcaacuuagaauaguuugaaauagaaaaaaaguauuuaauuuggaucuggaucuguuaagauaugcacagucuauuuuuuguauaguauuggaaaauaaaaaugcuauaauuuggguauggguucuuuuguauacauuaccugcccauugaggaaaggggcaaguccauuaugcaacuucucuccaaacccuucauauucuggauaugauacuuaaagagccaugagcagcuacauucugccuaucagaaggcauuuauuaaaugacugcuugcugaagauguguccaaagagauccuacauuaaggucauuugucagaaugauguuuguguuuguuuagaguuggcugaccuccaacuccuggggucaaggaauccuacugccuuagcuucccaaauagcuaggacuauaggcaugcacccggccauguguuuuauuuauagcucuuaaagcccagaugaagaaaucacauuuuugcccauagugaagaaacauuuggccauugauuaguccuuauuuucagugacuguccuguuuucauuagauuagagagacccugugugggccacaguuaauauaaaccauuaucacuuuuaaguaaaccugcacaucuuagauuucauaauuuccuuauuguucugacucaaaaugaacuaagagcuuuucacuuuuuguuuguaaguucucagagagucgggucugcaagugcuuuugccugccaggauuuuguacucaaauaaaugcuauuuggcaacuaa
